United States Patent 10,329,575 (REGULATORY SEQUENCE FOR PLANTS) - sequence listing, part 18

SEQ ID NO: 27983 - DNA, 3003 bp, Unknown
  misc_feature (1)..( 3003): 2750-1469P.txt file - cDNA_ID_2993328; gDNA_ID_1620626; Annot_ID_162469
gatgcaccgggaaactgttcccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatggaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatg

SEQ ID NO: 27984 - DNA, 3000 bp, Unknown; identical to SEQ ID NO: 3106
  misc_feature (1)..( 3000): 2750-1469P.txt file - cDNA_ID_2993331; gDNA_ID_1620626; Annot_ID_47135

SEQ ID NO: 27985 - DNA, 1826 bp, Unknown; identical to SEQ ID NO: 13455
  misc_feature (1)..( 1826): 2750-1469P.txt file - cDNA_ID_2993331; gDNA_ID_2214627; Annot_ID_135997

SEQ ID NO: 27986 - DNA, 90 bp, Unknown; identical to SEQ ID NO: 6826
  misc_feature (1)..( 90): 2750-1469P.txt file - cDNA_ID_2993351; gDNA_ID_1621108; Annot_ID_56012

SEQ ID NO: 27987 - DNA, 3003 bp, Unknown
  misc_feature (1)..( 3003): 2750-1469P.txt file - cDNA_ID_2993353; gDNA_ID_1620619; Annot_ID_46973
tgaactcattcaaattgatgttattgtgaaagaatgtgactggaaaaacagactcgaaaatttgatctttaccactttcacagtcagaagtgacactccattgtcagccagttcatcttcatacaaaactacctgaaggagtagagaataagtacatcaaagggcccagaaaaatgtgtgtttgagtttgtatcgataaggtgaccaacctcatcatagaagagaataggttctttaagtgagagagcagccaaatcaatctgatcttcacagttctcccactgaagagtagcttccccctttggattagcttttgcctcaacctgcttcacattaaaaaagcatacagcaatgagcatgaaagtcacacttgattgattatcgtgtgacagacagaaaaagagtgaaaatgagagcaaggcgaaccgtttctttgtctttctcaactacttcacttccacagtatggcgttgtaaacgtgtaatcataatctagtatcacctgctgagacggcttgctgcaagtagatcagagtggtatcagatacaactatcaagcaaagcttccctattgaaaagaataatatcttttgtgatatatttttcagtcaaatcctgaaacttacctcctgaatttccattgtgctgcagcaggaacttcaacaggtggaagcccttcctgcttccaaccagctagtgcgtcaaacgcattaaaatgaatcttagtgttgctacctaagtgtttaaggactaatgcattctcgccaaaaaccatttcaggtaagtgagatgtcttaagctttttttcccacctgtgttacaatcaaacatcacattcgtgaatctcagaagatgctatttacatatttgagataaacagagagctataccaggaaatgtgatgagcagagatcggaacaactaaaatcagtaaccacaaaaactaaaccaaagcaaatacgattttgattttttcacagaatagatcatacactccaccaaaaactaggaaaaactcgaaatcaaggacacaattctgatttccttcgatacgttccactaatacggtgtacacgagctcaaaaacccaaactacactactcagttcatcaaattaacgacgagcacaaatacaaaaccgtaaacacaaatatcacctacaagtaatcacagacaccaacaaattcatcatatatgatcgtatcttatgaggtgagagagatagagattaagtactcttcgacagcgagagaagtgagaatcgtgccgcggagggtttcgatctcccagtcatggatgcgtaaacctcgacgtccgtcgggaagaagctcagccccggaagacttcagaacatctttatcgaccaccgtctccatctgaatcgccggctaatattggcactaccttttctcctccgacgatgtcacttgtgtgaccaaccggactatccaaccaagacatttgacttttgatgggccggcctagtttcattttagtttgaaaaaagaaggtcaatttgattttggtccttaatgggctttaagtttataacgtaggcctttttcataataatgtaatatagctagaatttcatgcttttggaacacactataaaaaaggtcaatattcaatgtttcttttttcattattagtagatttggctaaataaacctctagaggacctagaccaggtttgaaacctgacatggtggaacaccactagcccacttgttctctcaagctcaataatatccatataaatcatcaaaagatgaatcaatcacaaaaattcacaactaatttgcacgatacacctcatgaacaaaatattcgtcgtcattgccactattaacgattcaaagtggtaaaaaaatcaggaagcagtgaaaggtgaaacctcatgaatctctagactctaatgcataaacatatttcattatatatcgtagtagaatactgagacacattgacatatataagtatcaaacagaaattgtataatggtatctttattttattaacacatgtgtgcgtcaatgtgaatcagatagaattagacacactatctttttaatatttaaagttggagccgttttggtcaaaactaatttatgtgcactactcatttatttataggttttttaaaaacacaaaaattgtgaaaaagcttctaagccaggtggcgggttttggtgcaaagtctttgatatgttcggagttgctgcttcgtagagaaaaaacttttctgataacatcggagtaaaaggaaagtaagtcggagtttaatcatcttaagatttgattgaatggctacgctcactgaaatagcaacccttgaggagaagtgagttttttcttttcaccttctatttctatgtgtatatcttatctactcttttgaaattaagacagaaaagttagagatgtgttcgtaggattgggtttttgtctgaaagactgaaactttgtaaataccttttcttaaaattgatgagtttggaggaacggtttcagtaaattaggttgtgtttcgattctgttgtttttgtcggtgttcttcgtgagaatttgtctgaatttctgcatcttcctttgattgaggattgttttttgattctgttctatagcttttgctcttaaggaatcaaagaaggcaagtttttttgtcaagtcatggctttttttctgtttcggggtgcttattaatttgtttaattctgggttatttagttataatgtgtgctaagtgattcctctactagtattcaagttaatggatttgattcatctttggttttaggtatatcgaattgtgcaagatgcatggaatcctacccaacactgccattttatctgctttctttgaggtttgattactttttccttgtccagaagatctgtttagcttaatcttagtgttagtctgagtataaactacgattgaacctgatcaactgaattttaggcggaggttaaaaagtcaaggaatcaaagatgcattatg

SEQ ID NO: 27988 - DNA, 3003 bp, Unknown; identical to SEQ ID NO: 27987
  misc_feature (1)..( 3003): 2750-1469P.txt file - cDNA_ID_2993353; gDNA_ID_2926207; Annot_ID_141777

SEQ ID NO: 27989 - DNA, 3003 bp, Unknown
  misc_feature (1)..( 3003): 2750-1469P.txt file - cDNA_ID_2993357; gDNA_ID_1620628; Annot_ID_47191
cttctgttacttcgacataacagagattgacggcgtcaacaccaacgagctttacaatgccgtccagctttacctcagctcctctgtctccatcgcaggtaaccgtctcagcctcacacgcgccgtcaactcctcctccgtcacattcggtctctccaacaacgactccatcgtcgacacgtttaactccgtcaccgtcgtctgggaacacatcgttacacagagacaaactcaaaccttcgcttggagaccaatgccggaagagaaacgtggcttcacgctccggatcaagaagaaagacaagaacttgatccttgattcttacttggattacatcatggagaaagctaacgagattcgtcggttgaatcaagatcggcttctttacacgaattcacgaggtgggtctcttgattctagaggtcttccttgggaatctgttccctttaagcatccgagtactttcgatactctcgctatggatccggttaagaagcaacagatcatggaggatcttaaagatttcgctgagtgtcaatctttttacgagagaactggtcgggcttggaaaagaggttacttgctctatggacctcccggaacagggaagtcgagcatgatcgccgccatggctaactatctccggtacgacatctacgatcttgagctcacggaggtcaaaagcaattctgaactgaggaagcttctgatgaagactagctccaagtcgataattgttatcgaggatattgattgttctatcaatttaacgaatcgtaacaagaaacagagcacagggagctataacgaaccggagatgttaaccgggtccggtttaggtgatgatttgggtgatgggaacactataacgctttcaggtttgttgaatttcactgatggactttggtcttgttgtggtagcgagaggatttttgtgttcacgacgaatcacattgagaagcttgatcctgcattgcttagaagtggaagaatggatatgcatatacacatgagttactgtacgttttcttcggtcaagattttattgaggaattacttggggtttgaggaaggtgatcttaacgacgttgttttgaaggagttagcggaagtggttgatagggctgagattacaccggctgacgtaagtgaggctttgattaagaatcggagggataaagagagagctgtgagggagcttttggttgatttgagaagtagagtggagagaaatgagaagaatgggaaatcgagggttcaaaatgtgagcttggaagagcaagagaatagagctttcgacagtctttacgcagaagagaatggaggagaagaagaagagattgaggataacatttgcaaaagtagtgatgattgttcttaattaggttttctaacgtttctatgttctacacaatgtgaaagttgtgtgacctttcttatgtttctccttttttgggtagttaactttttgaagtaagccaaagtgaagaagaagaaggagagaaaatagaaaagaggtagagagttggttaaaataagcaagtggtggtgattaagatttttgtatgtggcgatcgggaaatgcaaagagattcattggttaccattggcatatgatttggtgttactataaatttataatagtttcgttacacttttgacatagaattccatattattttttaacaatagcatccaattctttttaaaaagaaaaacttgtgtgtttttagagggtacggttgtctttcatcttcaccaacattggataagatcaatgcattccttgtcaatttttaaagtacaaaaaacaggacaaattgtttagccttaagaccaaacactgaagttgacatgttttgtttgtttactggattttcttagcattgtggactttctagactcacccgtttgaaattgtcataatatggtgtcgtcgcactgtctcttatatatttcttactttattcgcaatataaacaacaaagtctatgcttatgtcaattggtcaatctgtccatcgactctattaattgagttatgagtgtattgtgcatagattaataaaaataatacagtgagtatgttatggatagatgtggatctctctctctagtcacattaccacaaagagaataaagagttgaagtttccgaaagagataaaacaacaaatgtataatgtcgtgaaataataattgtgtagaagaaaatatcaaaaaggaaagattttgatattaatacctttttatggattcggtgagaaattaaagaaagatttgattaagaagtgagttggaagtgatgcatgtacattattaggcttttgtcggaaaactataaaaaagacttcttaagcccattttaatattcacttttttactttctttcttttttgcattgcaattttccattgtagtttaagatctgaccctactttgtatatgattcgaattatccattgtttaagataaaactaatagaaatcaattcgattgtccggtgagtaaacggctcttcgctaacagaaaaacctaacttgaatagcttgagtcaaaacaatctaatttttaaatagttcccaaaattttatcttaaattactcgtaattacactagcaatccaaagtttatttgttttaataaaaactattttgggtcgtcaaaatggcccataaagcctaattaagaagacccaatcaatttaaaagcccaaatcagtgtgacgtataatatacacgtcacacgtcaattctcagcgtcgttaaagtatgttaacaactccgacaagattcgttgctctaagaatcccattccgatcttccaataagattccgatctccattgctccctctcccaaagtttttcctcggaaaccagttatcagagttccagcaagtctccgatttgtagcgacgatgtcgacccctgccgccgccgtcaacgccaccgtcacagtcaccgatgccggcagaggatcgatcactcacgtcatattcgacatg

SEQ ID NO: 27990 - DNA, 3003 bp, Unknown
  misc_feature (1)..( 3003): 2750-1469P.txt file - cDNA_ID_2993357; gDNA_ID_1620628; Annot_ID_162567
ttttcttctctcaccttgttttagccgtaaagtaatcaccttttcaacttctcaaaagccctctgtttctctcatctccctctctctgacgatgaaagagtattggacatctttggcttctctactcggcgttttagccttttgccaaagcctaatgaattctgtattcccaccagagctccgtttcgccatctcgaaactcttcaacaaattctttaaactcttctccaccttctgttacttcgacataacagagattgacggcgtcaacaccaacgagctttacaatgccgtccagctttacctcagctcctctgtctccatcgcaggtaaccgtctcagcctcacacgcgccgtcaactcctcctccgtcacattcggtctctccaacaacgactccatcgtcgacacgtttaactccgtcaccgtcgtctgggaacacatcgttacacagagacaaactcaaaccttcgcttggagaccaatgccggaagagaaacgtggcttcacgctccggatcaagaagaaagacaagaacttgatccttgattcttacttggattacatcatggagaaagctaacgagattcgtcggttgaatcaagatcggcttctttacacgaattcacgaggtgggtctcttgattctagaggtcttccttgggaatctgttccctttaagcatccgagtactttcgatactctcgctatggatccggttaagaagcaacagatcatggaggatcttaaagatttcgctgagtgtcaatctttttacgagagaactggtcgggcttggaaaagaggttacttgctctatggacctcccggaacagggaagtcgagcatgatcgccgccatggctaactatctccggtacgacatctacgatcttgagctcacggaggtcaaaagcaattctgaactgaggaagcttctgatgaagactagctccaagtcgataattgttatcgaggatattgattgttctatcaatttaacgaatcgtaacaagaaacagagcacagggagctataacgaaccggagatgttaaccgggtccggtttaggtgatgatttgggtgatgggaacactataacgctttcaggtttgttgaatttcactgatggactttggtcttgttgtggtagcgagaggatttttgtgttcacgacgaatcacattgagaagcttgatcctgcattgcttagaagtggaagaatggatatgcatatacacatgagttactgtacgttttcttcggtcaagattttattgaggaattacttggggtttgaggaaggtgatcttaacgacgttgttttgaaggagttagcggaagtggttgatagggctgagattacaccggctgacgtaagtgaggctttgattaagaatcggagggataaagagagagctgtgagggagcttttggttgatttgagaagtagagtggagagaaatgagaagaatgggaaatcgagggttcaaaatgtgagcttggaagagcaagagaatagagctttcgacagtctttacgcagaagagaatggaggagaagaagaagagattgaggataacatttgcaaaagtagtgatgattgttcttaattaggttttctaacgtttctatgttctacacaatgtgaaagttgtgtgacctttcttatgtttctccttttttgggtagttaactttttgaagtaagccaaagtgaagaagaagaaggagagaaaatagaaaagaggtagagagttggttaaaataagcaagtggtggtgattaagatttttgtatgtggcgatcgggaaatgcaaagagattcattggttaccattggcatatgatttggtgttactataaatttataatagtttcgttacacttttgacatagaattccatattattttttaacaatagcatccaattctttttaaaaagaaaaacttgtgtgtttttagagggtacggttgtctttcatcttcaccaacattggataagatcaatgcattccttgtcaatttttaaagtacaaaaaacaggacaaattgtttagccttaagaccaaacactgaagttgacatgttttgtttgtttactggattttcttagcattgtggactttctagactcacccgtttgaaattgtcataatatggtgtcgtcgcactgtctcttatatatttcttactttattcgcaatataaacaacaaagtctatgcttatgtcaattggtcaatctgtccatcgactctattaattgagttatgagtgtattgtgcatagattaataaaaataatacagtgagtatgttatggatagatgtggatctctctctctagtcacattaccacaaagagaataaagagttgaagtttccgaaagagataaaacaacaaatgtataatgtcgtgaaataataattgtgtagaagaaaatatcaaaaaggaaagattttgatattaatacctttttatggattcggtgagaaattaaagaaagatttgattaagaagtgagttggaagtgatgcatgtacattattaggcttttgtcggaaaactataaaaaagacttcttaagcccattttaatattcacttttttactttctttcttttttgcattgcaattttccattgtagtttaagatctgaccctactttgtatatgattcgaattatccattgtttaagataaaactaatagaaatcaattcgattgtccggtgagtaaacggctcttcgctaacagaaaaacctaacttgaatagcttgagtcaaaacaatctaatttttaaatagttcccaaaattttatcttaaattactcgtaattacactagcaatccaaagtttatttgttttaataaaaactattttgggtcgtcaaaatggcccataaagcctaattaagaagacccaatcaatttaaaagcccaaatcagtgtgacgtataatatacacgtcacacgtcaattctcagcgtcgttaaagtatg

SEQ ID NO: 27991 - DNA, 3003 bp, Unknown; identical to SEQ ID NO: 27989
  misc_feature (1)..( 3003): 2750-1469P.txt file - cDNA_ID_2993357; gDNA_ID_2926188; Annot_ID_140870

SEQ ID NO: 27992 - DNA, 3003 bp, Unknown; identical to SEQ ID NO: 27990
  misc_feature (1)..( 3003): 2750-1469P.txt file - cDNA_ID_2993357; gDNA_ID_2926188; Annot_ID_200777

SEQ ID NO: 27993 - DNA, 3000 bp, Unknown; identical to SEQ ID NO: 4214
  misc_feature (1)..( 3000): 2750-1469P.txt file - cDNA_ID_2993367; gDNA_ID_1620691; Annot_ID_48601

SEQ ID NO: 27994 - DNA, 3000 bp, Unknown; identical to SEQ ID NO: 4214
  misc_feature (1)..( 3000): 2750-1469P.txt file - cDNA_ID_2993367; gDNA_ID_1620691; Annot_ID_164781

SEQ ID NO: 27995 - DNA, 3000 bp, Unknown; identical to SEQ ID NO: 4214
  misc_feature (1)..( 3000): 2750-1469P.txt file - cDNA_ID_2993367; gDNA_ID_2926159; Annot_ID_139637

SEQ ID NO: 27996 - DNA, 3000 bp, Unknown; identical to SEQ ID NO: 4214
  misc_feature (1)..( 3000): 2750-1469P.txt file - cDNA_ID_2993367; gDNA_ID_2926159; Annot_ID_198629

SEQ ID NO: 27997 - DNA, 3000 bp, Unknown
  misc_feature (1)..( 3000): 2750-1469P.txt file - cDNA_ID_2993375; gDNA_ID_1620745; Annot_ID_49713
aagattcgtcaattggaattgaaacatttcgaagataatggattcgtgtccattttcatctgcactggaaatgaattttgaagataatggattcgtatcagtctttgtgatctgatgccgctgaaattttttggaagtaatgaacaagtttgatcattggttaaatgttttggattagaatttgatttgaatctgtacttttgaagcattctggtttaaatcagagtaatcatcgttttgtttaattgttcagggtgattcacagtcaaatgatccagttgcttacgataatggggtgacttatatgtttgtacaacatagtaatgtatacttgatgatagcatccaggcagaattgtaatgctgccagtcttctcttctttcttcaccgcgttgtcgatgtaagtatggctggtcaattctttagtttttctcttaaggttccatctttttcctggatatttgatgtaatggcaatggtatctgttatctggttataggttttcaagcattacttcgaggagttagaagaggaatcattgagggataactttgtggtagtggtatgttaagcttctgtcatcgctcttttagtactatttcgcaatatatttttctattacttgggcaatcaaaaagatccttaaaattttggaaaagtatttgtcattgttagatgctgaaattgattttttggtgctggcagtatgagctacttgacgagatgatggactttggttaccctcagtataccgaagcaagaattctcagtgaattcatcaagactgatgcatatagaatggaagttacacagagacctccaatggctgtgacgaatgctgtctcctggaggagtgagggaatacagtacaagaagaatgaagtgagtgccattgttttcgcaagataggaatatgtttctgatgtttcggtttgcaaataatgacaacctgcttctttttccaggttttcttggatgttattgagaatgtaaatattcttgtcaacagtaatgggcaaattgtcaggtctgatgttgttggagcgctgaagatgcgaacttacttgacgtatgtcaacacatcaaatttacgatatagttcctaatcagccaaagcatgttaaatcacgtccctttttgactattttgctctttgatccattctattgcagtggaatgccagagtgtaagttaggactgaatgatagagtattgctggaagcgcagggacgagcaactaagggaaaagccattgatttggaggacatcaaatttcatcagtacgtctttaagtttttattatattgaaacttggaaagtcttcactgatcttaacccttctattttctttttgttcaaaaagattatatacttgagttttatgtattctcttcttcaacaaccatttatttaatgcaggtgtgttcgattggcccgttttgaaaacgataggacgatatctttcataccacctgatggggcttttgatctgatgacatatagactcagcactcaggtttgacatgtgggatatagcatctactggaattgttccacgtcttcaacaagtaaatatcatgatttgtttcttttatgttcaggtaaagccacttatatgggtggaagcacaaatagaaagtcattcaagaagtcgtgttgagatgctcataaaagctagaagtcagttcaaggaacgaaggtaaatatattctatggtatttgtgccactttccttttctgtcttactgtcatgcaaagatcctgattgatcagattctttaaacctttgatcacgaacattctttttgtagcaccgcaacgaacgttgagattgagttgcctgtaccaaccgatgcatctaaccccaccgttaggacatctctagggtctgcctcttatgctcctgaaaaagatgcgttagtctggaaaatcaaatctttcccggggaacaaggtataacactaacaaggttcaataaactcttaaattcagttgaaacagtcagcaatgtagactatgtagtatcaatgctaaccttcagaaaaccaatataggagtacatgttaagggcagagttccatcttccaagtatcactgcagaggaagcaactcctgagcgaaaggctcctatccgtgtcaaatttgagatcccttatttcactgtttcagggattcaggtaagcttgtgcttaataataaatggttactgtctcttccacaatgtcatatatataatatatatgttctttggtgtgtaggttcggtacctaaagattattgagaagagtgggtaccaagcacttccatgggtgagatacataaccatggctggtgagtacgaactaagactcgtgtaatgcacatttagtttcatcgtctatgtcaattgtgattcccacatccctcaaggaattgcctgaatcaaagaagcaaaacgaaacaggacaaaagtagagggaaaagaaaacgttttgaaacattttagctgatcaaattttcctttaatttgttttagaagccatattcttgtgaatttgtctttatggtgattctattttattttacatgaggctctctgtaacctttcacgacatggttcattattttcctttagactgctacatttctgtctatgtgttcgttctgcgatcaaaattgttaaacgttgaggttttggttttgttttttggggcattcgtctatgtttacataggtttctctcgagttatgatcaaaatgaaactacataaacaaattatgcttcaatagagtgaggtgagagagccttacaatagagagaacgtatattttggtgtttctcatattgtttaactgatatagtatgggccgaaatgaaataatcgtcaggcccattaaaaagcccataatcaccatactttctcctccaattctgtttcgagcttgggaagtgacagtgaattagggttttactcaaaaaaccttctcgttgtcgttgtttactgctccgacgagaaaatg

SEQ ID NO: 27998 - DNA, 3000 bp, Unknown; identical to SEQ ID NO: 4927
  misc_feature (1)..( 3000): 2750-1469P.txt file - cDNA_ID_2993375; gDNA_ID_1620745; Annot_ID_166642

SEQ ID NO: 27999 - DNA, 3000 bp, Unknown
  misc_feature (1)..( 3000): 2750-1469P.txt file - cDNA_ID_2993383; gDNA_ID_1620753; Annot_ID_49855
ccttcccattacgtcttgacgtggaccctgtccgtctatttttagcagattaatccaacggttcttattctttcttcgacccttcacgacattgcctcaaagccgtccgattctcatctcacgcccaatggaccacatatatcaccagtactccgcaacttagctgtcgtgtaggatttcacgtggcatttatttgttctagtttgtagtgcaaacattgcaagttgatatggtcccctatcgatcaccgtcgtctctttagcttcacatcgagattcttctttctttcctacgtgtaatagcatttttgattttgagaatttctttagaaccgttggatctctcatcgttggttgatccatccatccaaatgggacctgtgtgtgctccatccagggcatatgatcccaaagccaaaagagtatttccaagtgctttctttctttctttctttctttcttactaacctttttttttcttatgctttagactaagaaatttattcggccatatccacttttacgaatatacttcttacaagatctagatttttttgagttaattcggtgtatataacattggcatagactgcaattaagtaaatgataatgtgataatgatgcgatgtgttgttatcaagtagtataatatagatggctaaataggtaaacaaaattacgtgttatatgtacacaattaggtagaaccgtagaaattaaactgaataaaacctttattaattttaaaattatatggtacagataaatacggaaaaacattcacgctttacgtaacaattaagtggaaagtaaaattatcccaaaaatatttatatcacatcattgttatatttctaagttttttttatttctctaatggtatatgttttacagattgttttttgggaaaattcttaaagagacttgaagaatgttttttttttattttcttgaaatgtttgacacttgaaaccgtttaaaaactaaatatagtatatatcattgttggtctcataccttgtaattcaccacatatattatcaatggggaagatttgaaaatttttgggggatcacaaaacgaaggaaagagtacaaaaagagaaggaaaagatagaagatatatgtttttaacttcattggtatgacatcaataaataaatagttgaatgtactttagtttctcttttggtttaatgcacatcatctcgatcaattgtcatcatcttacattgaattatacgaccagatctgataacaagtgaattcgtacttgcccttccctttcttctcatacgtccttctaactaattttgattgtaacttataattatataaccatatttaattttattttatctaaaaccaattgaagcaaattaaaatatcataaatcttgagtcccacatgaagacaatatataaaactcgtgcaaatttgcttaaaatgcttctatgagaccatgaccaagtgagattaataagcgattcaatgtgcaaatcaaaagagaaaagaagctaatgggtttaaatataaccaaacagaataataatgctatgtttagtttttctaattgaatcatacctttgtgtccatcacctacttaccggtcagaataaagcaattacgtctgcaaccaaaaagcactaagactttcggtcagacatgatctctaacatcggacgaaccctaagataaccaaaataaactatatcttatattcaaatctctgtttattttatccatttatgttttctttctttcccataattttttttgtgtctcatcagactctcttaccaaactgaatttatcaacatggttttttttttggccacatcaaaatggtggtttataaagtagactaatacaaaagacatttctgttaatttcactaacaaaaataatcttagcagtactatagattggaaaaggaaaagcaaatctagcagtaagatttatcaaaactagcagtaagagttttagatatcatgaaaacatcacaaacgagtagtgttttactttacatttttaaccaatcacaagggtagttccgtaagttgggaaaatcgtacgaggcttcacctagttaaggttaggtcacatgattccctgaactcgattttataagtaaaaaagaaaaatttataaaatcaaaattttttatataaaaaaatcaggtggatttatcagaccctaccatcgagatgtcgacacgtgtccaaactcattcattgccctactattttctgtttagggttgcaatcactcatcgcacacgcgccatctccaccttccattattaatctctcattttcaacatcacactcttacgaatcatacgattttaatatctctgtctctctcaacgtattaaataaaaatggttttaaatgttagggttttttgtaggattttcaattattaatctctataattcgatgaactaagtaaaaaagcatcaaactttcttggcagaatcacatttttctctaaactaaatatggactgaaattgaaaaattaaaccactagctagaataaagtgttggtgagagtggaactctaatttctctcctttactaattatgtataaacacaaaaatgcaccaaatttttaggtttgaaaatatctaagcatggatagggtaattaacattttttctttcaattttgcaatatttgaataaatcctatgagggtctttggtacacaataattggagggtatatagttgagtctgagagtatattagaaagagaatatttcaagtaatgaagctgacatgtttatatgtactttgagagaagtgttgtgagatttgtacaaatgtatatgtacactttaaaaagcaatataagatagataaaaaaaatataaagaaaaaaagaaagaaagaaagaaagaaagagagaggctcatatatatatagaattgcttgcaaggaaagagagagagagagattgagatatcttttgggagaggagaaagaaaaagaaaatg

SEQ ID NO: 28000 - DNA, 3000 bp, Unknown; identical to SEQ ID NO: 27999
  misc_feature (1)..( 3000): 2750-1469P.txt file - cDNA_ID_2993383; gDNA_ID_1620753; Annot_ID_166849

SEQ ID NO: 28001 - DNA, 3003 bp, Unknown
  misc_feature (1)..( 3003): 2750-1469P.txt file - cDNA_ID_2993386; gDNA_ID_1620775; Annot_ID_50268
ccctaagtaccttctttcgtcggagcttccattaggagtgaagaagccaagctcaaatctctgaccagctgaaacaagagtctctccatggctgtcattgatcaatgttgaacctttgaacaatgttttggagtcttgaactgcaacaaaacaatctaatcgacgaatatgcagcaaaaacatatagaagaagacagaaagaatcattctctgaccagtactagcttttttttactcatctgatatctccattatttctgcttaagaactcaactcaaaacgtgtctaacgaaaaaagaaaaagtttgcctcaacgtcaacgaaagacccacctgaaaagtaaatatgtggaacgcagctaatcatgtgttttaagatgtttccaagaaaaagcagaacaagtctcacttgagcatctgaaccaaaagccatgaaagtagtagatactatttacactctcttagccactgtatgtagatacacatgtgaccaattcacgcactttgtgtcaactttttccgcgatggatctctaaatagttcaaaaagatccaacattttttgaataatacgtacttttagagtattttttgacaatgagagagacataggggtacctaaacgtgaattactggaaaaaggggacaatgatgttgaagaagtcaatcttttgtccttattggtgctttcgaagaagtggagattgaccctgcaaacattgttaaccaacttttttccgaaattattgtgagattcgaggagttttgacaaatgtaggacttttgtcgttcaaaagaaatgttttcatctaaaacgcgtaaacctgtaaaaggcagcttcagctctgattaaacaaagagacttgcaacaatgtcactatgagacattactgtttaaaaatagattcagaaacactaatcagttttcacactaaaacaactttgtcttctgccttgtttgtttattcctctggatgtttcatagatatacctttaacagggtatagcagtttcaagttcatagatgaaaccctttcgctcacaaatattgttttaaagccttctttatgagagttggattggttcaccacatagattctctaactcctcttccaggagtttatgcaactttgcttcagttcgccgatatatccacgcattagcatcacggtcccagtcaaatctagaagggccactgcaccgagacaaaaggaagaatgaagattacattaatgtgaatctaagatgtggaagcacaaagtcaagagcaacaacactatacagtcataaacagtttcatttctccaaatatcatgagtacaaaaatcagaagagagagcagaacatgataatccagatgcgaaattcaatctaggcgcctaaagttagcaactttcaaaaggcaagaaagaatctttacctcacaggtgaagacatccagatttgtcgatttggagtttgcttattcagtacataagtgcctaaagatccaagcttaagggtaagaacttcattctgttggaaacagccaaaaggactgactataataagtacacatagatttccagaaatatgaacaagatcttaaattgcttaaaagagtttaatccttaccccataatctatgtcgaaaccatcaatctgaacattatcaccataatcctgaacatgaatcatgcaagtagaacatagtgtaagctattgcaatctcaagtaaaacgaagaaccctagagagaaaaaggttccagcttcaaatacctcaattttctcaagaaggtgattaattgtgaagttggctaatttgtgaaactcttcctcctgcaaaaccgaactgtttttttcttccactttgttcatattctcatgaaattaacgattcagatacaataaaggagatcaaaatggagaatattaaagtacctgtaatcgacagaagcaggaccttgagaagagaagcttctggtagtcaaagaatcatggcggattcgagatcctattctccagaaggaatccaacggttctatggaatcttgaatcagattgcttgaaactcttacgccattgctacggagaagagttggagacagcttgagaaacctcggcaatttccgtagaagaaaccttgaagctgtagccatggcggttctgtcacaagaaacattcgacgcctctcttcttcttattccttcgttgtccaatttaggcccacaataaggcccaaatttagatttacccggttcacgtatttcccatgttccggtttactgaaaccggtatggttctcaagagatttgtcatttgtgtgcgaagaagagttttcttctcctctcataagaaaaaaccagaattttgaagaaggagaaagaaaaaaatctgggtttttgggagctgattaggttttgttccttcaatctctgggaattttcgctatgcactcaggtgaaattcgttttttcctctatttcaatctctgtcttcctgcgagtttacgtgagagaatagtttttaatgatcccgagttcgtcgaattacaatgcaactcccagtttttgtagttttaattagcgaaattcatcaatggcattggaaattttaagccttttttggtttgttttatggtactactaattattcaagctaaggaattccaaagttttcgttcgttttgattgggtttagaagtatttggctgatgagagaaagagccataattctgaaattaaacccttttatgtgaagcttgtgtagatgttttacctgaatttcggaattactagcaacatttctaaatacacaaagcatgattgtaaaatgaaattgattttggtcagggctttgcatctcttggttattgaatggtgtccgtgtttcactattatcttcttatgtttttgatttttatgtgctattttcgatagattcaggcgaagcgaccgctgatggcgataaagcttctacagaaaacagcaaaaaacggaagcttaagactcctatgcaagttatg

SEQ ID NO: 28002 - DNA, 3003 bp, Unknown; identical to SEQ ID NO: 28001
  misc_feature (1)..( 3003): 2750-1469P.txt file - cDNA_ID_2993386; gDNA_ID_2926205; Annot_ID_141694

SEQ ID NO: 28003 - DNA, 3003 bp, Unknown
  misc_feature (1)..( 3003): 2750-1469P.txt file - cDNA_ID_2993390; gDNA_ID_1620783; Annot_ID_50374
aaaattttaatggggccatcttagccgtccaactcctttttctttaatcagcttttccactggcgtacctttccagatggtgattacgtgtctataccaatctttatgaaataaaaattagcaatttggttacaaattcaaaaatagcgatagaagtttgatacaaaattgacacttcaatttccttccaataccgcagacaatatgatccgtccctttgaatacgatagtccttttcaactttttaacatagtacttaatttttatttttgacatcacatagtacttaattaaactactatatttatcatgtaattgagtatcatttgtgaataagatttgactctctttcttttccggaaaataggtccgatattttcttttatattcttgatttaatgaaatggcattttctaattttaaaattaattgaacagtttgaaaaaaattaacggaaaatgttatgcactgcgttcatcactttttggtgaagaacttacaaaacattctgaaaattttgaaaatcctattaagtttagataaaaatttataaagttttcgtagttttcaataatagtaataaattcaacttaatcaacaattttcaataaggatgaagaaaaaatattaattataaaatgaaatttttaaaaatttgcattgaacatccttctcataaaaccagttaaaatttttttttagtaagcatccttttcatactttctaatagacagaccctgaagagttctacaccaagacgaaactgcggtgaggattttatctgacggggcaaatcagaccggctggtatgtggacccactttcaaatggaatcatacgtggcatacagtcacgtgtcagcgatcggaaacaacttgtcaccacgtcattatttctgactcttatgggtcctacccaccggcctattacttgtcgtcaactgtccacgtagatttttaacatggaaaagatcaaaaactgtaatttaataacaaaatcagtgacctaaataaaatgctgggtaaaaaaatagaaatctcaaagccagaagaaaaaaataatttcaggatactggatactcaaaataaagaaggataaatatatatagtttgttataataatgcgtacaattataaaatatttatataaatgtaaaattatatatagaacatataaaagttctatcgtatacttttaacaagcttataattaagtggatatgaaaacgattaattcacgagtgactatgactcactaaaatgtcattttcattctacccaaattcaaatttctgtaattggttccatatatttcccttacatagaaaatcagatcactaataactaatatttacctctatgccgacttatgaatatattgtggtcaatttcatatatatgtttcactggatacaaacaaacatatattcatatataaagtatgtactattcgctacttttgcggttttacattccatgtgatatcttatctggatcagtaaataatttgctttgtacaatgttaagcaaacgcaaaaatccaaatgctagagtttataataaggatccatttatgatatatcgtgttattttgttagttgtttacactttatatcactcacattctatctcaattcatacaaaaagacgtagatattaattaattctagctttaaaatgatcaatctatatagcaatctaagaacagttatcatctgtgacaccaacattcttaataacattaccgactataagtgaataaatgatcacctaatcttctatgaatgataaaaaattccaaccaccactttcaccgaaattgttactcgagggatcaacttctttttgtgactaatttgaggctaaaactagtaagaagaaataaacaaacaaactgtatttctatcaaaaaaacaaaaccaaaacattgtgactctttaacactgttttaatgtcttggtagaattcgctgatgctaactaaggtttaaacgttttaaaaaaaaagaagtttaagttgttaaaacattaaatcgaccatgcacgatccgagatttgatatgattttttagtgggaagaattgatgaaaatgatttgatattgttcataaacatgttaatatgtttaatatcatgaaaaaatattgttcataattaaatggcacaaagatttacctattgttttgagttctattttagccaattcaatcggtgttcctatattttaaccaaaatacaaaaaaatcgtatttatgtcattatattgttttcatgaaacatattttttcatatccaacctcacttatgataatcagtatctaacacgacatctagaattatgagtttctatacatttttataattaaaatttcagattttttggtatagtgagaattgtagtgcacggttaaatcaacaactagactaaagacgactccatatcattaacattctcattcattgcaatactgtttctgccatcgattttctcctcaccatcatcactccttcaaatattcattttaactatagtttgttttcatgctataatgattctatatttctatcaaacaatagttacagaatttctttgcttaagaaaataatatatatttaaatctataatattcacgactaatagacgttaattgcaagtggtgtaagatctgtatatgatatatattttctttcacgatcacaaactgtacatgatgtttctttctcaaacatctatacaacaaaagcttcattattattgccagagaataattatgcttaatatgtgattttgttttaggattttttttttttaaatatatcttgaaaaatgattctaaagctttttttttttttttgataaaggtgtatttgtttctcctataaattaagccatcttctcaaccaaactcttcactcaccaaagcatcacataacactcacacacacactttctcttctcttattttctcagttcttttaactcttttctctacatatattcaaatg

SEQ ID NO: 28004 - DNA, 3003 bp, Unknown; identical to SEQ ID NO: 28003
  misc_feature (1)..( 3003): 2750-1469P.txt file - cDNA_ID_2993390; gDNA_ID_1620783; Annot_ID_168028

SEQ ID NO: 28005 - DNA, 3000 bp, Unknown
  misc_feature (1)..( 3000): 2750-1469P.txt file - cDNA_ID_2993392; gDNA_ID_1620803; Annot_ID_50518
aattgtaggattttacgtgataattttagaaatctgtttagaatgggcacatacaatagctagaccttggcgttgatgctgaatgggtgggtcattcaccatggagatttatataataaaacacatgagaaacgatttttctgcccttgtttgaattgtagaagactagaagacaatctttgttcgtagtccttgtgcaaagataaccattaatcattatttttggcattatccaaaacctctggtcaaactcgaagccatgccgatatgtggtggtcactggaagcctcttcaccttcatttttggtggagtattgcgaaaatataatatatttttttggaatcttattaggtttgttacctgatatgctttaaagaaggatatttccaggtactctttaactcatcaatttaggatagtcaatcgtgagaagaagttgttataatattcgggaacaatggccggttgcgttattaatggaccatattttaacaattgcaagaaccaattattcagaggcaaagtcaacggtttgatataagctcgctttcatatttttttttcacatttgagcatttacttggaatcatgcatgggaatatcatagtttcgtgctagtttctcctgcctgaagaagatgatgaaatggaccagttatagctagcgcgccagtactagaaacggtgttgtactttctggagaagaatggtaaagtatcagattcaatacaccaacacggcaacactcaagatgcagcttgtttttggtaaatacaaaaccgaaacttggagagaatgatcagaaagaaatgaaatgatggtaattgatccaatctgagcttttaccctattccattgaaaaccctttttcttttgtgaaaaaggtttgtatcggaaaagaaaaaataaaggtttgttaaaattacttatctgagcaacaactcgagtccggtcaccggtgaagctgaactttggaattccgaacacaccaacaatcccgtgcttgtgaccgtgagcatgcacgtgcaacccgagctcgtctccatgttatagttatttactatttagacttctgaaagaaagcatacagtaaaatgtttagacaacactctctttgtctgagcttatcattctctccgcccatcacatacgcttggcccatcctcattagcccataagcccagagaatcgttttctcatggaggcaaaccaactttgtcgatttaaaaacgatttcatctaaacacaaaattttcgattggtcgtcctttaccaggaccctaggtctcgcatctaccatcatgaaccaaagcacaaaccgtccaacaaaaccaaagttaaaactctgatcgtttacacattaaaaacaacattacctacacctacttttttttgtttgtttgtgtgacaattaagaagttcagacgtattacaaagatatgtgcagcgtcatattagttacctattgaactcctacactatgtttgcatattgataaatttttaaggacatcagatataagtaacagtaagattactattcgccaacacatcccggccctattaagttaagaaaatctaagtaatcgattccaaataatactatagatctcgtaatctttataaacgtatatataaacgtacggttgtgtgttttgaagtttgttagggtgacatgatcaaggtgagaggatacgtgatgttgcgccgaatttaaattatacttaaataacaatgatgataagaataaaatcaagaataaaacagaaaataataagacataactatcaattatatatatgaaagctgaaaaatgccgatttgattggttggttaaggtttgatatgaacaatctgtaaattgccagcctgagtgttgctgtatactgaattgcatgtcaacttgttcatgtttacatcataaactctttttgtcctttttccttttctttattagtttactatacaaaataataagtattttaaacattttgtcaacaaaaagctttactgttacatttaacttaaacattcagttatttcaaatatagagttttcataagaaaattacatatgtcaaaactggaaataaaataatgtactagttttcaaattccataaagttttgaatactctttatcaacaaataattccaaaaatatattcggtgtgggaagatgttctgatgcaattaataagaaagacaaaaaaaaagtgtatcaaaaatatcaaaaactattattattagaaaaagagataaacccaaaaatggcaaaagatgaaagagaagtcaaagcatggtatagcattaccacgcccacttcatcttcaagtcatttgtacacgttaatgtgtgcgtctgtgtgtgtgtgggtatatagtagtaaggtttaatcttataaatttaagtaatcaagcaaatacttaatttaattatatcaaatcaagcataactactgcattctaatccaatgaaaggggaaacagaattgcccacatgcaaatgtctcgaaatgtcttaaacctgaaagaaaatgtgtgttagtcttacatgtgctgctgcaacattaatttaatgttttctttttgtcattatgatcctataataagaatttttctgaaatttgatttgattctgaacgccaatggtgattatgataattcgaaaatttagaaacaaactaatcacttgggaattcttgaacggagccaacgtcagtcacatgaattccttttttaacattttaaatagattaagacatttatttacgaacattctttagtaaacaagacaaaataaatccatgatggtggactcttttctaacgaagatcaatcagagcagaggtaaagagccagcttgtctacaactcattttgtaaagtacctaatttacccctcccaacctgtcccacccaacctctacctctatatatacaccactgacacatatttaatatacacacactaatcagtaatcagaagtataaaacacaacatg

SEQ ID NO: 28006 - DNA, 3000 bp, Unknown; identical to SEQ ID NO: 28005
  misc_feature (1)..( 3000): 2750-1469P.txt file - cDNA_ID_2993392; gDNA_ID_1620803; Annot_ID_168731

SEQ ID NO: 28007 - DNA, 3000 bp, Unknown; identical to SEQ ID NO: 5890
  misc_feature (1)..( 3000): 2750-1469P.txt file - cDNA_ID_2993403; gDNA_ID_1620823; Annot_ID_57830

SEQ ID NO: 28008 - DNA, 3000 bp, Unknown; identical to SEQ ID NO: 5890
  misc_feature (1)..( 3000): 2750-1469P.txt file - cDNA_ID_2993403; gDNA_ID_1620823; Annot_ID_169579

SEQ ID NO: 28009 - DNA, 3003 bp, Unknown
  misc_feature (1)..( 3003): 2750-1469P.txt file - cDNA_ID_2993407; gDNA_ID_1620835; Annot_ID_57974
gtaatactgcgagagaaatcttatgaaagaatcgaaatgtgttttaaaaaaattaaagttttaagttttttttttttaatattgttaattttgtttagtgtttaagattatataattatattataattgttaattataggttttttttccgtagcatatcatcctatgttataatccactcaaacccgtcacaccatataaccccgtcccatgaaactaaacacaaatttgtcattttattataaatttcaaatatgtataaaattataaacttcaaaaaagattaatattgacccaaacttcatcattgaattttgagtgttatatctaagatttctctcgcagtatatcgtctcatattaatatcttttatattttgagtgttatatataaaatttgaaacttaaaaaaatacaatatcgaccttgattatatttaagacttttcctgtaatatatatcgtctcatattaatatattttatatatatttataatgtttaaatttctttaaaattcaatttataatttttaaaactttataagttttaaaattataaatattcaaagaattttttaaagataaactttataaaaagtttttaaaattataatatttaacttttgataaagttataatatttataatttcttgaaacattttaaagtttcaattctttaaaataaaaaaacccgagtaaatcggataactattttaattttggacgcctgataaatcaagcttcctgctcattcgtaatcagaatcattttggtccttttataatatgggtctgaaccattgtccaatttttctaagcgatgtgggacattgtacacatattatttcttcataggttgaataatatatgtctgttttaaaaaatttaaattacatcatatgcagaaaaaaatataatattttattaactatatatattttatataaattcaaaataaataaagtataagatcaagtaaaagtgaaagaagaattatatatttatgtttaaattaggtagaaatattttaggaaattagttaaggtaaataacaaatatggttagtttagagatattgtttatattaaatttggtaattaaatcattaattttcgtttttaattattagtttttaggtaacttttccaaaaattaatgttatccaagatcagaacagaattaaacatgttatccaagatccgaacagagttaaaccgggtaaaacccacccatttgaattaattgttgaattatggctcaaatcttcaacattatcttcaaaaaacgtttacaaaaatgtatatatagataactacaatataatacggttttcatagtaacaaaaatatatatctatttatatatagatattttcgttacttttaaaaatatatcgtacaatgcagtttaatcttaattcaaaatactgcaaattaattaatgatacacaaataatcaaatgcttttaattagcctatcaatagagtattaacacattttttttccttttttttttgtgtgcaagctattatacatcttgatatgcaagctattataattaaaacaatcataaagttagatcatttctcacttctccaattatatatgtatatttcaaaagcgtaacttaatcataatttcgatattatttcatttacaattcataaatttggttatcttttcgttttaatattttctatagtaaaagaattatgaagaaatttgattagttaatgcttataattttgattttttcatttacatgtcataaatttggttatcttttcattttaagttttcctatttataaatattaaacagtaaaaggattatgtaatattttgaataattaatgctttcattcaatatcagattcacatgtttgttgtggaaattaaagttttaggaatattatgagatcttctataattaataatatactcattaaataggtttatatctgctgttggaaaaaatgtgaatcaaaaagaaaaagagaaagaattttggatataaatttaaatttatcaaaatagttacacaaaaaaagaataacgccgttgatgaatggtgaccaattgaaaacggaagcttgaagatggagtcactgtcctgtcaaataaaaagactttgaaggtctttgtcatgttttttcttcaaacaaataaatacttaaggaaaacaaaagttatctatcaaaccatatatattaaaaaaaactaagaaccctagttgaattaaaaaataaagaaaaaaaaggcaaggtaaaggggaacagaggagagagaaaaaggtgtgaacagttaatggcggagcagtataaggaatcgcttctctctagaaatcttttgccatagctggatttcatttttttgatctctctctctctcttctcttgtaataacaaagctcacaacataaagaaattattacagaacaagcaagcaagaagaagaagaagaagcaataaaaattagtgcttttttatttagtgagagagaaaagctctgaagaagaaggaagttgttttcgagatgcgagctagtaaaggaaccttctctgtacttcttctctttctccttttgattctcattctgcccagtctttaattttttttcctttttcttcttcttctttcttcttcttcaatttcactcttgttgggtaagtcaagaatcgtccaaagtctttttttttttcttgggttgtttggtattggatctgtttcttggttcttttaaagattggctaatactttgattttggggggttttgatttgatctagggtttctagttagagtctgaagacctttggatttgatgtaggactttgttttttgttctaaagttaaaaaaagaagaaaaaaagaaaaagaatctgttttctcatccaaatctacccaccatttttgttgtgggaggtttttttttttattattacaaaaagaaaaatatagagagaaggagagatttgttttaaagtaaatattttgattgtttatg

SEQ ID NO: 28010 - DNA, 3000 bp, Unknown; identical to SEQ ID NO: 9621
  misc_feature (1)..( 3000): 2750-1469P.txt file - cDNA_ID_2993443; gDNA_ID_1972163; Annot_ID_179640

SEQ ID NO: 28011 - DNA, 3003 bp, Unknown
  misc_feature (1)..( 3003): 2750-1469P.txt file - cDNA_ID_2993456; gDNA_ID_1620386; Annot_ID_155462
ttgattctttctccctaacaatgtgggtcttcgagcttggcctctcatgtatgggtaagtcgtacataagtgcaacacacacactttattttgtatgggtaaattcatgattcatgtacctgccataagtgcaaaactgtgtatgatttaagccctacattaccaggaggtggcttaagtcaatatatgtatcatataggattatgtgtgatttgacataatagcatttcagagaaatcttaacataatatatacatgatttggttctaaacttataaattataagacatgctaaaagaagcttattatggtacatttaaacataatcctataaccacaacaaaaaaggataataatgaacctacaatgatgtagagcgagcgagattgcctaccaatatgcttttgctttgcccatttgtgtcggcaaattctggttggtttggatcactttggtatgatgctactttcacgtaatcagtaggtttggccattcagatataaaaacatccatatctgaatacttgatttagttcatttttcttttcatgcatagccggaaatatatcgttaatagattttttgtaaactaaatagaaatttgtttctacagtgataaaataaattttctttaagcttcatgaaattttcaaaaaattattcaatattttagatgttgtacgcttgctactgtagagtattattttgtgtccataactattttaacaatattataaatgagtgagaatacgaatggagagaaacgaaaatcttcaatagataaagattggctggttttgaattctagtcaaaaattagctttattgctgagtgattactcctacaatggttttaaaagcagagattcttcgtaagaagcaaaatatgtaaacgaaagtcacttttattttgggcatcgttctaaagccaaattcaaataaaatatcgacatttctccttcctttgaaatcagcatttacaaaaacgtttgtagaaacacacaaaacatgactaattttgttttcaaaggctatatatgtttgtggctattcattatcaaagatatataagcggtcaccaaaagaattttgcaggtcgaaatgtacttcatatatcataaatgattaaaagtgataactaatcatttttactagcctgaattgaagattattgcaagaaaactttttgtgcaagggaatactaaatttggtaatcttttttatatataataaattaactcgccgttaaaataaaaataaaaaataactcagtaaatttgtattagagagagctatttcagcttggagtatatattgacatggattaatgaaaacaaaagggtaaaagaattgtcaaacgacagcatatttatcattcaagtactcatcgtatagaataattatataacgtattatctgcgccacctaactaagcacaaacttcacgcatgatcgtgatgtatgaaaattccgatctctaagtactaattaacatcaaacaagcttttgttaaacctaatgcatcactagcaactttaatgttataaatatcataatttcttacataaaatactaatatgattcatgccaaaagttatctaattcatatatcatgcgcttggaataatataaatattttcacaacacactttcgtgattgttacgaacatagatcaaacagaaaattcaacatcaaacaaagaaagaatattgaccaaagaaaattgagtatttttggaaaataaatttggtaggaagataagtgggtgaacaaaaatgaagtagatataaattacaaagtgatttaacaatgacataaatgaagtaatatcactaagaatgtttttgcaatattaaaaaaaaaaactttggatattataggaattaggttaatccgcctaataaatgtttggtccaagtccaactaatccaaaactatgttaaattgtaatttaaatttgatacatcaaaacctgtttttggaaattaacctttttcgtcaaaacaagtttctttttggaaaccgttacacggttctggtgattaatagacatgggaactagaatccaaaatgcaggtgttacatcaaacttaagtgatatcaaaaaaagcaaatttcaaaaagagaagaaaaccactaaatcactatgatagtacacatgtcacacattcacaactatgtccaaaatataaattacataatttcgttcatcttatcaaattctgccgcgccgcatcatataacacgcagcatacactatagtgccttttcccaaaaacatactatagtttatttataactagattacatttgataatttgtgataaatattgtgtcaaattggtaggattatgttaatgatattgcttagtagaaaacagttgtatctttttagccttttaggcaagaagatgatgaaaatatgagagaattgagcggtaggcccatctctcttctgttcataaatgagaatcatgctttactctctctccctttttctcattcttcttcttcttccccatttacagcccaattccactatcttcctcatcatcataaattcataatactattgcactaatctcgagaagataaagagacaacaaacacctctctatctctctctttcttttttctttcttccgtttcaaagtttcttccttttgggcgggttttaaggaaattttggaatttctctctttttggagacgtttctttaatttctgggcttcttctagttgtgggttttgttttctacttgtagctactgtgtcacgcttttctctagcgaatactttgatgcttcttcatgactctttaacaagattattctgagcttttcctctggccttctaattattaaagtcttcctttttatctattgttaaggtttggcttcgttgtctcttcctcttacctctgctttttggttcagagtatttgaattttggggaatattaaaaattgcctgatactgaaatcaatctcttgctgtctagtgatg

SEQ ID NO: 28012 - DNA, 3003 bp, Unknown
  misc_feature (1)..( 3003): 2750-1469P.txt file - cDNA_ID_2993460; gDNA_ID_2926261; Annot_ID_143229
atgtagctatttttggacggtcactatttcaacttaacattgtgtaatgcatttatgagtttgggatctgtctgaggatatttatgaagaacttccacatggagaaacatttgtttactaaatgttgatatgactattcttgaaacttaacttttacacaaaagttaaaaactaaacaaaattcaacaaacaatttgtggttagctgcaagatctaccagaagttaggggattaaggaggatgagaggggtaaaaatataatttcgagtgggcaatgaagtggcacgttcacctgtcggcacagtggagaagagaacaacaaaccttacttctctcttgttcacattcataatttgatgaacagtcttcttctctgatgcagaaaccctctccctgaatcttgattctctcacaatcaagatttgaagcaaacgttttgagaaaaatcttttgacaccatcaagtaagtttttatctttcttatgttttttgtggtgtacctgcattgtgcctagttttggtacttgaatcatctattttggaatctagagtattgatctggagtatgattagtcaaatctaggatttttaaggaaaatggtactgagagattgtattatttgcacatatcaggtgttcagtggtagtgatttgatatgatttggtcattgtttgaatgaaagttggattattgttcagatttggttggcggattgtgggaggaattccagagcaatatagcaggtgatggttgtacaacaatggctaagaagaagggcttgttcactgtattgaaaaggatttttatttcagaagttaattcagaaaaggtgaagacaaagatgttaatctcattctaatgctgattgttgtttctgcatcttgtttgattcttcttgtgtacttctgcagaaagagaagagaagaaaatggacattttggaagcttaggattaagaaaagattaccttccattacagcacctccagagcacaggacaagtcatgaatcgcatgaggaacagaaggaggaaattgtgtcagatgtgggtgagatcagccaagtgtcttgtagtcgacagttagattccatagaagagtcaaaaggttcaacatcaccagaaactgctgatctggtagtccagtatcaaatgtttcttaatagacaggaagaagttcttgctgctactcgcattcagaccgcctttcggggtcatcttgtaagcttgtcttacccttttcttatgaagctactgaaagaatcgactcattttcatactggagttatgtagttaccttgtagctgtgttgactatagttgagtaggttaggtagagagctaagacgttgaaagtaagtttaggcagaaggatttggggattctgaattagtttaggatcttggtttgggcagtaatatatacattttgtctcctgtgtcagtcacctattaagtcttttgagaaccagatgtgaatcttttaaagcgatttctcttcttcttttattgctggattttgggttgatttttcaggtgacatgctgacaatgtttttgaacttcattgcaggcaaggaaagctctacgtgccttgaagggaatagtgaagctccaagcatatatcagaggtcgtgctgtgagacgccaagcaatgactacactaaaatgcctgcaatctgttgtgaacattcagtcacaagtctgtggtaagagaacacagattcccggaggtgttcacagagattatgaagagagcaatatattcaatgataacattctcaaggtatgtcttctgatctaaaaatgtaaactcgttgccaacagtgcagcagtttattagtatgtattgttttcaggtggacacaaacggtcaaaagagatgggacgatagtcttttaacaaaggaagaaaaggaagcagtggtaatgagcaagaaagaagcttcactaagaagagaaaggataaaggaatatgcagtcacccaccgggtacttcctatgcacttgtttcatttggctttttattgctttacaagtttcctagtattgacttgaaactgatactttgtcaacatcagaaatctgcggagtcataccagaaacgaagtaacactaaatggaagtactggttagacgaatgggtagatacacaactaaccaagagcaaggagctcgaagatctcgacttctcttcgaaaacaaaaccgaaagacgaaactttgaacgagaagcagcttaaaactccaaggaactcatcaccaagaagattagtgaataatcatagaagacaagtttcaataggtgaagatgaacaaagccctgccgcggtcactatcactacaccaacttatatggttgcaacagagtcagcaaaggcaaagtcaagatcattaagctccccaaggataagaccgagaagttttgacacacagtcagagagttactcgccatataagaacaagctatgcctgacgacatcaatgatgagtgaagcaccaagcaaagtaaggattgccaacaatggcagtaacactagaccaagtgcataccagcaacggtctccagggttaaggggatttaacataggccctttgaaatcatgcaataataataatactctattgaacgatctcagcattaattcagaaagatctctacctagctggaacaagcagagcagcttgagatgagtggatattgaaccctgtatatatacatactacatacgttccaatgtttcttttgacttttgagggtcacactcacatatgtgtatcatcaaatattgtttcgtttttttgtttacacttgtttgtttatctcaacttcaaaattggctaatcataagatattgtcattttggttgagtaatattacaagacaaaacataggttattgtaaccaaaatttggtaatctattggtttcttctattaaggaccagcgtggctcaagcgacaccgttttggtaaggaagaaagagcaaaaggttggagaaggaagatatg

SEQ ID NO: 28013 - DNA, 786 bp, Unknown
  misc_feature (1)..( 786): 2750-1469P.txt file - cDNA_ID_2993463; gDNA_ID_1564533; Annot_ID_149617
aaaaaaaaacmaataaataatcmaattttactgaaataaattgtaatgatcaaawawatttaagcattgaatttttttgkgtagtccyaaagktkaatyttkaaaggcygctgatcytaawttgtcyttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatttatttatatatttaatgatgaaaattgtaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactatamcagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatg

SEQ ID NO: 28014 - DNA, 3003 bp, Unknown
  misc_feature (1)..( 3003): 2750-1469P.txt file - cDNA_ID_2993463; gDNA_ID_2684240; Annot_ID_192556
caaacattagtttacatataaaagtaaaacaaaatttcaatagtaactctaaaaatagtcttcttgtgaatacttttatccatttcctctttttctaaccaatcaaaattttgttacctaacaaaaaaaataacggaaattttctattgggtttcaagtaaataagagaagctgaataaattttacaaaaggaaaacaaatgtttttccctatatatgtactaacgaactaaataaatcaataattgcgaggagaataaataatgatccgagggaagatctcattggcatacaaggcacaataagaataagcaaggaaaggcagtcaaaagaagtcgaatattatttgtctgttagaaagcataatcctaagttcccatcattggctcatagagaacatataatctttctccaatgatttgatgtctcacactcactagtcactacttttacttttcacattttatatgccatttgcttgcgcaaaaatacactgcgaatgaagtggttgtaatttgtggtttcattagtttgatcgatcgacataaaacgatttgtaacaatagatccaaaacagttgcaagtcgatcgataactagtatgggttcaagtccatgaaattcaatcacagctttgcggaattcaattgcttagatttcttgaagagttttgttaggaatttcatgtctcaacaagaagaaacttaaaataacacataacgaatgttagctaacataaacatattcacgttgtaaatgcattacgttttaatcttagaaattcatgaatgtctatattcttaaagaataccataaatttatcagtacagattcgacatcccatcaatcattcgcatagttatagctctaaagatctatccagtacaatcatatcaaacaaagaaggctaagacatacgaatggacatgatagaacatgaacaacaaaattttgttttccactagagcatatgttctcatagcattaaacctttcgaataagcatcttctcaatactatttagcctcacgagggttataaattctcacatttccctactgacttctcaccaaacaaaaaaaactagaagaagaacgatacataaactatgctcacgcaagaacttgcgcgcattatggggggtgacgatgatgagtattggtgaggaccgggtaatctgcatcctgaggtttaaagcttaatttacgcaggaaatttgtatacgcatatacgtatgtgtattagtataccttttagtcctcgggatgcggattacctcgttcttacttacaatacacgtactcggagacacgattactcatcatctagaggttggttttgatcctccatttcttctaagtttaaacatcattaataagatatttaagactgaatatcaccacacatatatagagtcagtctcatagatgatgaattggtaatattatatgacactactgacttaaaattattatcatataatattactaattatattaaagttttttttcgtcaacatacacactagttaaaaatttgaatttagaaaagttcaattgatgactcatttcaggaatgctcgaaacaatggcaacgacgcttgtgtatgtttgaattagtgatatatccgttttattcatacttaattaaactggtaactctaactaatacgctgtatatttacctttttgtctagtgaataaaaaaaaatcacgacgacctagttttatgtcttttatctattgctcaaaggtcgctcattgcctttgactaatatgtttagacttgtgatttctgctattcaattaaattaattaactgcgtttattaaatttcagttaggtgactcataaaaagaaaacatagattaattaagttatatatatagtataatgatgtacatacaaattcaaaagtactatggatcttgctttgaaaacgagtcagtcaattgattttgtagatttattcagttttcatagatgtccaacactggaataattgttgataatttcaggaaaagcatatgttaaaataatgctaataacaaaaacaaagctagtgatgtgtatcaaactaccaattgtgcagagacaaaaacaaaacgccaaaatgctgtgttgtacccttttttgtcaactgcgtatctgtttttttttcagtataaaaaacttaagaaatctctaaacctaattattgagagtaaaaaaaaaaacaaataaataatcaaattttactgaaataaattgtaatgatcaaatatatttaagcattgaattttttttgtgtagtcctaaagttgaatcttgaaaggctgctgatcttaatttgtctttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatctatttatatatttaatgatgaaaattgtagtttgataaaaaaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactataacagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatg

SEQ ID NO: 28015 - DNA, 3003 bp, Unknown
  misc_feature (1)..( 3003): 2750-1469P.txt file - cDNA_ID_2993463; gDNA_ID_2684240; Annot_ID_137757
ctttgaaaacgagtcagtcaattgattttgtagatttattcagttttcatagatgtccaacactggaataattgttgataatttcaggaaaagcatatgttaaaataatgctaataacaaaaacaaagctagtgatgtgtatcaaactaccaattgtgcagagacaaaaacaaaacgccaaaatgctgtgttgtacccttttttgtcaactgcgtatctgtttttttttcagtataaaaaacttaagaaatctctaaacctaattattgagagtaaaaaaaaaaacaaataaataatcaaattttactgaaataaattgtaatgatcaaatatatttaagcattgaattttttttgtgtagtcctaaagttgaatcttgaaaggctgctgatcttaatttgtctttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatctatttatatatttaatgatgaaaattgtagtttgataaaaaaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactataacagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatggaaaacatcaaaaaccctaaaaacgcagatgattgttccgatagcatatcaaaaaacagtcatcaaggcgttgatgattccctgaaccagtcaagatcttacgtatgcagtttctgcataaggggcttctcgaatgctcaagcactaggagggcatatgaacatccacagaagagacagggctaaactcagacaaaagcttatggaagataataaggatgatgtcgtcgccgagagtgatgcatccgaagttgtgtctctagaccttaatgaacaacaacaacaacaaggagaagctttgacatgtgatgatcacgatcaatatgttgataacgatataagtcctaaacagaaattagagttttgggttcaagaaagcaagcttgatactaatgatcatggaaaggtcacggaggctagcatagatggttcgagttcgagtcatcatcgtgatattgaagtattggatctcgagcttcggttaggccaaagcgtcgtaaagaagaagacaacatagtctctgaacgatgaatcatatattgattgcattgtatcaatgggaaaatccctatgaaacaccaaactctctaatccgtctattacaaatggattcgtggctcaaattgtattgtaaggtatgcatttgtatcttattgctaccattatcgttgttgtaccttgtattgatatttgtttccttgcttgggttaatttcaccaacaacttttgtaaatgacatacacgtccaaacaaacaaacatatatatagaaattatatatatttggtgtttgctttatagttgtttagggaaaatgaataactaataagcttaacttagctcaacattattgatctggtcatggtagagactattcaaacttgttcactgagaaatattgttacagttgagttatatattggtagtcgtcctcagattttcgagtaagcatttgccaattatgactcttatattcgagattagcactcaacatttaattatatgttagcaaatagtataacattagctagcaaacttataaacgataaatttgaccaaaacaacataaaccaaggtcactttatctactttttgttctctgaattctgaaaacgaatttgaatatcgtattctaacagtgaatattgcatttatactaaaatttacgatcatagccataaataagtagttatgtatagtcaaactatatgtagttatacagtactttaagacgtttgaaccgctaagattcccataatctgcatgataatataatgtatgtaaactgatacatgcacaattgcacatgataaatataactaaattgatacatgccgatttgcgcatgataattataattatatgctctataacatgttaggatttaaaatgaaaagagcaaatggttcaaggctgcaacttggtgacgccaccaatgatgaccttttacgtcttaaccacgttccggtttggttcgagaacttgtttgagatccgctttggatctaaattcagattggttttatttgagatgccgtggaaaattggataatttccaccagagatatatgatttaattaattggattttggattcgattatagtaaaccgataatagtgaggcagtaacgaacaaaacaacttcaaccggatcattgggttggtttagtttactaattgaaccggtttgataatgtttaaaaaataaacaagtgacaacgaagaccagcaggtccagcacacgatcctaaatcctgtgagcatcgtctccatcgctggtcttccattattgacgaatctctttgcctttttttcttccttcttaaacaaacccaattcgatttcaacgaacgcctcttctctctcactctctttcgatttgttctttgccggagctcgtagtgtaagcgtgatccgcggcggagagatg

SEQ ID NO: 28016 - DNA, 3000 bp, Unknown
  misc_feature (1)..( 3000): 2750-1469P.txt file - cDNA_ID_2993532; gDNA_ID_1621100; Annot_ID_55830
ttttcactgagctctctctcgggtgcaaagatagcaactttttaaaggttacagctttatttttataaacagactgcatgtcgttttctatttaaataaacgtcaagcagtgcggttactaaataggaaacgacatagagattgaaatttggcgacaatacaggttgatgcatcgctggatttgctggaaaacaaaccgtcaatctccgtctttatagagaaaaaaagattctcttctcttctcgttctcatcatcgtcttaaagaaggaattcgatttttcgcctgaacctgcggatttttcgattcttcaaattcaatgtcttatgcttatctcttcaagtatatcatcatcggcgatactggtaactccttctctgctacgttatctttcttcaatccatttggaattgagatgatcaaaacctatatatgtttcgttgcgaaaattgaaaagcgaattgatctgaatctgtgtcatatccaactttttttagtggatttaggggtcgagagaagctttggtgatgttgatttttgtatattgattctgattttcaggagtggggaaatcatgtcttctgcttcagttcaccgacaagaggtttcagccggtgcatgaccttaccattggtgttgaatttggggctaggatgatcaccatcgataacaaacctatcaagcttcagatctgggatacggtctctttctccttacttcttcaactttcatgatgtatctctatcttgttttcatgaatacctggattggtttgtgcacatcatcatatatgctttgattttctttgactaggcgacttggctattctgaagtttcatatcctttgtcttggctaatatctctctgtaatgacaggctggtcaagaatcctttaggtctattacaaggtcatactatagaggagctgcaggggcattgcttgtctatgatatcacaaggtaaatcatttgcttctttctgtatgtttatcaaaagtagagttgatcagggaagcaaattattttttttgtgtaagtagtaactagacgttattcttcttttctagattggagttcgactcctaaagatctgaaccagaattagatttgtgtttttgaatttataactgtttcagtcaagacacttacgatattttttacctccgttttttttgcaggagggagacatttaaccatctagctagctggctagaagatgcaaggcagcatgcaaatgcaaatatgacgataatgctcattgggaataagtgtgatcttgctcacagaagggcagtgagtacagaggaaggagagcagtttgcaaaggagcacggtcttatattcatggaggcctctgccaagactgctcagaatgttgaggaggtaaacccccatacgttccaatgtggtatatttgccaattacccaattacttaacatgatttcgactggtgttgtgattttttgctaggcattcattaagacagctgcaacaatatacaagaagattcaagatggtgtgtttgatgtgtcaaatgagtcatatggaatcaaagttggatatggaggaattccaggaccatcaggtggaagagatggatcaacctcgcaaggaggagggtgctgcggctgagatgggaaaaatatgtctatgtcattatgtaaaaatgatcacatatgatatagcaaaaatgtctctgcttctttctatagttgtaaatcgttttggaattcgatttggtgactgtgttgtggttggttttggaacggtttgacaatacacgtgtatgcctattcatatatctaaaaattaagatgtgtttgcgtaaggatctaatggaggtaggaatgtagcccatttgcattgtactggaaaaggtagtaaggatataaatcatatcatgaaggtaagttcagtgtttgtggagaaaattgtattggctgcatgtggttccatttaccgtgttatacaacaaataaagtaatccctttagcttttgtcatgatgaacgatgccttccatgtctttcatggtttactcgtttaacaaagccctccttcccgctatttcgtgtctaggtttttgcagttgtttcacatgatttcttcttcttctttactagagtctattggcttttgttccgcgtgctgtcttgtctttcaaataaaagcctaccaaatactgaaacgccagcaagtttgcaatggtcgacaatacaggttgatatttctctggatttgctggaaaaccaaccgtctttgagtgtgaaccagaacagacgacaacgaaattgaacaagggggtaaaatgagctcaagcaatcataatattggaccagaaagacatgcaaattgagaaaaggaacaaaaagccaaagtcacaaacaaaagaaactgttttatcttacaacttacaagggctatgacaagttattcggaggcctgaggcaaaatttatattaagatttttaactaaattttgccaatcattattaaacttttttttgttagatctttatctattttatgattaaaattataaaatcactaaaaattgattatcatttatttttaaaattgttaatttagctaactagaaaaataatagaggataatttttttaattttctatatttttgtactttttgttatgttgaaatttattaattatatattaaattttatcaaaggacctttttttttttttttttgatccaaatcatgggaccccaaataagaggctattgccttatttaagaagaaaagaaatggcacgtatcaaccttcacaacagactcatcaatctccaatcattgtacaatcatcccaatggtgagacaccaaatctctaagtgacacaatctagaagtttctaagactctatagaaacattcaaaaacgttaaaagtgaagacattgtcggattcttgaccttacccatcaggagaagaagggattcgtttttgtctgaacctacggattcagattcgtccacttcaatg

SEQ ID NO: 28017 - DNA, 3000 bp, Unknown; identical to SEQ ID NO: 28016
  misc_feature (1)..( 3000): 2750-1469P.txt file - cDNA_ID_2993532; gDNA_ID_2926167; Annot_ID_139969

SEQ ID NO: 28018 - DNA, 3003 bp, Unknown
  misc_feature (1)..( 3003): 2750-1469P.txt file - cDNA_ID_2993537; gDNA_ID_2684224; Annot_ID_191900
tagtgggaattaaagcttttatttggggtctgtaataagtaggcgagataagttactcttactctttgaaatctcaaaaccaaaataaaaagtgggaacttaattatgacaatatacatggttcataaaaatgattattcttgataaatgaaccaaccataaaagaaggaactaacagtattccacaagaaaatcagaaatcaagaaatgaagaaaaggagccatgacgtgaaggggaaggtagggttaattaggcggcgtagatgtggatgtgaagggcgatgagggagatggtgatgaaggcgaagaagaggagagtgtggatgacaatggaggggccgcttgtctgaaacccaccgaactcaaccgctttgctctttccgggcagctgaaacaaaactccagggctcaacacgatgaagaaaattaccgacattagcaccggtccccagtccaaccccatctttgttttctgtttcttctctagctataatatacgtctctctataaacatctaccactttattatgtgcttatatttataatgtacgcgtaaatgtgagaatgaacttgatgtcaatacgattaattaataatatatatgtggcttgggctggacaaaagtggagggttcttctcaagtttgtgggatgaaggaaagaactattctctgatatagtattttaaattatctgtacaaaaaaataattaaatatctagatcgatagtattttgcttgttttgaaggccaagcatatgattctcctcctcttcaggcatttcaattcataagcaagcatatgattctcctcttaaggcatttcaattcataagccaacatataacaccttacgttcttgctccggttctgagtttaagggaagtccatccgcttctgacggatgtaataatattcatgcaacatatataagtcatatatatactgaagtaattttaaaacgtcaatcgcaaaaataatacacaatacactaattaacgccataatttttatttttttaacaccataattttattatgcactaacgcggttattaatcaaatcacgtagtattagtaatgaaatagggataagatccacatgaggaaagcaaaagaatcgaaaccaaaccaataaacgcaatcaagtatcaaacactttaactttatatacatagccactaaatgtatatatccatccaacaagaaagaaagatactggtcaagtctcaatctgccttcttttgtcatccttaaataatctcaatagtttctgaatttcaaaaaagtacacaaaacacacctattatcacacgtacaatatatatataccaagtgcattaatacacttgtgtgtgtatatgtaatattgttccaagtagtgctttgacacctaataagacgatcaaatctttttggagctctaattgaggtagatatgggaggagcggactgggggccggtggcggttgcggtggtgctgttcgtagtgttatcgccggggcttctgtttcagttgccggcgaggaggagagtgttggagtgcggcaacatgaccacaagcgggatctcaatattggttcatgccattctcttctttgctattatcacgattttggtcatcgccattcaaattcacattcacatctaacatctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaaatg

SEQ ID NO: 28019 - DNA, 3000 bp, Unknown
  misc_feature (1)..( 3000): 2750-1469P.txt file - cDNA_ID_2993537; gDNA_ID_1972047; Annot_ID_178260
tgggaattaaagcttttatttggggtctgtaataagtaggcgagataagttactcttactctttgaaatctcaaaaccaaaataaaaagtgggaacttaattatgacaatatacatggttcataaaaatgattattcttgataaatgaaccaaccataaaagaaggaactaacagtattccacaagaaaatcagaaatcaagaaatgaagaaaaggagccatgacgtgaaggggaaggtagggttaattaggcggcgtagatgtggatgtgaagggcgatgagggagatggtgatgaaggcgaagaagaggagagtgtggatgacaatggaggggccgcttgtctgaaacccaccgaactcaaccgctttgctctttccgggcagctgaaacaaaactccagggctcaacacgatgaagaaaattaccgacattagcaccggtccccagtccaaccccatctttgttttctgtttcttctctagctataatatacgtctctctataaacatctaccactttattatgtgcttatatttataatgtacgcgtaaatgtgagaatgaacttgatgtcaatacgattaattaataatatatatgtggcttgggctggacaaaagtggagggttcttctcaagtttgtgggatgaaggaaagaactattctctgatatagtattttaaattatctgtacaaaaaaataattaaatatctagatcgatagtattttgcttgttttgaaggccaagcatatgattctcctcctcttcaggcatttcaattcataagcaagcatatgattctcctcttaaggcatttcaattcataagccaacatataacaccttacgttcttgctccggttctgagtttaagggaagtccatccgcttctgacggatgtaataatattcatgcaacatatataagtcatatatatactgaagtaattttaaaacgtcaatcgcaaaaataatacacaatacactaattaacgccataatttttatttttttaacaccataattttattatgcactaacgcggttattaatcaaatcacgtagtattagtaatgaaatagggataagatccacatgaggaaagcaaaagaatcgaaaccaaaccaataaacgcaatcaagtatcaaacactttaactttatatacatagccactaaatgtatatatccatccaacaagaaagaaagatactggtcaagtctcaatctgccttcttttgtcatccttaaataatctcaatagtttctgaatttcaaaaaagtacacaaaacacacctattatcacacgtacaatatatatataccaagtgcattaatacacttgtgtgtgtatatgtaatattgttccaagtagtgctttgacacctaataagacgatcaaatctttttggagctctaattgaggtagatatgggaggagcggactgggggccggtggcggttgcggtggtgctgttcgtagtgttatcgccggggcttctgtttcagttgccggcgaggaggagagtgttggagtgcggcaacatgaccacaagcgggatctcaatattggttcatgccattctcttctttgctattatcacgattttggtcatcgccattcaaattcacattcacatctaacatctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaaatg

SEQ ID NO: 28020 - DNA, 3003 bp, Unknown; identical to SEQ ID NO: 28018
  misc_feature (1)..( 3003): 2750-1469P.txt file - cDNA_ID_2993537; gDNA_ID_2684224; Annot_ID_137535

SEQ ID NO: 28021 - DNA, 3000 bp, Unknown; identical to SEQ ID NO: 6891
  misc_feature (1)..( 3000): 2750-1469P.txt file - cDNA_ID_2993545; gDNA_ID_1621111; Annot_ID_56092

SEQ ID NO: 28022 - DNA, 3003 bp, Unknown
  misc_feature (1)..( 3003): 2750-1469P.txt file - cDNA_ID_2993558; gDNA_ID_1621144; Annot_ID_56701
ctatcaaaatctctaaactaatctctatgttcagtttttgatggtttattatcaagtatgtgtctttgtaattatcttctcttctaagattgaatcatcacaatgtttttgaattatttgattttcattgaatatttcaaccaaccaaaatgttttcgttctagaaataaagtcctaaagtgacgtacattcgttttctaatgaaaatgctatttcataagttattcctttcattttttttgggtcgtcaaaacataagttaatattctttttttatttgactaaaactacttttccaaaattttcaccggggaaaccttctcaaagctttatgagcttaaacatatgcaaagtgtctcattaacttaaataaatatagagtacaattaatttgttcacaacgtttttaataggaaacttagaatatgttctgtgatgcactatatgttgcttcgtaaggaaattgcatgcgaaaatctagtggaagaaatttagttaaacggcaaaaatcttcaattaatcgtttcctttatctacattaccaaaaggttgcgaacattatgcgacatatggtggttagaacttaatacactaatgtttttcaaagatgctatttgtggagttgataaagacaaaacatatttgaagaaaataattttaaacatgtagtgtttaggaacatcacggcttcatagatatagagtcaacttaatatgttacaatgatattgaaatatgttctctaaactctaaaaggttctacctgattttcttaaacaatgcatcttcgaaagataaagaaaatatatttttctattttctctttacatgtcaatgcttactatatcatcttacgatatactataaacgttttattcataagtaaaagacaagtggcagatacgttaaattttataatagaaataaattagttaaatcttaaaaagttgctgaaaatagaaagcaaactacttatcttaaagcaaacgtaagtctctttaagaagaaatacaaaatgaatatatatcggattaaatcaaaaaacaaaaagatacacttttgtttttctgaacaaatgaaaaatgatatacacaagtggcggacaatccatctatctcattttagcgaacaattaatcttgtctgcgactgcgacctatttttttctacatcacatcttttgtttcgtatgaacactaacatgattgaatgacaaaatttactaacaattcttatagtactgagctctcctgtccaatatttaaaaatgcatacatttttttgtgtgtaactaaaattagtagaaaataaatgctagtcgttaaaaagtgcatatagcagatttcgagttttttttaattgcgatttcgattatcaatggtcgatcgtagacgtcttttttagtaaacaaatctgaaatttctatgaaggttaccaaatattttggatttcaacctaagatgaagttaacctatggacgtgtagaacagtggctgaagtctgaaatgataagataaagttcaatatgaatacattactgagatgttacaaaaaactacatcactgaataattcctttattttccagtttggacagtagaacctatcgctaattatttaattaccaattaaaagaaaaagaaagaataattcctacagttgttaggctatggttataagtttcatctttgaacttaagaaatgctctaattagtggtaatggtagttacatctatatatgttgatgcaatgtcaaaaagaaaatctctcaaattagcaaatccatacctatttatagacgcataagtatatataccaattatcctggtcgtgcaaatggatggttagtatttttacaaccaaactaatgtctaattttaaaaagtaatcattattttgctttagatttttaatagttaatattatatgtatagatagattaccgtatgatataattgtttcaagacactagatactatctcaattataaaactcacttttccataatatggccgcttgtttataaaaaaagaagagaaataaaacaattgatttggtttatattatttaattgcagatatcttgtacttaattcattttgagataattttgcgtatttgagttcggacattggtaggtatggacgatgaaaataactgccttcattctacatgtttgagatttgtttgtcgaccatataacacaagcggctagaaaaataggtgactattctcaaatgtcctggttctatctaacctgaaggatcccttgttctacctggtataactacaagaaaaggctgttttataaaatatatcatttcttctatgatttctatctcaactttttttttagtttttttcttttagaacgttttcgctttcgaattttttaagaattttttttttctttatatctctaaataatagttttaaaaacataacaagtgatactgtaatttttttttctctataaacttggcggtaccctacttttttcttatttttattaataatcttactttgttatgataaattatgttaatatatggcaaaactaaatatatatgaaactactgattactcattatcataattaatatctttgtataaaagtaaataatatttagtcgagagaggtatcttgttaaaggaaataaatcaaaaattagtggctaccaagtgggagatataatttggaatatttccagtgtattagtgtggtgggtttggaataccacaaacagaaataaaaagaaagaaaaatatgaaataagacgacaatgtgtgatgtacgtagaatcagttttagattctagtacatcaatagacaagaaaaagattgtggttatgatttcaccgacccgagttaatgcaaatccgaaacagtataaatatgtgtagagggttcatgcctatgatacaaattaaagaagcagaaacaaaaacaagtaaaacagaaacaatcaacacagagaaaccacctgtttgttcaagatcaaagatg

SEQ ID NO: 28023 - DNA, 3003 bp, Unknown; identical to SEQ ID NO: 28022
  misc_feature (1)..( 3003): 2750-1469P.txt file - cDNA_ID_2993558; gDNA_ID_1621144; Annot_ID_172944

SEQ ID NO: 28024 - DNA, 3003 bp, Unknown
  misc_feature (1)..( 3003): 2750-1469P.txt file - cDNA_ID_2993569; gDNA_ID_1620742; Annot_ID_49641
cggtttaaagaagcagtggagttcatggaagcactcgcaggaacttggccctcttgctcatccttcatgtaaagcattccctcttacctgaaggctctcacagattatcaagttcttctcttattgttaacaatccctgatatattatttttttaacatgtccataattttcaggtatacacacaattggtggcatgttgctctctgttacttagaaggagggtccccaatgagtaaagtagaggagatttatgatcatcacatctggaaagaattggagaaagacgatgctgttcctcctgaagtaatcctctttttgattaacaaatttatgcttttgcgtcatctattcaatattcaactgtctgcaactctttaggtttatctcaatgcattgggcttgttgatacgtttagatgtaagagatgctcttgatggttttgaagaccgtctcaaaaaccttgcagttcgtttaactaatcaggtaagccatacactagttttatatcatcccaaaacggttgcagttatacgagttatcttgttgaataagtttttatttttcggccacttgctttaacatttcaggcaaactggtatttggagtggcaccttgatatattgatagtttgggcactagcaaaggttggagagacttcaagagctcatgaattacttgagggccttaagttccggttagtgtgactttcttttattctgcagtttctaaatgataccgaatttgtcatgaacttgtgttgttcttgcagattatcaaagaagaacaagaagaagcaacaagtgatgcagaaagggattcaggtttgtttattccccctccctctttgatcgtctttctttatcattgtaactagtactcaatatcagtcttgttttcatataagcttggggaagctgtgtatgaatacgcaaggggtaactacgaaaaggctctagaactactgggttcagagttcaacgccattggttacaaggtaaaccgttcttcagcgacttgctcaaaatactctgaatcaaacacatttctggtggatcttttaaactgttttatggttaataatagatcgttggggcatcagacgaacaaatagatgttttcaacgaaatgtggtgccagctgctgctaaagacaggccaatcctccacgggtaaggcttgttgtagagtcttactaatttggatactcgtcttgcttagtatgatgataaacaatcgtggttctgatgtatgcagccaaagaagtaatcagagagaggattaaggccagagatggtattcctttcatgtggcgtttgctggtatacattcaaaagcagaacatcactttgttttagtgtactatatgtgtttttgctatgagaaaatgatgtcgttgtggttgcaggagaaaagttactccatggaaggcaatgcagaggctgagagtagtgcacgagagagagctaagaaacttgaatcttgttatttctaactttgcttcaaaaatccaataatgacatgtgtgtatacatgtttttaaataagtatagaataaaatattttgctactcgtgtcctacttttttgtttaccaaaaggtaaatgaataagggggtgtattgaaagtggaagtttaagagatttgtgtagaatttataaatcctatgttattcaaacatgaattttaaaaagtttcatgaaattcagtgttattgaactaatgatttaaaaatccaccttaaaatccactgttattaaaaacaatttgtggatttgaattttaatgattttggaggatttgagaggatttctttagttaaaaatacagaaatccaaattccatggctaccgccagtggtgtaacaaactgtggaatgctgtcagatttgcgatgatgaagcttggcgatgggtatactcctcctgtgcaaactctacgccctaaaaccatgaccttcagctgccaatggattctttctttactaacaatatcgaagacagtggattccttgaatgcgtttgcattatcggatgctgccaacagtgtatgcttggtggcaataccagttctgtgatgtatttatcgaggcaattaagccttatttttctgctgacactcaaagaaggattcatgcacaagatgctctctgggtgtgtctcgagactggtttgagattgctgcatccatttatgccttatattacagaagagctgtggcagcggttgccttcatcgcaagactctgaacgaaaggcgtctatcatgatatgtgactacccatcttccatagagatgtggacaaacgagaaggtggaaactgaaatggacatggttctagcgaccgtgaaaactcttagggcactgagagctgcagagtcgctaaagagacagagaaatgaaaagttccatgcgtttgctctgtctggaaatgcattaacactggggattgtgaaaccacatgagctggagatcagaactcttgcaaatctctcatcctttgaggttatgttgaggggagaagacaaagcatttgtagtgtgttgggaggaaattgaaatttggattagttacaatgtgctttattttattttatgtaaactatgtccatcgttttgaatatgacggattcgatcatggaaaagcaaacttaggaatttccatgtttcaaaaagtcaatgcatccatacaaaaagttatactacatgaattaagaagtgttgtgtatgctttagcactaactatgttgtaactaaaagctaattatgctttagccgacaaaagaaaagaagaagcttactaattctctccattgtcacgaaaagaatctgtctttcaaacttattttaacattgtggcattagaaatcgaaattcttgacgttttcggtttgtataagagccatgtcgctataatgtaatctttctctccgggttcacgtaaagaatttctctgcaccttttccatctttcaaaactttaatttcgaagaggaaataatcgaagatg

SEQ ID NO: 28025 - DNA, 3003 bp, Unknown
  misc_feature (1)..( 3003): 2750-1469P.txt file - cDNA_ID_2993581; gDNA_ID_1621084; Annot_ID_55344
ttttaatccttaaagagataaattaatttactctttaaaattttatttctaatggcatacctatgtaattacttacaaaaattaaggttacatttaaaatgtacttcccaaataatatagtaggatataaattataatctactgatcataacgcttagtttatagtacttatttgtattagactttcattgtacatgggaaataaaatcttaaaacaatctctaaaccgttaaactctagaccaacaacgaacccaaaaggccaaatgcatttatatgaacaagtttgattactagttccaccaaatttctacaataagtttccttgagatattccatagtaatttgaagttgatttttaattgacatttgttgcattataaatgagtaagatacgccatataattgttgaaagacctaaagcgagtttgagatcattaagataaagaggtagtcataaatcgtttatcgtcaaggtcgacgaaaaaaagaagtaaagtggtcatattcgatttctgataggtatgtaagagagagattaaatgctttctaaaattttatacatgatttggacctcttatctaatatcattcactcaatttatggacgagaacataacaaaaatttaaatacttatcgaagaaggaagaaaaaatatttagcaacttggctttaaaggttattccacttgtcactattcaaagattcgagttttgagcctttgagtaataccttggtcacccttatattgcaaccacgtggtataaagattgtaacgctttaattccaatgaccccttattttgtggacttttgtcatcaattgtaccaagtttataaagatatagaaactgagggcgtatgaattgtttcaagctagacatcaacaaaaaaaatgttatccactttctcaaatctatatatactaaaggatgtgtatttaatctagtagtttaaattatttgtgtaaaatttacaaactttatgttatttaattatagattttaaaaactttaatgaaatccaatgttattaaactaataatttaaaaattaactttaaaatcaattgttattgaaaacagtttgtggagttgattcttattcatcttgaaagatttgagaaaacttctttagttacaaatacacaaattcaaatctcatggttttagatagaatttgaaaagatttctataattttaagaaagttgatgtgattaattgtacaatcttttcaaattccatctacaatcatgagatttgttttcaataacagttgatttaaaagtaaattttaaaatcgttagttcaataacacttgattttaatagagtttttaaaatccatgattgataaattttacacaaatcacttaaaatactagattgaatacacttctacaaaatcatcaaaatcatataactacttaccctccccctcccacccccctctaaattaaccgtcattttaacaaaaactgcatgtaacaaaactttcaaattttaccgaatgtgacaaaactttcaaaactgcatgtaacaaaactttcaaattttaccgaatgtgacaaaactttcaaatgggacaacactttcaaaaacagcaacatttaccacatgtcacaaaactttcaaattttacttttatactttcacgtaatctaattctattaccactttgttagcaaccactccttccccatgatctcaaaatgtatcctctcctctaaactttcttccacttttttttttataagtaattgtaacagtcaaacagatgcattaacttcttctttattgctcttctttctcacaaactcagaagatcttccattttttttttcaaaatccaactaaaggcaattatgttttattttgccaaaatattttgatatatgatgtaatttggcatttattttgtatcagcatagcaggggcggccataatcttagtatatgcatataattgaggctgctcttaaattttagcgtatttatattgtagtgaattctttgtcttgtataatattttggatgtaggacctgaatgttggtacatgaagacaatctaatatttttaaagcagttatcattaagcatttaagcaagtaatgaaacacaacaacacggtagaaatttaagcaagcactttgatgatctctctccttaactcaaaacatctttatagtattgttgtgtttcattatttgttctatgttaattgctttacaaatattacactgtgtccttgtacaaatatttaggtctaatgctaaaactaatttttcttttgattcgcaacactcaaaataaaaaactgatcgaaagctaaccttatgttatactctctgagttctgacacaaacaagagaagaaaagagaggaaagtgatttagatgctttgatcgatgatagaatgagaagacaaaagcttgactttatagctaaagatcaacgtctatgccataaagtcaagcataattcacacaatatataagttgaacatgctatcaaaataagcttactacattggtgaaattatgcatgtgtggatatctcaagaaatatgcatgagatgcattactcttcttttacgctttgtgatttaagatattgtatgccaaatctatgtgttgccaacattgatttctataccaattggttgatacaatgactggaatttatcctttgatttgccaacattgatttctataaaagttaaacaaactaaaaataaaaagggaaaaatatttaataaaaaatgtacaatattaaatttccataaaaattttatatggttaatgttttggattagcattagtccccaaatcccatattaagtaaatccattttgagttttgttctcgcaaaccggtttaacccaagaacccaaagatctctctctatttgtttgccttcttctttctttctgactcaaaccctcaaatcaattctcgcgattaagcaaaaccctagatttattctactcttcgaagtcgatttcaatg

SEQ ID NO: 28026 - DNA, 3003 bp, Unknown; identical to SEQ ID NO: 28025
  misc_feature (1)..( 3003): 2750-1469P.txt file - cDNA_ID_2993581; gDNA_ID_1621084; Annot_ID_170460

SEQ ID NO: 28027 - DNA, 3003 bp, Unknown
  misc_feature (1)..( 3003): 2750-1469P.txt file - cDNA_ID_2993585; gDNA_ID_1621084; Annot_ID_55351
ggggaaagtcagcatcctaaatgaatgtcattgatatactgctttcaaatacagtgctttactacactgagactcagctaaataactgcaaaactggtactttggtacaaagtacatgcatacaaaaacgcacctagactgaaaatttgttttcttctcctttttaaccaatctctagctatcttgcttaaatagttctgtcaaagaatagatttactagtccgaattacaggtttctaacatctttcagttattagtttgtggtgccacctatcgatttgatgttatgaaattatgaatgcgtaaattatattaactaaaaacacataccacaacacagttattaccggaagatgcaagattctccatatcttcaacacggtttaatgctctgtaaagaagcattagaagcgtgtctattccctccctcactgggagagttaagcccttctcacgtgatatctcgaggtacctgtcgtaacatgtaacgttatctcattatatgccaactcagaccacagagaacagggatatctacaaaagctgtagaggaaaacaatatacataaaaagtgtaattgtatcacctggttatgtttttaattgctgaatccagtaaatcagctctactagggggatctgagaaaaactcttcgtcaaccggagtgtccattcctgcttttctaagaaaattggctctctggatggccatcagcccattatctacaacatcttcgaaaggagctgggggaggatgcagtccccagtatctgtttcttggaacctgaaaccaagcaaaaattttagttaagcagagtgcagctggacaaggcttaagacatcataaagttcgggttcgctacaagtcaggcaatgccttgagtaaggaaaataatgaactgtggttgataatcagtcaatttttagaaacaaattagagtatataattaaaaaccagctgacaggaaaaaaaattataccaccaaagaccagcgattaggatcccgcatgataaaaggaaaaacttcagaaggttccattttttctgacttcaaaaattgattcacagcttcctcaaagcgcaaatcaaaaagcagtagataccctatttgagcatgaagaaacgaaagcatgtctttcgaaatttccccctgtgagtcaagttcctccaccaaggagatggtttctctatatctctttttcctcaagaggtctttaatctgttcttcataaggcactctccgataaaaaataagctgaaacatcacaatgaaagagtcaacaaaaaattcttgactattttattaacaagatatactccaaagaaatgaagatagccattatcaggataaacacctttgacaaggtagtgacaaccaaaaggtttccgtctcctgcctcatctgcggccaaaagtgaaggcccacatccttgaggaccaaaactaactgattgaacacaagcaccagacttcttctgatgtatttccatttttccatctccaacagtcaccaagtagaaagacaattctccaacagaatcaggcctcctccgaaacacaaggctccctccaataggctgaccatttgtgtccacaacaactccaacattgtccaccaacaacaacactttccactctttacagagcaatttaagcagcggcggtccagaaacatcaggcaatgtgaaaataaccccacttagaccagtgacacacgagatcaaactataacctttaacagttcccgcaataacataatcatcaagccaaaccaaagttttgatcccaccaattcccagaatctctttcaaaacaacaaaggaaccacttaatccttctttttcagcacattgaagttcaatcagcaacattctctcaccaatagcaacagcgaaaacatagtgaccttgttggactctctcatgtctagaatcattacctctaacatcactcacaagattcccagcaccaagcaactgaagaaacttcttactcgagctagaatccgttgaaatctcagaaggcaacaagtcagtactcgacgaatcacgtcctcttactctcttagcaatcacattgatccctttcaataaaccacccaatctcttagctggttgagaaagaagcgaatccaataagaacaagtaaccattgcagagagctagaactctccctctttcctcgccgagtacaaagatagactcaacaggagaagggctcagcgatacacttgcgagacgcgagacggtattagttaaagtgtcgagagataggagaatcagagatccggagtaggttccgaggtatactagggtttgagaatcggagataggtgagagagataaagctcggatcttatcgtcgccgccgagatcgaaacgagcggtgagctccacaactgcccgagatttggacatgacctaaaccagatatacgatgtacaatggtagtgatcggatttaagtagaagaaagaccgcgattgaaaaactccggtgatcagtgtcgccgcttaccggtaaagtaaagagtcagacacgttcgagttattttgacttaccattacagcttaacaaacactaaacgctgtcgtttaaagcatcgttcaattataatatttgtttttgttttttgaagccaaaaacttaattttcaagttaagccctaaacaaatcaagttccttaaaatgttattttctaaaaaaattttgtttttttgtctgaattaattggttgcaaaaaaatttgatgcgaatatgcgatataaattcaattttcttgaatttttgatttgtagttttttctggaagaaaactaattttaatttcgtgatcctaagaacagatagacacgtggcgctctagatcgccagaagcccatccgaaaatacgatacttggcaagaacaaagccgcgccaatccaaaagcccaaactgagatggcactgcttcaatccaatcttcgtcttcatcatcatcatctccattaaagctgcttaagaatg

SEQ ID NO: 28028 - DNA, 3003 bp, Unknown; identical to SEQ ID NO: 28027
  misc_feature (1)..( 3003): 2750-1469P.txt file - cDNA_ID_2993585; gDNA_ID_1621084; Annot_ID_170470

SEQ ID NO: 28029 - DNA, 3000 bp, Unknown; identical to SEQ ID NO: 7131
  misc_feature (1)..( 3000): 2750-1469P.txt file - cDNA_ID_2993590; gDNA_ID_1621128; Annot_ID_56422

SEQ ID NO: 28030 - DNA, 3000 bp, Unknown; identical to SEQ ID NO: 7131
  misc_feature (1)..( 3000): 2750-1469P.txt file - cDNA_ID_2993590; gDNA_ID_1621128; Annot_ID_172409

SEQ ID NO: 28031 - DNA, 3003 bp, Unknown
  misc_feature (1)..( 3003): 2750-1469P.txt file - cDNA_ID_2993598; gDNA_ID_1620744; Annot_ID_49675
gagaaccggtctttctcatctctagtcgaaattcagcatttatctaagtgtaacaacaatttcataattatttcttattaggtttttcggtgagtttgaaccgggatatatattttgtaaaaatttatactatatatcttatcaatataagaaaaagaagaagaaggatatgtatctcagaagattagttacatctagctattgatgctttcaaagccataacaaaaaacgaaagccttggacttgttagacttataataaaaaagtttatcattcaaagatccatttctttataatttttataagaatctttgtaggagtagtgaattattgcaattttggctgattatatgagtactgtttgtggttgacaacaaaataagtgaactgtttgtgatgtatatatgtttatataaagacaaaatgatggtgtagtttagcaaaataaagaaattaaaggaccattggctgggataattttggagaaatgaaataaagagagaaagagagtgacgtcgtaggaatgtgggggaggaattaaagagataaaagggaaaagataccgaatcttctcatggttttgcaacttggtcggttccaattatttttcacacccactttaaatcataatattgtagggaaataatttcaagctacatattgtacattccgagttccgacagtactgcattccgatattttaattgattcaagttttgattacattttttctttttgctgatttggaaaaaaatcttgattttgtatcgtcatcaaacggttgaatttagagatttattgtattttatatattctatataaacttaacttttctcgtgttcaagtagtagctaggtcgccgaccttctgcatgaatcacatgtctcgtaagtttagagtagtaagttaaaattcattaattgtattgtctcaagaaacacgcatgatacaatagtatttttaaaaaaagaaagtaaaatttttattttattttattgttttcatatatttcaggatcgaccatgatcagaagttttctagatgatatcgacacgaaatgtcagtctatagaaaccgttagcagtgatcagtgatcacttatatagttgctaaattgaccgttacttgtcatcgttttatgttttatcttatcacccaaactgttttttatcccacagtaaacacaattgatgacaactaaaccaaataatatacgtgtttcaaacttaaaagaagaaacagcatcgtggaagatagcccattcccagagtggctattttgtaattaatgaagttttccatgtcctcgatcaaaacaactaagcgacaaaaaggaccgcccgtactaactcgtgagatccaaacgctgctactttcacgcgcctctactacaaattcctctttgcactaacccaacatttaatttctcagattattgatgtaaatgatttaattaccagtttcaagctaataatcaacggtacataaccactttagccaaatcggtctggtttgatttatccaaattattttacacaaaccgatcttgtaagctaaccacaatgcaaatagctaaatggagagtataggacacgcgctataaagaacgtgtgtgggagtgggaatagttcatattaataccaccactaactataatgttcgcttcgtcatatctgactaattactcattaatttataaggtttttatttagtttcaattaaattataaaaaggtttgtcgtactattccactagattcctattaaaacctctgacacagaaagaagggtttcaatctcattaaagagaaaagaaacgattagagaaagagaagagggtagagacttcttttctttgtttctgtggaggctcttcttcttcttcttctctgtctctgtctctgtctctctgtaatcttctgtgctctccacaaatttgtctctcctctctctcgccgactccacaaattttgagcttctttttttgaagttcttgaggtaactaaatctcactctctttatagttttactttgtttgattttgtcaattttgactctttgaattctggggttttccattaaaaaaactcagaaagttctaagatttatctctgaattgagtaagttctattgaaattggcgtatggattcgacagatttttgagcacgatgtatgttttaaatttcgatgtcgacgcaccataaattttatatatatgaaattgaaatcttgataacaacagatttggtctcatcttcttcaagttgttgttgttgatgtggctgctgcttagagtaatgtttgttgctgcaagttggcttattgtctaatccgttatattattattttattttatttatatacagttgtgtttcgatttgtaacattttagattccgtctttgaccaattaaatctttcctccaaataaaatatttattttcttgctttcatgtttttaattttgacagctactactactaagttcgttttaagcatcaattcgtttatgcaaatagagagaatatcatgtcatgtcttaaaaaacaaagttgctcagaaacaatctttttttggttttgattttcaagttagtagtaggaggaggaggagatcttttaggaatctattcctctgttttttttctttggttgagaaggacccagagaaactcttgttttgttttcagagaatctctgtttgtggtctctctttatgaaatctttatctctatcttctttcagattctgcttcttctgtctagttacttagtggccaagattcacttatttgactcggcaggcaaaatctaccgaatatcttatcttcttgcaacttgtttatagacttaaagctgtgtacttactttgttttgttgcttcttcttatcctttgtcttgttctgtctcttggtcgtgatatgaattagttctttcttcttggttaaattgcagaacaagtgaaagagcttaatatccacaagactcttgtttctttcttaaatg

SEQ ID NO: 28032 - DNA, 3003 bp, Unknown; identical to SEQ ID NO: 28031
  misc_feature (1)..( 3003): 2750-1469P.txt file - cDNA_ID_2993598; gDNA_ID_1620744; Annot_ID_166580

SEQ ID NO: 28033 - DNA, 3003 bp, Unknown
  misc_feature (1)..( 3003): 2750-1469P.txt file - cDNA_ID_2993602; gDNA_ID_1620744; Annot_ID_49685
ttttgagcttaagattctataggacaacatgatgaagcatgtaaacaaagcggacccctcataccacccacacacttactatcatcaataaaatcaccaaaatggtcaacatgatgttgacttttttgtttctcatgatgtttttggactcatcaaattaatgtccattctaaagaatttatttgggagattctatcattttcctctagctcacgtgtgtaatcatcagcgaaaccgacgcatggttttctatttttttcttccattactaaatccacaacctttattaacaaaaagagttataactaattagttgctttcaaaatatcaagttttgtcctaactatcactctgtatctgctcacgtgtattttatataactaaggatcagtgccagagaaggagattagcttcagagacgcacttaaggctgcaccacaggctacggcagccggtggtggtgcttccatggaggaaggagccgccggaaaagacacaactccggtggctgcgattggcaagcaagaaatgccaagtgcaattgtaatgatgcgcctcatactaacagtcgtgggccgcaagctttctcgaaaccctaacacttattccagcctcttaggtcttgtctggtcacttatatccttcaagtgagtcaaaaaataactcaaatatcaaaatttcaactataatcattgaatttgtttgttatataactttaactcatattttattttgctaaataatgagcagatggaatataccgatgccaaatatagtggatttctcgataaagatcatttcagatgcaggtcttgggatggctatgtttagtttaggtatgaacatgttcttataaacctgcataataaataaaattatgtataacgtattctaacaaaattaaactataggcctgtttatggcgctgcagccaaagatgatcccttgtggggcgaaaaaggcaacaatggggatgttgatcaggttcatctcaggtcctcttttcatggctggtgcttcccttcttgtcggattaagaggttctaggttacatgctgctatcgtacaggtaaactattcagagtttaccttgatttggcccatatatattattgttggaaaattaaagaaaacatacttggtgatggagaaagtgtttaagattttgggagtgaattaggaagtttaacatatagaagggactaattagttaaaaaaaaatgaaggatagatatgttcatagctttcaaaagtacaaatatctatctcatataaacctaatatagtctaccattatatctagacttatatgttacaaagtatctagatattatgaaaatatctagatattttacatgatgcaattctcctgtattagtctaaggaggtattaatattttaagatggttctaaagagactctttaacttgtttcaagttttgcgtttggtccaagaaattaatgatacctggatcattgacacataattataactaatccaaaatcaagttaaatatttcaaaatataaattacccgtggctataatttaaacttcgtttcttataaaagttttcgattaacttatagtagagatatgtacatctaaatttgatgaagccgatatgttcttttaggctgctctaccgcaagggatagtaccatttgtgtttgcgagggagtacaatttgcatccagacctactcagtacattgtgagtctcttgctcttctttttgttgttcttcatttacatttacggttgaacgtttcaaaatgcggtattatggtttatgtgaaatctctgttcttggtgattttttgttttgttttcagggttatctttgggatgatagtatctttaccagtaactattttgtactacgtcctcttgggcctatgattcacacaacacactgaagaaaaagattacaccggagaaattaaatgatctatgaataaagaggtctggaaatagagaaatgtgagctcttaagagttgttcttgaggagcttgtgagaaagattaattaacggttaattacattgttgaatcaaattactggtaaatggttaggtgaataatttaattttatgtatttgatatccaacattgatcgacgtacgtacgtagtgaggtagaggcttaggttaggaatcaatcgtgaatactatttcaacgttgattcccgcgagctgaatattttttgtgatgtatagtaaaacgcatatgattataggaatcatcataaagattcttgtcatgaagaacaatattaaaccaaattatgcattacgagcaaaataattatacaaaaatactgataattataacttgggtcattgtattttctgtgtaatgtctactatcccttaattagtcggtttaaatcaggaaaaagtataattaatgacactcataattgtatcgttaagacttgaaagtgacggccaagaatacaattaagagccaattagtgatctttcataactttaaaaatctcacaaaagtagaaaaaaaaaattccaacttgatgaccaagaataatactattaaagagctatttaagatgaaaccgcccgaaaccaaaagcattcgatgggtacaccgattactgcttttagcaacaccacggcgtgaccatcaagactaattaactaagaccacattttaaaaaaactattaataattactacaatttgtaattaaaaagatcaacgagaaatgccacgtggacgaatactagcaacgccaagtggaaagagcgttcgagagaacaaggcaaaaccaaatacgcccctagtattctacagatgtcgactggataattacaaaagatttcaataaacagtactaattaatttctagtggtgagtttttgtaaatatctacttcttccaattaccagctgctatataaatccccttctctgtttctcttttcttacatcacaatcacacaaaactaacaaaagatcaaaagcaagttcttcactgttgataatg

SEQ ID NO: 28034 - DNA, 3003 bp, Unknown; identical to SEQ ID NO: 28033
  misc_feature (1)..( 3003): 2750-1469P.txt file - cDNA_ID_2993602; gDNA_ID_1620768; Annot_ID_167384

SEQ ID NO: 28035 - DNA, 3003 bp, Unknown; identical to SEQ ID NO: 28033
  misc_feature (1)..( 3003): 2750-1469P.txt file - cDNA_ID_2993602; gDNA_ID_1620744; Annot_ID_166595

SEQ ID NO: 28036 - DNA, 3000 bp, Unknown
  misc_feature (1)..( 3000): 2750-1469P.txt file - cDNA_ID_2993606; gDNA_ID_1621202; Annot_ID_57697
ggcacagaatgaaaaagaactaattgctataaagagttgatcaaacttacagacgcttcatcaaccaatatagaaggaagtttcttttcagttgcaatgacaactccatttgaagctgcataaagaaaacaacagtcatgattaccaaagacaatgttccttaaaaatctcctctcgaatttgattagatcattgaaaaaacctttaattccaagtgatgtttggcctgatccaacagctgttagggcatgttctatctgaaccagcttccctgatgggctgtttcataaaccacaacatgaatcaaaccccgaagaaaccgttccaaatgctcagaaagagataacattgatatgataaacaaagttaatacctgaaggtggtgagagaaaacgagtactgactgtcccccattgaaaaccaactaaatcaagctgcaaaaaatgcgaaatagtgtcatctctggaaatttagaaacgtggaagctaaatctgttcttcatcaacaatgttcaaacttaaatgaaaagaaaccacgtctgagcaagtaagtagactgaagcgttcaaatctgacaaagcttaaaaacccggaagagtctcatcgccatgggcaatgtgtaaggaaaacgatgaaaaagacaagatataccaaccctaattaagaattgtgagtgaatcaaatcaaacacaaactcaaactcaaagatcagctcttagctcaaactcagagacgaaaattgaaaacttttcttaaaccccaaattcaatatatttaaagttatcaatttaaattcaacaaaagaaacccattcaatcaaagcaacatacctttgatatatggatcgaacggaatggtcgcaagagaagagagagagaagagacccaagtgaagaatttttaagctctcaaggtttcttgcacaaagggtgagagtctgacgccagaaaacgagagaaacaaaaaaaccaaaacggcggcgttttaacaacttcacagttactgtatcttacataatagtccaatattttatatctcttttcagtttgaaccacattatttatttactacccctagtcccctactctctctcgcttccacgcccgactcggactcaaacctggtccgaattggctgtgtctctctccatcgcctccttcttctctgacaaactctcctccgttggtcggagtttgtttcttcgctcgttcatcacaagcttcgtgtactggtaattgttccattttttctagctatttcggaaaattggatggaagaagcatctgaaatacgcgtgtaaatgtcgctgattgtgtcgttgaggcagagccattgttgattcttagagaaaatttgctcctttatttctccagtttgttaaactctcgattacgcccttgaaatgcattcgaccgggaagagaaatttcttagctgttatcagattattgtttactagttcgagcttggtcagaaaggctggttgtagaaatctcatttctgctacctttaccaccaggtgttcgacgttatgcctgaatgaatctgaagaatgcattgaggattctgatctatcgtctaggagaaaaaaatttgattatgttggagaagttggtgaaaaagagaaagtgagagatattactagtagtcctttacaagttttacgaagatggggttgtgatgatgatgaaatatccaagctttttactcgtaggcctgctttgcagagagccaatgttgctcagttagagtttaagttaagccttcttaagccactgggaatcacgtcttcagaccttgtgaagattcttaactgtcgtcctaggttctttagttgccgtcttgtccttgatgaaaggatcaactacttcatggagattttggggtcaaaagaggtgttgcgcagagtcattatccggaatccgtcactcatgttgtatgacctcgatgacaagatcaaacccgcgatagaatactacaaagggttgggctttagccaacaggatcttgtcgcaatgttgatatcgcgacccacgttgattccaagaacaaactttaacaatgagaagtttgaatacattgagaaaactggagtcaccagagaatccaagatgtttaaatatgttgcagtcatcatcggggtctcgaggatggagacaatcgaagagaaagttagaaacttggaaaagtttgggttctcggaagaagagatttggcacctgtatggaaaatgcccaatccttctctctctctctgttgagaaagttcagagaaacatgactttcgtcatagcctcgatgaaacttccagctcattccgtggttaagcacccttgtttgcttctcctcaacctcgagtctcgtctaaaacctcgtgcggatctcgttaagagagtcttggaaatgcgtctaaagccattgataaaagaagtgagcattttcagagcggtaaggatgagcgagaaacggttcttgaaggtttatgtaatgtgtcatccacaagatattgcaaccgagctgatggagttttacgagaaatccaaaaacatgaaacgtttagctgagaaatccaagaaatacatccgtaaaggattccccttttgaatctctttttcatcttttgtttctttggatatgttcattaaagatgtaacattgtgtagaattttccagctttatcaatggatacttttgaatcggttcatgttttggtttagatcagattagttaaaccggaatagaaaaatatcaaaacacaaaacgcgaagaagcacgtttggtgaaacgaaacgccaaagacgccctagacgtgtctctcttccagacccgttcgtggcggcagtgacaaaatcctctttattgataaaaacgtttgcaaagttgcaacctttttgggtttagtacttgaagagaatcaatctgacagcaaatagttttggcgtctttctaactcaacccatcatctctgttgcattttatcgagagaatatttgaggtggatatg

SEQ ID NO: 28037 - DNA, 3000 bp, Unknown; identical to SEQ ID NO: 28036
  misc_feature (1)..( 3000): 2750-1469P.txt file - cDNA_ID_2993606; gDNA_ID_1621202; Annot_ID_174957

SEQ ID NO: 28038 - DNA, 3000 bp, Unknown; identical to SEQ ID NO: 8247
  misc_feature (1)..( 3000): 2750-1469P.txt file - cDNA_ID_2993610; gDNA_ID_1621202; Annot_ID_57700

SEQ ID NO: 28039 - DNA, 3000 bp, Unknown; identical to SEQ ID NO: 7148
  misc_feature (1)..( 3000): 2750-1469P.txt file - cDNA_ID_2993617; gDNA_ID_1621129; Annot_ID_56429

SEQ ID NO: 28040 - DNA, 3000 bp, Unknown; identical to SEQ ID NO: 7148
  misc_feature (1)..( 3000): 2750-1469P.txt file - cDNA_ID_2993617; gDNA_ID_1621129; Annot_ID_172429

SEQ ID NO: 28041 - DNA, 3003 bp, Unknown
  misc_feature (1)..( 3003): 2750-1469P.txt file - cDNA_ID_2993630; gDNA_ID_1620621; Annot_ID_47042
caacaattggcgcgccaggtaggggggaatataaacaaattttctctaccctcctttaatcaaagcaagcatggttcaaatcgtcatcgaccccatcattcctccagtcaacgatgatgggacggaatcaagtctcctccacggaggagatccaccatctaccgtcgaagtagcggccaaaacgaccgtgaatcaaccaacacacggggagacccctatcgactcaccatctttctcattggaggacatcaaagccatcctcacaaccgtgacgaaagatctctctgaatcagtcatggagactaatcgccgactcgacgagctgccaaaaggaaggcggctggggtcagaccgcgccaaagccgtccaagacgaggtcgagcggctcctaaaagccggcctgattaaagaagtacaatatccagaatggctggccaacccagtcgtggtcaaaaagaagaatggtaagtggagagtctgcgtggattacaccgacctaaacagggcttgccctaaagacagttatccactgccacacatagatcgcctagtcgaggcaacgtctggaaatcagcttttatctttcatggatgccttctcggggtacaatcaacgaaaaacctatcttctataccagtaaagccctgaatgacgccgagaccagatatccgaccttagaaaagctggcgttggcggtgataacggcagctcggaaactccgaccttatttccaatcacattccatagtgttcactgatcagccactacgcacagtgctccacagcccaaaccagtctagacgaattgcgaaatgggcaatcgaactgagtgaatacgacgtggaatatcgctctcgcccgagcctcaaatctcaggtcctagcggacttcatgactgaactatccccggatgtgattgacgttatcccggacgaaaactggatactctactcggacggctcctcatcattacaaggctccagcctcggaattctacttcagtcaccaaccagagaaatccttgaacagtcacttcggctccagtttaaggcatcgaataacgaagcagaatacgaagcacttctcgcaggacttcgactcgctaaggggctcggagccaaacagatcaaagctttcagtgactctcaactcgtagtcagtcggttcagcggggaattcgaagctaagaacgaaagaatgcgggctcatctttcaatggtccacgtccaaggacttcccagaatggcattgtagattggttccgatcttcagaaagagatcagcgatcttcagatcgcattggttgctgtaaaagagcacgggaagagggagtgcaacaggttgcggaatgaccgagctgctaaagtcgcccgtactacaaagaaagcccaagctcgtcttgatagagtgaaggcttatctcaaggagcaagaggacctcgtcgggccaaaggtggatgctgagaatcaagccagaggcgctgaggagatagtgggcatccttatgcagagaggtgcgaagattgcggcatctgaactcagcggccttaaggagttaaccaaaagggcgaccgacgaagttaatgccttgaacgttatcgagctcggggacgatgatctgaacatgtccccagatcagctcggtttttcgaggcaaacctcccaagttgctccagtggcggaccagcacggctcaaatgtcgacctcgttagcggaagtgatattcgacgtgtaagcgttgaagaaacgaaccagacgacctgaataggtcgtctttgtaatctattttgaaatattgatcgtggacccaattttcggggcgatctcaaaactcttatttaaccgtgaacccactttcggggcggtttttaatttttacttctacgtcagggtcgacctcgcgtcgtatgagcgtccgttctcggggaggaaaaggatgtggacggagtttcctggtagattttttttaaatagatagggtaaagatatgtcgatcccgattagattctcatagctttttcttttgttgcagatcgatacaggcctagtccggattttcccgtcgagttcgaaggagttttagaggcgatcttccgagctcgtcgtcgtacctggaaagacgtcacgaggtcgcgcgtcaacaggataatggggaaggtcaggaaatccttcattagcttttaaacatgccacctcccccagctcccatcgaagaggaaagacagcctttagacggagaggcggctgcgtcaaatcctcccgttagtgctggcccttccggtggcgaactggtttgaagtttggatccttattgagcttatgacaggttacctccggggcgattcctgtcatatccttcgtagaccaagcaaaagatgacgacctcgatttcaggaaggcgatcagctcttcctttatctctccttctagctcgcttccgataccgaccgtccgagatggatccgactcgtcgatgttgacctggataattgttataggaaaactgaagtcaagctatagcgttcaggggttaatctggcgagctggaaatatgaagtcagggatgtttagcaaagcacgtgttgtgagctggcgagctggatatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacactggtatcagagccaagcgtttcctcggaatcaatg

SEQ ID NO: 28042 - DNA, 3000 bp, Unknown
  misc_feature (1)..( 3000): 2750-1469P.txt file - cDNA_ID_2993630; gDNA_ID_2926201; Annot_ID_141531
caattggcgcgccaggtaggggggaatataaacaaattttctctaccctcctttaatcaaagcaagcatggttcaaatcgtcatcgaccccatcattcctccagtcaacgatgatgggacggaatcaagtctcctccacggaggagatccaccatctaccgtcgaagtagcggccaaaacgaccgtgaatcaaccaacacacggggagacccctatcgactcaccatctttctcattggaggacatcaaagccatcctcacaaccgtgacgaaagatctctctgaatcagtcatggagactaatcgccgactcgacgagctgccaaaaggaaggcggctggggtcagaccgcgccaaagccgtccaagacgaggtcgagcggctcctaaaagccggcctgattaaagaagtacaatatccagaatggctggccaacccagtcgtggtcaaaaagaagaatggtaagtggagagtctgcgtggattacaccgacctaaacagggcttgccctaaagacagttatccactgccacacatagatcgcctagtcgaggcaacgtctggaaatcagcttttatctttcatggatgccttctcggggtacaatcaacgaaaaacctatcttctataccagtaaagccctgaatgacgccgagaccagatatccgaccttagaaaagctggcgttggcggtgataacggcagctcggaaactccgaccttatttccaatcacattccatagtgttcactgatcagccactacgcacagtgctccacagcccaaaccagtctagacgaattgcgaaatgggcaatcgaactgagtgaatacgacgtggaatatcgctctcgcccgagcctcaaatctcaggtcctagcggacttcatgactgaactatccccggatgtgattgacgttatcccggacgaaaactggatactctactcggacggctcctcatcattacaaggctccagcctcggaattctacttcagtcaccaaccagagaaatccttgaacagtcacttcggctccagtttaaggcatcgaataacgaagcagaatacgaagcacttctcgcaggacttcgactcgctaaggggctcggagccaaacagatcaaagctttcagtgactctcaactcgtagtcagtcggttcagcggggaattcgaagctaagaacgaaagaatgcgggctcatctttcaatggtccacgtccaaggacttcccagaatggcattgtagattggttccgatcttcagaaagagatcagcgatcttcagatcgcattggttgctgtaaaagagcacgggaagagggagtgcaacaggttgcggaatgaccgagctgctaaagtcgcccgtactacaaagaaagcccaagctcgtcttgatagagtgaaggcttatctcaaggagcaagaggacctcgtcgggccaaaggtggatgctgagaatcaagccagaggcgctgaggagatagtgggcatccttatgcagagaggtgcgaagattgcggcatctgaactcagcggccttaaggagttaaccaaaagggcgaccgacgaagttaatgccttgaacgttatcgagctcggggacgatgatctgaacatgtccccagatcagctcggtttttcgaggcaaacctcccaagttgctccagtggcggaccagcacggctcaaatgtcgacctcgttagcggaagtgatattcgacgtgtaagcgttgaagaaacgaaccagacgacctgaataggtcgtctttgtaatctattttgaaatattgatcgtggacccaattttcggggcgatctcaaaactcttatttaaccgtgaacccactttcggggcggtttttaatttttacttctacgtcagggtcgacctcgcgtcgtatgagcgtccgttctcggggaggaaaaggatgtggacggagtttcctggtagattttttttaaatagatagggtaaagatatgtcgatcccgattagattctcatagctttttcttttgttgcagatcgatacaggcctagtccggattttcccgtcgagttcgaaggagttttagaggcgatcttccgagctcgtcgtcgtacctggaaagacgtcacgaggtcgcgcgtcaacaggataatggggaaggtcaggaaatccttcattagcttttaaacatgccacctcccccagctcccatcgaagaggaaagacagcctttagacggagaggcggctgcgtcaaatcctcccgttagtgctggcccttccggtggcgaactggtttgaagtttggatccttattgagcttatgacaggttacctccggggcgattcctgtcatatccttcgtagaccaagcaaaagatgacgacctcgatttcaggaaggcgatcagctcttcctttatctctccttctagctcgcttccgataccgaccgtccgagatggatccgactcgtcgatgttgacctggataattgttataggaaaactgaagtcaagctatagcgttcaggggttaatctggcgagctggaaatatgaagtcagggatgtttagcaaagcacgtgttgtgagctggcgagctggatatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacactggtatcagagccaagcgtttcctcggaatcaatg

SEQ ID NO: 28043 - DNA, 3000 bp, Unknown; identical to SEQ ID NO: 4481
  misc_feature (1)..( 3000): 2750-1469P.txt file - cDNA_ID_2993638; gDNA_ID_1620708; Annot_ID_48945

SEQ ID NO: 28044 - DNA, 3000 bp, Unknown
  misc_feature (1)..( 3000): 2750-1469P.txt file - cDNA_ID_2993642; gDNA_ID_1620396; Annot_ID_155786
cttgagcattcctacgttgtcgtccgtgacaaagtactcgttgtccacaatttcaactcccttctcattaaaccggcttcggtcagaagatttatctaaccaagtggtttagaataaaaagtggaagggtaaaatagtaaataaacacctgtttgcgggcgaaatcctctgcacctgagaaagcaaggtaagagtggggagatttgtccatgacgagacgagcaagagatataggatttttcacggtggttatccccgaaacggcaccgcatcgtctcttcgtaccgtccataatgctagcttccatctcaaccgttcctttttccgtcaaagcagatccacggcctgaattaaacagaggatccgtctccaattctctaatctgtgttaatcaatcgtttagtatataattcaacaagaacaccgtaagaaatcattgtggggaaagagaacgtacgacgagctcaacgacgtcaatggcggagacattggaacgcaaagctattatgccgaggttgagacaacgagttaaaagctgtttagcctcttcttgtctctccgccggaagattagggtcgataccggcaccaccgtgtactgcgattgcccacccacccatattctctctctttctctttgttttatttatgtgtttcacagttaaaccgagaatgatggaagaaagaagagtcgcattaggtcattatataggccttttacgagcaaggagagacccacattttcttatttattgatttacctcttaatttttaaaaacattttttaattaccccatctgattttatttgttttgtttagttttttttttcatatgaaggaagaatatactttccgtatatttttctttacttttcagttattttgtcaacatttcccttttcaggttaatatttaaccaatttgggatttgttttaccattttctttctttgatttgattcgaccaagatgaaacgttattaaactgtaatgcttttcataatttcaagaaatctgcactacattttgtaatatgcaattttttttgctatgacatactatctcaaatgaaacaaaacaaagtagtcttgggaacttgcagttagctgtttatgttgaattccacgtcaggtctataacatgcatgaagggagcgataactattggttgttaattgttatgcattcttttatttgtcttattatattgataaaatgtggtttgggagaaataactgtttctcacaacttgtgaactaaataaattaaaagtttcaagttggcttgcaatttccctttttgtttaaacaacttctcttcttttcccgttttccttatgtttatctcgtcaattttgtgctaatctacgttattagaagatagattatatacgtcaatacacatagctcaatattatgtgtaaagtctatcttgtcgattatttgggtccaactcgacaggtatatcacaattttcctatttttatagtaaatcttacgtaatatttttctttactcaaatgtatcggttatgatttttcctatcatatgcaccgaaacatttcctcatatgcatcggagtctatagaaacctctttcttggaaatagcttagacaaatgttagtggattagtggtatactcattcccaatgtatagttcgattctaatatagtaatatgtttttaagagaagttgtaaagtagctgcgacacgcatttgctagcagttagcaggatcctatgcattaggcattagcaattgttaattatttaccgcaggattttgtgtctaaatatgtttatttattgttggccagtcgcatctttctctccacaagtttggaatctccgagattttctcttcatgtgttggaaaaggacagagcctagtgactttggtttgtggattccaataagattccgtcacgtgacaaactccaattagaaagacgtctattttcttctctctttgttgcctctcccatttcttaggggtcgtcaattagatccccacactctcgtggaatcttgtcctctcaaacatgttttgatgaccccacttctcctcttttttatacgagattcattacaaaatgaatcttgattcactacttcaaaacgttgctcaaaaaaaaaaaaaaaaaaaaaattcactacttcaatttactttttatagaaaaatcattcaaaacctctaaataactactgcaaaacgaatttttattttatttcaaattctagagatactttaaactatttttagactttcaaaaatggtttgcaaaaaaccttttagtgtgattttgtccatttaaggtgtcaatgatagtaacgaattacgcagtatagaatatgtggatcgattatatataacaagtaattgttagtgttggattatcctaaaaatcacactacactgccaattatgttaaattgtgaatatgttacagatggaatcacctggccatgactattgcctttcctctctacattcacatatgtaaatattagcactagtcgaagccaaatgagacacaacggtaatcgaacttttctttttggatgggttaaaattaactatttatgttgtgatttttttatatattttgtcgacacctaactcctaagatcagagctcaaattaaaagtggtggtgattcacaaatctatctataacgtgattcagggaacttgccactggctggagtttttagtaaacctaaaaaactattggggttttttccaaaacaaaatcataaagaaggggccctataacaaaataagaagacacgaaatattttagttaaaaccttgagataaccttatcctactagattccacgtggcattttccaagtggcgtaagaaaatccccgggaggaaatcagttgccacgtgtcagaagaagatcaaaactcgactcattgtgaccaaaggctattatttcctacacaaaattcccactcaccacacacaacaaaagaatagtgatcgaagctcatg

SEQ ID NO: 28045 - DNA, 3000 bp, Unknown
  misc_feature (1)..( 3000): 2750-1469P.txt file - cDNA_ID_2993652; gDNA_ID_1620675; Annot_ID_48220
aatcgaatagcaaattctgatttcttcttgttttcccagtttgtttttccagcgtatgttaagatcatatcaataataatctactttagctgccatgtttatttgtagtctttagttagtacggtgaaagtaatatgtggttttatttgattcaccttttcagctgaatgttttaaggatcggactgatgttcagtgtcttcatagatggcaaaaggtcttgaacccagagcttgtgaaaggaccgtggtcaaaagaggtgattttgtgaattgctttatatgctttactcggtttgagtctaatacaccttagcatttgtaatgtgttccatgacattacttttccatgttttgaaggaggataacacaataattgacctggttgaaaaatatgggccaaagaaatggtctactatatctcagcatttacctgggcgcataggaaagcaatgtagggaaaggtaatgcaaaggctctcaacttctttccgataaaatgatatttacatacattgggtggtacttcaacgcacataaacaatattgtgggtgatgtaggtggcataaccatcttaaccctgggattaataaaaatgcatggactcaggaagaggaactgactcttattcgtgcgcatcaaatttatgggaataaatgggcagagcttatgaaatttttgccaggaaggtaaatatgtcttttccatgggtcctagtataacaacataggtgtaacatgtccgtaaaattggtggcctcataaatgaaataataggtttttgatgctggtagttgtggtctatcgttcctgctttggtgatttgcttattttttcttacgttcctgtaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataaaatcccagtcatctcattctctgatgtctatagctgtaaggtgcaatgtctggtacatggttattgagtctattagtgaacttcttgttgcttaacacatcatctagtatgttgaattctcttcatgtgagatcgtatcaatcacatttgctcaaacagatagcatctagttatttcagctgtctttgtagaggattatagttttatagttggtctaaatctccataacgtaatcttataagctttaatctctaaatctcttacttgcccttgtaccaggaccaagaaacttctggaagtttttttgagttacgactgtgttctcctggtatg

SEQ ID NO: 28046 - DNA, 3003 bp, Unknown
  misc_feature (1)..( 3003): 2750-1469P.txt file - cDNA_ID_2993652; gDNA_ID_2926203; Annot_ID_141583
gtaaatcgaatagcaaattctgatttcttcttgttttcccagtttgtttttccagcgtatgttaagatcatatcaataataatctactttagctgccatgtttatttgtagtctttagttagtacggtgaaagtaatatgtggttttatttgattcaccttttcagctgaatgttttaaggatcggactgatgttcagtgtcttcatagatggcaaaaggtcttgaacccagagcttgtgaaaggaccgtggtcaaaagaggtgattttgtgaattgctttatatgctttactcggtttgagtctaatacaccttagcatttgtaatgtgttccatgacattacttttccatgttttgaaggaggataacacaataattgacctggttgaaaaatatgggccaaagaaatggtctactatatctcagcatttacctgggcgcataggaaagcaatgtagggaaaggtaatgcaaaggctctcaacttctttccgataaaatgatatttacatacattgggtggtacttcaacgcacataaacaatattgtgggtgatgtaggtggcataaccatcttaaccctgggattaataaaaatgcatggactcaggaagaggaactgactcttattcgtgcgcatcaaatttatgggaataaatgggcagagcttatgaaatttttgccaggaaggtaaatatgtcttttccatgggtcctagtataacaacataggtgtaacatgtccgtaaaattggtggcctcataaatgaaataataggtttttgatgctggtagttgtggtctatcgttcctgctttggtgatttgcttattttttcttacgttcctgtaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataaaatcccagtcatctcattctctgatgtctatagctgtaaggtgcaatgtctggtacatggttattgagtctattagtgaacttcttgttgcttaacacatcatctagtatgttgaattctcttcatgtgagatcgtatcaatcacatttgctcaaacagatagcatctagttatttcagctgtctttgtagaggattatagttttatagttggtctaaatctccataacgtaatcttataagctttaatctctaaatctcttacttgcccttgtaccaggaccaagaaacttctggaagtttttttgagttacgactgtgttctcctggtatg

SEQ ID NO: 28047 - DNA, 3000 bp, Unknown; identical to SEQ ID NO: 11978
  misc_feature (1)..( 3000): 2750-1469P.txt file - cDNA_ID_2993656; gDNA_ID_2214526; Annot_ID_134157

SEQ ID NO: 28048 - DNA, 3000 bp, Unknown; identical to SEQ ID NO: 11978
  misc_feature (1)..( 3000): 2750-1469P.txt file - cDNA_ID_2993656; gDNA_ID_2214526; Annot_ID_184758

SEQ ID NO: 28049 - DNA, 3000 bp, Unknown; identical to SEQ ID NO: 1414
  misc_feature (1)..( 3000): 2750-1469P.txt file - cDNA_ID_2993663; gDNA_ID_1620399; Annot_ID_155881

SEQ ID NO: 28050 - DNA, 3000 bp, Unknown; identical to SEQ ID NO: 4395
  misc_feature (1)..( 3000): 2750-1469P.txt file - cDNA_ID_2993676; gDNA_ID_1620703; Annot_ID_48815

SEQ ID NO: 28051 - DNA, 3000 bp, Unknown; identical to SEQ ID NO: 4395
  misc_feature (1)..( 3000): 2750-1469P.txt file - cDNA_ID_2993676; gDNA_ID_2926174; Annot_ID_140262

SEQ ID NO: 28052 - DNA, 3000 bp, Unknown; identical to SEQ ID NO: 8005
  misc_feature (1)..( 3000): 2750-1469P.txt file - cDNA_ID_2993690; gDNA_ID_1621182; Annot_ID_174312

SEQ ID NO: 28053 - DNA, 3000 bp, Unknown
  misc_feature (1)..( 3000): 2750-1469P.txt file - cDNA_ID_2993708; gDNA_ID_1620743; Annot_ID_49666
ttcatatttagtattaaaataatacttttaattagtttgttaattttcttaattttatttatttaaacatataagtaaatctaaaagaagtcatcgaagaaaattataagtaaaattattttttaatttaataataaaatatttgttatgatcccgacaactgcctagtagttttgtgaggacataaaggagaacagtgtggacaggaaatgaaaaagaaaaaaaaaaagaaatatagaagttgaaaattgtacgtgatcttgaaaatatctcttacgacgcaacttatgacttatgattccatattcttaagattattttaactagttagaagcatgaaacatgtgtagttgtgtacatcaatatgcaaacagctatctcatacgttttttcttttggttacagatagccgtaaaaaagaaatatatatccatcaagttggtaaaaattggtgagttttctaattcttgattcgatcgtaatttgtgagttttctaattcgtgattcgatagtaatttgctttaaacaaaaactacggattggttgaaacaaaatcactccattttaactagtatttagtctgttgccgagagactttatgatttcgtaggctttgaactaaaagaagcagagagtcataagatgaatttgttggaggtaagtcctcggtcataaaccaagcacaagagggaacaaaatcaatattcaagttcttaatgaaattagggttaaagcttacaaaatcttagaattgtatatgtatttgttgtttaagacaggtttcattttttgttattaatatgcataattactagaaccaaaactctttttaatccagagaaaagcaaatgttcttgcaaactttctcgtaaaactgcttttcagtcttatgactcctattgatgctaccattgtttaagcttttggtcttttaaataaatacggttggtcaatctatatatttatcaaccatcgaagggtctacaaatcaacaagtcatctctgtaaatggattggctaaacctttgactactttgcaatttgcattcgattatatggttagatattccatgttatgaaactttaatttacattggtcaaataattatttgattttgggccttataattgttgcagtggtccttaatactattcatttactataattaagactagcaactgactttattttaattctgattttgttaccaagttaagcacaccatctccaaagttccaaaaaggtaaggaatttattattaagaaactaatataagcatttgattgatgcttcatgcgatcgtattctaatcatgattctaaattgtaattgattttattattgtacataattagatacgatataataattaatgtgtaaactcacttatgttaattttgaaaaattatggagtgtgtgtgttatatgtgtctataaaatttgttttcgtgttattttagggtatttcttttaaattattgaccaaaatcacttggctttgtctcaattgtgatcatgtatattagatgtgcaaaataacccttacttaaataattaactctatctctcgtggtctcatctaaatgaaccgcaaggatgctcgccgcgacatcaagtttatatcacttttcgtggagaacagctacgccacaacttcgttagccatctcgtggaagcccttaggcgaaatgcgatcaatgtgtttatagacaatgatcaagagcttagaggtgaagatatcagcattcttttgaagaggatcgagtattcttgaatctccattgttgtgttctcgagcaggtacacagaatcgaggtggtgcttgagagaggctgtgaagatcaaagactgatgtaattttaccttacttgcctttcttgcctgttggcacaatccattagtcaagtttgatagtgaaagcaatgccaatgatcatcgtcatgttacttaagtcatctcgtatcgttcgattcaaattagttgtcgtttaagtttttgaagcatatactaaaaaaacatttaagttttcagttgtcaattaataataataaaaaaaaaaggaaaatgatgatgggtgagttttataatagttacggtgaacttggtcacattggataatttgtcattgttcttgggcggaccaataaaagcctctcttttgaatcccccacacagatctatcgcctcttcttccctcgtgtctgccagaatttttgtttcccgttgataaaggttaaacctttcttcttcttcttcttgtttcgatttcaagttcttctctttcgtgacctacggtgccgtttcatattccctaatttgattgaaaagggttgcgcaagggctttgaagtgaaacacttttgattcttgttgttgcttcaagttttcatttttatcaattgggttttggagaaaacactatgagctgtgattgaattgtctagctcgaagaatcttgattttgtttacacagagaattggtttcttctttcttgatgatagtacaattggattctgaatgttgtgtagagtttttggaattgctcattggtgtatgcttttgttatgcagggtttatctttggtggatgattagtgaaactttttaaggagataatagttcacatgttttagttaaaaatggcagcttcaagcggctctggtttggaaggttagaaacatgacctcaatccttttgttgttatgtattctttgtgtatactgactttaggaagttatatcgagtttccatttctttatttccgtttcttagagtgttttgcttttacgtttaactttaaataagaatgaggtcttgtttctgagactcatcaatttagagagctttatagggtagctttgagctttgtttattggctttgctgaggtattttgtttgtatgtattgttttgatttgaataaagaagagcttttgggatttattctgttttttgctcttgactatatcagctgaggagggggaaataagtatagacatg

SEQ ID NO: 28054 - DNA, 3000 bp, Unknown; identical to SEQ ID NO: 6950
  misc_feature (1)..( 3000): 2750-1469P.txt file - cDNA_ID_2993716; gDNA_ID_1621118; Annot_ID_56226

SEQ ID NO: 28055 - DNA, 3003 bp, Unknown
  misc_feature (1)..( 3003): 2750-1469P.txt file - cDNA_ID_2993716; gDNA_ID_2926161; Annot_ID_139717
aatctaacatcagcaagaaattcaaagagaccataaaaccaagtcaacaacactatgaaaactatacctcccaacacgattccctaaacgcgttgtaaagttattcaaaaccagttctggttgatggcttgtaggatttccgtgattctgcagttacatttaacatccaattcagtgatcactaatctacactcgatgtagagaagagtaatggttagcttacataccttaatatccttccttagaacaagatttgacaatttgaaatgagcagtaggaccatttggcaaaccgatgataagaagcgcatctacatatgaaatagcaaaagcttgaaacaaagcatatacagtagagagcacaaaacttgaaactcagtgaaaactaaccaggttctctacgatttgtatgaacaacaataagagatgtaaaatctttcttcgttgcgtattctacaatctgcagaaccatatctaacaaggttatatagttgcaaaaagactaactttatagagaaacaaggaagctatgaaacttataacaacaccttcttcaaatcataggttcctctcttttgataatgagagtttggtatcaccgaaagcaactcagatattaaagcaggtcctctctgcaatccaacaacattacttgaatcagaaaaccacaaacaaatctgtagaatctcttatgaaacaatggtaccaaaaaaaaaagacttacagtggaattgaaacgacatgttgtgagcaagaccttaggtgcaatctcacgtctcagaactggattaaactcatcagcatcaatatccgcaaacaactacaaactcaattacactaaattagcaacacgacaatgaattgaattcaaaaattgagatgaatcaaactttaaatctaaacatacttcttcatcgtcaggtctgcaaacagtttcatcagattctcttgtattctcaatcgtcttcggaatcatcttttgtggaggctacaaacgaataacacacaccaaacttaatatctcaaattcataaacacctttaaaaaatccctaaaaaagcttctccagatcgttacctcttctccaagctctaaagctcgtttctcagcagcatcacgagctctaatcttcttctgcttctccaatttcttctcatgcttctgcttcgcatacacttttgatctcttatctttgttcttaatcatcgaaggaagtatcacattcctcttctcacccccactgaaagtagactttccacgaacatcagattccatttcctcaccatcaccatcatctttcttcctcttgaaccccatttttacgacggacggcgaacgaagcctctctctctttaatcgatgaaaacggcaaagctgagaatgaagacgacggagactaacttagggtttatcgactcaaaattgaaaaacctatacaaatgggcctatgcttgggcccatctttaagcataggcctatctatctttataatattcgttaaaccgtcgccgtatcagtctattaacgggcttaattctgggccttgaagaaacattatactatggcgtttcattataacgatattaaacgacgccgtgtatgttagctatcaatttcgtttctcagtggtcactatgcgatgcgccatggaagaggaagcgccgtatcagctgcaatttccggtctatcaccggcgaagaattcaccgtttccacagctctgcaatgtccttctcgtcgcgtctttgtccaagaccttgtctcagtccggtacacgaagcctcgacgcgaattcgataccgatttcggaacctgtggttctccagatccttcgtagaaactccatagatccatcgaagaagctagatttcttccgatggtgttattctcttcgtcctggatacaaacattcagcgacagcttactctcagatatttcgcactgtttgtcggacagggcttctcggagaagttcccgatttgcttggttcaatgaaggaagatggagttaacttggaccagacgatggcgaagatacttctagattctctaatccgttcgggtaagttcgaatcagcgttaggagttttggattacatggaggaattaggagattgcttaaatcctagtgtatatgattctgttcttattgctctggtgaagaaacacgaattgcgtcttgctctgtctatattatttaagcttttagaagcttctgataaccatagtgatgatgatactggtagagttattattgtaagttatcttcctggaactgttgctgttaatgagctcttggttggtctaaggagagcagatatgaggtcggagttcaaaagggtatttgaaaagttaaagggaatgaaaagattcaagtttgatacatggagttataacatttgtattcatggatttggttgttggggagacttggatgctgcattgagtttgttcaaggagatgaaggagcgaagttcggtctatgggtcttcttttggtcctgatatatgcacatataacagcctgattcatgtgttgtgtttatttggaaaagctaaagatgctttgattgtatgggatgagctgaaggtgtctggccatgagcctgataattcgacatatcgtatactgattcaaggatgttgtaaatcttaccggatggatgatgcaatgaggatttatggtgagatgcagtataacgggtttgtccctgatactattgtgtataattgtcttttagatgggacactcaaggcaagaaaagtcactgaggcttgtcagttgtttgagaagatggttcaagaaggagttagagcttcctgctggacatacaacattctaattgacgggttatttaggaacggaagagctgaggctgggtttactctgttctgtgacttgaagaagaagggtcagtttgtcgatgccattacgtttagcattgttgggttgcagctttgcagggaagggaagctagaaggagcagtaaaattggtagaggagatg

SEQ ID NO: 28056 - DNA, 3003 bp, Unknown
  misc_feature (1)..( 3003): 2750-1469P.txt file - cDNA_ID_2993732; gDNA_ID_1621153; Annot_ID_56916
caaggatgtcacgtttgggaatcacagaatcaagaaagtaagaaacaaaaagaacaaagatcaaataccaaatcagcaataacagcaggatttcgaggatcatcctcgggaattccctgctcaactttcccaacgagatctgccccaacatcagctcccttagtatatattccaccacccaactgagcaaataaggcaacaaacgaagcaccaaaaccatatccgacaagaagaagaggtactgtaagagaaacagaaaattcaatcaataaatcttacaagtttaatagctccactatcgcccatgcaaatgcaaattctggtcaataaatcaagagaattacatatagggttcactgaaaatcttagaactgtattggtaccccacctcaatcaagattaatacaagtcatgacatatttaagaaaatactgctcatgtctgaaaatgatcctttgaaaagataacaataactttttgaaactcagtacaatgattatagaatatacacacaagacgaaaatgaatatttttcataaaaaaaaaagagcagaagacttacggtcagtaacattcattgagcctggtgaacccacgcccaaccacacataaaatgtagaatagaggatggcgataccaatcacagccataccaacaacaaccagggctgaaaacccaccagcacgaacggctatctgcattatatctgccacttagtatttggaaacgtgtacatgacatgttaccaaaatagctaaactaaagaagaacctgcaatgcttctctcgcagatcgtctggcagcactggagacccgcacattagcacgaactgacacccacattccaacatatccagcaatacctgagcatagagcccccaaaagaaatgcagcaacagtaatataagcagacatcgccctgcagcaaaatagtaatatggctaagcttcattcacaacaattcaaaagataaaataaatcttgtgaatgtaatcatgtatcagcaccttcctaaaccagcagcctcttgctggggagttaagctacggaatagatatatgcaaagaatcacaaaagctagcaaaatggccatcttggatatagtgctatactgcgttctgaaaaaaccttcagctccatcacgtatagcatctgatatctataagtaagagaattacctcacaaattagaattacaaatttttgatgagaacaaagaaggaaaaatgtcaacatcatgactaacaccacataatctgagtgagcttacctcaaccatctctggaggtccttcatctttcgctaaaacccacttggttagatatattgacaaaaggaagctgatgatgcatactgtgaagacgaacacgatgatgggagaagtacttgcccccatgtaaaagattgctccgaagcagaaaagcagaattatcgaaaggacacggacatttaatttcctaataatccggaatatctgccaaaaaacaactaaactttatacaatttcaaagaaaatgaaaacgagatgctcaagaaactaagatgctaaacgaaatagaaggaaactagttataatacgcatctcagtgatctgatgcaagcaaaaagaaaagcactcaagaaagagaggaataaaagttgtaccagtggactataggttttactacgcatgttgggaaaagccctaggcctgtcattgaaagacatcaaactggcctgctcaacatcttcatccatcatcatgttttgagctgaattagcccttcggactatgtgtagaggcgtaaagtcaatgctatggggcaactccgccccagaactcggacgctgaattttaatacactacaactttttcctccaaacgttaacaacagcacatcacaaaacgagcacaagttagtatgaaccctcttaactctagctatatctttgattccagcttcttcaaactttctcagtagagttgccacaacaagtttccaccacaatcaaaatttctgaaaaaaatagaaaagtatgaaaagttgtgatgtttctctttaccaaccaaatagcatttttaaatgaaatataatcagagtaaggttctacagtaaagtttagctataactttcatcatttcccatgagcgtaattgcttctacgatcaattccccagaaaagtgcgattaacaaacagacctcaagatctaatcgactaagatttcagtgaataaaacgcaagggactttgcattccgagtttaatgaatcaagcaccgttactttaatttagatctgagttctgttctaagagaaattcacatgatctctagacaggaaatggatacgtttccagaaacgaatccaacgaaaaaaaaaaagcatacgaagagtttatccggaaacaaaccctaaaaatcggtaaaacagagaagatgacggctccggtgagagtgatcagaaggaaaccgccattagcgaaagcttgttgtagccgaagaagcgctctatcctctcgctgtctccgttctaaatccgaagacttttcacagaactttccgaatatttttttcctaaattaatttttctacctttaattttattttcactcctcagtggttcaatactaattttatgacacatcctatccaatgagtcgttgacacttaatcactattctcacttaaaaagttaaaaacttaaaatcatcctcgtttgttaaattatatagatcgagttaaattatcaaaaatacccatcaattttggaatattaacatttgaatattatatgggcctagcccaaaattatgttttgccattcggcccatataatagacaatctgcaaagtgaagaagaagaagaaccactaacgttatcttaccggcccgatcacggagctcacctttcatcgtcaatctccggcggacgaatttctcttcgtagccgttacttctcattatttctttgaaactttcttagaaaattctctgttttggttaggacaatacaaacagaggatg

SEQ ID NO: 28057 - DNA, 3003 bp, Unknown
  misc_feature (1)..( 3003): 2750-1469P.txt file - cDNA_ID_2993732; gDNA_ID_1621153; Annot_ID_173321
attgtaaaaagaatgaaaggaacaagacaatcaatggttatgtgtgacaacattaccgcgccaaatgttataacagctaatataattgtcagagaatatcctttctgaagtacagccattggatcctctaccggagatttcacactagcatcacgtgttcccttgattgatagaataccaattgaggatataatcaagtcaaaagaatgaacaactagaggaaaaaggataaagcctgatggatctgcataatagagaaagatttgagtaagtatcaagcatgaacaagaggtttaataggatgtttatcagcgcatatctaacaaccactgctagaaatgggtaatgttattgaaattttttgactgcagccaagtgtagcttgctgtcatgaaaagtagtcttccttcaattttcacacaatgcatagcaggttcgtacaaggtgcttcaaacaataactctatacaacttatgtcgactttttaaatcctaacaagtaataatgtaccctcaaatcctcaaggagtgaccaaaacatgcaataaagcgtagattattctgtatacagaatgtaatttacgagcttgaactctctatgcaactcttcctaagtttgcatttcagattataaaatcctagcagttcatttaattttctcggtatgagtcaggaactcacaccataagttatatatttgcatataccagaagtaactttaaagagagatggtgcaccttcaattttgcacttcttagccattgttccacctagtatcattgcactgatgatttctgcagctatactttcaaataaatcagcacctctagcagcacagtcccccacattgtctccaacctacaagaagatgaaaatggctttaaatgcctaaatgacgaaaacacaagcaaacccttgtagagtgatatatgccccaaacaaggatgtcacgtttgggaatcacagaatcaagaaagtaagaaacaaaaagaacaaagatcaaataccaaatcagcaataacagcaggatttcgaggatcatcctcgggaattccctgctcaactttcccaacgagatctgccccaacatcagctcccttagtatatattccaccacccaactgagcaaataaggcaacaaacgaagcaccaaaaccatatccgacaagaagaagaggtactgtaagagaaacagaaaattcaatcaataaatcttacaagtttaatagctccactatcgcccatgcaaatgcaaattctggtcaataaatcaagagaattacatatagggttcactgaaaatcttagaactgtattggtaccccacctcaatcaagattaatacaagtcatgacatatttaagaaaatactgctcatgtctgaaaatgatcctttgaaaagataacaataactttttgaaactcagtacaatgattatagaatatacacacaagacgaaaatgaatatttttcataaaaaaaaaagagcagaagacttacggtcagtaacattcattgagcctggtgaacccacgcccaaccacacataaaatgtagaatagaggatggcgataccaatcacagccataccaacaacaaccagggctgaaaacccaccagcacgaacggctatctgcattatatctgccacttagtatttggaaacgtgtacatgacatgttaccaaaatagctaaactaaagaagaacctgcaatgcttctctcgcagatcgtctggcagcactggagacccgcacattagcacgaactgacacccacattccaacatatccagcaatacctgagcatagagcccccaaaagaaatgcagcaacagtaatataagcagacatcgccctgcagcaaaatagtaatatggctaagcttcattcacaacaattcaaaagataaaataaatcttgtgaatgtaatcatgtatcagcaccttcctaaaccagcagcctcttgctggggagttaagctacggaatagatatatgcaaagaatcacaaaagctagcaaaatggccatcttggatatagtgctatactgcgttctgaaaaaaccttcagctccatcacgtatagcatctgatatctataagtaagagaattacctcacaaattagaattacaaatttttgatgagaacaaagaaggaaaaatgtcaacatcatgactaacaccacataatctgagtgagcttacctcaaccatctctggaggtccttcatctttcgctaaaacccacttggttagatatattgacaaaaggaagctgatgatgcatactgtgaagacgaacacgatgatgggagaagtacttgcccccatgtaaaagattgctccgaagcagaaaagcagaattatcgaaaggacacggacatttaatttcctaataatccggaatatctgccaaaaaacaactaaactttatacaatttcaaagaaaatgaaaacgagatgctcaagaaactaagatgctaaacgaaatagaaggaaactagttataatacgcatctcagtgatctgatgcaagcaaaaagaaaagcactcaagaaagagaggaataaaagttgtaccagtggactataggttttactacgcatgttgggaaaagccctaggcctgtcattgaaagacatcaaactggcctgctcaacatcttcatccatcatcatgttttgagctgaattagcccttcggactatgtgtagaggcgtaaagtcaatgctatggggcaactccgccccagaactcggacgctgaattttaatacactacaactttttcctccaaacgttaacaacagcacatcacaaaacgagcacaagttagtatgaaccctcttaactctagctatatctttgattccagcttcttcaaactttctcagtagagttgccacaacaagtttccaccacaatcaaaatttctgaaaaaaatagaaaagtatgaaaagttgtgatgtttctctttaccaaccaaatagcatttttaaatg

SEQ ID NO: 28058 - DNA, 3000 bp, Unknown
  misc_feature (1)..( 3000): 2750-1469P.txt file - cDNA_ID_2993736; gDNA_ID_1621153; Annot_ID_56941
aaaagctaaaatcgtgaacaatccaccattggagacgtgccatcttcatcctctgagatgtggagattctgcttcttcttatcgttactattctttgatgttagcgcggtgaaatctgcagaatcgattttcctcccaagtcaaatcggagttgaagattcccgcgtctttgaatctcttagtcttagtcctgtatgctccgcggctgatccaaacctcaactacaagccggtcatcgggattctgacccaccctggcgaaggtcgatgggacgctcgtcttcactctctgaaaaactacgcctacgcgacgaacatatcgtacatcgcagcttcgtatgtgaagttagctgagactggtggagctcgtgtgattcctcttatctacaacgagcctgaagaaatcttgtttcaggtttactctgatgattttgctcttatggattccgttcactatgtagccttctttaatcactaatcttacaactatttattctacttgaacttggctacacctgatttgtttacatcacataaacaggcaatttgaaataagttcaaggttgatgttaccatgttattgttttggctattgcttgtcaaaattagttcatgttatcttagtgaatttcatttttgagttgcagaagctagaattggtaaatggtgtgatattcacaggtggttgggctaaaacagggttatattacgatgttgtggagaaaatcttcaatgtaagttctcattatgcaaacactctctgttgctttcatgtgttagctgagctgtacaacgtaatagtcttttgaaatccttatgtttctcacagaaagttatggagaaaaatgatgctggagaacattttccggtgtacgccatgtgtcttggattcgagattttgtcaatgatcataagtcaggtcactcttttggcttcttgcttcttttgttgcttaagtaacttccatatatgtaaagcaatgtttcacactgcctaaaatttaaaagagctttaagctgcatatcttgagctgagagggatatgcagtttccatcctaaatttctgacgattttgtgtgttttgaaacagaacagagacattcttgagaggtttaactcagtaaactatgcatcaagtctccagttttttaaaaacgttaatatcgaagcaaccgtgttccaaaggtgcatatatagctatgctttaaacttttcagtgatccaaagaacaatatcccataattgtaatgtttcatatttgcagatttcctccagagctgttgaaaaagctcagtgcagactgtttggttatgcagaaccactatgttagtatctctctaattttctgcagaatatgaatataggctatagctctcaccttttgttgctcttaagtatactttgattgctgttttcttcttataagtatctttaatcctatacagttacacaattttatatttcctgttttcttgttcatgaatgatttattatattctctctgcttttctgaaatgaaatgctattgtttcccagtttggtatctcaccagacaactttcaaggcaatccttatctgtctagtttcttcaatatcgtcacaaccagcgccgataaagacagcaaggtatagttaatatgttcctatacaccgattatacaaattccacaagctgacaatttcaatgaagggataaatttatcttttttctttccagacttttgtttcaactattcgatcaaaacgataccctgtgaccgccttccaatggcatccagaggtattacacacaagttaacttgtgtctctcattagtcttctcaatcctttgttaacttatatcttttactatgctatatgctttataatggatatatgtttctaaaaagatccttaaaatatactctgcagaaaaatgcattcgaatggggatcatctgaaatcccacactctgaggacgcaattcaggtgactcaacatgctgcaaattatctagtcaggttagttctctattgatcaatgttggaaagtatcattaaaagaattatgtagtggttcaattttcttatttgaatgttggtgcagtgaagccagaaagtcaatgaacagaccatcttctgagaaagtgctgagcaatctcatctacaactacaagcctacgtactccggatacaaagggtacaacaaaaaaaaagccacttcataattggagtccaatccttacagttcttgctgtatgttaacaaatattggatcatgtatgatcaacctcgttgggtttttttttgcaggagcggtgacgacgaggtttatattttcacgtaacaaagatcccttctctgtgtgttttcgccaaaacatagcaatttatattagttactaagagcaatacagtgtttctccttatccaccattgattgtaagttgtaaccaaggtgttgaactataatttaaaaaaacacagtatagatcacatgaggcgtgaggacgcaatcacttgttcccatatcttcctctaaaacctaaatcctaaaaaatcccttttcaaagatcaagttttaaggcaaaaaagcaatcatgattttggccagacacagcgaaaggaccttgtctgtttcgaaaaactcatttaatcatgtgttattaatttattattatcaacaatacaatcgtactgggtgaccaataatgagacgcacccatcaaattgggccctccacggctccaccactgagagggatacacgaaagtcgttttacaaaaacacctattaaaaataaatgtgcataaaaatctattaccacgtgtacggtgaagattaggttctcgattttgtataagaaggtcgaagtgtgaagaaatcaaaaacccaaaatcgtgaaagttcatttctcctccattgatctttctttactcagatctttcctcttcctctgagatgtggagctacgtttggttaccgttggtagctctatctctctttaaggatagcatcataatg

SEQ ID NO: 28059 - DNA, 3000 bp, Unknown; identical to SEQ ID NO: 4408
  misc_feature (1)..( 3000): 2750-1469P.txt file - cDNA_ID_2993740; gDNA_ID_1620704; Annot_ID_48839

SEQ ID NO: 28060 - DNA, 3000 bp, Unknown; identical to SEQ ID NO: 4408
  misc_feature (1)..( 3000): 2750-1469P.txt file - cDNA_ID_2993740; gDNA_ID_2926206; Annot_ID_141717

SEQ ID NO: 28061 - DNA, 3003 bp, Unknown
  misc_feature (1)..( 3003): 2750-1469P.txt file - cDNA_ID_2993752; gDNA_ID_1620618; Annot_ID_46966
tctagcgttacacataggtcgatatagctagcacaagaatgaaaactaactttatttgtcttgggaacaagcgaaagatcgaaactccgacagacgtaatcttaattcgctgagaggcgtgtgagaattgcctttttccttgaatataaaatgcactcccataatgtaatcaaacaaaagatataaatagaataagaaaaataacaactcagcgtaacggagtccgattaacggagtgagaaatcatctggtttctcgagagttctaagccaatgataatcgaaggaaacgaacggtgttgtgtgtgtgtggttaagaaaagaacaaactcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatg

SEQ ID NO: 28062 - DNA, 3003 bp, Unknown
  misc_feature (1)..( 3003): 2750-1469P.txt file - cDNA_ID_2993752; gDNA_ID_1620618; Annot_ID_162156
tcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatggggactggagattctgcttcgagactgattctctggttctgcttagggtttttgattctaggtgttggatttgtgcaatgtggagttacttatgaccggaaagcacttctcattaatggacagagacgaatcctcttctctggctccatacattaccctcgaagcactcctgatgtaagatttaacaaaagccctaaacttttctcttttttcttcttttgggtttaacaaaaagaccctatgtttctttcctttatgttctgttttatacaatttatcaaaaaggttttagctttattaattttaactgttgttcttgttgttagatg

SEQ ID NO: 28063 - DNA, 3000 bp, Unknown
  misc_feature (1)..( 3000): 2750-1469P.txt file - cDNA_ID_2993752; gDNA_ID_2926211; Annot_ID_141977
agcgttacacataggtcgatatagctagcacaagaatgaaaactaactttatttgtcttgggaacaagcgaaagatcgaaactccgacagacgtaatcttaattcgctgagaggcgtgtgagaattgcctttttccttgaatataaaatgcactcccataatgtaatcaaacaaaagatataaatagaataagaaaaataacaactcagcgtaacggagtccgattaacggagtgagaaatcatctggtttctcgagagttctaagccaatgataatcgaaggaaacgaacggtgttgtgtgtgtgtggttaagaaaagaacaaactcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatg

SEQ ID NO: 28064 - DNA, 3000 bp, Unknown; identical to SEQ ID NO: 3679
  misc_feature (1)..( 3000): 2750-1469P.txt file - cDNA_ID_2993752; gDNA_ID_2926211; Annot_ID_202619

SEQ ID NO: 28065 - DNA, 3003 bp, Unknown
  misc_feature (1)..( 3003): 2750-1469P.txt file - cDNA_ID_2993756; gDNA_ID_1620832; Annot_ID_169710
ttcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgactcttttcttctagggtttgattatgttggtttagggtttctgttgttggagagagatagagagaagaagaatctgaaacggaagtaggatttgtgtgtgttcgagaagagtccttgggaatgagcgagtttgttcagtaatttcgtagtacttgtcaactttgaacttaatttgaagagacatgcattgactctataaaaaaaattctacttttgcattcatgactactcttattccatgaatgttttaacattccatgaaacagtactttagtaagaatctttggtaacctatcataataaagatccttcttgacttcgcgcgctcaatgcttttgtacgtacgatggagaaaaacacttactaaaaaaaaaacactttttgttttgacatttgacctttctaagttactttttttttttgtcgtctgaaaatttattatagagattccggtgaaatacaaaagtgaaatataaagccggcggttaacaagtaacaccagaaaactaagccgacgattaaaaggatagtcttggaagcaaaacccaaaggaaagggagacaacaaggcaaaacaaaccttacaaacaaagcaaagttgcgaaactgaaacaaagaagcagaccaaaacaaccaaaattttaaacacaacatctcgtcaaccacattaccagacaaaggaaaggcagagctttacaacaagccactccgtaggagacaaggaactcccaaccaaacggacagcggtgccacctattacgatgaagactaccttacatagaagagttccaaggaatccataccggcgagaagaactaggccaaagacgacaagtcacacctacactcccggaatcggcgaattaaagaatatgattgtttagcgcctcgaaggaaaccagccaatgaacagatgagatctcgatcagatctttagagtagagacaaggagagaaccaaatcaattcggaccacaccgaaaaagaaaaacgggaggagatcgaaccggacagaaacgaaagcaaccaccaagcctggtaagaggctaaacgagaagaaggctaaaacatgaccggatcaagaggcgctactagcaacatagaccaacccacaaaaacaacataagccatctaagaaccattcgaaaatccctacaccacaacgcacataaactaagtaaaagcaacataaactttacaacagagcaagagacgcatagctccggcgctatggaagccaccaaagccagccaacgcaaactgagatctagatctacttttagagagaatgaagaggttttagagtcctccattctttacacaaattattattaatttgatctttctaagttactagtatataaaatatataaccatcaatattcacgaaacaagaaagctaaagaaatcaatttccatgattgaagttactttgacagtataaattacttcatcctaaactatattaacatgcacttttttcttttagcttaaaaaaccagagcaagtctgatcttgcaaatgcatgaaaatcaagagttggatctatcggaatcctttattatatcattgactttttttgcagtaaactgccagtggatctcatgaatctaaagaaaccatagttaaaacttaaacctgaaccgatcaaaaattaaactcgttagtcttttgtcacggcgaggggataataagaagaaaaaaattatatcagaagagtgttttttttcggataaagaactaatatacttgtcaatgagcttaatttgtttttgtttgctttacactacggacggctctgaccgtacgaacaaaattattaaggaaaatcataattaagaggttgacattgcattttagatattggtgtaaattatttgttatatatactttattcaaaattctctatgtatgtacatgttaacgatcctttactggaaaacttaaacatcttccatgccatgtttaaatttgttttcacgtttttttattttgagctaaactgatatttctttgtgtattctgaaatatttttggattttggtattggttaaggttataattttccagctgaaaaggatgaattctctaaaagttttcaaagatagggtatcatttcaaaatacattttttaaaaaggtttgcttctcctaatttcatattatctttttgacgtcaccactcaccactattgaaaaagcatttcttaattttctttaacaaatggagttagtagaatattattatctgcacgttttccctatctaataacaggggtaatttcgtaaatcccccttcaacaactaattaatgtgccggaatcgcaacttcttaaacttctaccaataacaatacgccacgtcatcattcttccctgtcatcgattacctcagacggtgtcggagacgtttcattctccggcctttagtggcattttctcgtaaataaattcataatctgtgggcgaacctttggcgtcgtgtttataataaagtccaccgcgaaatctctattattcgccacaacaacaacaacaacaacaacccaaaacccaattttgttacctcttctttcctcaatcctaaagtcaaaacaaacaaaaagcttccattttttttctttgattatcttcaatcggaatttcaggtaacgaaaaaaaaaatccgatctttaatcatcaaatcacctaactgggtcaactatttgatcaaatcgataactgatggattgatttggttttgcttatcgtaacttttgattttcaggtgtgagagatg

SEQ ID NO: 28066 - DNA, 3003 bp, Unknown
  misc_feature (1)..( 3003): 2750-1469P.txt file - cDNA_ID_2993779; gDNA_ID_1620774; Annot_ID_50245
catttggggtgctagcccatacattatatttgatgctcttatgcacatcatcttcactgtacgacttgatgataaagaacttagcatctttatactcaactggaaaatcgtctctgttgcactcttctctatctggaagaacgcatgttacagtctcctcagtatttgattcatcaaacgtctgctttttcacctcctctgagctaacctcttctgtggccttcgtgcccttggctctagggcccctgtttagttcattcaagccatcaatgttctcatttccatagaagtaactgttaccccttccccggcttctatatttgttgtctgtattgagccatcctctttcatttgttcttgaaccatatccagaagaaccataacccataccagacctcaccgtgctaccatactgaccatatgacttgtttggagacactctgtcgtagtaaccctgagctgcataacctgtcatggatgcaggctggtacatactctgccaagaatagaatgaggctatcagatacagggattcagatagagaagaagacttatcatacaaaactgacttccatatcataccgtgtaatgcgaattggagctagagttttgattcctagtcgcaggtacattgttgttagccttagaatatgaggatgcaactccactgccagaaacagacctctgcacatctgagaagttagagccatcgtgccatgacacaggagtgtaaaacccatcatagctatacctggggtcctgataaccagcagcaagaccacctccaagagcactgtttccatacagtgcactctgattcaatggtttaacaggagctgatccattcattcctttagggataccagcagatgcagagttggctgctttgtttgtagagagcttgctctgagtagaggcaggaacagacgaagcgaaaggcccactactggctgtgagaggaaaaggatactggtactgctgagcaccatacaactgtccatcaccaccaagttgtggagcagggcttgttgctggtgagtaaggaaaggcagcatacccgtatccctgcggataaacaagagatgcattctctccgtaagctccctggagtgattaccaaatgactaagtagggcaaaaggtaaaagagaggctaaatagtctggacacgagttgcttataagaaaatattaacgcacgtactgatgtcatatcaacactctcggaattggtataacctgtgtagtcactcccataacctgaaagattatacaaacggttgtgttatagatattacaataattctagacagtagaaggctgaagatatataaatgaaacttaattatcaccataatagtagggctgctgatacacattaggaacatagaaaacagaaggatccaaggcatcactgggtagcataggtgacaaagatcgatcaaaagaaggaacttgaccattcgaatccatagctccatactggtaaacacccgtctgcaaagataatgatgctatgagaactctgcttggagtaacaaaatgtgcagagacattaaaagatgtaactttaccttcttagtaggctcagggatctccaaagtcctagactttgaatctaaagacagtttcttcaatacatcagcagcttctgaaaaaacaatgtaagtgaaggaaacaaataggtttctatcttcagcaagactaaaaaattgatttttctaatcaatttattcactttgctagctacaggaacagtcaaattcatcgagctaaaacaaacagaacaaatggaaatgacatcatttcactatatgaatcgaattacgatgaagcaactagattcatgaacgtagatcacaaaagaaatgaaggagaaaagaaacaaaggcaaaggatacgatcagcaggaggagcaacagtagacatgagaacagagttggcagcgaagactgataatagatccttgtcggatattgaacaataagagtttgagacaaacacaaatatcagagcaaaaaagaactcagaaggaatctagggtttaagagattgaatcgtagccgcaagagaagagagaagaagaggaagaggcaaaagtggttttgttcgttcacctcgatttgattcaaatacctccaagatcccttttttatatttttctattatttttgtttacctttttctccatcgttttttttttaaaatacttcctttattccagccacattaatattatactagtcactacgaaatatctcacaaaataatactataaatattatttcctcgaaaatttcgcaattaatcgggaaaaaatcaatttttaaaataaatatcactgattccaattccattgttaggaattaaggagcaagaataaaggcccaaataggcccaatataaatctgatccaggatccgaagagttgaatccaacggccaagattaactcaaagcttgaaagaggtaagggaacgttaaaagcaccttccaagcgagagtaaggagataaacctacttcctttccttgcttcagctccccttttcttatccggaaaccaaaaacttccggtgataaaacctccttcgtcatctctctacttctgttagtttcttaatccttactcttggaatagtttatcctctgcattttttagtgccacagtttatgtgtgtatgttttgtttggataagaatttgttgtaagcttttgaaaacttgtattagttcattacttccatgattttgggtgttttgtaataaaatttatggattagtgtttcttcagattgtcaattgtgttcttattgagctctgctttcgaaggtgtcgcctttcttctggtttgttgtgaaaatttattactttagcttactgggttgttgtttctttctgttatattgattgtgttaaccgtatatagatgaaaagaagagtcttttttatatctttgaaatcttatctaagtgctgaattttgtctgtctttgaagtggataaaatg

SEQ ID NO: 28067 - DNA, 3003 bp, Unknown; identical to SEQ ID NO: 28066
  misc_feature (1)..( 3003): 2750-1469P.txt file - cDNA_ID_2993779; gDNA_ID_1620774; Annot_ID_167632

SEQ ID NO: 28068 - DNA, 3003 bp, Unknown
  misc_feature (1)..( 3003): 2750-1469P.txt file - cDNA_ID_2993791; gDNA_ID_1620658; Annot_ID_47910
tttttgacattgagttgtaggaaaaagagaagaagtcgagaaccaaattgtgcaccaaatggaactcgcctttcctaaaaaaagaaagacagtaggatgtgataattagaataacttaattcctgagcccacactattctttttttttttttgaaaagtgaaaattcagatattcatgcattcccatgaaacatactctagagattgggagaggagagtatccaggtaccacattgccggcactgttaacaaggacaacggacttaaccaacgccggccaaagaaaggccattaatgcaacgaaataccctgatagaggaaaaaatatatatacaattagaggagtatcttaatcatttgtgccattttaacgcatatattacatctcaataacttagggtgcataccaccgattgaattccctacgcaatgtgctggttccccaactacttcagccatgaaatcccgcagtaattcagcccacaaaagctcggtgtaaatgatatttggcttctctgattttccaaaacccaagactgtgatggtccatactcgatttttgctatttacgatgttgtctacattatcgcggtaatgctctagaaaagcaccaaagccatgcacaagaagaacggcaggcccttcattaccaaccactgtgtactgaaacaaggaagtgacttctattaaaattccatagcaaatataaaaagatcaagcagtgggattacaaaaatggccaatgtaggccattggacttggagaaatatgagtaataacagaaacctgaataagatatcccttccatctccaaatccttatagcgtgccttttttcatcaatcctctctctacttagagccaggagataataccactgccaaaacaaatccaacatcttcaaatattttcgaaaagaaagtaggagcatagatatatcatgtctatgagttattgtacctccatagagcatacagcatcagttgcagcagacactgtggcagctgaatatccaaaaggagaaataaatccagcattcctttctttttcatactcgattgcttcatagtggacacttcttctggatacgataccaagacagaggacaggtccaaaaagtttgaaaaatgaagctccgggcctagtctcggcatcacgaagtctcgcatggaccctggtcaacatcaaaaccaacgcccatcactcttcaacaagatataaaatataccagattcattccataataaccactttcatatggaagcatctgggaagcacaataacgccagaattaagaataaccacgtactcttgccagtcatctcgacttgtaccctccaagtacctcaagtatcctgctagagcattcagtacaacctcatttccacctccaacagtatctcttttacttgtgacaaaaacagagttatcaaccttcttccctaaacttccatcaacaattggctccatactgctttccttcaagttaccaagcctttccattaatactctttcagcagatgcctgtgccatttccctccaactattttctatttcccataagctttccttcaaatagtccttcaggtcatcgagcgttggcacagaacctggagcatgtttcatttaccatttcccctagttaaaagagtcacaaattagatatctaaaagaactactcaagcaagagatccaactccatgaatattgaagaaaaccttaccccactgcaattcacttcctggagatgaaaattttgctgcaggaactggcaaagtgagaggcagcttcagtttcttaaactcctcccaagattgtggtagatctgtcaaattctggaagaacaaaaatgtgtcacataagtaactggttctgaatcactacgcagtaactgatattgtaaaagatacgtacttggctctcgtaaaaaggagtacgccaagcaacaatcctcggtgattctccagataaagaaacaccttccaatttattctttacagcgtctaaaacctcacacagatggtattctacctcttcttccacaaagacaaaaggagctcgcacctgttacaatccagtacatgcttgtgacaaatagaatcttgccttcaaattgtgagaaaaatgctcaaattatactcggtgaagttacctctttgacaagatcttcaatgacattctctgcattcccatatctgagcataagatttgatccttgcttcttcaaggtttttctcaaatcttccaatgctataatagctagctctaaagtgtccgttgtgtatcctacatacatataagcccgttggattagatacccaatcaagtaacgcttggaaatggagtcctatggaagaatcctagctacttgatctatgcaaaaccattccactctcctacaagctaaaacgaagcagaggttcatcaactagagagatccgaattgagctcaggtaaattcgaatttgttccgctaatcaatccaacatttggaatgtatataaacttactcgatagaatgcgacgatcgaggacgtagagaggtatgacggctctgtgcttagacgcagcgaggaggccaggatgatcatcaacacgtaggtcatgtttaaaccacacaaccgccgtggaaccttcattcgttgccgaagacaaacaacatttgcatcggtttttccgatcattccgccggagacggagatgcaggaaatgcgggagagcgaggaacgccatgaggacggtggaagaaaaccagaatcagtgggttagtactagtagtatccatgaagtcgaagcagagagagagagagggattgtggtggagaagactctttccaagtgtgtggtcaatactcagtcccacagagaaacacctaacattcaaaacgacgtcgtacttcacttttttctttctttcgttttttgtgttcaactgtgactgtcttcattagatttgagactatctatttacattctgattatttcttaagaagaagcggccatg

SEQ ID NO: 28069 - DNA, 3003 bp, Unknown; identical to SEQ ID NO: 28068
  misc_feature (1)..( 3003): 2750-1469P.txt file - cDNA_ID_2993791; gDNA_ID_1620658; Annot_ID_163716

SEQ ID NO: 28070 - DNA, 3003 bp, Unknown; identical to SEQ ID NO: 28068
  misc_feature (1)..( 3003): 2750-1469P.txt file - cDNA_ID_2993791; gDNA_ID_2926187; Annot_ID_140836

SEQ ID NO: 28071 - DNA, 3003 bp, Unknown; identical to SEQ ID NO: 28068
  misc_feature (1)..( 3003): 2750-1469P.txt file - cDNA_ID_2993791; gDNA_ID_2926187; Annot_ID_200703

SEQ ID NO: 28072 - DNA, 3003 bp, Unknown
  misc_feature (1)..( 3003): 2750-1469P.txt file - cDNA_ID_2993795; gDNA_ID_1620627; Annot_ID_47159
cttacatctgcataggattttgtgataaattagatttgtttattgccacaggaagctatatcggtaccatggaaaccgattcctcggagaacagcaaagctctactttgctatgagaggtagttactagttactacagctgatttctttattactttccacaaatgaaaattgagatcccaaggcagatacatacaacaaaaattcttcactaatctttggcattctcatgaaattttcagtaatagaagtgtttgaagagagtgaagggcgtaaacatggagaatgttcgctactcgatcttgccagagtcttggaaatcaaaaagcaactctgtgaggcaaacgtaagtgtgtttagttgttttatcattatttagaaatgtcactgccaggttcactgaataactgaatattgtctctcagtctgtgagcgagagccatataccagatattctcttggagagacttatcactggtactactgaattcccgccagtttgtgccattgtgggaggaatattagcacaggttctctctctctcactttcactctcttatcgcattcgaatcttctcactagaaacttgtaatttgacaagaaagattttttgatgtggcaggaggtgatcaaagcagtatcaggcaaaggagacccgttgaaaaacttcttctactatgatggtgaagatgggaaaggtgtgatggaagacatttccgactcttttacctcttaaacaaccagtgggccttgatttagtttaaactctataatctctgagattccatgtatatctcaatcgtttgttttttgccttcacattatgaacaaatttaatgcagaatttagtggaggatcagttgtgattttccttcggtaaaatcattttcagttattgacatttgaattgttcaatttcaaatttcaaatattataattcaattcaaagactagctaagtttttaaaagtaattagtgagagatctcacagtgatataaaccacattcattttaattcatagcaaagtaaatggtaagaaatgaaaatggaagaaagagaggagagtagttcacacgaacatctgaaggagaagttgagagagcttgaggaggaatggacagccatgaaaacaggtaaaaactcatctgcggtttcatggattaccgtggaagatgctcttgagtatgtcgaaaactctcccagaaacctaatgctctctctccaacacaaaccaaaggcagagatgatacaagaaatatcgccattaaggagaaaactctttcacgactctgatgatgatgatcaaactaagaagacgacattgctttctcattcatcttgttggtcttcgaatgtgacgagttcgagtgataccacgaaagcaaagaagaagacaacgattagaagatttgtttctgttacaatggtgctgcttttgtcatgggttttagttgtgttgatgaaccactttgatcatctctccatgaatacacaaatcattactttggttcctacttgatatttttatttattttggtttgagaatgttcatcaatctcaataaataaaaaaagtttagttttgtattattacctctcgccttctcttttaattcattgaacctcttcaactttggctgtaactatgttggttaaaacagtataagtaatgtatgtatttatggttttaggaaaatcttacaaaataatactctatcattggatgaagaagcaaaaactacacccctctacatcttttctattcataaacttttttggggaaagaactacattggtggtgattaggtgcatcggtgacactaatgttgaaaatatgttttgtgtaaaattagtatggttaaagctaatcatttagttgagcaaaaaaagatgctaatcatttaaatagaaaatggactcaaacaaaagaaggccacacattcaattgttacatctttattgggttttcatttttggaagctatttttatgaatttgcagtgttttgttgcccaaaagaaaaaaagcataattccaagtatatctttcattttgaatccatcagtcatatgttttacttgaatcaactatttgttgggttttacgaagttacttgttaagaagattcaaaatatatataattagactatcaaaggaacaaaagaatgtaattgggtcataactttttccgaagcttacgtgacttgggagaaaatcaaacccattagtttcacccttaatcaaactaatcacaaattttgaactttgcaaagaaggtaaaataataatcagcaaaaagattaataaaatgacaaaagtatctctttaaaagattaataaagaaataaagaaatgacataagctctcaccgaccgacgtcttgtcttttttattcttaaggtcggtgccatgtcgacgccttcaagcttagaatctcgccacgtgtgggataaactaaccgaacccaatcgaaccagacagaccaaagacagaccagaccggactagttgtatgtcggcatcagcgttctagtacgacgttaattaaaaaaataaaaataaaatattatttatgatattccaccaataagagccaatgaaaagtgtgtgaaccaaccaacttctgtagcaaaccgtaccatttctctcttagatacctttaccttccttctataaattaggttcttcctttcacatttctttgtcttcttcttctacataaaattgattcgcctcgaaatttacacagacttgtcgctctctctttctctcttatttcacagagcccctaaacatttccaaaaatcttgcaaaggaagaaaaacaatggacaaattttggactttcctcactgctcttcattcaggcgctgggtaattattcttaatcttaattttccttccattatgtttccaaaattagttactttttgatttcctctgtttcgatttctaatccaaaccgtaatcgatttgttggtaatgtatatgcaggcctatcgtgatg

SEQ ID NO: 28073 - DNA, 3003 bp, Unknown; identical to SEQ ID NO: 28072
  misc_feature (1)..( 3003): 2750-1469P.txt file - cDNA_ID_2993795; gDNA_ID_2926186; Annot_ID_140804

SEQ ID NO: 28074 - DNA, 3003 bp, Unknown
  misc_feature (1)..( 3003): 2750-1469P.txt file - cDNA_ID_2993802; gDNA_ID_1620678; Annot_ID_48294
taatcagtataaggtaccgaggtgcgtgagcttcacacctatcatggagctgcttgactctagagttgtgtctgctcatttcagcccttcgttgccgcattggtcaccagaacgacgtcgttagataaaactttatatgaaagatatcaaccggatgatgtgcggttttagaatataaagctctgtttctgatgctaattaagactccctgttagatttcttattaggctttgtgaatcgtacaataaaatttgaagtacgtaccgatgtttttttccttcatcttctgttggaatccagctaataactagctttggtccaaaaaccagatatttttaaaatcagcatttaattattactacgccctaaattttctttaaacacggaatgttaatcaatgtgccctaatacttccaacataaaagtttggaaactaacattagatcttaaattattgttagatcttaaatttcaactgtgtacaataaattagatcttagattgtggactaccccaaactcgggcttctctacttagatcttctactaaatatttgggcttctacaatgggttcaattactttccctctcagggcttttaactagtttcggcaattcacaattgtaaaactgttgcaacatggctcattcagagataaagcccaatatcagtattggtaaatacacaattttattttttacttctttttacacgagtttctagaaatgaatagtttttgacatgcaaacaattagtcaaatctcttgtcgaacaaattcagtgcgaaagcaatgtatacgaatcaatagatatgcccagaagataaaatgacaagttatcatgaaacgaatttgaaccagaataagaggagcacacacaaatgcttcgttaagcatatatgaacaaaacaaggccccacaaaaggaataaaaaattccttggtatgtgacatatcagggaaaccacactaactaaaatatttttacgaccttgaacatgttgaataattttttttcctttgaaattttaagatatactgcaaaacattatgagtacttgtataagatatatacacaagaaaaagagcataaaaaaacaaactacaaaaaaaaaggattatatattaaatgaagttatagataaattcataatgcaatgtctccttttttttttagaatgtttctatttgacttaacaacaccttaaaattttaatagaatgcaacttaaccgaactattgtgactcaaattaaatttattttggaaacaaagctaaaacttcgaaagttactggagaaacgattggaaaacaataaattaaacaacttaatatggcaaaacaatgaaacgtgattttaaaaataagattaaagtaattgaccagaagagtaaattaggctgagatgacaaaaacagcgattagaaaaagactatagaagcgaagctggttcctcgctgtcgctccaagactaaccacctcgactaaaactacttctggtggcaattttttagcattttatttagatcgtggttttacgtgcataatggcttttggctcaaaggaaaaaaaaaacacataaaaatatatttcgacatgtgcaatcaaatctttgacaaaagagatttgctgatttgcaatcgcaacgtgaactattatatattaccatggaccataatgtattatacatgaaaggttagttttttttaatatatcaataagatattaattaagattaactaaatgtataaatatcgaccgttatagacagagtgaaataacatagaactttttttcacaattttgacatgagctccatgcgctctaagacaagcttttcttttttttttgcttgtcgtttatttttcttttgttgaaaatgtcttttaatgttatagtctctccatttcattatatgtatagtttcagaaattttcacatatattatattaagaaaagaaaaaattggtttttgtccttacgatttttttcattgatcaaatacttaaaattaacagagataaaactgaaacaatattttaaattaaaacaacatttaaagtgtaacgaaggaagtaaaaaatgtttaccaactatatttgtcctatctttcttaaccaagctagcttatcttcactaattcaaagttgtcacgttgtctgtttgatttaatactatttcgagtaaaagcaaaagtatcttatggaaatatctgctaatactcgcaataaatatatatgggacaaatgtaaagaaagatgtagtatggttttaaacttttaataataacaactatatatatacatatatagacatttttatcattaaaaccttttcacaccatgcaggatggttcccattctagaccggtgaccctataaataatatgataatttccttgacaccatatcacaaccaaattccttagagaaaaaggaagagaaaggtcaaagatgttttactatgtgattgtccttcctttagctctctttctcttggcttacaaattattcttcacctccaaaacgaagcgtttcaacctccctccctctccaccttactctctcccaatcctaggccaccacaacctcctcaagccgccggtccaccgtctcttccaccgcctctccaaaacacacggcccaatcttctccctccaatttggctcccgccgtgccgtcgtaatctcctcctcctcactcgcaacacaatgcttcacaggccaaaacgacatcattctctcaaaccggccttgtttcctaaccgctaaatacgtcgcttacaactacacaaccgtaggaaccgcgccttatggcgaccactggcgtaacctccgccgcatttgctccctggaaatcctctcctcgaaccgtctcacaaacttcctccacatccgtaaagacgaaatccaccgcatgctcacgagactctcacgcgacgtcaacaaagagatcgagctcgagccgctcttgtccgatctaacgttcaacaacatagtaagaatg

SEQ ID NO: 28075 - DNA, 3003 bp, Unknown; identical to SEQ ID NO: 28074
  misc_feature (1)..( 3003): 2750-1469P.txt file - cDNA_ID_2993802; gDNA_ID_2926213; Annot_ID_142080

SEQ ID NO: 28076 - DNA, 3003 bp, Unknown
  misc_feature (1)..( 3003): 2750-1469P.txt file - cDNA_ID_2993806; gDNA_ID_1620721; Annot_ID_49208
tcatccataaccggcgtgaactctgttgctatctctcccatcgttttagaagagtgagtgttccgttctttgggggatgaatctttttttatatgtaagatcttgattgatactctatcgcaattattgaattttgatgtttatatccattaaggaagtctgtctttttccactaatatttatactattttctcactcgcatgttattactgaaataataaaaatatacatggcttgtaatgtttgaattttttgtagaagaaagagaataaatcagagtggaaaacgacaagtgatggccgatgggtcaagtgtgtaggagggaaaaaacagctaagacgatacatagttttgtaatttcaaaattagacaaaggaagccaacaaaaaaagagtcagattattattaatagattaatatacagaagcataagatatatatgaaacgtcgaaaaagaaaacaattggttttacttgttttcactcgagagtataaaaataataatgcatctggttgtaatgggtaacggagttcacggcacaaatgtggtgtatattaaatattattcaatatttaaaggtgttaaattcgaatactgatataacaacggttcaatcacattccattagattatttatgtgttctaacttctagtcaacgaaaccaatatgattatgaatttgtcatcaatggtgaagaatctaaatagactgaaataaatattttggtgatcattgccattccagctgtacacaaatttattgtcaccgaaaaccttgtatgtatctaactagaccgttaatgatatgtaattagcaatatatacattgaataattgattttagcaagtgtcaatgaaacttttattctaacggtaataacaagcaataaccttatggtcaactttggttagagatcacatcaaaactgtataaatacataagtcggatattaattcaaaacaaagacttttgggtcagtatgagtatttcgtcgtcttctaatttataaatggatcggaacacccaaattattatcgggaaaaacgtacggcaacttgtttatagaattcaagttgctactaaatcatgcgccacttgatatatttgcagtcgcaggtccactcttcctagtttagtaccccatctaggcacatatatcgaaatagtttaataaattgaatcaaatactgaattgttactgatatatatactctgtatgtttctcgaaaatacttaaatttggtgtcatggagttgataaatttctgtaagaaattgaacgtctacagttcttatggtttagggtttctaagatggatccaaaaaaatgcaggaaccgaactatatacggcttttgagaacttaggttatcctttagacgtgactttcaaataagtatgtcgatgatttgataagacatgtcgttttatgatatgtagggacagggaaataaaagcacaatgtgaattaagactttagattcaaaaagatgcttcatgcttgtagaaatgatgacgattgcgacttgggacaatggacaagtgctatgtcattacatatactgatacacctaacctaatgaccaaataaggactctttacacgggttaactaaacaaatatatcccaactaacatttccaacaaaataagccgataaatgtaacatgtaccgaacaaaacattattaatcatcgtaacttttttttaggtttgaattaatcattataatttaaaaccctaaaaccaacttataagaaccataattgatcagaatccagtttaagtaaataacatagaaaattttgagtcagataaaaaagaggaaattgtatggttagcaacatttacattttacagaatatggatatggtaaatgagaagtgtgtggatcacaagaagtgaatgtgctttttctgctttttaaaggatgaatatgaaaacgaggctaccctcgttattttatttaatgtgaccactgtttagctggaaatcacttggagacgactttaaagtaggctccaaaatctaaagctagacaccagacaaaagactttctatattgtttgtcttaagataattctaaaaatatcagcatcgttactttattgaatgaatacttataagaattgacagtgaaaatgaaactagtgttgaaaagagatgtttggtcattaaaatcaaacaccgaccttaaactaaaaaagaatatcacttcatcggctcctccttttttcacaacttatatacaatatacacacacacaaactgagaattagaatgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcgatg

SEQ ID NO: 28077 - DNA, 3003 bp, Unknown; identical to SEQ ID NO: 28076
  misc_feature (1)..( 3003): 2750-1469P.txt file - cDNA_ID_2993806; gDNA_ID_2926191; Annot_ID_141057

SEQ ID NO: 28078 - DNA, 3003 bp, Unknown
  misc_feature (1)..( 3003): 2750-1469P.txt file - cDNA_ID_2993813; gDNA_ID_1620726; Annot_ID_49283
tacttgatgctttggtacgtaatggtgatgatgttcgttatgattatcttgttcagcggctaaggaagaggattggttaggcccttgtggatgttggtgttgatgttcttgagcactgtttgggagattgtaaaacacatgtcgtttgtcggatctatgttctacattcattgctgacattgttacatatacaaaaccaattccaagtaaatcacaaatagaaatcagcatataaaatcaaactaaaccaaaatgttttacaaaaaaaaaaatttgaactgatatttatttataacggcattgtttaaattattttctatgcaaaataaaccggatcgaaatcgaacaaaacccaaaatttggtgaaaacaaatactatattactatttcaaaagtaagatgaaagaaaaagtgaggtttggcaactggaccgaaatattttggcttcaattagactctcaactcctaaaaaaacaaaatagctgatccgaatcgaaccaaaaatatcatatggctaccctaaataaaaatggtatatggaaaattagtacatataacaaatggtatcaaagctgaggttaatacctcttgggagcgccggatctagattatctggatgatcattagaagcagcagaggattttaaagaagcctcgtcggttatgtaaactttcaagccgagctcacctctcacacgagaaaagatcccacgtctctccatgggaaagtgaagaacaacagcatcagaatgaggaacaaaagaggtccctgagagagataccttgccaaggaaggaacgtccattagtagatctgttgtgactataagcttgagcttcaagattgagatagtgaagacgagatggatctgagatgttgaagaagaaactctcgttccaaaccgggtttaagtctcgatctttgatcgttgttcggtgcttttgaccatcgaagtaaagctcaacgtaagcgttcgatgttccttgcccatcttttgggaagagattgtgtgctccgatcacgtccacgccgagttttagattgctcatcatcatgaccgtcgatcttttgatcgaacacttaaaagtgaaagagagacttagagtagaatcaagctcacaacttcaattttgataaagggtcttggaactatatactacataataaaattatatgcacatgcatgtgcattcataagtatatgtaagttgtggagaaaaattgaataattatggtaagaccaacttagatttcaagtaagggcagacagagtttcttgggattttcttaaatgtttctcatcttgaaaaattgaaaaaaatccagaaccgaccttaatttatacatgtacaataatgcatatttttgttataaattaatatgatatggtgtgccttaacatattgacatgagttataaataggatatggtgtacctcaactaggacctcaacccataattttttttcctttgtaagtaaaacaaacttacaaaaaccaaatctattttacagagttataaattggaatacaagaaataaggtcaactctttagtctctttttgttgattggatgagatggattcaggaaaaataatgaaaaaccatattattatctccacacataaatgcagatgcgtataaaagaggtcaagagttcatgcatgcatatatctaaggtaaagatcctagaaaaacgcttatgtcacatgagtttctttgacttatataaattgagcacatagctcttactacttaagatctaaatttccaccaatagaaaaactactagctaggtctccgcagtaagtgatacgattattaaatgctatatatatttatacaaaatacatgtgtgtgcatgtatttatacacgtattttagaagtggggtctctatctttttatggattcccatgattcacaatttcacatacaaggatttaactactatcccatcaaaatcctaatctgaagactaaacctctgatcttgattcacatgtataaggagaaagatgggaaagcttttaattcatttttgcctccgtttccaacattcaagctttgaacttctcacttttttactagagagagatagtgatggcacgatgaacgagggttgaaatggaaatcgcagattatgagatttattttctatacatcttgattcatataataaacacagtactagttgataccatgctatttgtagatttctagataattattgtttttagtaaaattgactaatggtaaaaccgataataaatagtgtattttgtgtgtgaatgatctaagcaaaaccactaaccggatataataacataaaatttgttaactaacacgtccaaaatctatgttccttcaaaaaaaacatactagataaataaaaatatacaatttggctcgaggtctcagtcaaaatcaatagtttagttatcaaccctatagtcctgaatccataaatgttggataacaagtttgcaatgttatataataaaaaaaaagattgcaatggtaagaattaacatcataagaattttattggagattagttagctgtttagttcatatataaaatgctttttagtgaagaaatagtcaactatcatatgaagatttaagatttaatcagtgatcattatacaattctatttctaacttgatttagattctctgccgatcttatctcatctccacttgttctctttctcaccttgttttctaatttctagtcttctagagaagtcaacgtaaacaaaaaatgtacatggactaaaggaatgtgatagttttatttatttagataagcaatgcacgacgtttattgtgcaataaaacagcgtggtgttctttttttctagctccgtgctgtcttctcgaatctgcaattccctgtaaacagagcaaactgaaatccccaaatcaaaaccctaaaccctaatctctaatttgagaaattaggttagttcacctttttgtcgattcctcttgcggagagatg

SEQ ID NO: 28079 - DNA, 3003 bp, Unknown; identical to SEQ ID NO: 28078
  misc_feature (1)..( 3003): 2750-1469P.txt file - cDNA_ID_2993813; gDNA_ID_2926153; Annot_ID_139391

SEQ ID NO: 28080 - DNA, 3003 bp, Unknown
  misc_feature (1)..( 3003): 2750-1469P.txt file - cDNA_ID_2993825; gDNA_ID_1620629; Annot_ID_47217
agccgtaaaccggactaaagattatggtttgccgcaagaatgtctccataaaaccagctgatcaaaatctaaaacaaaaaagttggaactttggaagtaaatacctcagaagctgcagaagcatatacatatacacacggcagaatcattcaagattcattgccaaatcgattctttttgaaaggaataatcttgggttttgagttaggtgaaccatcagtcattatgtaagcaaaactctatttgttaaattcaagccagtttttataaagatcgtaagttaacaatttattcagcatattatctaatctcttcctctctctttattttgcttgaatatttatatatatcatgcaacatacatttcaaactattcataatcgatctatttaagcttcactcaatctgcacccaagcggctgagcttggtatacctgcatgcaccagaaatatcatatagtatcccggaggagcaatctcagccgttgatggacccaatgcactgactctataagaatttgttagctggtcacgcgtcacagagagtagcttcaagattaccatcctctgattcatcgcaaaggagtgtgtagtgaaagatggtgcaactatcctcacagagagaagatcaacggtcagaaactgagctatggagaaatccacgttaaacaatctcttgtaactcaatactttgtcgcttgtcaataatatcttgggacgtattgggtcggatgtgaaaaatagatatggtggagaataagcctcgaggcttaaatccgttggatactcgacgttggtaaagttgtaataaacgtgaggattacttccaccaactaaaacccgaccgtctggtaataaaatcgctgaggaatggtacatcctaggacgtgatggtgtggacataacggtgaagagatgatcaaacggttgatatatcacaggttggataatcgggtcacgtgctttctcccaaccggccgtgccagctccggctccgtttacgatgatgacgtcacctgttggtaagagtagcatgtctcccataacacgtggcaatggcatggtttccatttcccaacttggactctgatcggatagttttagcctcccgcatgtggaggtggcacgtgtgaatccacgtgagaagccgcctttaggagagcctccacataccattatctcaacttctacgttagcatcgttggtatcatctaatggaaatagtatagaagaaccactgcttggatagttccttggatcaccacctggaatctctggaaactctttcacgattcggttctttttgtaatcgaacacaatggatcttgtgttagcgaagacaaataagtttccatcaggtaaaagatgtatgaacggatataagttgttctcgttacttccatctgaagtttctctaagaaactcaagtcttgagcttctagaccgagaatcatgtcggggaaaaagttcatagttgaactgtcttcttcctccgaccacaatgatccgtccatcgggtaatatttggttggtggcataccatctacgttgggatagatactgaggaaactcaatccaatcacatgtatcactataaccacaagggctaaacattcgagcagcacgctcaccatcgttgtatccaccggtttgaaccaatgttccgttgggaagaaccgcaccagaagaacaccatgtatctgtttggacattcaaaggacggtatgtgttggagacaacatcgtagagaactgagtgtgcgctgcaatcgaacttttctgcggtgtcagtagggtcgtaacgacatatgcctccgggtagagaaacatttgaggtaccgaaatcggtacggtcgaacattataaccatgccgttgtggaggagttgcatgtgcatggcggatataccgatgctcggtagcaacatttcccaccgatcgagttgcaatagaaaagggttagcttgaccttcggataatatggccatggagaggcataagatggttgtagcgacgatgaatgtatttttggagttgatcatagtggttggtggtttcttcctttgttcttggtttgatggtgaattttaagttagaggttggtttatctattttcttgttgaagagtagtatggttggagtaatacgtccaattatatattctttcacataaaattgttatttttattagattgacgattcttgttttatatatttaatttggaattttggacaagcaaactctttgactctactacattcatgccggagttttagacagtctttaagaaaacgtagtagaattgcatcaaactatagatagttttaatcaaattaaaggatgtaatattttctttctaaattctggtatcatcactctttgaaattgtcgtaatatttggaaataaataagtaaggaacacatataataaataagtatgaaatgaatagagaaaacaatgtacacctgcatgatgatttctataattccgcaagttgcaaagagaatgcccaaaaaaaaaaacttaagaaattatcagacaaatatttccttattcttatatgtttataaatcaaaatgacaaaaatatcactcacttacaaaaatatcaccttaagaatgtctccatagaccggctgatcaaaatctaaaaaacaaaaaagctggaactttgggagtaaattgctcagcctcaagaatgtctccatatatacatactcggcagaatgtctccgtaaattttgaattacagcattcaattatggcatgttaacaaaacgctgactttttaaattcagtttagttcttgctttgtgttaagaccggttttagtctcggtttaaccaaattaatttcattacatatttcatgtaaaggtcaaaatggtcattttagttcacctgagctcagtttgaaaaaaggtcttcctcaggtttccccatactcaagtgccggcgaaccctaagacttttgatacctcttctcttctctctcttcgaagatg

SEQ ID NO: 28081 - DNA, 3003 bp, Unknown; identical to SEQ ID NO: 28080
  misc_feature (1)..( 3003): 2750-1469P.txt file - cDNA_ID_2993825; gDNA_ID_1620629; Annot_ID_162622

SEQ ID NO: 28082 - DNA, 3003 bp, Unknown
  misc_feature (1)..( 3003): 2750-1469P.txt file - cDNA_ID_2993832; gDNA_ID_1620715; Annot_ID_49101
gaaacactgacagggaaagaacatcttctcttttatggaagacttaagaatctcaaaggccatgatctcaaccaagtatgttatcattatcaatcttacttctatcttatattagtgcaagagtcttaaacgtcaattcatggttaaatattaggccgtagaagaatcactaaagagtgtgaacctatttcatggaggagttgctgatatacctgccgggaaatatagcggaggaatgaaaaggcggcttagcgtagccatttcacttatcgggagtcctaaggtacaaaattgtatcttactcatctcctaacaaaaaacttattgaagcccttatttgaatgtgatttagagagctaaagtttttcaagctttaacaattatttttggtttttatattaaataaaaggttgtttatatggatgagccaagcacaggacttgatcctgcttcaagaataaacctatggacagtcatcaaacgcgcaaaaaaacacgcagcgataatcctaacgactcattcaatggaagaagcagagtttctctgtgaccgattgggaatttttgttgatggaaggttacaatgcatagggaacccaaaagagctgaagggcaggtatggtggatcctatgtgttaacgattacaacatcaccagaacatgaaaaagatgtggagacattggttcaagaagtttcctcaaatgcaagaaagatatatcacatcgcagggactcagaagtttgagttcccaaaggaggaggttcgaatttcagaagtctttcaggccgtggagaatgcgaaacgcaatttcactgtatttgcttggggatttgcggacacaactcttgaagatgttttcatcaaggttgctaaaaccggcctttaactaatgtcttcttttgaatacttttaagattattagttatgtctgttccacgtcaatattttgcttgttcatgtttgataaattgataatgcagaggtttgattcatgtacattgttggctcttcgcctgcaagtttgcgaattagtctgaggtcttgtattagtttgtttgtggatgatgcatgtaaccacaatttttttatttaaacgtggctatatttaattgtggataaaccactgaatatgaaattttatttcatctaccattcagatcctaaatgtatatcttaccatttaattcatatagggtttacgatttaaaatttagaatttcgaaaatagtatctatattaaaagatagtaattaggtctttttttcattgaattttacttaaacattggtaaaatttcatatgccatcgaaaaaagaaaatatcactgaaaactatgttagctgccggagacaacatttctaaaaagaaagacaatttttaaaaaagactacaaaatactctgttgttcctttttgtttgattgtttagaaaaaaaatttgtttttaagaaattaattttttaagttttccatgcaatatttattggttaatattggtgaattgtaattttcaagaaaaatagttagttatcattggtttagagttataaaaaattgtaaaacactaaaaataatacatttataatcaaaatttaatatgttttcttaatatatgtgtttttctaaacaatataaaaaaaggaacagagggagtataaatcaaaactgttaaaccaaattttttaccaattaaatcttaattatatcaattggttcttctccgaaataagaaattgtcttgatgtctatgaaaatcacaaatttcactaaaaatttatggaggattcctaattaactttagaccaggaatttttcaaaaaataaatttaaagatgacattatcatgaacacattcaaactgaaatcaaaccaaagtaaatttattttccctgtaatggaccatagagtataaagtatttaaaactgctacttattaaatcaaagacttttgtgttttttattgtgtgcaaagactttttatgtttgaaaactgaaataagactgctagtaaaaatataaactgaaataagaatttttcttaggacatcataacatttttgcttcttgtccaagtaactgccacattggaaaaaaatgtttagatttgaacaaatctttttaaaatggtcaaaaaattatcatagtcaaccaaattacccgacacttttacgtgagacattaaaatagactagtttaatcgattatgttcacacgtgattacgtctgagatgacgtatgaatcatctttatacaaatacaaatatacagtaaacaaataattgaaactcacctcttccactagtcgaagaatctattggtcgtggcatcactctccttcgcagcttcctaccaaatttacattgaaaatattctccattgtcactttctcgatttcgtaaaattacctttttgttatttgaccaaaagaataaccccaaaaaaacaatactaatatattcgagaaaaataactaattaaaggtatacttaacgagaaattaaagcgtgtgcacaagggtattactgtaatttcacattccgtatctgatctctgttcttctttcctccgcctgctataaaccaaaaggcggtgactcgatttgttccttctaagttcaaaaattgggtttccattaggattcaatttttactaaccctaaaaaacagaatctaatacacagagaaaagcgaaggttgttaccttcatcaatggcggatcctggtcctgccagtttctcaacgagagccaatgccttgcttaggaaaaacttaacctatcaggtactttttccgttttcttttcctctacgcaatccaattatacacatacaaattttcgtttaatgtgagtaagattctgttctgggattttcgtttaatagatcagtttccacaacaaaattagtggctgatttattgagtagattctgttctaattatgtctttgtgtaaattgtgtgttggtgtagaaacggaatctatggagcaatatacggctaatcatg

SEQ ID NO: 28083 - DNA, 3003 bp, Unknown
  misc_feature (1)..( 3003): 2750-1469P.txt file - cDNA_ID_2993836; gDNA_ID_1620715; Annot_ID_49103
atattacattgatcaaatcatttactccaggaaacatccattgttcttcctcctacaaagcacttccaagaagaaacaacacttctctgacaacaaaatatccaaagttgttgtagagatggaaaagccagatgtgtgtcgagaggtaatgaaaaatacaatatgaagataagtttcattattgacaaggctaagtaagatttgcatgcatcttttttggtgtcagagggagaaagtagagcagtgtctacttaaatcaactagagactctgcggttttatgcaataatctcaagaaggtgtactcgggtaaggacggtaatcctcagaagctcgcggttagaggattatctcttgctttacctcaaggagaatgctttggcatgcttggtcctaatggagcaggcaaaacctctttcatcaacatggtccgtataaacaatatcatacctattgatcttttgtctaatgagtcaatcctcaatcttctagtcaacctctttgacattctaatgttctgtgtagatgacaggaatcatcaaaccatcgtctggcacagcatttgtccaaggtcttgacatactaaccgatatggaccggatatatacaacaattggagtctgtccacaacatgagtaatctataaatataacaatctctgtttctttctttactttaaggctgccttgtttcttagtccattactccatttcattgaaatttctgcagtcttctgtgggagaagttgagtggaagggaacatctactgttctatggaaggctcaagaatctcaaaggttctgtcttaacacaagtaagtgtttgttttaacttttaacgtggtcggtttgtgaatggcttatgcaaaaactgatgagtttttaggctgtcgaagagtcgcttcgcagtgtcaaccttttccatggagggattggtgacaaacaagtcagtaaatacagtggagggatgaagagacggctcagcgtcgctatttctcttataggaagccccaaagtaacttgaaacatctcttggtatctatgttctatgatatgtaataagcctaatttgaggaaatttgtcaaggttgtttacatggatgagccaagtaccgggctagatccagcctcgaggaagagcttatgggatgtagtgaaacgggctaagcgaaaaggggcgataatactcaccagtagagtcttctaagcatcttatctcctttttgttctgccttataatgttttcatacacaagaaaacttcagctttggtcttatgcttcagcacattcaatggaagaagctgaaattttgtgtgaccgtataggaattttcgtcgatggtagtttgcaatgcattggcaatccaaaggaggtaaaactacaatacaccttatactcaatcgttagaaacagagtataacagtatgaacttgagccaatattaactgaaacattaatgacagttgaagagtcgatatggaggatcctatgtattgactgtgacaacctcggaggaacatgagaaagaagtagagcaattagtgcataacatctctacgaatgcaaagaagatatatcgaaccgcggggactcagaagtttgagctgccaaagcaagaggtgaagattggtgaggtgtttaaggctttggagaaggcgaagacaatgtttccagtagttgcttggggacttgcagacacaactcttgaagatgtctttataaaggttgctcaaacttcttaactaacaactcttttgaatgattccttcagatcaatctcaatcttttctatatcttatgtcaagctcaaaatcacaaactatatttcatataactctctctagccacttatgctcttaagaaaatcatttatttccgtaaatagttaatacgagctttcgagtctaaaaagggaaacaatggatagacttcatttagacgtaattttattccacaaataataaagagtctcttaatcttatccctttattctcgctttctttactctgcttttgctcctatcctattcctatgctttgtctattcttactttttcgaccaaactaaaaaaattactgtgtcaaatcttctttctaaaggataatgagacaaaattactttttcgaaatcttcttttaaaaggataatgagacaaattacttgttggaagagtgactaaaataggatttgcaggagctaagttctaaaagtgaatagtagaaatcaaatgtacaaaacaaaacgtacaccaaagaattaggggcataactctccaatgttatatcatggttaaaattttcaacgagtggtttccaatataaactaatttactggtctaattctacaatttagattattccttttttggtcaaacctacaatttaatgtactatagtcttttcaagcaagagaatttagctcgaatcaaattcaagaaactcacccaccagaagagagaaaaatcaaagtagtctactttttgcaagttggtccgtgggtgggtgcatttaagaacgagggacattgttcgtgaccacgagagcacgcacgcataccaaaactcaatgaaatgacaaaagacatataaacaagagagaaaaatgtatacacacaaatagaataacaactattcgtgaaagatagaatagaaaaattcaaaatatacaccttaaatttcatgtttctacccacaaaaaaaaagaatgtagaacattcaaaaacttatttttttgtatatttctgttaaaaaacaactgtaatatgaaaagtcctaaaataaaaggtcaagactaaaaatatcttataaaaatctaaaattacaaaacaaggaaaatttgtttatcaaagtttgggataatagtcttatctctttcatccacactaatataaataggatacatacacaacacattacaagaagataaatccaaacttttctttctctctctttcgtttcccattttttctcttattactcatagatcctgattgatctgaaaaaatg

SEQ ID NO: 28084 - DNA, 3000 bp, Unknown
  misc_feature (1)..( 3000): 2750-1469P.txt file - cDNA_ID_2993844; gDNA_ID_1620715; Annot_ID_49109
aaacaaactcaaaaacaagaatctcccctgaagatactcaaacaacgttttttttaatcaatcttataatctgtattttacttagtcttctttactagagaaatatccggcttatataccagactacttctccttcttcccttctctcatttcccaaaaaccattaacacacagacacactaacgcacacatctctcattttcaaaatcctcattttcatttctcaattctccagagtctcttgttctgttcccatcgaatgagcaatacaaaacacatccacaaagggttacaggagaggcttttagatcttctcttgatcgctcttatagtttacatgactcttaaaggcggcacgagtggggcttgtgccgcgtgcaagtaccaacgtagacgctgcgccgcggactgccccctcgcgccttacttcccagccgaacaaccgaaacttttccaaaacgttcacaggctattcggcgtaagaagtatcgtcaagatcctcgaaaaactagacgaaactcagaaaccagaagcaatgaaatcaatcatcttccagtcttatgtccgtgaccgttctcctgtccacggttgcctcggcgtcacgcaacaacttcaatacatgatctggtttgctgaagaagaactcaaagctgtcaattctcaattacaactatatcgctctcaaccacaaaacggtcaaaatcaaaaccaaaaccataatcataatcagatgattcatgagcttggtagtgatcataataagcagcaagaagatgttacatcgcagcagcttgacttgggtatgggacttaacgttaacaataatcagagcaatgtcgttacaccattctttagttcattattaccagtttccgaaacacaacagccacaaatgtcttacacttatagctgcagtgaggttaacaacaatggctatagtcctcctgcttataatacagattcgggcaaggagattctgaccaacaataacaatgtttggggtgatcagaatcgatttctgtataacaacaacaatggaggaggatacagcaaccaaaacgagagctgtcatgagatgaagagtaacggtgtaatggcaatacaatcacagctcgtaaatctgcaaatggtatcaaatcatcagcgagtggaagaagaagaagctgatcatgaatacgatgaactccatcagtttcttgatatcattgacgataggcaatcatttggggattctaaagaagcgtaggcctcaaggtaggggttttttcctttgtaaaactatgaaatatgtattttcttcttcttctgtagatatggtgattgaattggagtatattggtggttgtagctctggtggatcgttgaaggaacagattgatgaaattggagagaatgaattgagaagtgcagctacttgtttcagtctaaccagtgtgaataattgaattgatttctcaattcgtgatccctaattatgctctcgaaattttgttatacttttgttgacattttattattatcttttagtcagagacttaaaggttatgaattcagagtttctctaattttaataatatatctttttggagtctctaatgaacttgaatattagtgcaacgtaactctatttgctttatttttcttgggtttttaacttgttattcaagggacgcttctctgctaaaatctaacatggctgagtgaagaagagagacacaagacaaatgttaatgatgcattagctcccgaggatactcacattactcaggtaattatactagacttccacttatttatgaaactcaaaaatgtaatgttgatcttgtgttgaaccttgaggaaataatcaagaaactgtgtgtgttagtaggttagatgttggatcccgaactaatacctaaagtatcatgctccctagaagctgaagccatgttcataggactacactaagttttggaaatataggctacaagcatgtgattgtattcctcgaatctgattccaaagagatggttagagcagccctacgaatggcttcagccttcagcttaaaattgtgtcacattcagttggttgtacaagaactctagtaatcatggcagaatattctcgagtgtaatggttcaagaataattgatatatccatacgtgcgttagaaaaaaaaaacatgttcgatagtatatcagaatattttaactaatgattttgaaaatatcttcaaattatctgttatttttttttttatcaatagatattgtttaggactcaaacgagataatgtagagggaagttgtttacattatttagaattttttgtgccaaattatccgctttgacatttacattacgagaaattaaagataaagaaaaagaagtgaactcttccttatcgctctgaaactcctccaaatacgctgaaaatgctggccatttggttgggaaagacaccatcttcattaggtctgaacagtctgtgaaaaacctacttcttggttgtcggcaccaatcatacacttcattgtccagaataaagcgtcgacttcaaattatctgttaatgaaaacatttacactatttctttgaattttgcatttaaattattttgttaaaaaatcaaaagtcaaaaacttaaatcttttagatgataattcttgatattaaaataaaatgtcagaacaaaatttatgaaattcactcaaaattcatagaaaaaaaaaacactgaaactattcaatatattttatttgttttgagataggtgtcaaatgttttattcgaataacacgtctagttaacgtgaaaggtgaagccatgcactaatcacatcgttaatatcccctaatactatcctaatactatacactagaatttttcaaaacgacagtgtttttctgtgacaaggtaaagagaaagaaatatctcccaacctgtcaacacttaaaaaaagacataaaagtctgtggcgaccaaaagaagtgagagagaaagagagagatatg

SEQ ID NO: 28085 - DNA, 3000 bp, Unknown; identical to SEQ ID NO: 28084
  misc_feature (1)..( 3000): 2750-1469P.txt file - cDNA_ID_2993844; gDNA_ID_1620715; Annot_ID_165629

SEQ ID NO: 28086 - DNA, 3000 bp, Unknown; identical to SEQ ID NO: 7257
  misc_feature (1)..( 3000): 2750-1469P.txt file - cDNA_ID_2993855; gDNA_ID_1621135; Annot_ID_56546

SEQ ID NO: 28087 - DNA, 3000 bp, Unknown
  misc_feature (1)..( 3000): 2750-1469P.txt file - cDNA_ID_2993859; gDNA_ID_1621140; Annot_ID_56621
aaaaaaaaagatagcaaaacatgagcaatatataagcaaaacataatcatttttttcattatatacataatatagacttgaatttgagacattaaaccacataatgttaattagttttaggaaaatgaatcaactaaaagaagtttacatgttcttcaagcttttccattgccattcccctctttacgttgatttcccctctttatgttgattcatctataaacgcatccttccctcttcacttctttacataatctcatttctatagtaaaataaaactgtttgcaagaaaaaataaagaaaaatgtcaacaataggtgggatgataaaatgatagataagtactttgccgctgctagaaatacgacgagaacatgatcaagcgaatagctgaggatctaaaagtagtggagagcgaggtccaaagagaagcaaataaaatcaacaattttggatattactaaaattgcattgaaaatgtaaaacgccatcctttttgaaagaaaaagactccaaaacgatattttttatgaaacggatgaatttgaatgtgtttctgttttttttttctttataacaaattgtatgattctcgagatgagtgaaaaagcaaattttttatttgggggatcatactctttcatagacatgagatatcaaactttggaaataagaagcaactctttcatagagaaaaattcgtgaaacgaaagattttgtttggggatcatactccattagaccctcggaataacgatgcgaaatgaggatcttgttggtcttgcatatcacactggccgaaccacacccaaaagctattaccttggttttgccgttatgttctcctgtgagccaatagagcgtcccgttcacggaaaatatctagcacgtctttttagataaccattttaatgattaacatgtcaccacaaattttcttgttttacatggatagaattaagattaacttatctcaattaatacaaccaatcatcttgagaaaaaaaggaaactcaaacacaactatatatggttgagccatccacacctgtggcggtttgcaagaattagaagatcctgctctcacatcgccgtttccgcggtctcgtaaaatatgatcacctaacaaagtctctcgaaatcttttacagacatccgtgtgcttacagaaagttacttattttcaaagtttgatatcttatctataaaaaaccctactactactactactccttttgaagactttttatttgcttgcatccatacttggaaaatgactagatctccacaataagaggtctcttagcactgtcgtacagacaaatttggttctcaagttcgatctttgaacactttttcatcttgtggctttttggttttgatagatttcatactctctatcggcttcgttcctaggatatgactgaagatgacacatgcataatccaagttagtagaatttattattttatttataaatttgaagttagtagatttggtttatggtggtttgactgggttgcgctacctgtaaaatagtagtctatttagtgttgtttatgtggatgggacgtgacatcgatggttgtcattccgtccaagtagcttatgtggagtggagtgtcatgtatgtctggagtctggagatgtgcttttgcatggtcgacgcgtctctcaatgctcgttggtgtttggtttgtcccgtagagaattctatgcacgtttgagatgctttgctagcgaatgtacgttgtgtccaggagttggactcgtaagacccatatgaagattaaatgactaatacatgtctctttgaagcctctataaagacaatccggtgttgatatatcttgttggatagaccttgttgggagtagtttcgttgatgtggtgtccacttgttatatgttagttggctttctttggctacccgaaaaaacatctctatttgattttactttaaatctttttccatttgttcgtatagggaatgttttatcgaattaaaatattttttagcagtaataataaaatttaaaaatattggataatttaaaaatttaactgaatatataggtactacaacatgctttttttttttacttagattagttttttgtgcatttgagtttggtaacctaagtttgtttgtttcaccgatgatacctctttgttatttcgaaaaacagtttagtattgacaaagtatttgttattgaccaagaaaattttatatgagtcctaaagtcaggaacttgttaacaaaagataaccaaactttatacttaatttcgttataaaattattaaaagatcaaagtaggcttttatacaaactaaatttagtttcgattcaaataattttgaacttaagttatattttttgtgcgcatgtcttcttttagaccatagaataatattgggtttattcttgaattacggaaaacatgttttattagtgaggcaaagtacacgcgttcttccactttgggtttttgttttgtctatattcactttaggtatttattccaaaagctgttacaatttgaatgaaagcgactattaaacctatattcattcactttgaaataattaaaaagttcatattcattcacatacaaaaagccatctcaactcaaagtttataattaattagcttattaaacaaggaaaaaaacatattaattttgtcattaagaagaagacgaatttttcttcaaacatgattaatatataaataaaaagctagcaaccggaaacaaagaatcaaaaaggcaaaaagcaaagagagagagagagagaagaagaagtgagacttgtgttcttacggtgtttatagcttctttgttttgtcttttaggttcttgcctttttccgatcaatcagaccaatccctccttcacttttagcatcttattctctttcgttcttcttatatttctgggaattttcttcaatcgattcctctttgttgtaatctcacaattagagagagagatatg

SEQ ID NO: 28088 - DNA, 3000 bp, Unknown
  misc_feature (1)..( 3000): 2750-1469P.txt file - cDNA_ID_2993859; gDNA_ID_1621140; Annot_ID_172802
ctttttgaaagaaaaagactccaaaacgatattttttatgaaacggatgaatttgaatgtgtttctgttttttttttctttataacaaattgtatgattctcgagatgagtgaaaaagcaaattttttatttgggggatcatactctttcatagacatgagatatcaaactttggaaataagaagcaactctttcatagagaaaaattcgtgaaacgaaagattttgtttggggatcatactccattagaccctcggaataacgatgcgaaatgaggatcttgttggtcttgcatatcacactggccgaaccacacccaaaagctattaccttggttttgccgttatgttctcctgtgagccaatagagcgtcccgttcacggaaaatatctagcacgtctttttagataaccattttaatgattaacatgtcaccacaaattttcttgttttacatggatagaattaagattaacttatctcaattaatacaaccaatcatcttgagaaaaaaaggaaactcaaacacaactatatatggttgagccatccacacctgtggcggtttgcaagaattagaagatcctgctctcacatcgccgtttccgcggtctcgtaaaatatgatcacctaacaaagtctctcgaaatcttttacagacatccgtgtgcttacagaaagttacttattttcaaagtttgatatcttatctataaaaaaccctactactactactactccttttgaagactttttatttgcttgcatccatacttggaaaatgactagatctccacaataagaggtctcttagcactgtcgtacagacaaatttggttctcaagttcgatctttgaacactttttcatcttgtggctttttggttttgatagatttcatactctctatcggcttcgttcctaggatatgactgaagatgacacatgcataatccaagttagtagaatttattattttatttataaatttgaagttagtagatttggtttatggtggtttgactgggttgcgctacctgtaaaatagtagtctatttagtgttgtttatgtggatgggacgtgacatcgatggttgtcattccgtccaagtagcttatgtggagtggagtgtcatgtatgtctggagtctggagatgtgcttttgcatggtcgacgcgtctctcaatgctcgttggtgtttggtttgtcccgtagagaattctatgcacgtttgagatgctttgctagcgaatgtacgttgtgtccaggagttggactcgtaagacccatatgaagattaaatgactaatacatgtctctttgaagcctctataaagacaatccggtgttgatatatcttgttggatagaccttgttgggagtagtttcgttgatgtggtgtccacttgttatatgttagttggctttctttggctacccgaaaaaacatctctatttgattttactttaaatctttttccatttgttcgtatagggaatgttttatcgaattaaaatattttttagcagtaataataaaatttaaaaatattggataatttaaaaatttaactgaatatataggtactacaacatgctttttttttttacttagattagttttttgtgcatttgagtttggtaacctaagtttgtttgtttcaccgatgatacctctttgttatttcgaaaaacagtttagtattgacaaagtatttgttattgaccaagaaaattttatatgagtcctaaagtcaggaacttgttaacaaaagataaccaaactttatacttaatttcgttataaaattattaaaagatcaaagtaggcttttatacaaactaaatttagtttcgattcaaataattttgaacttaagttatattttttgtgcgcatgtcttcttttagaccatagaataatattgggtttattcttgaattacggaaaacatgttttattagtgaggcaaagtacacgcgttcttccactttgggtttttgttttgtctatattcactttaggtatttattccaaaagctgttacaatttgaatgaaagcgactattaaacctatattcattcactttgaaataattaaaaagttcatattcattcacatacaaaaagccatctcaactcaaagtttataattaattagcttattaaacaaggaaaaaaacatattaattttgtcattaagaagaagacgaatttttcttcaaacatgattaatatataaataaaaagctagcaaccggaaacaaagaatcaaaaaggcaaaaagcaaagagagagagagagagaagaagaagtgagacttgtgttcttacggtgtttatagcttctttgttttgtcttttaggttcttgcctttttccgatcaatcagaccaatccctccttcacttttagcatcttattctctttcgttcttcttatatttctgggaattttcttcaatcgattcctctttgttgtaatctcacaattagagagagagatatgtataatcagttggcgatatcttcgtcttcttcatcttcttcgtactatgaatctttgaaggttttggaagctgatgttcaacacgctaattctttgtaagtcctttttctgggtttcttctaaagtttaagactttagtttaaaattgtttgattagttgagctataagagtatagttagtgaaaaaattgaaaacccagatgataattttaggtcattctcttctctgtgtgtaatctcttctcatcaaaattgggttattttaggaaactccgataaatttttagtttagttttagaaagctttcacaaatagaacattctggaaagttgttgttggttttgatattctaatttaagcaaatttagtagcttttttgtttttgttttggctcaaggtccctaaactttgttattgcacatgttgtgttcgatgaattgtgtatgagaactttgaggtttatatcttttcagggcagaagcaattccaatg

SEQ ID NO: 28089 - DNA, 3003 bp, Unknown
  misc_feature (1)..( 3003): 2750-1469P.txt file - cDNA_ID_2993863; gDNA_ID_1620654; Annot_ID_47808
aaacatcttaatggttttcacctttgaatatccaatttaactaccagcaagcactacttacatacatctatctacatctttcattcttttatattgtcaaaatttgtcaccaccaaaaacattgatttatattcaaaatttggaaagtaactcaaagtagttgagttttgtgggtaccttcagaatgtccatttgattatcaatcaaaaagaagtttttagctggcgcatgaaaccgtcgttggaaactttgaaacggatgcttcactgtataaacgtactattattatttaatttttaataacgaaaagtaaattgtagatgaattctttttatttgattcatttttagttagtgctagccattatttctatctttaactatattcaaaattgttttttcatactataaactattattagaccattttcttgaatgaaccatactttctagacactatttctaaaatgactataaatcacaccatgtagttctatatttgtattattgtagtttattgatttaacattgaaaatttaataaattatacaattaaaaaattaataggttttaatacgtgtaaaattataaaacaaaatttataatgaaacagagagaatagtaaaaacatttatgagaaaaatatgtattggtgtcactaaagttattttagacatattttcattcaagaaatcagttgaataatagtcttactgtgacaaacaatttaatagataaaacattgagtagtattaactaataaatgaatcaaacaaacaaagtctaattgataaaatacgccatataaataaactataagtttctttaaaatatacattaaatatacaaaacgacaaatttatgaaacaaaaaagtgaagtcataagattaaaactattgtgaaatggatgacaaattcagtttcttctttattctttaaaccctaagtttaaattctttcaaacacaaatcgtagtatttgtaaaactgttattttcttgaaatataatttaacgttacattaacaaatcaaatggatgacatattacttaaaatttagattaccaataaaaaatcataaattcttcttttaaattgtaagatttaagtcttcccctttacatttagcaataaatagtttgctgcactggtttaaatgcactaatgcattgtttactgaattgtcttttgtttcatatatttgtctctactatacttttactaactttcccacctccaattaaaaaaattattacgaaataaacaaagtcatatctctctccacaacataattactttattcaacaaatattaattcctagtcatattttagctcctcttcttccttatatattacatacatacattttctttagaagtcattaccatcaacccatcccctagaaaaacacagagaaaaacaaatacaagaatacaaaaaccctctcgacgaaaccgaagtatcgaaatgagaaacaagaatggtaaaagaggtagcgttgagccctcggcgaggaccgtggcgtcggtggttgctaatgggaggtttgaaggaagatcaccatcgagcgacacatcatcatcacaaaactcgtgcctgacgaggacggaggaagtgaaggaggaggttgcatcgtcgtgggttgatgaagaagaggcgccggagatggtggtgatgggatgtcgaagttgtatgatgtatgttatggtcttacaagaacgtcaacgttgccccaagtgcaaatgcaccgacttgatcttcttttagagaatttgttttaagttattattcaatttggacttttgagtttgagatgatgaatttaattttctttgtaaagtcctctatataaatcatattgtttaaattataatctctattttaatatgttaaattgacagacagatcatttctgtttgtggccgtccctcttggttcattttgttaagttgtccattttcatgttttagtactatggaagccaatgacatgaacgaggatggattttcatcggagttgaattcgattgtttcaaacgctagttatggcgtttgcgtttatatttatttatttgtatactccagagaaacatagtttttcaatgtaaatgaaaaacgccaaaaaaaatagaaagtttatttttaaaaattacaaaatataaatttaaacacaagtaaaaaaatcgacacgtctcgaattagggtcttaagaatcaaattggtagtatgctaataatggtattgctttggtttcatcggcattcaatccgatgaaattttcaataattaaggttaaaagttgtatcttcatcaattaaaacgttatttattcaaaacaattcaccatcaaattcaataaaatttaagaacttttacaaacttcaaatattaaattatttaagaaaatatttttaaacctaaatttagtgaaaaagtagcaactaaaatttgttttaatgtattttatgacatttttctatttataagtactaaattttcaaaaatctaataaataattaatttctgtttttcatatatattaaggcacatgcgacgacatatatacgtgacaacattttatcctaaagttttaacatgatttttgaaaaagaaatttacattttacgataatttagttgcaaatcaagcgagttttaatatttcaataattttcatgtatatagaaattttgcattgctagttaaaataataacaaatagatgttgtcaaaactcgaaaataaaaggggtgtttctgtagttatcataatttaaggaattatatgatagaaaaacaaatttgggcggtaaatttgaaaaaaataactttttccagtctccccaaaagtacccgatttgccaaatttgaccctcccattttagctttctgtctattcaccagattctctctattcgattctccctttacttcttctcgtctctcttctctgctcgtcagatctcaaaatcaatcggatatcgaaaccacaacttcatcaattatg

SEQ ID NO: 28090 - DNA, 3000 bp, Unknown; identical to SEQ ID NO: 4364
  misc_feature (1)..( 3000): 2750-1469P.txt file - cDNA_ID_2993867; gDNA_ID_1620702; Annot_ID_48796

SEQ ID NO: 28091 - DNA, 3000 bp, Unknown; identical to SEQ ID NO: 4364
  misc_feature (1)..( 3000): 2750-1469P.txt file - cDNA_ID_2993867; gDNA_ID_2926189; Annot_ID_140949

SEQ ID NO: 28092 - DNA, 3003 bp, Unknown
  misc_feature (1)..( 3003): 2750-1469P.txt file - cDNA_ID_2993875; gDNA_ID_1620724; Annot_ID_49252
tgaccaggagatctgtcaagagcatgcactttttctgtctagtttaattggaatttggagttgtgtcagtgtcttggcgcttttaacactgggaagtgaagtgttgcatccttataatgccatccttctttgttacttggataactggatttcgcttagatccttctatgtatgaagaggttcagcttttgttgctaacaactcgataacagatcattttatctgttgatgccagtaccgtctgtacgtcttttctcggttcctcagcacttcttctttgtttttttgtgcaggcttattgctccaccagttcaaaatatatctgtacaggctagagtcaacgcaaaggtaacttactcatgattatctgttaggttgcattagactagcttcttagtatctctcccttggacgagtattcgttttgatatgtttatgggggaccataagatgtgcattttagccttctgctgttctgcatccgtagctatatctgcctgttgatggtagggagtatctgaaaggtttatgaattgaatgtggttgtaaatctttatgggtttgtaaatcccagaccatggaatgtgataggggcttgatctggtaaatgcttggtgtgataactgaatcgaatatcactatatccaataactttatactgaatgtttggagggctaataacaattgatcttcttaatctgcagaggcatgaggtagatcagaaagtagaacacagaggagggaagaggaagacactggactctcgctttgcaagcatgaaagagcagagaatgacgattaacaactatggtgttacagtgcaagttccaagattaccaccatgggttagagccagaagattttcccaatgagaaaccacaaagcttttacgggttgttccagtttagaatttggcttttgggtttagaatcttgttaagcaaacactaagcaatgcaattcttttgtaaacatattgacttttagtatcatgaaagaattttttttgagtcttggttcattatatagtcgcatttccacatttctgtcaattacatgtttgcctctaagtgagtacgcgtcgtcaagaagaaagcctatcagccaagtatgtcttaactcttaaggaatgcttcctgtataatctagacaaatagagttgtaacatttaaatcttcaaaattgggggtgtagctcatatggtagagcgctcgcttcgcatgcgagaggcacggggttcgattccccgcacctccaattttgttttttgttatttctgtatcttccgttccttgtatatgtggcctcagttaattcaggcgaaagaaactcgcaactttctctgtttcctccattccactttttcgaagatgtaactaatttacttaaggaaaacaataaattatgatctttagtaaatatggcctattccaaaaactgaaccaaacaaaatatttatgtttgattttgagttaattacacattaaatttttaatcacacacccagaagcagctaaaagacttcgacctaactccatcatataattatcttttgaatttatcttgaagaccatatataattatggcccaaagactccaaactgactctttgtttttagtgtgacctaatcaatatcactttcatatgttgtccaaaaaaactatacgacatacaactcgttctcatattttacagtgtacacttaacactttggtcacacgtattacgtaccgacatatttatatgcatagcttgagtatggagactgcgtcaaaaacaataaattaactatatttaaagaaacttggcaatcatctagtataaaaatagtcgattttttttctcttgtcaatccacgttaattaatctatgctttattatcaagtgaattaaagaatttgacgtaaaactggtgtattcaatggattaacattgaagcttattcacaaagtggtcggctattgatttactccttagacttgctctaattttctttcttaagctttttaattttggtacgtcacttagtttgacaagcggagctgtttaagtgaaccacaatatattaattctctaaacgggttattgtacaatatattaaatcaaaggaagttacgatgaccaaattaactttcataagaaaggaaaacaaatattaatttggagtttcaagcaatattacatctatatacctttctattggtttcttataatgttcacgagaaatgtaggaaaactataaagtataaactgaaaacagagaaaaagttgataaaagaagaaaataaatatcacacatttcttggctcatcactcaagtcacggaaagtctttggagaagtgtagctaccatttttgttcattttattttggatagaaatttaacacacacttaatgatatggtttgaggaaatagcttatattaacttacctttccatgtatctatttatattttgcttaataataatgtaaacgcaataacatatattaaaacaaaggaaataaaatcttaatatatacctaaagttacacacaatcttagaatgctagcatactcaaatctcgtgaccccgaattttctggaaaaatcaattctacttcttctacctaaacagtttaggcttacaaatccatccaaatttatccattcgctttgttaaatcttaattgagcctaataaaataacatttgttaccaaaaaaagaagatcaactatataaatacacttccattaacaaaaacgtcaaagggtaattaagacaattcacaacattccggtatattcgcaaccaaaccaaatcctgccacgtagcaattatttcctcttcatttttctctctgtctccctcgaagaaacgtagaaatcagaaagtaaatcatacagtcaaaaccgcttcttctataaaaccctttttagctcaatcccaaaacgcaataaaaaacaaaacgctctccagaatttcgaaacttctaagatattttgttttctctcttaacgatg

SEQ ID NO: 28093 - DNA, 3003 bp, Unknown; identical to SEQ ID NO: 28092
  misc_feature (1)..( 3003): 2750-1469P.txt file - cDNA_ID_2993875; gDNA_ID_1620724; Annot_ID_165899

SEQ ID NO: 28094 - DNA, 3003 bp, Unknown; identical to SEQ ID NO: 28092
  misc_feature (1)..( 3003): 2750-1469P.txt file - cDNA_ID_2993875; gDNA_ID_2926184; Annot_ID_140703

SEQ ID NO: 28095 - DNA, 3003 bp, Unknown; identical to SEQ ID NO: 28092
  misc_feature (1)..( 3003): 2750-1469P.txt file - cDNA_ID_2993875; gDNA_ID_2926184; Annot_ID_200486

SEQ ID NO: 28096 - DNA, 3003 bp, Unknown
  misc_feature (1)..( 3003): 2750-1469P.txt file - cDNA_ID_2993889; gDNA_ID_2926197; Annot_ID_141349
gatataaccaaaccaagcgtttggagaacacaatcagaagaactctcattcatatactagttgttttcaaatgtttgtatatgattggatatatacacatgtaaagtttatcagagacaccataaaataaaataagtaactggtgctacaaatttcatctaattcgacaaatgtaaattacaaagctaaatgactcgtctaaggtaagtgataatgttagtgcaaacatttagtattatttttgaactgcaagatgattaagtatttttctaaatcatgactatggtagtactatttaataattaaatgaaactgtatattcgaaagtagaaagaagaggtgtggaattggacaagagaagagtataacagagaaaagtttggtgtaaaaaaggctgcaaaggagttggttaaaaagtgagtgaactcgataaacgcgtaaccctaaaggcaaagcgtgcgttactctttccccaattattttaccttttaaacttttttttttctttctcttagaaatgattacggcatttttaaaactagttatctcatttatatttataacgactacaatatctcatgacgatggtaaatcacatgaataaagtaaatatgattcgactacttggacgagttttgaagttgtccacaattagttttggataataattgtagtgagtgcatggttactgtactcacatttcttctaaattacaaatgtctcacaaaacctagaattttaaaccatgagagctcttcaacatactatagagattaatttgtactctaatccggaatcctctggatactaataaaattaatgaatacttgatcacctctttactttcgttgcttataaatttattcatgtagtttgtagtatgaaacatgaaagtatgtatagtcgatactccatagcattattggttctgaaaaattgaatctcacgtaaagtacagtattaagtttttcgtagacatattgcaatgatgagaggtaacaaatgaaataaggacaatttgtttggtgtagaagaagtaagagtcatgtagcacaaaaagattgtctattaaatggtctctgaatttattgggtcggctcgcacatcggcacatgtgatgaccttaccattcttgtctctgcatttaatattctttatccaaataatgatacaagtgaagttggtaacaaaatcgatcgtcaatgttttgtaatttctttccttgttccaaaaggatgtcaagttgtcgtgcagccattggctattttgatttgttataattcaagtttagcgtttatcttgcttcgatggaaagacatttaatcaaaattatgatctttgtatcaaggaaatgaattcgtaacacttatgttacgttcttttcaatttgtttccggttcttctaatagaaaagttaaaacgttattttcaaaatgattgtgacactttggattgtatttcagttccaaatctaaaagcaagactggcacatgatcgatgatacattaaacacacataagctataacagtttgaagtaattctcgtaccttcgagtcagaaagatcaaactcgtagaatttatatgttcaaccttttcatttacttcaaagtgaagttctatgttacaattgatttccaaaatgctaactacaaaataaaaataaaagagcttttggatcggcgtaaaagagacagcagagagataaaaaggcaaaatacgaaaaggtgaaaaagctttttgagtcgattccttttgcagggattgcgtgtgatttacagatatttcgtttttttaaaacaaaacaaaaaacccaacgaatacaaaaaaactcacacgttttcaatagcgcgtgacatacaccgatcaccacctaagctgatcacgagtcagaaaaggcactcaagcaattatcgtacacgcgccactttaaaacgcgtgaacacttttgtctcattactatgactagattcaaactttaatttcgtcatcaaaactttattagttgctacctttttctttttttccccacattcatctaaacttagtaatttaattttttgcttttttccaaacgttttaattagtagtagtaaacatcaatatcaaatttctaatcttttccatataaagtttgttctcaaccgtatagcagcaacttacaaaaaaacgttaataaatcttcttccaatcttgtgcatgaacttgttgtagtcttgatgattatttaaatagtaacactaatatctcttctaaaatacgaaagatgacactgaaaacagagcatcgtattcgccgttttaagacctatatcggtattcatttagtacctatttcgagttttaattctctgtcatcacaattcacaaataatttaatcttaataattgggtctcaatacttaagtagatgttaattggtctagaaatgaagaaattaagcaattttcaaaaccaagttaatgactttgaggctcaatgcatggttactattctctatagccgcagacacaaaaggacactatcgtaatctcctcaatgctccttataatatttggcgtcgaataaattcaaatagatacacatagaaagctataataatgagagagtttataagttcttgtgaaggcaaatgatccaatctttccttttcttctcctcaaattttctttcttttcccacgcgcttacacacacactgcaaaaaccacagaaacacagagaaagagaaagacaattcaaacaaaagcttcgattttttacctttctgtttgatcggctttttgtttttctgtaaaaagccatcttttgtgtttgatcctttctttttttttacctgattaaacaacttttctcctctgcattttttcgtgacccttttaaatatcttgtggccggtcctaaaagttctttatgcaaaggtttcttctttataagataaacaaaaggtgaagaaaccacaaccaaaaaaaaaaacttcttgttgagaaaagtttttttgagatg

SEQ ID NO: 28097 - DNA, 3003 bp, Unknown; identical to SEQ ID NO: 28096
  misc_feature (1)..( 3003): 2750-1469P.txt file - cDNA_ID_2993889; gDNA_ID_2926197; Annot_ID_201565

SEQ ID NO: 28098 - DNA, 3003 bp, Unknown
  misc_feature (1)..( 3003): 2750-1469P.txt file - cDNA_ID_2993893; gDNA_ID_1621125; Annot_ID_172243
ttccaataacgctaatgggaacaggcaaaatcatgccaacgggtagtgaaggtatactgaaccatgggaatgtgagagttatcatccataaaccaatacatggaagcaaagcggatgttctttgcaacgaggccagaagcaagattgcagaatcaatggatctctaagctgatctcagaagttgtcttttgctgcgtctctgatgaacattgagaagctttaatttttacatgtggaagaattaaatgttgagatcttttttagtcaaaaattgtgatgctccctttaatgacatttaaaagaaactatcagtttttggtttattataaaattttgtatatttcgttgtatctcgcgaattatcgtacgtatcacagtcttggccgcattgtcacgcctcccaggaaacagagtccttcccagtccgtacgtgatttccgacttgtaatcccagaagacgtctccttccaaattccaaatctcatgtgagttttattgtatctcttttgttgaactgtgtaatttcggtctgttgaatgtatcgagttgaatcagagattcctgtgttctcagtgaaactgaagcaatatatactgaaatagttgtgcttataattcttgttgattctcccatagatgacagtagatcatctggttatatttatgcagaattgaaggctcttattctagttggaggattcggaaccagattgaggccacttaccttgagcatgcctaaaccacttgttgattttggaaacaaacccatgattttgcatcaggtaggttagcttcttcttcttcttttgtatttgctcaagttttcacagtttcttttgttctcattatgatgcattcgcagattgaagctctaaaaggtgctggagtgactgaagttgtattagctatcaatcaccaacaaccagaggtacatacattcattgtccttaataacgatacgataacaattgaaattcttccgtgtcatcctccttctccttgtgtgtttggtattactcaggtcatgttgaactttgtgaaagaatatgagaagaagctagagattaagattacattttcccaagaaactgaaccgcttggaacagcagggcctctcgcgctggctcgggataagctggtcgatgaatcaggccaacccttttttgtactaaacagcgatgttatctgtgaatacccattgcttgagatgatcgagtttcacaagactaaccgtgctgaagcatcaatcatggtgaccgaggtagtcaaacaggagcattttctgcattttgtgaagtttatctttcatctgttaatagcattttctgatattaacaggttgatgatccttctaagtatggtgtggtggttacagaggaaggtacagcgagagttgaaagttttgtcgagaaaccgaaacattttgtggggaacaagatcaacgctgggatatacctcttgagcccatctgttcttgacaggattgagctgagaaggacttcgatagagaaagagatattccctaagatagcttcagagaagaagctttacgcgatggtactacctggtttttggatggacattggtcaaccgaaagattacataaccgggcaaagaatgtaccttaactctctaagagagaaaactccgcaagaactggccacaggggataacataatcgggaatgttctcgtgcacgaaagtgcggttataggagaaggttgcttgataggacctgatgtggtgattggtccgggatgtgtgattgattcaggtgtaagattgtttggttgtactgtaatgcgcggtgtgtggatcaaggaacatgcgtgtatctctaatagtatcgtgggatgggattcaaccgttggaaggtgggctcgagtttttaatataacggttcttggcaaagatgttaacgtcgccgatgcagaggtttacaacagtggggttgttatcgaagagcaaggtctgtgaaaccagagcctagacctagattagttagttccactgtttccagagtcttatgaaccgcaatattcttacaatttaaaacagatacaaactctatggtaaaccatatcataaaccggttaaaaatggtattcgacaccaatagagaaaaacgtttttcagatccatccctaagcaagttgtgtatatttctttcgtaaatgttttgagacattcttataagggacatataaattattgtagataaagcctatgtttcttaaacacgaaactgtgatttattaatagactatagtttggtgtatgtaattaacgttgagaaaaatgaaagacgtgacggcagagagagagagagtggacccgacccggacggcacggagacactttcagtttcttcttcttctcttctgtctttgtgatatttctctcaaaatcaatattttttcatctgtgaaacgacttcgtctcctcccactccattgtcactttcttcttcacccttctctcgtctccgtctgatttggcgtgtaacttctttctaccgtaattctccttcgtcttcttctctggtatatctcttgcattccctcctaatttcttagccaattactgtttggaatgatcttcattttgtacttcccattgcttgattttggttgacacctttctcgtttaagatcgtctcgttttcatgctgaaaactcaagtatttagttttttcgtttgtacccttttgttgatgttttggtttggggagaaaatgtggttcctttcaagttttttccgtcaatttgagttctcaggtcaacgaaaatggatggatgttcttaacccattaaccaagtttgatttttagagagattctgtaaacaaacaataacattttttgtgcttgaattatttttatatttattgcaagtttaggattttgctgcttgaaatgattttgatcataaatgtttattacattttcttatgtgtgtaaaaacaggtttgggattcatgagttgagtcacaaggaaaaagcatg

SEQ ID NO: 28099 - DNA, 3000 bp, Unknown
  misc_feature (1)..( 3000): 2750-1469P.txt file - cDNA_ID_2993893; gDNA_ID_2926198; Annot_ID_141370
caataacgctaatgggaacaggcaaaatcatgccaacgggtagtgaaggtatactgaaccatgggaatgtgagagttatcatccataaaccaatacatggaagcaaagcggatgttctttgcaacgaggccagaagcaagattgcagaatcaatggatctctaagctgatctcagaagttgtcttttgctgcgtctctgatgaacattgagaagctttaatttttacatgtggaagaattaaatgttgagatcttttttagtcaaaaattgtgatgctccctttaatgacatttaaaagaaactatcagtttttggtttattataaaattttgtatatttcgttgtatctcgcgaattatcgtacgtatcacagtcttggccgcattgtcacgcctcccaggaaacagagtccttcccagtccgtacgtgatttccgacttgtaatcccagaagacgtctccttccaaattccaaatctcatgtgagttttattgtatctcttttgttgaactgtgtaatttcggtctgttgaatgtatcgagttgaatcagagattcctgtgttctcagtgaaactgaagcaatatatactgaaatagttgtgcttataattcttgttgattctcccatagatgacagtagatcatctggttatatttatgcagaattgaaggctcttattctagttggaggattcggaaccagattgaggccacttaccttgagcatgcctaaaccacttgttgattttggaaacaaacccatgattttgcatcaggtaggttagcttcttcttcttcttttgtatttgctcaagttttcacagtttcttttgttctcattatgatgcattcgcagattgaagctctaaaaggtgctggagtgactgaagttgtattagctatcaatcaccaacaaccagaggtacatacattcattgtccttaataacgatacgataacaattgaaattcttccgtgtcatcctccttctccttgtgtgtttggtattactcaggtcatgttgaactttgtgaaagaatatgagaagaagctagagattaagattacattttcccaagaaactgaaccgcttggaacagcagggcctctcgcgctggctcgggataagctggtcgatgaatcaggccaacccttttttgtactaaacagcgatgttatctgtgaatacccattgcttgagatgatcgagtttcacaagactaaccgtgctgaagcatcaatcatggtgaccgaggtagtcaaacaggagcattttctgcattttgtgaagtttatctttcatctgttaatagcattttctgatattaacaggttgatgatccttctaagtatggtgtggtggttacagaggaaggtacagcgagagttgaaagttttgtcgagaaaccgaaacattttgtggggaacaagatcaacgctgggatatacctcttgagcccatctgttcttgacaggattgagctgagaaggacttcgatagagaaagagatattccctaagatagcttcagagaagaagctttacgcgatggtactacctggtttttggatggacattggtcaaccgaaagattacataaccgggcaaagaatgtaccttaactctctaagagagaaaactccgcaagaactggccacaggggataacataatcgggaatgttctcgtgcacgaaagtgcggttataggagaaggttgcttgataggacctgatgtggtgattggtccgggatgtgtgattgattcaggtgtaagattgtttggttgtactgtaatgcgcggtgtgtggatcaaggaacatgcgtgtatctctaatagtatcgtgggatgggattcaaccgttggaaggtgggctcgagtttttaatataacggttcttggcaaagatgttaacgtcgccgatgcagaggtttacaacagtggggttgttatcgaagagcaaggtctgtgaaaccagagcctagacctagattagttagttccactgtttccagagtcttatgaaccgcaatattcttacaatttaaaacagatacaaactctatggtaaaccatatcataaaccggttaaaaatggtattcgacaccaatagagaaaaacgtttttcagatccatccctaagcaagttgtgtatatttctttcgtaaatgttttgagacattcttataagggacatataaattattgtagataaagcctatgtttcttaaacacgaaactgtgatttattaatagactatagtttggtgtatgtaattaacgttgagaaaaatgaaagacgtgacggcagagagagagagagtggacccgacccggacggcacggagacactttcagtttcttcttcttctcttctgtctttgtgatatttctctcaaaatcaatattttttcatctgtgaaacgacttcgtctcctcccactccattgtcactttcttcttcacccttctctcgtctccgtctgatttggcgtgtaacttctttctaccgtaattctccttcgtcttcttctctggtatatctcttgcattccctcctaatttcttagccaattactgtttggaatgatcttcattttgtacttcccattgcttgattttggttgacacctttctcgtttaagatcgtctcgttttcatgctgaaaactcaagtatttagttttttcgtttgtacccttttgttgatgttttggtttggggagaaaatgtggttcctttcaagttttttccgtcaatttgagttctcaggtcaacgaaaatggatggatgttcttaacccattaaccaagtttgatttttagagagattctgtaaacaaacaataacattttttgtgcttgaattatttttatatttattgcaagtttaggattttgctgcttgaaatgattttgatcataaatgtttattacattttcttatgtgtgtaaaaacaggtttgggattcatgagttgagtcacaaggaaaaagcatg

SEQ ID NO: 28100 - DNA, 3000 bp, Unknown; identical to SEQ ID NO: 28099
  misc_feature (1)..( 3000): 2750-1469P.txt file - cDNA_ID_2993893; gDNA_ID_2926198; Annot_ID_201608

SEQ ID NO: 28101 - DNA, 3000 bp, Unknown; identical to SEQ ID NO: 7076
  misc_feature (1)..( 3000): 2750-1469P.txt file - cDNA_ID_2993900; gDNA_ID_1621125; Annot_ID_172255

SEQ ID NO: 28102 - DNA, 3003 bp, Unknown
  misc_feature (1)..( 3003): 2750-1469P.txt file - cDNA_ID_2993900; gDNA_ID_2926198; Annot_ID_141361
cactatctttcttttctcatcagaaccaatttggtacacaagaatctactgcaagtgcatattcctcaaaggattttgttttcatgttaatttattggcgtatctcggtctaaatgtaaccagcaaactatctgccttgttcaatatgtacttccactaaactattttgcattccattggaaagtgacctccatgaaatgccgctcatgaatactcttaatcaatcatccaccaaatgttgcaggatctttttcgcacagaaccagaaaatgttgcatatctcattctcatctcttagtccgcactccacaccctacgccactcactttggagtctgctcttaaaatgatgttatgacatagtaagatatgaccaacataaaccctttcacactcacgacatcttcttatattgcttatttcttaggatcatgaatgaattgtttcgacaatactgagaacgatacacgtcttcaatattctgcataaaggccaacatggaagtagctatattttatcgtggaactagccataatgcttgaaataaacaatgttatactcataatatcaattaaatgtttgtgatatactactatataattaaccactagtaacttcatcatcatcctttttattatttttgggtcaactatatcattatccttattcaaccaattttattcttatataagaggaaaatcgaattaggtaaacggaaaatgcgattactttctgaactcaaaagaaggaatcgaaacaatttttgttataatattaacaattttcgtgtggtctttatcaaattacgatcctgatttatgaacacgtggcgctaagttagttcagtttcattcattgagcttttaattgaacaatgagcgttaccaattttgtgttttttttctcgcaaaatgattttttcttgttcagaaggacacgaagtgttcatcatcttcttacatggcaaaagtacgaaaacatctgagattgtggcacgtgtgttaccctgacgactctcttctcgtccctttttcacttttccagtttcaagttaacacgcggattgggcccggaggtttcttgattcgtcaatcgttagccacacacaagttttattctttaaccttttattttctttagttagtttcattgtaaacaatttttttttaaaaacaaaaaaaaacagaggttgacctagaaaagaaataaatgcagcggtattgaattgttttcttctcaacagtcatcatcatcatcaataaaagaaacatcaaatcaaatagttgaatcactgtatgaaattaagagccagaatttcacagctcaattgcaactttgcaaccgaatggctaaaaacccttacaaaaaaaaagacgaatgattgcaaacttgcggaattaaatgcaaatgcacttataacaagccgcagtacttaatcatcagtattagagtgacgctaaaaaatttgtatttgaaagaattatgttcattctcattaaaataagagtaggatacatgttatctctagacctaacatgtaacctaattttataactaatgaattcacattaaagcacgtacaagtcaatacaacatctccataacattcaagacatctttaatttggatctttttagggttgataatcacaacttttcgatcaaaaagatatatagatcgttcgttaattacaaaaaagtatgtaaagagtataatggaaacattttaagagtaaatttcacaattaaaaaaaactatagattatacaaaatgaagtgtctagagacgtggtaggttgtgtggcttgtgatgaaacttccccacgtaaattctcatcccaccacaatctctacctactaactgctaactactttacgtccagcgccctttcgctgttttgcttttattagttcttctcttatattttctcctagtttttctacttttttttatttatttattttagttttacaaatcttgaaattctatattatagttaaattttagaaagccacctttgtgtgagttttgcttatgcaattgccgaccgaagtttgttccattctggcgttctcaaacctaacaactgtaactacatctttcattcataatcagattgttttaataatatactcatatctaacaatatcaggagagttccagcagttttattcatataactggtgtagtttgaacgataaatagaacttattatagaattaccatcacccaaattttagtattgaactattcgatgagaattttgacatattcatggagctaaagaaatatgacgacgcatcacattttgatatgtacagtctctacattttttcaaatacatttttttctttttcaaatctagtatcaagtacaaacgaatgtctaaattcgcttggatttattaaaaaagtatctttaagtttggtgtacagtttgggttaaagtactgtgtaatataggtggattgttttgaaaaactttgaaccgatgccgatatctaattgattttcttgtttttttttggtaatttgaaaaccattttaatttatttggttacatatatttgtagtattcagtaagtaagaaacaacataagaagattggaatttgatattagctggtgctactaattttggagtgtttctgaaagaagacacacgttccaaaattgtcaacacgtaaacaaaaaccaataagggattgacttgtggatattggataaccaagcaattaattaagatggtttagagacgtaaaatgattaattaagaaatagtactaatactttattggaaaataagagatgaggtataataaaagatgagtagctgggaacgtgcaacagaaaaatagttcacccaactttctcctattaatacttgcctcttctctcttcctacttctaaccttctttttctccttcatcacacacatatacacacgctttcgtttaaactctctctgtttcaatcattaatcagaaagaagcaacacaaatatg

SEQ ID NO: 28103 - DNA, 3003 bp, Unknown; identical to SEQ ID NO: 28102
  misc_feature (1)..( 3003): 2750-1469P.txt file - cDNA_ID_2993900; gDNA_ID_2926198; Annot_ID_201597

SEQ ID NO: 28104 - DNA, 3003 bp, Unknown
  misc_feature (1)..( 3003): 2750-1469P.txt file - cDNA_ID_2993912; gDNA_ID_1621099; Annot_ID_55792
cttctatttaaaaaaaatatagacaaaagtttttaaagtaaatttaagtaaactaataagatctacgaattgtgaaggtttatagaattaaatctcaaaattaatttataatcttttggataatttatactttatttaatagagttacatcggagttttcttcgaatatgatataaaacttctaacaatatttctatataaattttgcaattttaaactaccaacttcataataataaagtatcggaagatacatcttttcctaataatttaacaaaacaaagtttactcaaatctcaactacacacgttttcgaatttaacattgcgtatcaaattcgtcgaatcgtcaactaattctagagtaaacaagatcattggcaatactcttaaggaaaaatggatccatttgattatgttacaagtgataagagttttgaactcgttttgtgtcaaatgttccggtctccaatatgtaaaagtggaaggtttctcatgcttctcttttgtttgttccaatcttcttcctagtattgccatggaaaacatcaaccatatcgtcaaaatgacccgttaaataactaaatattgtaaaaactatttttaagttttcctttcatttcatggtaacaaatatatattttccagttatttctgtttaaagaaagtttcatttgagatctgattggtgggaaatagaagaaaaaaaactcaatctgattttaaacctttaaaagcataattcggttgatttttattttattttattctgattgatagaaactggaaagtaagatgaattggacattaaaaaaaaaaaaaatccctttaaatttgagctaattatagcaactagtcagatccttcttttttttctttgaacagaaaaagaatcgccaaaaaaagaaaaagatgtacttatttagcgaaaatatttttcgtagtaaaaaaacttctttcaatatctttgcttgaatgtgaccatttctattgcacatacaaaaaaacgactataaaaaggacccacagtgattatgaaaatcagattgacgaaaagtttgtgtgtctgattccaatcatattgatccaattcattcatcatattcgatggttgtcaaagcatatagctggattaagtggggcacaacactgaaaacgtttctcaaccgtatgatgtcatttcagcctttggttttctcaacgtttaatcggtgaccgtcaatttcttttcaatctctataatcatttcttcttttggcgtgtcactgggaccttcactgtcaatgctgaattaatctcctttaaggatttgaaggcaagaaaaatcttgttgcaactaataaaaggaatcgattttgatgctcattaatcgacctttatgaccaaaatgggtctatatgaaataattatatgatttgacaagtaaccatttgatttacaaattattcaacgatttagcattacaaaaacatctaaccatgcttaatgtatgatgttattcattttaaaaagtcgaatgaaacccatgtttatctcaatgcatgatttaataattttattatacatgcacataattctacatttttaattaattttattagtttaataataataattaattttctttttttacacttgttataggtgagaaatgaaagttatcataatacaaaacatcagtttttataaaaccaaataaaactcaaaaatcattcagacaaataagtttatggacttatggtatatgatgatactctctcaacatcctcattaacatcatcactattaagttaacaaaaagaaaaagaaaacatcattataagttattaataagtttaaatagtagtattttatattctggtacaatgtactgtttttggtcattaagtggttcaacgacaaaagtaaaactcatgcggtcgacccatgcgttagaagaagaaaatctgaaaagaagtttgaattctttaattttttcataaaaagaagtttgaattcaattcaaccgtttttgtttagttcttctttaattaactttatcactaatgtttaaaagtaaaaggtttttaaagtgtgcaacaagcgtgactctttggcctttagagtcatcaagaagggtaatcattttttttactctttctcgacaatagcaatcaaattatcattcccacttttaataatctcataaaataaagtcaatcatagttaaaatttgataaattccatggaaatgataaaaatttgattttactattgttggatgtgcaattgttcatggtaacttactaatttatatgctttattagttgcagatagtgatatatatcgaaaaatgaaagatctaattccaataattgtcaaagaggatttctaaatttctgtttgactaggtcatatattctcacgactcaacgatctaaccaatcacctacaacagaaaatttggttgaaataaaacgaaaagtgataagtccaaatgtttaaaacaaaaaaaaagtaaacaaaaggcaaaataagataactacgattagattttgttctcgccttatgaatatcctaaaaattatctattagtgatagtttgataatcatctttgactgagaaaattgatgtcacataaacattaatatagtatcaacattaatcattaatgatgcgactataattattattttatcacaatttcttagatttgataatttgtttaggtttgagagagttatatagagggggacaaagaagcaaagtttgtgattataaaattatttccattgaactaaagttttcaatagtttattcttgactttaataataataactattttgcccccagctagtcacatactcatgattgcaaaatctctctctctctctgcctctctatatattaacctttcttcttcctttactttctcatcttctatctctcaaaagaaaagcagacaactttatttgcaaaaacagagtttttttttcttatcttgagaaagttcaacagaagatg

SEQ ID NO: 28105 - DNA, 3003 bp, Unknown
  misc_feature (1)..( 3003): 2750-1469P.txt file - cDNA_ID_2993912; gDNA_ID_1621099; Annot_ID_171269
tgcaagtcttggtgtcgtatgagatctataatgtaatcgttaacaaagaggggatatttgatcataataatggtccgtcgatgtcctcctaagttggtaaatcgtaactgccagttttcaccagactctctattctttagaaaacagaaaaaagtaaatgatttaggaggttactctcttttttactatgtacttattatcttgggttcttttggcgtcgtcgttatttacttttctatggagtactaccgagtacaaataattggagaggagtcatgcatgattattgattagagaatgaagaaattaaaacccaaaactggaagtccaaatcagacaaaagcacctgtggcccacaaaacaattgaggacgatattacgtgaaggacaaatggtcatttgacggacacacctttcttttgttagacgcagtcccgttcgtggtagggtcagatccacgtgaagttcacatgctttccatgcaccgtttgggtcatcctgttggtcccgctttattaactagtctatttcctctattaggaaaattcaattttcgaaacaaaaatcaatcaaaacatgtataaacaaactgataaaaaaccacacaaaaaatatggtgcttttctgagggtatatatattttttgttttcgtctgatcttatattttaaatttggattttatattcaaattttttgtatattttgtggtcataaattgtccaagataacaattcgtgaccaaaaaaaatatatgtgattattttacagaaaacaaataattaccaaaaaaaaaatcatatcttccaaataaaatgtaagagaaaataagaagattatatatgtgagaactttatgagctaaataaaatgaagaaaagtcatagtttagccgcgtaggaaatcattcagaattcagaaatatggctcctcgctaatatttttcttttaaaggtaattgtttttcaacctaatttgagagcaatgtatatcgataggtttcacattagcttatttcgctcacatacatgattgtgcaaaaaaacagaaacgatcgttaactaattatctaagaaagtgacatttcaaaaaggctcatttcaatatagagttgccttcttcatgacatgaccttgatatgataaattccctaatgtaatgaatcaataaaacgaacttatagaacggtagaaattacgtacgtgaggatttatatcatctattaattaattaattgacaacaaaaacagaaggggtagtgttcacgtgcatgtcacgcgggtaatggtgtggacacacgagcctcgtacggtgtaaagaaggagaacagagagagtcgcacgagccgcacgtgggatgttgacttgtcgattagcttaaggggtatgtccatatactaatgattaagtacagtcgaatgaaaacatgccacgagccctagatctacatgtttattgtggttttttttttactcagtcacatccacatgattaatattggtccctgatattcatcttatatatttcacaagtataacaatcacccaaacattagtttttcttaaattgttttacggtgaaatgtttcactgtttcctctatgaataattaactagtggagtggaatttattcatttatcatatccacataattcatctttattttcatttgtgcatataatatatatcctttaactttctcatgcttaccatttaggctttttgtcttcctcaaccttcttaaactttaatatcccccttaaaaacagatgaaaatagtctttcctcctatgaattttcccaatcactttacaaattattaaaggtcttccaattaacctggtttcctaataatgttgagtgtaatcctttcacaagcttttcttaagaaaatgaaaaacaatcatatatgtacaatactagagatatataatgagtcatgactcatattaatcgcggtttttgtaatatcataaagctttctactttaggcttgacagtgatttaatacagtaacatatcacataaatatgagaaatggaggctctttaattaggcctttacaatatacatatatattagaaatagaaagaaaagaaaaaaatcgaccgacaacaagattggtgaagaaacgcaataattgaaccattaagtacagtctaatacccgcagaaaatattacaccacctactcttagtggcaatgctgtactttaacatattgtcgagacaaggagaccaggttgcgtgaaatcatgtagatgatgatgcataaacaatcaccaaagttcaccctatgaatccaagcccttctagcttagtggctatgatcatagccgacatctcatacagtcacattccatttcggagtaaatcatgcgatgaacaaaatttagcttgttctcattacaagataacaaattggatactatatatcaaaaaattgtgagtgttaggatttggatcaaatctaactattagagaacgataatataaaaaacatacatgatttgaagtagtttactataattttgatagatttagaatttggaaatagagaacgattatagattttgctagtagaatttggaaaaagaaatgctattaaaaaacagaatatattctttttgtttaacattttattaatataacaaaccaaaatatagtttccgatattggccagaatatcgtcgggctacaaaaccggaaatagacattacggataaagcttaatccgtattttcactctatttcgcgtttaatactttgtttgtttactattaagatcaccatactatataacaaacaaacaaaaaaggtcacacaactacaataaaatgctaacaagccgaaagtgtacggcagcagtgtgtaatcgaataagtatcattaaagaaggccatgctcgattcattactctataccattccttaatatattagtattacatgggcaacaacgaaacaggataaaaaagagagagtgatcagtgatgatggatggtcatg

SEQ ID NO: 28106 - DNA, 3003 bp, Unknown; identical to SEQ ID NO: 28104
  misc_feature (1)..( 3003): 2750-1469P.txt file - cDNA_ID_2993912; gDNA_ID_2926166; Annot_ID_139931

SEQ ID NO: 28107 - DNA, 3003 bp, Unknown; identical to SEQ ID NO: 28104
  misc_feature (1)..( 3003): 2750-1469P.txt file - cDNA_ID_2993912; gDNA_ID_2926166; Annot_ID_199170

SEQ ID NO: 28108 - DNA, 3003 bp, Unknown
  misc_feature (1)..( 3003): 2750-1469P.txt file - cDNA_ID_2993916; gDNA_ID_1621097; Annot_ID_55733
gtaatttgtccatagtttcccgcagcaagaatagaaaaacaaagatgagtttacctgcctgatgcaagccaaacttgggatgctcctccaccattgtatctatatcgataaatataatctgcctcttgtttctccttgtctgcatcactaagctctggtagctttgcaaacatcaagctgtctagatcaatctctgtatttttaggatccattcttacctgaataatgagtaaagaaaagaagggggcaattaaagaatccagcaggatagaatcaattactgaacaaatgcaaatatgacaagaaaaaaatcaacttcaagaacagagaaatatgacggttataaagccaagaaggcataaaaaatctttcaatcaaaacaaagcaaaaaaaatacaagaacagataaagcatttggacaatctgcataccatatgcaagattcaagaagtaagaagagcactggaagccataccttatcaaaattcactacaaatatggcacttggtataggtttatctgccgttgcggctgatccagaacccacatcaatatcaaatatatacgagtaaagctggttaaatgcggactccacttttattgcctctacgtcataggcaggtaagtgtcttccaaaatcagcctaaatccaaaaatatttttgaagattagtatcataaacattaagatgtagtttttacagctatgaaatccacattttcatcgacatatttttatatgtaattaggttcgttatgagaaacagttaaatttgagatgataaaattacagcaacctctagtgcagttccagcaggcaccatggcttctttcactgccttctccagagctattaattcaggttgcccactctagagaaagaaaaacaaagatgaacatttaggtcaatgggggaaacaatgaaattattggcatcagaagtcagtaaaacttaatattgagtgcaaaaaacttcatgtacaataataatcagctcgagacgcaaatgcaaatcagctaaatcaaatacaagaatccagaacttgaatagaaatcttatcctacatatataatatcggatgttgaagcaggtaaatcataaacaacacaaaattcgtgaagactggttaaaggtttataaaattactcacaggaaagatattataaacaactcgatgctcaatatcaagtggctcgcccgtctcttggcatgaaggcctatgtgttgaaaaactggctcttaggaactcttctagtttttgaggatccactgaatacctgtaacctccatctccattcaaacccacaagcactatattcacttccaaaggaacctgaaatggtacctaaacaaaacaagcttcatagtgtgaaattcaattctcgatgtgtcactcaaactcagccaatctaacaaccatatgcacgaaaaaagctatgatcatagtcgtgaagcaacaagaacgcttttaatttcacttcggtgattctacagaaccaaattactcaacgatttcttctccttcttcttctagctaaattcagactaactgatgatgatgatgatgattcacataatttaagctggagattgtacctcggcacgggagtgaagcatacggcggacatcggatcgaacactctctcgtacgtcaaggaaagcactgtgatgccagtgaggatgacctggctcgcgacggaaaggttgctgagccgagtcggtacgagaaacgagtccgcatagaaacaagagaaacgcgacgaataggagagaagaaaacgaactcgatcgtgaatccgatctcaactccatgactgaaaaaaaacaaccggagatttcgctcacctcccgattttggactggactggcgagagtcgctacaagtcgcttacggcgagggagcagaaatgggaaaattaaggctaattactaatttaccctcaagttttattattaaggtgacctgacctgctctgtctatatgtgatattgtgacctgctttgcctatatggctatatgtgatacctataatcacaaggatatttcaggtggagaatcagagaaagaaattgaagctgaataagacactatatgggagagattgaaaggaagctgttgggccattttggtgtagcgggtcgcaagtcgagcgtgagacttattgctgtgccattgcaggaatgcaaacagaggaaagatttcacaaatgggaaacggatacatgctcagatggttgttttgttgtaggaaatgcctttcaatgagtatgttaaacgctagctgtcctgtttaatggaccggtgtatgtcatcttgtcttgcactgtgtgagcacaacaacttgcaatgtttccattgatgctgtagcagtctctcacattaagctctggtttggatggctatgaacaagttgattggtagataagttaaaatgttgtgatttgaatctggaatgaatagaaagatgtgattggtactgatgtaaattcaatgctttagagaatgtatacaggcaataatataccaatcattatgtttattgctgactaagagccactcctctttgctgttgcaattcggcaatcgttctagatatggtttccatttcaaatcatgatatgcattgactttttccatgtggcgttcggaaatctttcatctatactacgtctacgttgcaagttttgcaaaatgtttaaattagtagaatctcacgtatataaaaactttagtcgccaaattgaaaatggagaatgaatggtaaactactagtttaccctcatattttagctgaaaaatatcgtcacagctgacgaagaaattagaaacaacaagcaacgtgtcacttctcatgtcgtcgttttccccaagaaatatccaaactaacacccaattacctaatgccacgtgtttactcacactcctttaaacaagctcgtaactgtttcatcttcttgtccccaaagtctcctcttccttatctcttggaaaccaagaagcatg

SEQ ID NO: 28109 - DNA, 3003 bp, Unknown; identical to SEQ ID NO: 28108
  misc_feature (1)..( 3003): 2750-1469P.txt file - cDNA_ID_2993916; gDNA_ID_2926165; Annot_ID_139875

SEQ ID NO: 28110 - DNA, 3000 bp, Unknown
  misc_feature (1)..( 3000): 2750-1469P.txt file - cDNA_ID_2993919; gDNA_ID_1620812; Annot_ID_57882
actttattttgctttttattgggtcaatcatcggtgttttgtttctattttaaatctataacattttggtttcagctcgttagattttcagaataaaataaagcaaattttgaattttttgattcattagtcgtttatttttgttggtataatactcccattttgtgtactttggaagccactagagattgtataagtataaataagaataacattactataatgggatctttcgttggaaagttcgtcattttgttttgtctattcccaacttgtttgttatatctaaataatatgctcgtagataccaagattcaagatataaccatgctcctttttttaatttaaatttttaccaaaatgtaaattttctatatataaaaaaagatatattaattgctacttgaaatttatacaagaaatttcacccataattgctacttgaaatttgaaaatgatattttccaccaccaccaatgactgattaaaaaataaactgatttctaacacaccttaccacccaaaacctaataaaaactttaaactgtacctctatttctaacacacccaattaaaagtgactgataagttgtcaaaacattattttgaaagatacattgatgatgtgattgtttttttctacaaaaatttcagtttcgaagtttacccattaacgtgttttttttttttggttttttttttctggtaaatatcctatattttattaaattttcttactatcaactgtacaaaagttttatcatccattatactatctataatggaattgtaattttattacacttagatgtaactagaattgtaaatatattattgtagcaaacatttgactattaaattaattacgtaacctggtttttattttgccttttaatgaaattataaaaattgtatagtttgaaaaatatgatactatgactatttcttatatcttaaaatattattgtcagataaaagagtttgggattttttgataagttgtactctacaaaatattcgaaaacagcctgtacagttgaacagaggcatgcagcaatgattaataattaatagttagataattagaatgttaagtggaaaattgttgtatttagctgactttccagtttccaatagacatcgcccatcgaatgtttatttaatcaacattctttaaaataatgagagtgttttgcttacttggcacgtgattaaagactactgacagaaaaaaacaagattaaacatctaacagaaataacatctttaaactatgattgcaagtagatatatatatatatatatatatatatatatatcagaatagttgaagaaattactgaagaatcaatcaatatacacaaacaaaattatagtttttctccttcgacaatatacgtttagaatttaaactaaacgagatccatatatacattttttttaatttatatttactttgattgcatatgagattgattgtacatgtacatatatgtttatgattattagttaaaactgatcgtgcatgtacatatataaactatggagagtggattataagattgtaaaaactcaaatctttctctataatatttaacacgtgttcatatttatgactgacacaattggacacaacttaagttcaaagagtcaacaaataacaatgcatgctgaggcatacatatatgtaaaaaaaaaaaaaatcgcaaaaaaaacagatatgtaaattatacattattgttaattgacaaaccaagttgcaaactgcaactaatcacatagagtttaaaaatgtgataattaacggaacgcttaagatggacatgtaattatatattaatgaactgaatcaaacaaaaactaaaaacatttattgcttatgtggttgatgagatatttgttttaagcaacatgatcaaatgagaatgtgaagacgtgttagtcacatatgaatatgatttataaaagaatctaagacgacataaatgactagatggtggaaataatgtgaggcatcttaatttccttttcatgcatcttaatttccatataatccataaaaaatgtatcttatatggtatttttctcaatgaacgttttgtccaatgggctagagacaaatatatcctccactctttataacggaacgggctaacaataaaaaaacgaaaggaaaatttgacgtcatcttttctattgtcacaagaaagacatcatattttctatcgttttgtagcatgttacgtttcagattgttttagactttgtttcttaacttgtcctaatagtttactctaattgtgtgagtcttttacgagttttacacgtacttataatattttttagtcaagatttctatattatattttcaaagttatgacctaaaactatcattttcgctatattaaataaagaaaatcacatttcagctaactacctaaaggaccttatgaggtttattctttctttttttaagaagacccgatcaatataatcaactttctcacgacgactttccaaaatatcattgaagtcaaccttcactgaagcaactaaccatatgcatcgtccagttcaagattctgcaatgcgattcaatcgttaccacaacttaagatcgaaaccggacattagaacccctttgttacttcgtcgtacattcgtcaactatatccttacctttggtatccttcgcctttgatacaatgataccaaaagaaaagaagaaataatcagaaataatcaattgttctggttttaggttgaccaaactctttaaccgaaataatcagaaattcgaaaataaccgaaacgaaccgacgtaagaaaccggatcgtccaattccagattttgaaaccaaaatccaaacacataaaccctaaaacattttcgcatcttctctattcaaatcctcttatcatcgatagaaatgatcatcactgggttcgaaattttctagaatcttcaagctttccttaccagtttctgattaaaagatg

SEQ ID NO: 28111 - DNA, 3003 bp, Unknown
  misc_feature (1)..( 3003): 2750-1469P.txt file - cDNA_ID_2993923; gDNA_ID_1620812; Annot_ID_57893
tgaatagatattttctcctctgcgtaaagccaaagatattagttaatgggaacactataattcaatctactttataatgctctttctttcctaaaataggaaaacaaataaacaaaggtacattatcaatcacgatggtagtggtaacataacaacattaacattcacattaaccaaaaaaagaagaagataagatcttctctggtctaaatttggaaagagtctgcactctcagaatcaatctctcttgttgaatctcatcttagcttcagtttctccactgtaaggagcaacgtgaaaagcgtactgttgaatgatggagaagacgatcatctcaagacatacaagcacattttgcagagcttcttcaagctgatccacctccaaccagaaatgatgcgacttaattaatcccaatcccaccaatatcttcaggactattccctgtgcaacacataattcccaaggtttaagaatggaacaaggcgaaaaattagacatgaatgctttaaacttgacccaatgtagcagtgatcctaaaatctattgagatgagacttttttgtgtctcaagtaccaaccaacaagctctaaacggttttcgttcgctacacaatcgaaagacttagattaaggagaaaaatctcaacgctcagaccatatgcacattacaaaaatcctagacaaaagagttcccctttaaaccttcagctctcaactaaatagcctacggtctgttgttgagctggcaaagctacaattccttgttaaagtagtcctgcaaaccttaatggtctaattcgtggcggtgaaatattataaggcgggaacccctaaaacatcttatgacattctagagactatatgtatctttccattgtctaaacagcagattgaagaaaaatttgaatgtttcctcatcaaactcagttagttgattgaagaaactagtaggcagagaacttgtgattttggcatttggcaggcaaagaaaaagttggaaattaagtatttacctgccaaaagcagaagaacactatccctttgacgcacatgaactttgtaagaggcttatgaggctccaactctttagcaaaaacatggtagaatttcaccaaagaatacaacgccagggaaaccgaaacattgagaatagcagtgaagatccagctcaaccaaactggataaatcccaaggatctgtaatgttatcatcaagatggaacacactgggcggataatacaaaactgccatgtccattgcttgagctgtttcagtgtgaggtaatccagatgtgtggtacggggcacgaaaagagtcattggaaacgaatggtggatttctcgccctttgaattcatctgggataatccgtgcactcatcgatatgtttacataactatacatcaaagccaagaatttagcaatgacctgaaacaaacagaggcaaatacaacaaatcaagaaatatccacacagagagagagagttaatgtagggaaaatgagacatgacagaatctagaaggaacctacaagtgcctcatagcattccttaacggcgtctagaaacatgaagaaaggtttgcttcctttagcatctaacaagcccacaaaagagttgatagcgtaaacaggagccataagcacaataataagaatggctctctgttcattaggtttcttccagtaaaacagatgctgggatacaagctgcatagtgaagtgcatcgagagcaaaacacagaacacggatcccatcaccgtgatctccgcaggagataaagtagataagtcaatcattctgcataaaatgaaacaagttaagtacacactgatcatcacgattcccaaaaaactaacaatggttgtgaattccaatcagatgtagcagctagcacaattatgaagtgtttctagactgaatagaactaaaacatcatgattcctgagatatagatactaattcagaaattcccagtacttaaatagtaacctcactactttgacatactttctttgtctaagtcacagatcttatactctagaaaccccagaatcaaatcattgacgaacgagctaaaagattccaaatttaactaagacacagcaaaatggggctaaaaggagtaactatacgccgaaaacccattactttcaagctcttcaggatcatcaaaatcgaaactttttgtgatactgaacttaagagatgaacaagaagaagaagtagagagaatcagaaggcaaaccttgattgaaacaagagggagattatcgaagaagacgattcaggtagagaacttcaccgagttgtttgttattgtacgattcatcaatggtatagatttgtttgattaaaagaattgtttttttgaccagaatctgttcatcattgaccggttcaaaatcagccgagtcctctttgcgaccaagaaatatacccaagtcctccgtcgttatttgccggccggtttggttttccgtttaaaagttcgaaccgaattgaaatttggttattcattaaaacaaaattggttaggacttaaattgcggtttggtttgatttattttgtgaaacaagcaagaacaaagaaaataacaagttaagaagatgcaaatgtttgacaagattaggcgttaattaaattattgtaagatatgccacacatgacacatggatgatgctgttacatactataagagtataaggaatgtgctttaactaataaattgacgactctttcatcttatgtttatactcgtgttctttttgtcaacttttatgaggaacgtatgagactcgcaatgtcttgcttgcacacaaactcaacatcatatatgttgcttccggttaacctaacttgtaagtccattcttgtctctctatttataatctctctgtgtgttttcttttcaaattcgatgaggttgttatagacaagagaagacatttttatacaaaagagtttatcattatataagtttcaaactttgaagatatg

SEQ ID NO: 28112 - DNA, 3003 bp, Unknown
  misc_feature (1)..( 3003): 2750-1469P.txt file - cDNA_ID_2993930; gDNA_ID_1620833; Annot_ID_57905
tataatagttaaaccaatgagggaaaaaaaagatgagcaatagaaggtgcttgttgctttaggaaaaataaataaattaagctttctctcctagtcctgattaccgaaaccaatcccctaccttcttttgctgaaaaaaaaatcaagtaatagaaggttttgccggcgtccggatctctgtttcaccattttcttttgcttcccaaagatctctgttttacattgcttttggtcaacttctcaatcaaccaagcctttccctcttaactcaatgtcggatggttattgatcagatgctagagttggatggaggttcccagaaatctcctttgggaagctatgcctactacttttctcgtgattttaaacctaggaagccattcttttacaacagtatctctttctttgaacttgagacgattttctttgtgttgctcagatctcccgattttggctctccctcaatctgcacaaatgccttttcccaccagaattcgccttcggtgacaaactaacctaatttatgtcgatgtcactagattggacattcctttctaccttctgggcttaggcccaattatcatattttcaaagctcaactccaaaaagtgtattccactgttctctctgcaaaagcccatgttttgcataaaacttttctgatcttgcttagcgaatttttgtgtcgactcatggaactgattgttaatggacgtcgattggaacataatcaaacaatcttgctatgctggtataaaacttatctgagaacatgaccattagaattacctaggggtaatactctctattttcaaagcttgaaaaacaccttatatgatagcttcctttatcaaggcttgttgaataggtcgaggagaaacggcattatgaccccgtctctaaggagcaatggttaccgtagcttcttcaaccccatatccatgtattccctgtttatcgagctcatatatgtacaattaccaacttctgggaccttttccatatgctcaaatccaataagctcatgtctgattatttttgttatgtgttaagtcgactaaaaactttgtgtgaaattcttaattttcatggtataatactccatgtgagagaggatccacctattatgttacaaccttatactctttttttacgaaccttggttttagcttcatataatatgttgtggtatgactttctttgcttgaaagactttggtctaatgctgttgaaccttcatgcgagagtttttatggtggcttgggaagcttgtcaaaggaccacccctcatcatgctcgcttaacgtcttcaagtcatacacctcacttcatgtttgctattgtttgcctaacctcaactttcattcggcatcaattctagcaaataaatccaagcaccagagcaccatcaccactacccaaacctttgtcaaagctctacttcatgtagctctcctcgtgccggcgagaatcatgtctttgaccccttcattaacgccacttcgtcttttgacagagacaatttgtttttcctttgaatcgctcttgaaagagtcgtcgataaactttgatctcacaagtaccataagcatctttgcttttggctcaaaactctcaaggaccctttgtcgattagccctatctatctttttatcatttttctggtaacttttggagtatgccccttattgttgtgctttaaactttggaactttttccctttatctttgtatttggcttctacattatggaatgaaaacaaacattgtccaaaaataaaataaaaaaaacaatgaggaaaaaaatcaaacaaaaataggagaatcatagtcatatttttggatttaaattcaaatctttttccatggtacataatctgcagcatttacagcaaaaatgaaacaaaatctgttagttttaaatttaaagatatgtttgcaccctataataatctcacataagttcttaaagattgaaaaacaaaaatggttgcatatgtcaagaacaactttttattggttcatatagtagttttacttctttttgttgtctcatcatatgcaagatttaatacgaaggttacaacagatgaaatatgtggcatgtgcgcacgcagagcagtcaatgcgtcattttgctatgagttcatgaaatcatccactcaagttgcaacattggatacttatgatctcgccaaatttttgatcaattatgattttcaaaacacctttgatctaataaagcatttccagtcactcacaaacagcacaaccgatcccagttctaagggttcttatgagctatgtttacatctttttaatcttatcaatcctcttgaaaccgcacttaaagctttggcaaccaatgactatgacactttaaacaggaatgttgatgctatgtctcaattcgcgatggaatgtgaaagcgagctgtcaagtgtcatcaagcctattccaaagctcttgaaaagggtttctatcgtcgaaaatgtatccgacattatttttgtaattgtggaatgttttttaagaaaagaagaaacttcatgtaaggaatcagtatcaaatctacaataataaattaataatcataatgttgtttggtatgatgttgccattaccgatttacaccgataattaattgttttagtgttaagaaaaatcgaaatccaccacaagagcataccaaatcacgaaaaagcttgtttgatagatcggattggaccggctttcgtatttgaaaaagtcatcgttcacctgtgaaaaattacgcaactccggcgaggactattttcaactatgggcctagccccaattagtccaattagtaaggagcttaaaatggttttctcaaagtacggggcaaaagtaaaagaataaaaaagtagtggaccttgagaaaagtcatcaccagctttccttcctatgccacacaaacgtgttcttctgaatatgagtcaaacacagagaagattaggagaacgtggaagaagaagccatg

SEQ ID NO: 28113 - DNA, 3003 bp, Unknown; identical to SEQ ID NO: 28112
  misc_feature (1)..( 3003): 2750-1469P.txt file - cDNA_ID_2993930; gDNA_ID_1620833; Annot_ID_169751

SEQ ID NO: 28114 - DNA, 3000 bp, Unknown
  misc_feature (1)..( 3000): 2750-1469P.txt file - cDNA_ID_2993936; gDNA_ID_1620818; Annot_ID_50667
ttaaaacataaaatttgactcatctattataaacttatatagttatttcaacacatgagatggccaaattggagtaataactagtgggtttagtggagttttagttttcctttctccaaaattggtttagctagtggagctcgtagaaacaataacattaataataaaaggaaggattctactattaacaattaactcgcactaatctaaaaggagggttgaatttagaattaaaatcacatcagtaataatatttctctccatctttttgtgtctaacttctctcttcaatttctatttctaattatgcaaagatatgagaagttgaagcaataaatagtggatttagtaaacctagtggaaacaatattcctaccatttggactgcttcgaaaaatcaatcggactgacacttgagaaatcataagtgattgatcttcgtttgtaaaaaatttcctgatttttgcgttcaatttccaaccaatttaaaactggaccaagatatgtgtgtagatttcatgtccgtcacaatagttgttccaaataaaaaaaacagcactaccaaacttgatgtgatgagtccagtaaaaggagcttatacacgacttaaagaccatatgaaagaagttcaaatttatatcatatatgtagattcagtgccttaaaagtaaggactcgtgggcactcatgagcatataggattccaatactgatataaccctcctacaaaaactaatgctaacattataaacattaaatgatttttattggctattttggtatatgcatggtagtttccatattatttggcatggccttgtttcagtgttggcgtcaaaacataagtgaactggtgtgcctaagacttgaggtcttagacgaaatgttaaatgtgtaatctctttttctttttgctacggtttattttaaaaaattcatgatcttttaatgatttttttatggttatcattagaaagcagtattctctaataagtaggtgatcaattttgtccaacaatgacacgttttttcaaatggctattagccttgttattgttacaacgaatcgagtatgtgtgcttttttcaaagcaaaacaaatataacatgatttttatatgaaatatattaaaaatgaataagattttatcggataaatgaaattttttacacaagataaaaaaaaaacattaactcgtaatttcattaatatggttaaatatcattaatatcaacttttacgagtagtattctaaaaccacaagtgaagagtgatcccaacaatcgccgagtaagtccccgtgaccataagaactaaacccatcacaataatcaccaccaaaaccacactctcaaactccagacatctcctatatcccttactgatctttaaataaattacacatggaaacactatcgaagtacaactactcaaaagtgcgcctataagtgacattacatatccaaacaatggcacaacaagtgcaaccaatattgttcctaaaaccagccccgttccagtcaacatccggaggcttctccttttatagtttgcttggatcaatcgtgtattgattgcttccatgatcggggaaagaattaatgcgtatttggttagcggactcacgattgtagtagatattgctatcaccgcgctgatattatgagttggaaggtttaaagtgatttgtgattgcacctcttctccatacataagatatccaaagattgccaccacagcatagattattgatgataaagcaaagcttatggaaagaatctgcatgtatactcaaaaagaaaacaaaaaccggtttaaaatgattgaagaaatttatataaattaacaaatcttgttagctgaaaatgttttgataaattaagtaccttagagaaatgttttttgttcttcatagaattgtagatggttgggaagacatgatgtgcagtgtagcaaacaagatacaaactaactgcggtaggaattcctgaccacttgaccagaacacctttgttcttaaatcccacaccgtcaatagcgccgatccaaagaatagacattacttgtatacaagaaactaggatcccaccggccgaaatatacgagagaaaatcttgtgtttccaaccacattgttggaacaacgatcaaagaagcaataacgataaacaagtgcttcgaatcccggcatgtgggaacatgtgatacatattgtcagcttctaatatcaagattgccgttgcgacaaaatacaactcgatgtatatgaagaaagagactaataaccgacctttcttcccaaacgctttgttcgctagatcagggtaactacgaaccatagggtcgagtttgaggcaacgttggagaagcaaaccggtgtaccaagttgttacaccaattagaaagaaaaacagaatgctaatccatccacttgaggaaagtgcataaggaatagccaatattccaacacctaacacatatataccatcaaaatagcaatctattagtttttcttataacaaaactaatactaaggctaattacgagtgataatcgactatagttatatatgaaactatatgtatcttagaaagttatacctgacaaagaattcaatgtgttgaaacaagcgtgaacagaggaaatgctaacatcaccgtcgttgccgccggaaaattccatcttaaatgttttgttttgttaaataaaaaaaagactagagtttttgaggaacttacttacacatcatgacttgtgttggtgtcagtgagagtgagtgtatgtatatatggaccaagtagataaaccggaaattggtttttgaaccggtttaaatgtgaaacccgtttggatttttgttttgtttttttatctcatcttcttcttcagaaaaacacaagataacagaattgccaccaaagctccatttttatccccacacagaagaagcttggggaatgagaagataagagctctcaaaattccccgaatttcgaatatg

SEQ ID NO: 28115 - DNA, 3000 bp, Unknown; identical to SEQ ID NO: 28114
  misc_feature (1)..( 3000): 2750-1469P.txt file - cDNA_ID_2993936; gDNA_ID_1620818; Annot_ID_169353

SEQ ID NO: 28116 - DNA, 3000 bp, Unknown; identical to SEQ ID NO: 6792
  misc_feature (1)..( 3000): 2750-1469P.txt file - cDNA_ID_2993944; gDNA_ID_1621105; Annot_ID_55963

SEQ ID NO: 28117 - DNA, 3003 bp, Unknown
  misc_feature (1)..( 3003): 2750-1469P.txt file - cDNA_ID_2993948; gDNA_ID_1971793; Annot_ID_58052
atagacgtaaggtggagacttgtacacatatggagacggtggtggactgtaggcgtatggtggtggtgaactatagacgtaaggtggagacttgtagacgtatggagacggtggtggactgtaggcatatggtggtggtgaactatagacgtaaggtggagacttgtagacgtatggagacggtggtggactgtaggcgtatggtggtggtgaactatatacgtaaggtggagacttgtagacatatggagatggtggtggactataggtatatggtggtggagaactatagacgtatggtggtggtgatggtggagagtatgggtattgagcacttgtatgcgcagcaacggcatacaaggccaatatcaccataagaagagatggccaattactcggattagccatgtcgattgaatgtgtttgctcttgtttctagactcaggttttgttagtatgtttcttactttaaacccgatttatttttgaatggattgtaatagaaagtaaacagtttatatagcttacattaggccaactagaatacttgtttattgaactttaaggaagcgtcttagagcaatatcttatattgtttaataagtcaacttaactagtttctgattttgtctataaatctgaagaaaaagtcgagaagaatatgtctttggtaactacctctaaccatactttaaatttaaatgtgtcaacttttgaagttgtcaatttaaattcaagacatttaagagtgtttctttctgaattatctatcaccgaatttgtacactagttctatattacatcttgtaattttaaatactaatgttatcgtacatgactcataattttgagtttttcttttgagttaatttttccaaatggtgataactttgacattttatttcgtaatgtgtataatacaactaccgattttcattttttttaaaaagaatattacttacactaaccatttgatttggtttagtcataatctcttcatatttcagccatctggtcgtcgtccgttatatggaccttttcttattctatcgttttaacattgtaattaccgattatcttttttgttgaataaattttaaatgcttaggacaaaactaatattacatgttgtggtttcggacctggagagattacaggcttcggcccaaaacttccttgtattaaaaaaaaaaaaagaataaattttaaattctaaataaaaaagatatttactaaggatttttgtgaaagcaatactaattgcattaacattcatacatgatttgtataattgtttggagttgggtaagatgctcgacttccacattagggaacaaacaaagctagattaatgcacgtctagtgaaagatccatccctttgattacttaacttcacattagggaaaaaacaaagctaggttcatgcacttctagtgaatgatccatccctttgattacttaacttcacatttagggaacaaacaaagctagattcatgcacttctaggtgaaggatatcaggatatgccacatttctatcaaagaatacggttaagaaagtctataggaggacaaaaatagatatgttttcccaaaaaagattcaaagctcaagttaaatggaacaatgagttagcaaaaaatggtttaacgggaggagaaatagtggtagtgtcaaccaagtcgccttggtccagtagtaaagagaggtaattcctgtcacatgggttcgagtagctttggccactgggattcgagtaatttaacatgggttttttcgggttccagaattagtctttggacctagaaaccctttaagatcacctgaattatcaaaaaatatatatatagtagtagtgttgtgtcctatgttgaaaagtaatatggatcagctttggaattctccaggaagcaatgggatcatgtgggatcaaaaagaataataaagagaccacgattgggcaattactaggcacttatgtcattgaggtgattagtggatcataagattatgcctactgttatcctcaatttgaccgtatactattttcttctcttttagccatccttgaatacctaaccgaggttcaagaatcagtttatgctttcatgttgggttgacctttgttaaataggttatctagtcatgaagagcgaatcaagccaaactcttttttttttttctctttaattaaaataggattgtctctaaaataaaattttacctaatccccgattttgtaattttacttttcatctcaaagaaatacaaattaatattacaaaataaaaaaaaatatgaaatataacccgtcaccattaccatcaagttttcaaagttttaacgaataatatatcaaatcaaaactttcgtgatgcagaattcaatctttagaattttaaacatctaatacatatgatcgtaataaattttagaatatacatataaaaatgcatattattttttacataataatatcgatttccgttgtttactatacacgtagcaagacctaaacagttttaatctgatatagcggaaactaattttggcaccttagacaattgattggtcaattcaaccctcaataagcccaagtggaaagacaaagaaatttagggtattttgtcgaatgagacataatcaacttgactgctccaataaactgttttcactagatgatggatagtagttctgttctaaacatggttaatagagatccaaaacccaatttctctatggactttattggtgcaactctttaagtgaaattgaaaccttacttcaacacatttcaaatgtatctacctaattaactctttatataaaattaaaaaaaaccttagtgcataagtgggtaggtgaacttgagtctcttggcaatatgtaaagaggcgaaatcaaagttgatcaacaattaaacacaaaaacccttaagttgacgtggctgtatctcttccaactcttaaaaatcaattactattatacccctcagaaaaatg

SEQ ID NO: 28118 - DNA, 3003 bp, Unknown; identical to SEQ ID NO: 28117
  misc_feature (1)..( 3003): 2750-1469P.txt file - cDNA_ID_2993948; gDNA_ID_2926143; Annot_ID_139022

SEQ ID NO: 28119 - DNA, 3003 bp, Unknown
  misc_feature (1)..( 3003): 2750-1469P.txt file - cDNA_ID_2993959; gDNA_ID_1620811; Annot_ID_50584
ccatatatcaatagacgggaatttaaaagtcttaactagggctaaccttcccacataaggtaccatataacaacttttcctataataaccctctggaagtttgatctggttgaacttttcagatctaacgtctaagctcattagtttgcgttccacttcaataccatcaccaacataaacagttgctccatagtacatgactccattaattagtatatgcatcccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaaatgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgacttcgttgataacaaggtttggtttctttcttttcctttatccaacaatttcaatttcttattatttctttcagttttcttttgatggaattttttggaacttttttattattattgttacattccaatgaatttatctttcgtgcatggattatcttggggatatatacttagatcgtcctatttgagtgatttatatatgacaaaaataaaagagtaatgttgtattacataatacgtggatataaactcggatgaagacacattaccaatactatcacaagctagtcaactcaggtctaatgaaatccagtaaatacttcttctagtagtagcatataagtttgttctggtatacattattagtcctagataatcatacattatttctaacataaaaatgtcctaattcttatccataaatttaaataagaatcatcaggcttacaagagaacgacatttgtttgattactctgacactagaccacatttgtttgtttgcgtctccgttggtgtttctatgctacggtgaataggattttatgatatagggacgcaattcaaacataaataaacaattgtagcttatatattattcaaaaactaaaaatgcagtggtttccggcgttgagaatggcggcgatcactaaatcggaagacgcaaaagcgaaagccatggaagaagtggaagaagggttgttgcaactcgaggatgcgtttgtttctataagcaaagggaaaccctttttcggcggtgaagcaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggagatcgaaaaagtagctgagtttctacaagaacttgaggttagagctcaatccgcagcttcaagatcttgagatcatcttagaaatgtattgcaatgcaattgtgttttgtgtacatgtaaaacgaaaataagttgaagttttaaagtgttgtgttcagtctatgctaggatttatgacgcggtgtatgggctacggactattttcagtttatgtttatcgaaaatataagggtcagcccaagattattaggggtcgtcccccctttaacatggaaatctatttaattcgggatcataattatttttggtaactgagataattttggaaatttttcaaaaatctttttaaaaaacttgctttaatattaagtttctattgggttttcacttttcagaccttcacatctttcttaaccaatatgagcccgccgggataatgtgctttcacatcgaaagttaaacgacttatcttgaccactagtacaatttgtctaatagtagtacttaattgaccactagtcctaattaatctactaatttttctgttttacattttaattaatctgctagtactaaattgtcctccatggaccctcttcattgcatctgctcctgataagccaaaaattttaatatcttgaaccaatcaaatttctctggtcagagagatctagtagcacgaatatatttattaacaaaaaagctaacaattattagagaaaattaagtaactaccaaaaagagtaacattgacaaatactttcacaaactcaaaaaaagaaagatatgaaaaatgagtaataataattttaaaataataaaataccttttctgtaaaatagacaaggtcccaaagacccagctcaagtccagctctctgtattcattaagttaccttctaaacattcacaccatctctttctctaacaatg

SEQ ID NO: 28120 - DNA, 3003 bp, Unknown; identical to SEQ ID NO: 28119
  misc_feature (1)..( 3003): 2750-1469P.txt file - cDNA_ID_2993959; gDNA_ID_1971909; Annot_ID_177048

SEQ ID NO: 28121 - DNA, 3003 bp, Unknown; identical to SEQ ID NO: 28119
  misc_feature (1)..( 3003): 2750-1469P.txt file - cDNA_ID_2993959; gDNA_ID_1620811; Annot_ID_169030

SEQ ID NO: 28122 - DNA, 3000 bp, Unknown; identical to SEQ ID NO: 8966
  misc_feature (1)..( 3000): 2750-1469P.txt file - cDNA_ID_2993961; gDNA_ID_1971952; Annot_ID_58633

SEQ ID NO: 28123 - DNA, 3000 bp, Unknown; identical to SEQ ID NO: 8966
  misc_feature (1)..( 3000): 2750-1469P.txt file - cDNA_ID_2993961; gDNA_ID_1971952; Annot_ID_177356

SEQ ID NO: 28124 - DNA, 3003 bp, Unknown
  misc_feature (1)..( 3003): 2750-1469P.txt file - cDNA_ID_2993965; gDNA_ID_1971952; Annot_ID_58639
agccaacatggctttaggccactattacacagccgctgttttggtacgtaaactcatatagatatatttatgttttgtttataattatgtttggtataacttatattcatcaatatttattgttttcgcagtttgcgcatttggtcaaatgctatgccaagtggtcaaaaaactcttttgacctctttacttgggaggatttgttcatgtacacggcatggtgtggtcttgccacgatgaaaaaagatgagcttgaggtaatacaatattaatcgattatatatatataaaaataaataagccgacttgtaaactttttttattgatgattttttaggagatttctgagaggatgggaagtcaaaaagttggccaccatttccaacacttgattagaaaaactcttggagggtaatatataactcttaaaaaatttctattgaatacacttgtcggcaattaaacaagcttggtttatttgttgcaggatgtttaaaccaccatgcttggattttttgaaaactcattcaaaaccaaagcacttttggacttatacctccacgaccatgtgaatgctcttgagatcctcatccaggagaaatttagggtgtgatgcatggttgctttaaaactatctagttttgtcttttttgtaaggctacagtattttcttgtctctcttggaacaagagtgtttgcaagttttcttttatattcaagtgtgttggacttagaaaagtttgaaaaatcgtactcaatatcaacaacgaatcctcttaagatggttttgtttttgtagataaatttggcttttagttcccaccaacatttcttccatgggtttaagtgttgatcatgagcttaacaagtcattagctatatcaaattgccaaaagactgattctcaaaaccgatcaagaaagaaagcatcattttataatctaacttgtgtagagtactgaaaatttgatttggaaattaattctcaccgacttaacatggaccaaatgtacttgatcattttcaatataacaaactagtgcaccgtaccgtattataaagtctttatgtatttttttttaatataaaaacattttcagatatatttatttccaataaattcatttattttaagaaattaaccaaaaagaaataaaaatgaacaaacatatataagtatcttgattagaagaagcaggagacaaaccctagatgagtgagtccgaggaaaagacatgcaacgacgatccaaagcagccgacacttgtccgagacctggttatatcgatcttggatcgcttgagattctctgattttcatcgagccagatgcatttcttcagaatggtattacgcctcgaaatcgtgcatcagagtaacaactccatggatcataatgtttccatacaacacagattggaaagaaaattcatcatgtaagttgttcaatcctcgtgaccatagttgctacactttaagagatgtcgggtttgatctagctagtagtcgttgtttggccagttccggtagatggttccttatgttagaccatagaaacgattttcatctcttgaatctgtttactcgagagaggatttatcttccttgtctgggtgcaaccgatggatgtccgatagaattttggagaatcaataataataatttttgggtgactctcaatgaccaaaacaattctgcaaaaaaaaaaaaaaacttcacatatggtcatgtgtcttagaataggcaaagctgttttgtgggtagatgaagaaaccagagactacttagttgtttggaattatgatggcttttttgcatatcacaagaaaggagatgacaagaataactggaaagtgattcaacctttaatgaatcaacgatgcgtggatatggtgtgtaaagaaagcaagctttacgtgcttactgatactcacgtcactgttcttgatttctcccacgctgatgcttctccaatacaatgtgcaagtttcaaatctccgaattatggtaatgattcgttttgcggcaagaatcttgctgtgactttgtcaggacaagttttgatcgttatacacagtgggggtgtctacaagatggatcctaaatcattagaatggagcagaaccaattctttaggagacgaagcatttatttttgatctaggaataactgttgcagccaaagatggagttatgaaaaattgcatatatttttatgctgacccgccttatcgacctaggaggaggtttgtacgcaatgctgaaagcggtattagcgtataccatattaaaaccaagaaagtggtccaagtgtatcaaccagctcttactgcttcgtctccaatatctttctcttctgctcgatggttcttaaatagttgcttcaaacctaaatcaagttttgtctcttggtaaagtttggagtattttcttttgttttgtactggaacaagatttgttgcaacttttcttttttatatattcaagtgttttggactaaaggattgatgaattggagattagacgggtgattattgattgtctataacatttgggcgtaatctgttataatttacattaccgttctgtttttggtaaagagaagatccacatgtccatcaatttttactgtgacattgtaaaaaaagtaaaatctgttaatctgtttttaagctgaggtgcagataaatctcttaggatagagaattcatgaatcaagagttgcccattgcacaaattagcccaattgttaataaaaaggaagaaataaacaaaatcacaaaagtcatctaaactttgaagaatctttaccaacgagaatctcacaaaagttggaatcgtgcacgcctctcgagttatctccggctccgatactccatctggtggattctgtagaagaaaaaatttcaatctttgttggattttctgggaaaaactcagatgggtttgctctgaatcgattggaaaatcaaaccggtgtggactctgcaaagttggttgatatg

SEQ ID NO: 28125 - DNA, 3003 bp, Unknown
  misc_feature (1)..( 3003): 2750-1469P.txt file - cDNA_ID_2993973; gDNA_ID_1971973; Annot_ID_58670
attgctcataaatctctctctctacccaatctctttatttagtaccctattcttcttgactttgtttctttccaaagcttatacaagagatattcattcttaaactaagattttcatatatattgaaaaagaaagaaaagatttctcatcattttactttttggtagagagcatttcaagtaaaaaatactttgagaaacaaaaagagaaaactagtatgagaaacaaatccttaaaaaaggaaataacagtaatgcacgtgatgatataacaaaaggttttgttttgtttgtttttttattgtttttttcttcttttatttgtctgttataataatcaaaaaacaagaagaaaaaacgagacgttcatgcatttaatctcgcaccttacgacaaagagtgagagagaggatcgctcaggtttgttcatcttcaccggacgattagcttttgcggtgggagaaagaacggcctgtcttcagctctgaaacagaggaacagagaggttaggaaggagacaatggttggacccgcgcggcctcagatcgttttgtttggatcttccattgttcagatgagctttggccatggtggttggggcgccattctttccgaggtctacgctcgtaaggtatcgtcagattcatcaatctctctctctctgtggcttctggattcgatattcatccttggttagattactagagcgttgattctacaagtagatcgcttattctaattactctgtattatttattattttccctaactatacatttgttcattgaaattcgtcttttgttttacgattgtaagcgtgtattatgcgaaccataatgttatttctccatttggatgttatgtgtataggccgacatcattctgcgaggatattatggatggaactcttctcgtgctttggaagttgtcgaccaagtgttccccaaggtactctttcaactccctttttttttgcttcttctctctttagactattagtttcttcaatactagattatgataaagattcagcgttttataggtctttatattagtccgtataggttgatgtgtgcttatcatttgacctagtaagaattctttgtgaacattattttactagttcaaaatgtaccccaaaaggattacacaagtggctattttagttgcatagtctttgatttagcatacaagactctgcatctgtttcaagggagatgtctctgtttaagcataatctgtttcatccgagttttcttgatatctcaagctgttttctcttacccattataaaaaaaatttggtagaatgagcttaactttgtagaaaaccatcatattcaaagcttctgttttcttccactttgtcgcctaaaaattgcaacttgttacggatgcaggatgctgcagtacaaccttctctggtcattgtctattttggaggaaacgactcaatggcgcctcactcgtctggactaggacctcatgtaccacttactgaatatgttgataacatgaagaagatcgctcttcatcttcaggtttatacttcctttataattgttagatttattatttatctcctgtcagtcacgtttaaaagccatttcaagtgctaatttcttcctctattttctgtttcagagcctttcagacttcacccgaatcatatttcttagttctcctccagtggatgaggctaaagttcgccagaaccaaaggtaacttccctgaatttcttcactatctctctgtttctccttattctctccggccttattaatatagatgtgcttctttttctctcacaagcccatacttgagcgaggtaatccgcacaaacgacctctgcaagacttattcagatgcttgtgtagagctgtgccaagaactcggcctagaagtagttgatctcttctctacttttcagaaagcagatgactggaaaactgtttgcttcacgtaagtattttttgagttctgaagaaatatagagagacctttgatatatatgactttctcagagtttccaaatgcgataaccgggaatggagtatcgacgatgttcattgaaatgttttaacggtatagtctggtttgttacagagacgggattcatttgtcagcacaaggaagcaaaatagtagcgggagagatactaagagtggttaaagaagcggaatggcatccatcacttcactggaaatcaatgccaacagaattcgcagatgactctccttatgatcttgtatcagcagatggcaaacagacagtaaattcttcagaatggacttatttctgggaagaacaatgggactaaacatttcaacacacacaacaacaacaacaagaccctatcttcacataattcactgtcttaatgtgataaagctttgctttagattgtttacattacaagtgtctctgctataatctgattcagtttcgctcgaaaaacgttaccattttaaagtttatacttatctaaatcttaaatcacagaaacacaccaagtttgtgttcaagtaatttctttttttcttgtttacattttacagacattaacaaatgtctgaaactcatcacataacactcctccagacaggggtttagtgttttgaaggtaaaatcacaaagtaactaaatttgggccgataacaaaaaagtcgcttaggagattggacttatttgggcctaaaacctaacacttaagggcccaactaaaatgccatttacctaaaaagcgacgcatcttcgtctactaccaaaccttttcgctgacgcaaccaaactcccaaaaataaaaataaagtttttattttctctctctctcttatttttcttctccttcttgttccgtctgcttctctccatctccttccatatctattgttctctctctcttcatgcccgaacgcatcgggtctcaaaaaccattgatacagacatcgatccttgtcaactagtactgatctataaatcttataaaaatctgtagagatatg

SEQ ID NO: 28126 - DNA, 3003 bp, Unknown; identical to SEQ ID NO: 28125
  misc_feature (1)..( 3003): 2750-1469P.txt file - cDNA_ID_2993973; gDNA_ID_1971973; Annot_ID_177489

SEQ ID NO: 28127 - DNA, 3003 bp, Unknown
  misc_feature (1)..( 3003): 2750-1469P.txt file - cDNA_ID_2993976; gDNA_ID_1971973; Annot_ID_58692
gtaaattcaacccggttaatcctggttacgccgcatgcgttgaagaaattcgaaaggatctaatcgtcgccaccgtagctgcgtcactaatcggttgtgtaatcatgggattgatggcgaatcttcctctagctttagctccgggaatgggaactaacgcttatttcgcttacaccgtcgttggatttcacggatccggttcaatctcataccggaccgcactcgccgccgttttcatcgaaggactgatatttctcttcatctccgccataggtttcagagcaaaacttgcgaaactcgttcctaaaccggtcagaatcagttcctccgccggaatcggacttttcctcgctttcatcggtttacagaacaatcaaggaatcggtttagtcggttatagtccttcaacactagtcactctcgccgcttgtccagcctcatcacgaatatcgttagctcccgttataacgtcagctaacggaaccgttagtttactcgccggaggatcagtttccggcgatattatgtgtattcacggacgaatggagagtccaacgttctggttaggtatcgtcggattcgtgatcatagcttattgtttggtaaagaacgtgaaaggagcgatgatctacgggatcgtcttcgtaacggccgtttcgtggttccgtaacacagaggtaacggcgtttccgaacacatcggccggagatgcagctcatgattatttcaaaaagatcgttgatgtacacgtcattaaacataccgccggagctttaagcttctccgggataaacaaaggacatttctgggaagctctggtgacattcctctacgttgatattttggatacgacgggaacgctttactccatggctagattcgccggattcgtcgacgagaaaggagatttcgccggacagtatttcgcgtttatgtctgacgcgtctgcgattgtgatcggatcgttgcttggtacatctccggtgactgttttcatcgagtcgtcgacggggataagagaaggagggaggacgggtctaacggcgattacggtggctgtttatttcttgttagcgatgtttttcacaccgttgctagcttcgattcccgcatgggcggttggtccgccgttgatattagtcggagtgatgatgatgaaatcagtcacagagattgattgggaagatatgagagaggcgattccggcatttgtgacaatgattctgatgccgttgacttactccgtcgcgtatggattgatcggagggattgggagctatgtagtgttgcatctatgggattggggagaagaaggtttggtgaaattagggtttttgaaaaggaaagttaaagaagaggataataataatggagttgtcaaagctagtgagattgatactaccgtttaggtttttctttgatttgattttacatttttgttactattgattttttagatttctttcttaggatgaaaggacaagtgattgcattattgatttgttgctcttgtagattttttgaagagaaaagtgtaaaaatgttggggaaaaataaagaaaactgttgaaatttcgagctctattatgctttttgacattgacactagtagaggttaagcacttgaatttgactttcattgaataggaattgaaaggttcattacagaaacaaaaagggaagaccccaaaaggagtcaagagggacacttaccttctcttaagttaatctgaatcaagaaagtaacaaaagaaaaaagcctatggaaactttgtatttgatagaacaaaaatgacttctcggtgatcgccgttatgatttttacgatctagctctcggtttgctctctcaaccgcctgatggtactcctaacagtcacagcactagccgtgttcattgtgtatgcaccgcctgctttcactttcccgcaatctttgcacccccaaatgccaacaactttcctcttaacggagtactgcatcagaaatcaactaaagtcttttcacaaaatgcaaaacagagatttgcaaactgaaaacctcattgaattcaacgacaataagttacttaggagatggtaatgagagtacctttccgcagaactcacagaagtacttgttgtgttgactcacttccatcttcttgatctgcttcctaagactggcaccatatcgtgtacctttgcaaacacacaaacacaaacagattcagattgaggattcaatcattacaatagagacatttcagttctctgttcatgatctgaaactaattcttactagagaaacaaggtttaaggtttcaacctatgaatcaacagaagtctaaagttgcatactttaaactatagcccaggattgatttctgaatactcaccatattttccgacaattctagccttcttcgttctcttggtctgaaatccaaataaaacaaataagttgagaatacaaatcgaagagattcaatgcaggcacacgaaacagaagatgcactcaccattttcgccggctgagggagaaaagcagacaatgtgcaagtcccggcgaagaggaaggatctctctaggctttttactcgtttcgataagtacagggtattaggggaaattagggcatctccatccatgataaactcacaaagtttctaaaaaaaaaaaatattaatattatatttgattatttgattaaaaaagtaattttgttaaaaaattgaaccaatagtaagatgagaattgtcatgactcaagtgagaaactttctacactctctctccttcattttcattatttttatttttttaattgtgagaaactcttatgagatacctcaatagagatggttttagggttttattcaatgggctataataatctatcatttaaagcccattaaataaaaagcccaataacacaatgtcgttttcgtttgtgtgacggacgattattgtaaaacacagatatcaatgttgcatcaggtgaagaacgagagatagagaacgatg

SEQ ID NO: 28128 - DNA, 3003 bp, Unknown; identical to SEQ ID NO: 28127
  misc_feature (1)..( 3003): 2750-1469P.txt file - cDNA_ID_2993976; gDNA_ID_1971973; Annot_ID_177521

SEQ ID NO: 28129 - DNA, 3000 bp, Unknown; identical to SEQ ID NO: 9023
  misc_feature (1)..( 3000): 2750-1469P.txt file - cDNA_ID_2993980; gDNA_ID_1971973; Annot_ID_58694

SEQ ID NO: 28130 - DNA, 3000 bp, Unknown; identical to SEQ ID NO: 9023
  misc_feature (1)..( 3000): 2750-1469P.txt file - cDNA_ID_2993980; gDNA_ID_1971973; Annot_ID_177523

SEQ ID NO: 28131 - DNA, 3003 bp, Unknown
  misc_feature (1)..( 3003): 2750-1469P.txt file - cDNA_ID_2993983; gDNA_ID_1971953; Annot_ID_58668
ctcattcttcaaagcctcattttctgtttattaagagtcactatccattatatagttctttttcttcccgggaaaaatctagaaatttcggtttatagtttacgtaaatgggaccaagaattaaaatcttactaatcgcgatttattggattttatatacgaattcatacaacttttgtggttgcaagatgatttgcgattgaccaacttgcactctcctaaaatttctttgtaactagataaccaaacattttttacataaaccatctctctgacaattactattaaactaatctgtttaaaacaaacattttgatggttgacacttattttgttggaaggaagagacaggggaatgtactttactggagctgtgaaaaccggttcttgattagagtggctacgtgctgcgcaacccatgccgagccagccaccgtgcagcagaatccgtgcgtgtgaccttccctctcgatagataaggaagtatgcggagcttgctttgaaatctggacaatggagagattctatgagagaccttccttctatcgttaggataatgcattttgattaagcgagaagaagggaaaccaagtaacctcttcaaagagttgcagtggaccccaatgatcatcaatgccaaataaaaatgcaagcttgctctggttttctctcatgaaatcccaatctggctctgctgcaagcttatatgccaaaaatgaaacagtggatcgtcacctagaatgctttagttggagatcaactatagggcaagcttggtcatgttgtagagctttcaagtaaacactttgcatactttgaattcaaaatgagactctaaactctatacaacacattgttgaaagaagagtacctctctaaactctgactttgccatgaagagaacattgcgcatggtgtgatactgcaagcatcagatgaagttaagtcgtctgaatagttagtagggaataagaacttaaagtatcaagaaaagaagatgtaatggccatcttcaagtctttatacaactaggttcaagtgtaaaacccaagaaaatcagtgaatatgagataatcaatacctgcctcaagtgagtgcaggtagcttgaacagcagtatcagaccatgaagctccaatggatttagatacaagcagccgtgcagctgacataggtaaaagtctcagcgatgcaatcagaaaacttgctgtagccgacagaacagaagacctgcacaacatgataacgatttcacaacattctaaataaagactgattggttctttcctatcgaggattcgtattgagaacaaaagctcacgctgcaagtttgccaattaatgattgctttgttgattgttggttcaaagtcaaaaatggatataggccaatgcaatataccacctgcaaagcattccagagaataatataagaaaaatcacatagcactgaaagaaattgtgatggagaaagtactactcttagaggaagccatctataccttgtccgagaatttcttcaataactcaagggatatataagacccaatagaatgcccaacctaccaagatcaattaagcttagagttgtaaattttcatgaaaatctggaaatccatccaactaatggacatatatattttggtcataagaagcaatatgtcaatggcttatacacatgacagtcttaccaatattattggaactttcacactctccaactcctgtctgataaaatcaatctgtatgataactaacagattaagatcttaacttcacaggatgaacaatacaagaacctaaaggctttcaaatccaagagcaatgaagaaaaatgatttttattaccttatgatcaatttgttcttgaaatgaaaatagcctcccagactcccagtcctaaaagtgaaaataatcaagtatcatgaaagcctatcaaactaagatattatatgaagagaaccatcaaagtttacacacagtaaaacctgaaaccaaagttaacgtaccttgctcgtgtgagatatttgcccaatagctacacaaataaaacaaaccactccaccattagagatcagaagaacaaactcaaactcagaaataaacagcttccatcttaaggactcaaagaaatcaaactcgaaaagtagagcagccataccaattacagaagcatttccaccaagaaactcgtataaagattccaaaaagtccttgtaaaatgacacaactcctgaaaaattacaagccaatgtatgaagcacactagtatatacacgtgcatgcataagagtcttgagcataataatgaaacctggatttcccggaataaacaatacatggaatgtgggattctcagcttgaatttccatcatctccgtcatcgaactttgatcacaaatacaaaaaacaaaacaaaaagtgtaactatagtcaaagaaattagaaaatttcgtaaaagattaatgtaacaatacccagaaactctgcacaatctggatttaacatgtcttttagtttcattcatcaatttgttttgagtctccatgtctccggtcacgcgattcaacttatatcttctctcagaactgtcaacacttgaaaggagaagatcgagagaattaatgagacaacagagaaaccactaaaaatcaaaactttgcaaaataagtgaagaagccttttaaagtaaaccaagtgaagagagcacaacaatgcacctgaaacaacaggagtagattagatactttggagaactgaaccaccgatcggaggaagaaagtaacggagagacggagttacccaaggtagaagaagaagacgcatatttgcagcaatagtaatacgacctcgttttgagtaacgcgacgtcgttttatgagtttgggtgtcgtcaggcttatctccacctcatacttccactacaaagagaggtgattgacagatagataagagtgtttggtagctcagactcagagagtcacaaagtgtgtgtagcagcaatg

SEQ ID NO: 28132 - DNA, 3003 bp, Unknown; identical to SEQ ID NO: 28131
  misc_feature (1)..( 3003): 2750-1469P.txt file - cDNA_ID_2993983; gDNA_ID_1972008; Annot_ID_177804

SEQ ID NO: 28133 - DNA, 3003 bp, Unknown; identical to SEQ ID NO: 28131
  misc_feature (1)..( 3003): 2750-1469P.txt file - cDNA_ID_2993983; gDNA_ID_1971953; Annot_ID_177418

SEQ ID NO: 28134 - DNA, 2963 bp, Unknown
  misc_feature (1)..( 2963): 2750-1469P.txt file - cDNA_ID_2994000; gDNA_ID_1620629; Annot_ID_47199
gaattctttttccataagtgtgttcgttgagcttgaagattagtctataaatgacgagaatgaccttaggaagtgtgctagctgtaatatgccattaaggttttgggtttaggggacagattttggtggaaagatcaagatcaaagtgtgttttggggtccatcttttgatgataagtgggaaaaaagttgcaatctttctatggaaggtgaggaaggggtagtatcgtctctaacaagttcggtatctatcaaggaaaaatagaaaatgactcttagaaggacgattaaagcaaatgatcctttacaaaaattgatatgctttgagtcccacatacctaattagttggaaacatgatgtgacactcccccagacagctaattaatcatccctgatgttagaagttagcagcaattattggtgtgatagagatgatgatatggaacatcagtgtttgtttaaaatttggattctataggtgagctgtgaggacttgattgattgttcctttagcccccctagggtatactgattacttgtgattgtagtagataccatttattataatagctttagattagcacgtcattctcttgctgcttttttcactgtgtattttggaatcttggtattttctcgttgaaatattggatcatcttaacaatagttagctgtctagaaagaatttttggtatgtgaaagcagatctacctaatatgaatccgagcttatcagaaagtctttgacctgcagattcaaggtaccgcgctggtgctggatgaaatcattaaccatgtccagtcattacaacgtcaagtggaggtgagactttccgtggtccaatttttgttctttatacctatattttacaatagccctgggcacaataaaagggtcaactcaaaacaatttgaaaatgaatagaattatgtgccgcaatctcatgaaactgtgacttgtgtttccacagatgctatcaatgagacttgctgcggtaaaccccagaatcgacttcaatctcgacaccatattggcttcagaagtaagtatcaaaatctcaaacaataatttggtcattctgattagtcttctctaggaaaaatttaaccatttcatgtgtttctcatttaagttaaccatacctctttgagtagcttctagtttctatcacaaaaggagaaacttttggggtatttattgatacaaacattaatttagaccattttagtgtaaggcataggaagatcacaacgtctactctcatgaaggaaactcagggaaaaataaatacacaacacacacacacacccaatgcaaataacagtagtgggtcaaaactcggaccacctttgttctgtaaaacctttctgtgtcttctgtgacttatgtcggatgtgttacttgatgaaccttttaaaaaaaaagttaattcatccctcaataatttctgtgggtctcttccaaaatcttgttatttcaaagtgacctatctaatttcatgatcacctgtggattctcatcaaaagttttggaccaaactaaataaatgctccctctctctttcttcttacagcttgtaccaccattaaatagccagggaccctctcatcaaaccttgttcttttaggataataataacacagcaacaacagttgacttctttgactagatcaagatctctatgaatgatccctttgctgatatcttttccggttttggctctgtgtttttttctttgacagaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatatatcttactaataataaatagagataaaaaaattctatttagggaaataaatcagtatcgataaacaaaaacagaaagaagaagcaggggcatcctttggatattggagttgcacgaaaaagaagaagcaaaaacaaaatgcaactatatgtttagattgtttgagctggaccaagtgaaaatgcacctcttgaattatggtttaggttaggtaacaaaaaaccctaaattgactcattcgataagaacagagatgcaatcataaatatgagtgcaaagcacgttaccggaagctgtgatggccttgtttgcgtctaccgtatagaaagattgatgtgtatcatcaatcccgccactagatggtatcgatctcttcctcagcctaagattcaacaaattaaccgccttagacgaaatctacacgagagaaagtttcactttttaattcttttgcttaatcaatttgcttaatcaatttgctcatatatgtttacttaaatttttgatgtttttgtagtattatttcactattattgtgcctaattaattgtttttgtttttacaaactctctcatagcttattattctgcatcaaactatccaggattcggtaaagacactacgatcctcatagaagagatctggaattctagtttcagttgtttatcaattccaataaagtctacacacatagacataggataagattattattaagacctttaaaaaaaaatg

SEQ ID NO: 28135 - DNA, 3003 bp, Unknown
  misc_feature (1)..( 3003): 2750-1469P.txt file - cDNA_ID_2994131; gDNA_ID_1620530; Annot_ID_159693
agtgagatggctattaccagttccatcttgtgagacctgatactcctcatgtctttcgactgtttcatcatcttctacaagcatatcatcattatcatcccctgatatctctccttcttctacatcatcacctccaactatccgagacacagaatctaccaaaaccggactattatcaacaggtttctctaattccatctctctttgaactgttccattacaagcttccaaaactccagaacttataacctcattagattcaacagatttaggaacctcctctgcctttttctcactttcaactggatctacttgaacttgagttgcaatattaggcttctccaggacattttggacaatgtcatagtcattcacatccaatgcctcaaagagattcacacaactttctggaacagaatcttgagtttcattaatcataagctcaaagctatcgaaaaaatctgtgtgtctactaacaacagatgcatcttgcaagtcaattccatcacaaatatctccaagcatcaaactcttttcctgtgaaattgtttccaccttctcaccacttgaatcaccagacactccattgagttttgattccgtaattgataaattctccggcggttcgcaagtttctcccggagactcttgagcaatttctatgtaagaaaacacaaatagcatcagaaatagtttcaggcaatttcaagcaacagatgaactttgaattttgattactagaagatgaattaatcattcctaagaactttgacttcgaatcgaacactgacctgttcgtaagaccagctcctggagaactgccggtgtggcaagagaaatttgaggctcccgatcgaaactcgagcaaaagtgataaagcaaagagcgataatttcgattcggcagatgcgtgcgtcggtgaggaaacggagcgacggaagattccattgtctccgccggagaataatctcaaccagtaccgataggctcaacttcggcttgtctttcgccggagaaaggccgtcttgtggcggtggacgatttaaaaatctttattgggcttgtatcatctttgatgttaatgggcttcctgattttgtaggcccaatgaatccttcaacaaacggcgtcgtaataaggatccaaaccctaaaagatttatggattcagagttttcgaaattggaatttctcactctctctatctctcttagccagctctgatcatttcgatttttttccggtgaaaagggaggagaaacatggttgtacgtatcagactgtcgagatttggatgcaaaaatcggccattttttagggttatggctgctgatagcagatctccaagagacgggaagcatcttgaggtcttaggttacttcaatcctttgccaggtgattgacaaaacaaaatgtattccaattggtgttgttcgtagagttttcgattaaaatacacgatctcttggtctatgtgttcaggccaggacggtggtaagaggatgggtctcaagttcgatcgaattaagtatgtttcttctcatctaattctctagtttcttatgtttttttcggtaaaatcaggtaggttttgggttgaatttactcagaaagaggtctctgaatgcttcactagatgattaaggcttttctgcatttgaagtgttttggttaattgctaaagttagcttctagccgcctctagatatcttaatgcattgttgtatagtcaacattgtgttatagttaactatctttcgatctgatacaaaggagctgagttcagtctttgaatggtttttgttatcgaaaggcgaatgaatctacatgtttcccatggttggttttgatcactttctttctcttcatggtattgaaccattagttgaagcaattttctacctcatttaatcactaacttatgaaaggaaaaactgaaatatttgtggaaattcatcaacaagttttgttatataacaaatgaaacttctccgccagtcttgagtctttctatggaacttctgctctgagttctggaattgtttcttattagtgtaagatgaagaacctgttgattatctattcgtatacacacttacttacattcttaattgttcaccatatacaacctcttttgcataattgtatggtcatgtagctttagaatcttgtcatgctctttatcatcatctaaaattaagattataatgtccggatattagaagaacacatgtcaagactacttaaaagttagatcctggtctgtctttcttttgttctgaatgactagtttcaacagaggatgcatatagtttgattaatggacattttgtttgattctcttgttctgtacaggtactggttatctgttggtgctcagccatcagacccggttcaacgtctcctattcagatccggtttacttcctcctcctccaatggtggctatgggacgtaaaggtggagcacgagacacacgcccagttgatccgatgactggtcgctatgtggatgcagagaataaaacagttaatgccaatgataaccagcctaaggaagaggatacagaagccaagagtgcatgattcattagccttctgtcatcgtagcttttcaagttcactttgttgtcgattatattgtgtaatgcagcattagacaactgacttgtttcctttgtttggcgataaacggcaaggtgtttggcactttttgcagaaacggcacatattttgcattgggatattttagattttaaaaaatgaaaaagtaaataaaaatgccagcgagggaattaaaaaaaaaagaatggcagttgttaggtttaaattttataaaggaggaagccacgttttgcgtttagtcgccacccagaaaaaaccctcaagtcttcttcttcttcctcaatctctccacctcttttcaaaccttcttcacactctctctcaatcaatcctttttcttctcaaatctttcagttttgatctctaaatttccagaaaatg

SEQ ID NO: 28136 - DNA, 3003 bp, Unknown
  misc_feature (1)..( 3003): 2750-1469P.txt file - cDNA_ID_2994134; gDNA_ID_2214454; Annot_ID_182624
aagcttttcagcattgtgtatgaaagtgtttttttggttgatgtttgagtttaggatcacatttttgcatagtgaaatcaaaaggatcatttcagtgattgatttacgtgttcaagtctttgttgtaatcttttatgttgtgattgttgtgcagaaatgtcacgtgaagaagaaggatatcaggaagtttcttgatggtatctatgttagcgagaaaagcaagatcgtagaggaagaatgaatgcccatatcatcgtcttagctcctatttcttgtcttttgaatgttagtttcgttttatggaccaaatccaccggtgttgcaaaactctggctatcccttgttccctttttgtgttcgagattttatttacttatgcacaagttttggagacgagctatcattttcacctttgcttaattaaatcatatcgtgtgaatttgggattgttctggatttggcattgtgggttgtgcattcaaaattgatacttcagtcactaaactaaaatcaatttctcgcaacgctgtgatcaaacataaagataacttgagacaacgaaagcgagctttgcaatttgagaaaagctacgagacgccctgatggtcaggtgatcaatattagtgcagaatgattctgctttccagaagtcctctttcaaccatcgtttatcatattggaagcaccgaggattcatgagacaacttataatttaatcatgaaatgtgatttcgacatcagaaaggactagtatgttaacattgtgctcagtggcggatcaaccatgtttccaggaattgctgatcggataaccaaagagatcacggggttggcacctagcagcaggtggttgcaccacctgagaagaatattggaggatccatcttggcttctcttagcacattccaacaggtaccgtaaactctttaaccgtgtgatgatgattcaagttattcacacaaagtactgatgtttggtgtggatatcaaaggcagattacgagggatcagggccagccatttttcacagaaaatgcttttagacaacctctttatgtagcttgttgattgatgaaattggcttaagattaatatttttagtctttagtcgtggcttgttttaagttttgttcctttatgtttcttcatatgtttgagaaaagcggagatgggtgtgtaactttatccaaatgttcgtcaagttcaagaacagtataattttgaagatttgatataatggttgaaaaggagacttgaagaacaaggtcaaatgtgttttggtaatggttatgttttatatgttttgatcctcagtatcctctctgatcgacacttcaaacattttgtacttattttatctctttgtttattttttatggatcgtcagctaatagagaaccaaagtttgaaaccaaaggtattagagaacaaaccaaaagccaaaaagagagcaaactagagataaatactaaatgtgtcgttattcttcaaaacaaagatggtttcacaagtcttgcagccatacctcattaaggctgacggtatccgaattgtgatggacatgctcgtattcaactaagatttgtgaaaaagtcagattacacaacagttttctaaaaagtgttggactccaccatagtataaccactgtgcaaatcaccatctaccgtcaacaatttcaatgtcttattcactctgaaacgagtagagtttatatagagtgagtgagagagaggtcaatgtagtgtcacttgaaaactgcaatttttactctcgtttttttaccggttttacttgtcttttttactttttatatattatcttctatttattacccattttgatgttgccttattcatggtcaaataatgcacaaccacgagtaataccatcacagtctctttggttttgttacgaattactagtagtatctaatccgtatgtcaatgggttagaagtgataaattccattatgtatatatagtaaatactaaatacaacaatatcactttaaaaaatccaaaactatatatttaaaacggaattctcttgaggaaaaaaataaatggaattctcttttagtgtttgatatatacaaattaataggattggtaataatcccccttgatatgaatacaacagaaaagactaacaatcagtttatcaaactattgtacatttcctctaccaaccaccaaacaagaaggaatcgattcaaaagcagagtaactcatgtcacttagccactaaggtcaccgacgtttcccctcgaaggaatggtaaacaatgcttatcaaacacccacaaaccatctctctagatattcacgtatgtttagataaaagtatctcttgatacatgaatatgtatgtcacgtgtgaagaattcttatgctcagtcgacaaatctagcattggtccggtgggacatgaaaaccctgacattatgctcgacttgtctagaatactatgccccatttattatccttttacatagtactgtatcaattacaaaaatggggataggacaagatcctaattatcaattcctcgagtccaaagttatgggtaccacgtgaattattttacgaattttctttattatcttgacttctttacctgattttttatattttcaactacatggagacatggcaaaacgaaaaatgaggctattcaatctccaactttatctcaaaattttatttttccctctctttaagaccacttctaataataagtgtggttcttggctttttggtaaagaatagacaccaattgtccttttttattacaataaattcggacaaatttgatttcttgtgatggtggatccctttttctcgtgcttcgagctccaataaacttttcttacatttttaatccatttttacgttgatatttttttataaaatttccaccaccttacaaaagattttagctttttgtgttactaattaaaatcagaacaaaagttgcaagtctttcatctctatgcacaaatg

SEQ ID NO: 28137 - DNA, 3000 bp, Unknown
  misc_feature (1)..( 3000): 2750-1469P.txt file - cDNA_ID_2994151; gDNA_ID_2936581; Annot_ID_194904
aagtaagaatgatggcagtgaaaaaaaagctccggcaataaacataaacggaaaaaggagaaacgtgcgttgacgttaacggaatgttggatgccgtctaactagagttcataccatttggccgatagagcgagatggaaaatgacacaccggtcaaccagtttctgcatagctatgcccctggtttcacccattaattacgtaaaatgccattacatagttttttttttcggctctttagaagaatgaaaaacacacaattaaacgaaactcgtggaacattaacatgttaggaaatcaatcaacataattaattttctcggtcgtaaagaaatagtattcaagactcaagattatgctcttcttaaatattgcaatttggattaataaaaaaattttgctatgtaaaactaaaacctaattgtaatttaaaattttatttgaatccgtcctaataactaacaaagtcgtggatgcacgaaaacatatccaaaacttcaaaataaacccaacgaatatttcaaagcttagacattgtaatttgcatgattaaaataaagagcaacgaatatgcgtataataagtcaatttcataatcaattaacaaaaaaataaacgcgtacctattcttttgttggagaaaatacaatggcagtttcgttaatatatccatacacaagcccattataacaaaaacctcaggttataagaagctacacaccaacgcttaacctgttgtcttcagctgtgtacagaatcaagtttccaagagagaaagagagtaaaagcaaattaacaaaggaagactctgattcaccgagaaggttttggcttaaagatgacgaacactcgcgcgatctacgccgtcatcgcgatcctggcgatagtaatctcagccgtggaatcaaccggagacttcggagattcgctagatttcgtgagagccggatcttcatcgctcttctctggatgcacaggatcgatcgcagagtgtatagcggaagaagaagagatggagttcgattcagacataagccggcgtatattagcacagaagaagtacattagctacggtgctatgaggaggaacagtgtgccttgttcacggcgtggtgcgtcgtactacaactgccagcgtggagctcaggcgaatccttacagccgtggatgcagcaccatcactaggtgcaggcgttgaagaagatgagtcacttgaatttcctattttgcccctttctttttgtgtctctgtctctcttctcgattttcatttttttaattatttttattttccgggatatatgggtttgattttacacattgaaaaaaaaacttctactatagtctttgatttgaaaggaaaaaaaacgaaattgcttctttgtttttttttctggttgttgtctatatacataaataaaaaattcaaagttgcgtagattaaaaatagttattagtccgagaagtgattttgagatctgtgcgtagttttgtgtttactaacaattgttaatgaaaagtgattaccgttaatttaattatatgaatctgaggtgtttgagtaataaatatttggagcgtattaattaattatagtagacagaaagataaataaaagcagaattgaattgatccttcctttattagctgttggtggcatgttggcttataaggtaatgatgggaccatcacaacctaattcgtaacatttttcttcttatactaatttatcagcctcgaaacttcgttttggctgtaattgttttttttatataattaatgatgcgtcgttggatatgtttttagacattattatggctctcaatagacgaatctgtaaccttacaagtaataacgaatgtagtaccataatgaaaatgtggaaaacaagaagaacaagtcggagtataaaatattctgtagagtttattacccataaaacaaaagttttcatgaattcatgtaaaatatactctagagtttagatagttctcttttagcatgtgtaaagattcagaactagataaatgtggataataatctgaaatgccgaatataaacagaatcatagccgcaaatgatttatttttatataaccaatgggtttgtaattaatattactcgaatctgtaatattttccctccaccaagtttgaaattggactaacaatggaatcaatagcacaatcaggtataagaagttttagtcatttgatcgagattaatgttggagtgtagctttgtttgggtcatgttttgggctcttctccatttcatactttgccgatgtgatgaaccacgcactaacatgggtatagttcgttcgatgtttctattgggcctttactcgtaatattgggccataatgatcacgtgacttagttttgttttgtttttgtttgtgttcatgtaattttaagtagtgggcttcaacttgttttgagcccatagcacatgatttccctttattgtttattggtctactttttttttttttttttttttgtgtgaacattggtctacttttaaaatcattaaactatgtaaattagaatctaaaataaattcctccattgactcccaagtcttcatcattagaacaagaatattcttgtatttattataatacttattataaacaatttccttttctggtgagaaaaaacaaaatcaaaataaaaaatttccttttcttagcgacacacatttacttaacccacaagtcgtcaacggcccaaagaatatggatggttacgagagagcgcatacaaagacgcgctcctaaccgacccaattagagaaaacacacgcttgcttacacgcgtaataaggttcttacacgtgccaaaaacccttgttatataaagaaacctaggtcacgtcaatttctcatcaccattgctttgttttgttcgtcaaatataatcaattttaaatttcttctcttctcttcaaacgaatcgcctttttcgataatctctttgcatcgatttcatcatg

SEQ ID NO: 28138 - DNA, 3000 bp, Unknown; identical to SEQ ID NO: 28137
  misc_feature (1)..( 3000): 2750-1469P.txt file - cDNA_ID_2994151; gDNA_ID_2936581; Annot_ID_143752

SEQ ID NO: 28139 - DNA, 3000 bp, Unknown; identical to SEQ ID NO: 9705
  misc_feature (1)..( 3000): 2750-1469P.txt file - cDNA_ID_2994155; gDNA_ID_1972173; Annot_ID_179928

SEQ ID NO: 28140 - DNA, 3000 bp, Unknown; identical to SEQ ID NO: 839
  misc_feature (1)..( 3000): 2750-1469P.txt file - cDNA_ID_2994165; gDNA_ID_1620327; Annot_ID_153530

SEQ ID NO: 28141 - DNA, 3003 bp, Unknown
  misc_feature (1)..( 3003): 2750-1469P.txt file - cDNA_ID_2994195; gDNA_ID_2926285; Annot_ID_143644
ctaaaaagaggttgtagcccaagttcacctttttttaacttgggccaccaaatttatttgggcttaaaagaacgtaaattattttcataataatgtcctttactcagtagtaatttcaaatcatttctctcttctcatgtctcatgaaacaacatcatctacatgatctctgctctgcattagtaaatcaccacgaagcttagtgttaataagtagctcaccaaaacaaaaagatgcatcgcctgcaacatgaacagaagatgcatatgcagaattggaaaggatcagagactttaaaatttctgatttttctttagggctaatatacgtataataagaccatacgagatgcaaaatgttaataggtaagtcgaaaatgtaaaatacatagaaagacgaatataggacctcttaaatcttacaaaacatttgaaaccaatcagtcaaaaaaccaaccatgtcgttttggcaatcttctttgtacaccgtctttgctctcacagcccttaaaaaaagcgtctttcttctcttcagacaagggtgaaggcagattgtactgttgattggaaccgtgatgcgattgtctgcgaagcaaactgctgaaattgtttctttgcatctgccaacaagaattggtgaatgccgattagagtcacctctatatatgtacatgcgtatgttctttgtacaaaaagctaacaacctattgatctacagctggtttgattttacacaaaatcaggtcagttgtgaaagactaatgaggatcttacctttcttgcactttgtgaagccgatgatattagccacattgagggacaagcaaacgccaacaacaagcagatagtcagcttgaaatctaatcagagaaaataccccaaggataaaccatgcagctgcctgaagagtgaaaaaaggagaagatttagctgtgaagacaacagaaaaagacagcaaacaaatccacatgtttttaatgtttactacgctccagtaccatagacatcaaatccatagctaccatctcatggctacatctcactctttatagtcgcttgtaaggtaactgagcatataagtttgtaagctaccaagttttaactaatattatacttagtcagtgtaagatcataggatatactccaaatggccgacttggttccagcagataatctttccctactcaacatatattgtaatgtgacttcgcatgtgatttgactccaatgtcaaatgctatatcccactcatgcagagggaaaaaccatttgtcgcaaacttctttaactggtagcttcttgggggaagatattcaggtgtctagcgatctatatatgggtctacatgggattctaaaagactgctctcaattcttatctaccacctttgcacaatatgcttcaatataagggacatgtttattcttgcctattcttattccactataagggacatgtttatccttgcctattcttattcctagtcatccactaaagttccacaatgattgtgaatgggttttaagtaattagcttatgctgcaactgaagtgttagatatgaaatacttactgcaaggtaaagtgtccaccagaaaagccatgagtctttcttgttcatccgagccaaagactgtatagaaaaatgatgaaaacacatgagtatacaaaaaaaaaacggaaagggaaacacaaccccacatttctcgacaggctgaacccatatccttgtgaataagtgaagaaaagctaacctcctgatcaagagactcgaatttccagacactttctcccaagtcattgatctcgttccaccacctgagaccaaccagtatacgcccactgacattcttaaccacccagaagtcaagagcagcaagaagaacagtgactacaaagatgatgacaaagctgttgaagaagagagcagagagaatgtaaaacgccaacgcagcaccctggtccaagaacaaatacaaactggtttaacatttgtccaatgtctaacatttcctttgactaaactgatttatactctaaatcataccttgaagagaacatggaaaagacatgtccttgggtttgcataattttcaactggtgcctgtatctaagaaagcataaagttttggtaagattagctgtagcaattttacattgtaataaccattacgatgctacccaaaagagtacataaagattattatccgccaacacatcctctaacctagcaatgtttatttagctcaaatgcataatttctacggattatcggagaccaaaacgtcgaaacacagatctgacacaataacatctagatcgaacaactagatacaggttaatcaagaatctgatatgcaatcgaactcagaaattaagtcagaacaaaatgagaggaagcagctgaaaattcacctgattattagggtccatctttcgaagaatccaaaaggatcaatccgagaaaaagaagaagtaatctgctgatcagcagaaacgaaacaccttctccgttgtggaaagtatcgatcttccctctgaattttcccgagaaaaaatttctgtatcagatcttcaaaactcttgcgcgtgtctgctacgtgatttcttctatttttgataatttctttcaaatgtgttttttaattctcaacgagcccgataactcttctctggcccaataatatttaaagaagttaggcccaattattcaaaaaaaatggtaattacgatttcaccacaaaaacttgtgtttcgatcaaaattatccactatccacaacaaggcaaaagaagagttaagaaagaagaggacgacaatggctgtaaatatgtgaccatgaaatggcgagaggctgagataattgtcttatcccttcaaaatttaagacttttaatgatcggaaggaacaagatgacgaggtcccacgaaccaccatacacacttcaatttcaaataagagcttttcttcagttgttgctcagagacttaaccaatcaaccatg

SEQ ID NO: 28142 - DNA, 3003 bp, Unknown; identical to SEQ ID NO: 28141
  misc_feature (1)..( 3003): 2750-1469P.txt file - cDNA_ID_2994195; gDNA_ID_2926285; Annot_ID_205425

SEQ ID NO: 28143 - DNA, 464 bp, Unknown; identical to SEQ ID NO: 600
  misc_feature (1)..( 464): 2750-1469P.txt file - cDNA_ID_2994202; gDNA_ID_1592239; Annot_ID_152150

SEQ ID NO: 28144 - DNA, 3000 bp, Unknown; identical to SEQ ID NO: 8927
  misc_feature (1)..( 3000): 2750-1469P.txt file - cDNA_ID_2994209; gDNA_ID_2926219; Annot_ID_142373

SEQ ID NO: 28145 - DNA, 3000 bp, Unknown; identical to SEQ ID NO: 14791
  misc_feature (1)..( 3000): 2750-1469P.txt file - cDNA_ID_2994211; gDNA_ID_2684225; Annot_ID_191944

SEQ ID NO: 28146 - DNA, 36 bp, Unknown; identical to SEQ ID NO: 236
  misc_feature (1)..( 36): 2750-1469P.txt file - cDNA_ID_2994211; gDNA_ID_76056; Annot_ID_147017

SEQ ID NO: 28147 - DNA, 3003 bp, Unknown
  misc_feature (1)..( 3003): 2750-1469P.txt file - cDNA_ID_2994234; gDNA_ID_2214454; Annot_ID_182622
tacaaatctactatctacgttacaactaaaaaacgtatctatgagtacattaagcctatcagtttcaatccaatcatattttactactgaaatatgttctatgaacacctacaaaatgtatatatgaacacattaagccaattatattcttattttgtttatgtccaactatatgtctcttcatttacacttttgcatagtttcttcaaccactaaatgttttgactcaacaaatattttgaacaaaaaaatatatcatatagcaataattgatgatgtatttacaagaaaactaaattaagtaaaaaaactacttgattagaatgcgtttatgaccaaccaataaactaaaggttgagaaattaaaagaaattaatttgacgtaactaaaaaaataatataaatgagtcttagataattcaaagatagaaatataaatgaaagtaacaatctaaaatacgaccactaaattaaaagtaaatagacaaagaaaaatcatatatcgatcttaccatatacaaattacaaatttgtttcaaatcaacacatatttctaattaaaaaaaaacaaattgaaatatataatgtaaaattttacattaaatcatgacacatgtagtagtctaatttttttagtacaatgatatatgataattaagttttatataattcaaatacaaaaaatcaatacaaataatcttgaaaacaaaaattaaattataaattttaggaagacgatgatttataaatctttaataattcaatgcatgccacgataatgtgataactttgtagctgtgtataagcacacctagagatggagataacacctagagatggagatagagagagagaaagcttcaggaggagatgaagaagatgagaggaggtgcagatttggggatgtttttttctttttttttcggtccaatttttttttttctggatggattgatcaactttacaaaatctctggcaaatatttggtagatttttattttattttcattgctttaacttatgaataaatctatattttgaaaaataaaaagcttgtgtacttctcgaatgtttatggtcttaatattgctgcttgcttcgttttggtcgcatgattttaaatttactaggttataaatccacgcgtaatttttttatcaaaattgattcttaactctattgatttttataatttttaatatggtatatttaaaataaaatgtttactttattagaaattttaatactataatcaataatatatacttttcaccaaattatattacgcgtgggttcaaaaccaagtgttaattactttgaaaagcaaattttatataataaaattttaaagtatgatatactcataacttgatttttttttttttgccggctactcataacttgatttggtgctatttatgacaatttctctaatttattcgacttttgttattttgttctttaaagcaatgataaattattatttggtctggcccggaacggactgctttcaaatggaccgggccgccagcccacatactaactcatttagatataagtttcttctaacctctctttctctaaaaagctgtcggcgagtgggagaagcgcagagagagcaaacaaagagcaaacttgaattatttctccgttggctttgtttgaaaatatataaaaaaaacaattaacgggccatgagcttgttgcaaataatctatttatttttcattttaggatttttgtttctcgacacgagttgagctgattttgataagcccacatgacattgttttagagtttctgtttttcttctttatactttttaaaatgcggccagtgaataattttctaaggtttatgctttaatacaagttaaataatttttttgtaaataattttttgttggaatgtcaaatttattcaacaaaagaaaatgattacaaagagttttgaaaggtaaaaaatggagaaaataaacgtgaaaagtagaaacaaaaatgatgaaattggcgccacttacatcattatagaaagttcaaaaggcctaattctgacacaatattattaacgggtcatgggcttaatgacaataataaacttttctcacttttgagttttaataagcccacatttgctttagggtttctgcgtctctatctttaaattgcttccgacgattcataaactagggtttctgcctttagccgtcgtgagagagagagcaaatcgaagagagagcaaagagaaaataatatgttgtttgcgtttggtacggtgactcgatctgtggctaattcagtggtggtttgctacggctttctttcgacaatggtgttttctttcgacctaaacttgatagaccgaaccaaactgaaccaatttttatatatatttactcaattaaatcctaaactcctctatttgatctgaacccgatcaacccgaatacataaatatctaatcttatccatctgaaaggatactaaactctctaattcgaattacccgaatccagaaaaagccgaatagcatgcattctattggtacttgattatattaattggcatatatatgacctgttattgccaataatatattttgggtgtttcctgggcttcagttttattgggctaggaatgggtgtacttttaaacccacttctgattagtctcttagtaaaacccacttttaaacccacttctgacccacttctgacgccgtcatttttcttgagaaggagagagagcaccacttccgtcattccagcccaatatttttaacgggccatgggcttattgtaaataatgtatttttctcatttttggttttctttatgggcacgattttagtgggctgaattttgataaaggcccacatatgaaagatatttagggttttttctcttgataccttttaaaacgccgtcgagaaatctccctctagggtttctttgatcaaaccagagagccgtcagggagagcaaaacaaagatcggagaagatg

SEQ ID NO: 28148 - DNA, 3000 bp, Unknown; identical to SEQ ID NO: 11224
  misc_feature (1)..( 3000): 2750-1469P.txt file - cDNA_ID_2994242; gDNA_ID_2214484; Annot_ID_133328

SEQ ID NO: 28149 - DNA, 3000 bp, Unknown; identical to SEQ ID NO: 11224
  misc_feature (1)..( 3000): 2750-1469P.txt file - cDNA_ID_2994242; gDNA_ID_2214484; Annot_ID_183454

SEQ ID NO: 28150 - DNA, 3003 bp, Unknown
  misc_feature (1)..( 3003): 2750-1469P.txt file - cDNA_ID_2994248; gDNA_ID_2214605; Annot_ID_135645
aaacaaggaatgaaaaaataccttctcatcctccaccaaagtcttaagaataacatcaatctcacatgtgaatatctcgcaagagatgaatggaaacctacgagaagaagaatccatcactagccagaaataaagcattgccagaaacattcaacaaataaaagcatggaaaactgaaaatccagtcattataaaagaagcaaacattacttgaaagcacgtttgctatcagcatcgtcctcaggctcttcaacaacataccgcaatagtttctccacttgagttttttcccttagactgcaaataccaatacaccatcagaaacttttccaagaaatgttttatacagtatgtctggatatgtgaaacaaagtagtacaaggcaaatccctcacaaattaatgagtcggctattcaaagctttgcattcttgaataatctcttcctcgtcaagaagctcttccaatgtgaaactgtctttgtctagtatcgactccacctatatccataacaaatggaaagaacatcaactcaggaataaattccaaattgacctgaattgcaatatcatcacaacaatgaatcaacaaccaatctccgtgtaaagctagaggtaaatcaatttcactaggaaaatgaatgaaaaatgcaaacgaagaaccattccaacttcctaaaaccagatcaccaaggaagacgctgagcagctataagaaaggagaagaaatgaatctatcgttgaaactcacaggagacgatgcagagagagaggctagcttccagaacatggtggtggcgatgaaggagacaaggagactgagagcttttgcccgtagtcgaagaagtagaagaaccttagcagcggagcagtggcgagttttggggttcgagctgtgaaatcgatcaaatcagtcaatggtgatggagatccaaagagagagagaatgagatcggagttctcagatatttttgaaaaatcgaggcagaaattgcaaattttgcataaataaggacaaaagtttttaaatacctctaatttttgtatactatgtagtttccaagcaaacactagaaataaaattagaattctacagttaattttttttaattaatattataaataatactctagtctgattaatactaatatttttccttattttgttttgaataaaatgtaaaatttattccaaaaaaaactttgttacaaaaagtgcatcatctaataatcaaagagagcaatgtataaattttactaaaatcattaacaatattgataaaagcatttaaaatattaaaaaacatagttacatattacatatttatatatctcttttgtttttcttttccgtcgtaaatttattattctgtcttttgatcatgtgttaaaagataactcttgtaacaatagcttagcttatacttttatttttgaatgaaatcttcacattaaaaccaaaatgcatatccatttgcttgtaaaatcctgcaattattagcggaactctgctaataattgagttaattgttgcgaatgaaaacattgtggttgatcgcattgtccaaatgatcagattcacagggattcattactagttgggcttaggtttggttgattttgcagtataccatttttctttttaaatcatttttttaatcagacttgtttctgtttttctagctttactacttggtgttaccaagactgtcgatagaaaaatattctgtcaaattaatgcttgtatgagaacatgccgccatggtctacttgtcttaatcgtcgctgatcgaagaacataccttacttagaagccttaaatgcttgaagaattcatacttttaatatatgatcctagaaggccgacacccgagttatgcgaactaaaaacttacaaattttttttttaccaaccagaaatttgccaaaaagaatgtaaagccgcgaaatattggccagtttagaaccataataagaaattagtaaataaaacataaaaagtactatattaaccttgaaaatttgttacacagtattaatttaaatttgattatacttaaatagacatcttatattattaatttaaatttgattataattaaaaaatctatagcagatatgactgatttgacaaaaaaataaaatgcaatattgtcgtttggttggtacagaaattttttcatcacaaattatatcacattttggagtttaacaaaaaaaagcatgctaaattgctacaatataaatcatagttagtgataaactgataatatttgaaataaaattagtacccatattaatgtaaaaagggaaaaaataaaaaatatatgtggtattgtttcttaaaaaaagatatattttaaagtataatttaggaaaccaaaaaaaatgtgaacaaaagaaaatatagattggtggttatatttccccttaagaagtttaattgacctctaaatttggtttaatggttaatctcttttcgtcaagctatattcttccttttgatcaaaacacccacacctcttcttcttcttcgcataaaccttaaaaaccatttccacgatcttcttcttcttcttccctcaaatatagcttaggattttcttaatttcctctacccaagctccatggctgctttcaatttcttcctctcttcttaattctctcaggtaaacaccaatcccttactcgatctacgtgctcaattgattggatctcgttttctctttacttctccggagccaaatctagttcaatttcgtaaccttggatttagtttagctatcgcggagatttgattctatgtttgatttagtcctccttgaactttgtactgagttatcattagattgtataaattgtggtttaatttggtgaatacaggtaggggagatttgagtagtagtagattgttagatttgtaattcagctattggtgaagaggaagggagagagagatgtgttgaattggttgagtttggtggaggaaagaagaagaagaaatg

SEQ ID NO: 28151 - DNA, 3003 bp, Unknown; identical to SEQ ID NO: 28150
  misc_feature (1)..( 3003): 2750-1469P.txt file - cDNA_ID_2994248; gDNA_ID_2214605; Annot_ID_187203

SEQ ID NO: 28152 - DNA, 3000 bp, Unknown
  misc_feature (1)..( 3000): 2750-1469P.txt file - cDNA_ID_2994252; gDNA_ID_2214609; Annot_ID_135717
atcaacatgtctatatacatgtggataaatggtcaaggaaacatggataatgtactttggattggcgtttattgttcatgtataacttatgtattagtatgaaactaccatgtgagtcattagataaccatatggactggattgcttggacaatcattaatggacaagtatgtctttgatttgctgcaaatgtgtttatagctcgataaaattgtatcaacatgtctatacacatgtggataaatggtcaaagagacatggataatgtactttggattggcgtttattgtttatgtataaacgtatgtattagtatgaaactaccatgtgagtcattagatgaccatatggactgaattgcttggacaatcattaatggacaagtatgtctttgatttgctgcgaatgtgtttatagatcgataaaattagcacttttttgtttgctcatctaacattatcattggagtccaacttgatataacctctctagcttctcttcttcctctcttacaataaacaaaataaccatcaccttctctttcaacctctctacactcctccctcgacgtcatagctacatcggccgatgaagaaatcggagctacaaatccagcaacaccaatcggtatatcaagccttgtaggtcgtttcctctttaaaactcctcccggaggagacgatgcagaaacgataacccgaatctagatggaggtttctcgaaacgaagacgaaatggcgatttaggagaagaaacagtggtggatatagaggaaggagaagatgttggaggtttgcgatgagaaagagattggccggaagaattatcagccatcaacatcgagattgtgagataatcggaagacctgtaattgtgaaggtaactctttctcatctgcaaatctcaactgtcgttttattagatatcaattcaaacaaaaccatgttaaccggttaagcaattgatggtttagtttgaaaaggatataattatcattttatcatccagaaacaagagaaaatgtctcatccctgaaaagtgcctaaaaaaaaaagagaatattacgtgattagacacttttttaaaagttagttcataattatgcactttaaatagagaaagcactttaaatggagaaggcactttaaataaattattttatttatttactctttaactacattttttcaatcggctatctcttctctctccttttcccatctcttcttttttttttctttttttttttctcactttatcgaagaaaaaaacctttcccagaatatcttcaattccaaatctgcaattaatctccaaatccactctacgcgatggctttctcttctctcttgactaattggagaatacgaggtcttggtttctttaagattgtgatttattttgcaatttaaatatttgttttgacataaatttgagatttagttatctaagaaacttcttcttcttcaacaatggcgacttgaattgatttctgctctctctcatgtgtcaaactcgtttcacctatgtagcatcgagattccggttaatcaaatttcctgttattatggacatggtatacataatggatatagatcagtaaaaaggtttccgaatggatatatttaaatggactcgttattatggacaccaaaaaattgtttgttgatttttctttcggtttgtagagacctctaccttcaaaaccttatggacatggaactttagtttctttacaaaacacggttaatcaaatctcctgttattattgatagggtatatagaatgaatatagatcagtagaaaggtttctgaatggatatatttaaatggactcgttattatggacaccaaaaaattgtttgttgatttttctttcagtttgaagagacctccacttccaagatcttatggacatggaactttggtttctttacaaaagcacggttaatcgaatcttctgttattatggacttggtatatagaatgaatattaattagtaaaagttttctgaatggatatatttaaatgaactcgttattatggacacaaaaaaattgtttgttgatttttcttacagtttgtagagacctccacctccaagaccttatggacataaaacttttaccaaattcctgagataatcgagatcgaattgtttaagaaacttctctcaaaagttatggagacgtggagaaagagaggcgctacaaatcatgaagagagagagagagagagggagagagagagagattttatttattttgggtaaggatcgtggaagaggaataacaagaaagagaaattgagaattaaaaacataaatattgaattgagagtaaaaaaatctaagaaaaaaaaaatagtagaaaaaatgtttatttcctataaagtgccttaaatcgaaaaatattttttaaaaatgcctaatattagaacatttccaaaaaaataagattttctaaaaatgcctaaacgtgtcaaattatcttgaaaatacgttgaaacagtggtggaaaaatctcgacccgattggtatcaattaaggatccgacgcgtgtctcttttattactgagaaattgctgaaacgggtcaaatactatgaacttgatccttgcatcgttctctttggccccttgcttctgtgttcgattctttccttcaaaccataacaatctcaatctcttattcccaggtctctctctatctctctctctctgctacaagcttataagtattttgtggtcacatgtcactaatcattctcatgatccttaatcttagctcctagggtttctgtgaattagtctaattttacaattttatgcctttgaggatatatcttaatgtgaaagttttaaacttgtaactcaaaaaccatttgttagttagtaatcatcatcattctgaattgagctttgtttgaatttgagtagggcaacgaaagattcaagttagttgcggtggtaagagtgaggtgttgaagagtgatacaatg

SEQ ID NO: 28153 - DNA, 3000 bp, Unknown
  misc_feature (1)..( 3000): 2750-1469P.txt file - cDNA_ID_2994252; gDNA_ID_2214609; Annot_ID_187302
acatgaatgctttgttaggtgatatttcagaaatgttaatcacaagaccttatcttcttaccacagactttggcttgcttatctcctcattgttgacggtgtcctcatatcctcaaaccaacctagtacgcctacatttaaatatgtagagatgttggcagatttggagaagttccttaactggctgtctatacacatgaggataaatggtcaaagaaacatggataatatactttggattgacgtttattgttcatgtataaacttatttattagtatgaaactaacatgtgagtcattagatgatcatatggactggactgcttggacaatcattaatggacaagtatgtctttgatttgctgcgaatgtgtttatagctcgagaaaattgtatcaacatgtctatatacatgtggataaatggtcaaggaaacatggataatgtactttggattggcgtttattgttcatgtataacttatgtattagtatgaaactaccatgtgagtcattagataaccatatggactggattgcttggacaatcattaatggacaagtatgtctttgatttgctgcaaatgtgtttatagctcgataaaattgtatcaacatgtctatacacatgtggataaatggtcaaagagacatggataatgtactttggattggcgtttattgtttatgtataaacgtatgtattagtatgaaactaccatgtgagtcattagatgaccatatggactgaattgcttggacaatcattaatggacaagtatgtctttgatttgctgcgaatgtgtttatagatcgataaaattagcacttttttgtttgctcatctaacattatcattggagtccaacttgatataacctctctagcttctcttcttcctctcttacaataaacaaaataaccatcaccttctctttcaacctctctacactcctccctcgacgtcatagctacatcggccgatgaagaaatcggagctacaaatccagcaacaccaatcggtatatcaagccttgtaggtcgtttcctctttaaaactcctcccggaggagacgatgcagaaacgataacccgaatctagatggaggtttctcgaaacgaagacgaaatggcgatttaggagaagaaacagtggtggatatagaggaaggagaagatgttggaggtttgcgatgagaaagagattggccggaagaattatcagccatcaacatcgagattgtgagataatcggaagacctgtaattgtgaaggtaactctttctcatctgcaaatctcaactgtcgttttattagatatcaattcaaacaaaaccatgttaaccggttaagcaattgatggtttagtttgaaaaggatataattatcattttatcatccagaaacaagagaaaatgtctcatccctgaaaagtgcctaaaaaaaaaagagaatattacgtgattagacacttttttaaaagttagttcataattatgcactttaaatagagaaagcactttaaatggagaaggcactttaaataaattattttatttatttactctttaactacattttttcaatcggctatctcttctctctccttttcccatctcttcttttttttttctttttttttttctcactttatcgaagaaaaaaacctttcccagaatatcttcaattccaaatctgcaattaatctccaaatccactctacgcgatggctttctcttctctcttgactaattggagaatacgaggtcttggtttctttaagattgtgatttattttgcaatttaaatatttgttttgacataaatttgagatttagttatctaagaaacttcttcttcttcaacaatggcgacttgaattgatttctgctctctctcatgtgtcaaactcgtttcacctatgtagcatcgagattccggttaatcaaatttcctgttattatggacatggtatacataatggatatagatcagtaaaaaggtttccgaatggatatatttaaatggactcgttattatggacaccaaaaaattgtttgttgatttttctttcggtttgtagagacctctaccttcaaaaccttatggacatggaactttagtttctttacaaaacacggttaatcaaatctcctgttattattgatagggtatatagaatgaatatagatcagtagaaaggtttctgaatggatatatttaaatggactcgttattatggacaccaaaaaattgtttgttgatttttctttcagtttgaagagacctccacttccaagatcttatggacatggaactttggtttctttacaaaagcacggttaatcgaatcttctgttattatggacttggtatatagaatgaatattaattagtaaaagttttctgaatggatatatttaaatgaactcgttattatggacacaaaaaaattgtttgttgatttttcttacagtttgtagagacctccacctccaagaccttatggacataaaacttttaccaaattcctgagataatcgagatcgaattgtttaagaaacttctctcaaaagttatggagacgtggagaaagagaggcgctacaaatcatgaagagagagagagagagagggagagagagagagattttatttattttgggtaaggatcgtggaagaggaataacaagaaagagaaattgagaattaaaaacataaatattgaattgagagtaaaaaaatctaagaaaaaaaaaatagtagaaaaaatgtttatttcctataaagtgccttaaatcgaaaaatattttttaaaaatgcctaatattagaacatttccaaaaaaataagattttctaaaaatgcctaaacgtgtcaaattatcttgaaaatacgttgaaacagtggtggaaaaatctcgacccgattggtatcaattaaggatccgacgcgtgtctcttttattactgagaaattgctgaaacgggtcaaatactatg

SEQ ID NO: 28154 - DNA, 3003 bp, Unknown
  misc_feature (1)..( 3003): 2750-1469P.txt file - cDNA_ID_2994267; gDNA_ID_2214624; Annot_ID_135922
ctaatgatcaaactgaatcaagctcaagcatttaaagcacataactttcattgtttgatccaacactcatccaatttatgcaatcccttaaacaaaagaagttcactaagacctctgataagtattgatttcccagcttggtaccaacttctggctccatcaaagcatcaagagcacctttatctagaaccgtatcaaaagactcatcagccaactgcgtaatagaaaaagtaaaaatatttagtgaatgagagacagaacaaggatcagctagaaaccaaaaaaaaacagagcacaaaaggaaccaaaacctgcatctttgttatatccataactcgccaacgcagttcaggccgagtccgaatgttccgacgaagcatatcggagataacaactttggagaagtcaacattagtgatgtcacggaatccagcatcgtacaaatgctcagtaaggcgggagtttccacatccaggaaccagaatctgaagcgaatcagaagaagaagatgaagaatcttggaggagaggtaaaagcgagtcatggagctgaggccactcagcataccactcgaaagagtcgtcgttgcctctgagagtgaagaatttgtcccaattctctttgctggtgaaatcttcgagggtttgtaaaaaatcatctgttgaagctgctgctttgtttcctttcttcttccccatatctctgctatggaaacacacccaagtcccaaaaaccctaattttccagacttaaggatttacacttaccacacggtgacgactgacgaagacttggaggtggtggatgctgaagtcggagtacggtttaaatttggttcaaagtcgaatcgaaactaatcaattaaaccaaaccgaaccggaaagctaaccaaaaccatcgagtcagagtctgctgtgggcttaaattgggtcagaatgttgaagataaaatatttgggcctcatacatatgtgttttgattgataaatcatgaattctcataatcggtttaaactttctttttttttgactaaacaaaaatttataatcggctatctagaatcataaattttttaagtaaatcgaaagtgaatttatttatatcagaatttttgttttatataatatatggatacattttttgtcataatggatagagacactgccatcaaatatatggatgctaaattgttcatttttcaagaaaaacttggcacctaccattagataaaccaaaagttgaattgaaaggtttttagtttttagttattctcacttttgcaattggggtttcatgcttacataagcaatgacatcaatagctataatttgatggcagtgtctctcttctccgaagatgacaagaatatatgaacaggtatatcaagtcaagtctcttttgttttcgatataaacaacatatcatcaatcattactccgaatgtatatttaaagttatggtaaattattgtcacattatacaactctcgatccttatatctaaatacgttaaaaatgtataaaagacaaaagttaacctatttgaaaagattattgtcacatttcacctcgaatatttaatgtcaaaagattttatttgaaaacttcgaaaaatatatgtgtttaatcggagacgaaaaacgaatcacattggttatgacgtaactaaaaggatacatcataaatgatttaacatagagaatttcattttgaagaccatattattgataccgatatatgcatagcatcctctaaatgctaatgaaactcaggtatctagacgatgaaaaaacaaaataaaaaacaaaaaaaaacgatatgtcatttttcgtagtttggacgtgcagacttggcatgcaatacggaaatcacccgaacttccatctacattttggtaaaaaaaataaaaaaagtgttacctaatttctttttgcattttttagttttatttttgtaactcgttaagtcattattaaattgcacattcatttggatggacatacattgtgggcagtcactgttttgttgtcagagtcattgtattgatatatagagcaaacctaacgaatacaaaaagcatacggcacatggcatgacattgatatatataccttcacaaaccaaactcacatccaaaatacttctcttctttctttagtttcttgtgaaagatgattacttacatgggtctgagccacacgattgtcttactttatttatcccgtcaagaatgtttggaacttaaaaatgttggttcttaatgtaataaatctctaaacgttacgagagaaggacatatattaccatgaaaagactatgattaattttattttattttaattcattttccagatgcttcgaaaacaaggtaccatttgaaaatacaagtctaaggatggatgttgctaaaccattatttatcctcgtgagtgtcttaagatataacatatagtcaaaacatcatctatatatataattaaaaagaaagtttccttccaacgattctaaaaatatatttaatggtaagataaactttagaagatatatgcaatagatggtataatatattgacaaactcatccaatagcataaatccaaatcttagcttattttaattttatgtactctgataagtgataaatggtttctttagtcgacatctgcttgataaaaaacaaaaataacccatcgaggaggaggaatctagctggcggatatattgaaccctatatctaaaatagtatccaccactaattttaagaatttacgatccttaggccatttgtatgaataccttataattaaccaaatcactaacccaccaaccccttttaacttttctatttggtaaagagacatatagaaacaaatcttttatattaaagttgcctataactactattttctacgttgcatacttgcatatatccgataaatacttccgtcataacagagtaagagtttgtatgtaacaaatttcaacaaaaagaagagaaaaacaatg

SEQ ID NO: 28155 - DNA, 3003 bp, Unknown; identical to SEQ ID NO: 28154
  misc_feature (1)..( 3003): 2750-1469P.txt file - cDNA_ID_2994267; gDNA_ID_2214624; Annot_ID_187738

SEQ ID NO: 28156 - DNA, 3003 bp, Unknown
  misc_feature (1)..( 3003): 2750-1469P.txt file - cDNA_ID_2994275; gDNA_ID_2214636; Annot_ID_136135
ccactaaacttgatttcaaaacgtttctatagcccatctttttcatgttgtcttaattatcagatagattttactctttagactcctaagaccaagttactgtatatcattttgattatcttattttctttcactttctaactgtagtttacttttaggttccattccgtaaacattgctatcgttttgtgatgaacacaaatttcttttaatttgttctttcctcattatttcctagcaaaatgaatggaaattatatttcataaaatgaatctttaatagtttaatccatgttacagccattttcacctttacatgagagacaaatatgtacggcgaactttctagcaacaaaaaactgacatgcatgaagatggtttttttttttttttttttttgccagtcgcatgaagatggtttataaccatattgaatggtcatttttgtaagctacaacgagaggcgagcaatgagacttgccaaaaaaatatgaggaaaaatggtgacttgcatgtgtacttaaaatggcaccatatggatggatgaaactacttaaagggttgaaacgagacgattttctgttgccatatttttcttgattttgtgtggctgtgtataccataatctctaattgcaacctgaaattaaaatggtctatttatgttgcaattagtgattatgttttatattaaccttggtaaagttagttaaaattatccaagtcagcctgacgtgttacactgtggaacacgaaaacaaatctttgtagtttgtatgtgttgaaatcgtatttagctacatataataagtgaccatttctaccctaaacttccaaattactgaacaaaacgtttcaaaagatccaaacatcgattttcaaaatacaaacacaaacttacgtacgttgaagtttgtggtcattgtgatcgttaactttacgaaagattttagataatagacaagaaagttctcaatcaaactctatatttcatgtgtatataataatatgtgtccacctcatgtattacgtcactcataggaccatatgaccaaaaaaaatcaacaaaacacaatgaaacatgatgttgacaaaatggaccggtgaaaggaggaacgaaacgcaattacgcaacccttgggacattttttttttttaacttttcttatccttttactgtttatgcagttgaaagattttcagataaaattcaattttcacacagcgaacccaatatgttagcattcaaagaaaagtaaaaactcagtgagttaatattgcaattcctcttgtctctatctctataccgcagcccatgttttttgtagataggcggttcttggctgtttccatgaagctgaaactaacaaaaccaaagtaatcatttaattaaaatcactaattgtgctctttaggagagcaaaattcttttgatttatgcaagaatttaaaaaataattatataagctattggtgctgaacgaattatgtaaagtagtgtatgccagtaggtgatagtgatacgaatagtgtattacaacgaaacgtgaaattacattcttgatactcgaaaacatatacaattttttaaaaaattgttcagatatatgatacacatttttgttgatgttaatttagtaatatatgtacattacacacacatgtctcgaattcttctatgtactagtatcaaatatattaatcggtcaaactacttgacagattaaaaccatgtgcgacttctcgtatagcttgtattttaaagttttgatctgatcttaatatgcgtttattggatcatataatataacatgtggtattttaatatcataaattttggtttcttttcctaaaaatacaacaaaatatctaaaactttttgggaaatctgttagaagatttttttttgaatcaattgtagtaaatcacttcttaaaatgaattttttaaataatataaaacataaaagagaagagaagaggaggttccatcaacttcacttacaatgagaaaagactatgcaatttgcacaatcatgactttaaccaatacacatttatcagaagaaaaagaatctatctttatctttaatctctttacaaattcttttttattgataaaatttcaaaaatgatgtgattcaaaaatacaaaaatgatttgattaaaacatcacttttcttcctatatgaacttgtaataataaacgaattaccggacttcataaaatgatttgatttcgtatttaaggccatgaaatcttctaactaaagtttgtttctgataaggtataggatgtatattctttgaattgtgacaattggtcgaatgtatttttaccttaaactgatataagattctgctaatctagactcaagtcatcaagtagtcaaagctgagaaatgatgctctttttgttttcaaaagcaatgttacctttaagaaatcattaaacttgatcaactatttgcgtcacaaacaatttttgtttttaatattatccacggatgattaaagtaatgttgttcagaaacttggtgccttcgtgtctcgtaccatcacttgtgtcaaaccggcgtcaaacgcccactctcgctgacctcagcccccaacaaatacacacatacggaaatgaacatgtaatatcaaaccatataatattcagtaaaaaatcagtatcgataatatagtaaaataataaccttcacgcattccttcttcttctataaatacacacatttgcctccacttactctcgttcaaacaattcttcgtcctattaaatacaaaaaataaaaatccttaaaaatatatccttatcttcaaccaagaatgggagaggtccaagaaggtcccaaagttgaacaagagaagaagccggctgccaccgtagtcccagttgagactactgacggcaagccaaagagcggcggaggagattccgcggcagcagcagcaccaccggtcgccgcggttgtctctgcctttgtttacaaagtggatatg

SEQ ID NO: 28157 - DNA, 3003 bp, Unknown
  misc_feature (1)..( 3003): 2750-1469P.txt file - cDNA_ID_2994275; gDNA_ID_2214636; Annot_ID_188131
actaaggtgctcctgccgaggaatacaataattgtaacaatgatagtgaaacagaccggtaccaaatccaaacttttcatattatttattagtgtaataatgttgcatggagatccatttagatgtttaaaattgagttcttgatgagttggttctactttgtctctgcccccactaaacttgatttcaaaacgtttctatagcccatctttttcatgttgtcttaattatcagatagattttactctttagactcctaagaccaagttactgtatatcattttgattatcttattttctttcactttctaactgtagtttacttttaggttccattccgtaaacattgctatcgttttgtgatgaacacaaatttcttttaatttgttctttcctcattatttcctagcaaaatgaatggaaattatatttcataaaatgaatctttaatagtttaatccatgttacagccattttcacctttacatgagagacaaatatgtacggcgaactttctagcaacaaaaaactgacatgcatgaagatggtttttttttttttttttttttgccagtcgcatgaagatggtttataaccatattgaatggtcatttttgtaagctacaacgagaggcgagcaatgagacttgccaaaaaaatatgaggaaaaatggtgacttgcatgtgtacttaaaatggcaccatatggatggatgaaactacttaaagggttgaaacgagacgattttctgttgccatatttttcttgattttgtgtggctgtgtataccataatctctaattgcaacctgaaattaaaatggtctatttatgttgcaattagtgattatgttttatattaaccttggtaaagttagttaaaattatccaagtcagcctgacgtgttacactgtggaacacgaaaacaaatctttgtagtttgtatgtgttgaaatcgtatttagctacatataataagtgaccatttctaccctaaacttccaaattactgaacaaaacgtttcaaaagatccaaacatcgattttcaaaatacaaacacaaacttacgtacgttgaagtttgtggtcattgtgatcgttaactttacgaaagattttagataatagacaagaaagttctcaatcaaactctatatttcatgtgtatataataatatgtgtccacctcatgtattacgtcactcataggaccatatgaccaaaaaaaatcaacaaaacacaatgaaacatgatgttgacaaaatggaccggtgaaaggaggaacgaaacgcaattacgcaacccttgggacattttttttttttaacttttcttatccttttactgtttatgcagttgaaagattttcagataaaattcaattttcacacagcgaacccaatatgttagcattcaaagaaaagtaaaaactcagtgagttaatattgcaattcctcttgtctctatctctataccgcagcccatgttttttgtagataggcggttcttggctgtttccatgaagctgaaactaacaaaaccaaagtaatcatttaattaaaatcactaattgtgctctttaggagagcaaaattcttttgatttatgcaagaatttaaaaaataattatataagctattggtgctgaacgaattatgtaaagtagtgtatgccagtaggtgatagtgatacgaatagtgtattacaacgaaacgtgaaattacattcttgatactcgaaaacatatacaattttttaaaaaattgttcagatatatgatacacatttttgttgatgttaatttagtaatatatgtacattacacacacatgtctcgaattcttctatgtactagtatcaaatatattaatcggtcaaactacttgacagattaaaaccatgtgcgacttctcgtatagcttgtattttaaagttttgatctgatcttaatatgcgtttattggatcatataatataacatgtggtattttaatatcataaattttggtttcttttcctaaaaatacaacaaaatatctaaaactttttgggaaatctgttagaagatttttttttgaatcaattgtagtaaatcacttcttaaaatgaattttttaaataatataaaacataaaagagaagagaagaggaggttccatcaacttcacttacaatgagaaaagactatgcaatttgcacaatcatgactttaaccaatacacatttatcagaagaaaaagaatctatctttatctttaatctctttacaaattcttttttattgataaaatttcaaaaatgatgtgattcaaaaatacaaaaatgatttgattaaaacatcacttttcttcctatatgaacttgtaataataaacgaattaccggacttcataaaatgatttgatttcgtatttaaggccatgaaatcttctaactaaagtttgtttctgataaggtataggatgtatattctttgaattgtgacaattggtcgaatgtatttttaccttaaactgatataagattctgctaatctagactcaagtcatcaagtagtcaaagctgagaaatgatgctctttttgttttcaaaagcaatgttacctttaagaaatcattaaacttgatcaactatttgcgtcacaaacaatttttgtttttaatattatccacggatgattaaagtaatgttgttcagaaacttggtgccttcgtgtctcgtaccatcacttgtgtcaaaccggcgtcaaacgcccactctcgctgacctcagcccccaacaaatacacacatacggaaatgaacatgtaatatcaaaccatataatattcagtaaaaaatcagtatcgataatatagtaaaataataaccttcacgcattccttcttcttctataaatacacacatttgcctccacttactctcgttcaaacaattcttcgtcctattaaatacaaaaaataaaaatccttaaaaatatatccttatcttcaaccaagaatg

SEQ ID NO: 28158 - DNA, 3000 bp, Unknown
  misc_feature (1)..( 3000): 2750-1469P.txt file - cDNA_ID_2994285; gDNA_ID_1620849; Annot_ID_50977
agatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtatttcttttgttccattctttttcctcttagcccatttgcttcaaggttccaatgatcattatggtttaatttgttaggtgggaaaccgttgttggagctcaatagggtacttaggccaggaggtttcttcatatggtctgcaacaccagtctatcgagataatgacagagatagcagaatttggaatggttcgcaacaatcatgttttttttatttgatcattcaacactgatgttgatctctatggttttaactgttacaattctgttttgcagaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtaaaaaaactattacacaaaatgatgctttacattcacatataagtaatgtccactattttttgtaacatttccttctgattaattttaggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcgggtacatttacaatctctgaaactttaaccagaatccggtttatcccaaactgaaacttgacacaagtttttcttcttttcttctttttggtatagttttgctgctgcacttataaatctaccactctgggtgatgaatgttgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtaaacaacagatctgagtttgtatatctatagagtttcagttctttagcagtagccagtaggcattcactgttttggttcggttcacggttagcttaaccaaagtcggagttgtcataccaaactcggtttgatattgcgaatagtgtggttaacctttaatatgtgttttttgggtcaatttcaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagattatatcacagcgtactatataacccattaagggggttttgttttgactttctgattttgttccataagaagaattgaacgaaaccgagtcactaaagactacataagatattaaagttaacgagaataattcttttgccaacaacatatattgttttgagcaaaacaaattgtttcttatatcttagattctcaaggttttgtccaaaaaaaaaaaaaaagattctcaaggatattttgtttttgtcacattggttcctataacaaaagaatatggaaatgttgacaaaataaaaatagtagaatgtgaattagaattaagataactaaaacatagaggggtttggttgatgacaagtgaccagaccacgaggatcccacatgggaagagaattggggacgaagaaagcaacagctaagcaaccttccactttgaaatagtctcacattacttaagatgacaatcattccttcaacctcaatcattcaaatatcatcacaccaaatctatcgtggctctcgttgaattttatttataaccgacacaaattgtaagaaataaccaagaaaatcaagaaggtggaaccattcgtccattccctacgccacaagtctttttcaacggtggatggctggctggctgtctaattgagccttttcttttgaaccccttttagttctgtaactacattttaccaggtataatagtatattagttaatattaagccgtattacacatttttttttttcacctaacgtttatatatatatataatattttttagttacagaaaatcctcaccactttaaattacgatgcaataagatcaatctaaatggataacttgtaaagaaaagaaaatgatacagtattcgtggttcggaataagtcaagtatgattcgaacatcgtacaatattggtatttgacaataatccttggagaaaaaacaaataaaaagtttctgcagaaaagtttaattttcataaaaatacaaaaagaaaaacgttgattggttgagaaaaatacgcacacttatttagttcttcttgaccaataaaataaaataaaatctcctaaaagtcaagtttcctcaatcgggcaaaacacggcggacgcgctttcttcaatcaaaaactcgtctgctaataagtctcttttcgtcttcagcttcttccgctttttctgattgcttctctgatctcttatctctaattctaatccatagtaaactcgatttcatcatcttctgctcacaacacttactgttgttgttgttgttgttattgttcttctcgattcactcgatcgatgttgttcaaaatg

SEQ ID NO: 28159 - DNA, 3000 bp, Unknown
  misc_feature (1)..( 3000): 2750-1469P.txt file - cDNA_ID_2994285; gDNA_ID_2214645; Annot_ID_136342
atgtgttttttgggtcaatttcaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagattatatcacagcgtactatataacccattaagggggttttgttttgactttctgattttgttccataagaagaattgaacgaaaccgagtcactaaagactacataagatattaaagttaacgagaataattcttttgccaacaacatatattgttttgagcaaaacaaattgtttcttatatcttagattctcaaggttttgtccaaaaaaaaaaaaaaagattctcaaggatattttgtttttgtcacattggttcctataacaaaagaatatggaaatgttgacaaaataaaaatagtagaatgtgaattagaattaagataactaaaacatagaggggtttggttgatgacaagtgaccagaccacgaggatcccacatgggaagagaattggggacgaagaaagcaacagctaagcaaccttccactttgaaatagtctcacattacttaagatgacaatcattccttcaacctcaatcattcaaatatcatcacaccaaatctatcgtggctctcgttgaattttatttataaccgacacaaattgtaagaaataaccaagaaaatcaagaaggtggaaccattcgtccattccctacgccacaagtctttttcaacggtggatggctggctggctgtctaattgagccttttcttttgaaccccttttagttctgtaactacattttaccaggtataatagtatattagttaatattaagccgtattacacatttttttttttcacctaacgtttatatatatatataatattttttagttacagaaaatcctcaccactttaaattacgatgcaataagatcaatctaaatggataacttgtaaagaaaagaaaatgatacagtattcgtggttcggaataagtcaagtatgattcgaacatcgtacaatattggtatttgacaataatccttggagaaaaaacaaataaaaagtttctgcagaaaagtttaattttcataaaaatacaaaaagaaaaacgttgattggttgagaaaaatacgcacacttatttagttcttcttgaccaataaaataaaataaaatctcctaaaagtcaagtttcctcaatcgggcaaaacacggcggacgcgctttcttcaatcaaaaactcgtctgctaataagtctcttttcgtcttcagcttcttccgctttttctgattgcttctctgatctcttatctctaattctaatccatagtaaactcgatttcatcatcttctgctcacaacacttactgttgttgttgttgttgttattgttcttctcgattcactcgatcgatgttgttcaaaatgcgttcttttgtggcttttgtgctccttctgagctggttcggttcgtgttgttctctcaaggaccaaggtagagactttttttccgtttcacttactcgtttttgtctctttggtagtgtagaaacagaatccagttccctgattcacatcctctgtttcgcttttacgttttcagctgtagattttctcaaaagtgaagatagtttaaagaaagatctatcgtcagatgaagattccacgtatttgtaagtagcagcttcaggtttctgagatttctattgggtctttagattagaaacactcttgtcacttgtgctgattcaatttctcagtttcctaagaacaactcttaaagtttcgattttactactttttattctctactctcaatctatcttgactttgaaagattttttggtataacaacaacatatatgtagtcaagatctacaaatttctctaatcatttcatagcttcattctctctatgtatgtatggtagaagaaactgttgttacttgtaaccgacacttctaaacttgctatatttagagcatgttgtgcaatggcttaatttcttcttctaccttttcttaggaaagcttttggatttcacaggaaaacacttgtccgtaacccttacaaagacttgccttcaagaaaagaccgcaaaaaccgtgttgtggctgcaactacaacaccatcatcatccccagaacctgctccaaaacatgtttcaactaaagcttcaacagtttcagagccacaaaagagatcatctacacaagatgtttcaccttctccatctgcgccacttgcaaactctcccattccaagaaactctcattcttctgttcctttagttgttggctgcgtaggcggtgctttttttcttctccttgtagctaccggtctctactttttcacaagtaaggccgggaaaactgtgaatccttggcgtactggtcttagtggacaacttcagaaagtattcgttactggtaatttcctttcttgaattgttttggcaagtgcacttacttggagtagtaaccaaatttgtctcatttggtttcatcaatgtgtggtttttgatactcaggtattcctgtactcaaaagatctgagattgaagctgcatgtgaagattttagtaatgtcattggatcttgtcccattgggaagttgttcaaaggaacattatcaagtggagtggagattgctgttgcttcttttgctactactactgccaaagactggaaggacagtacagaaattcacttcaggaagaaggtattgttttccccatttttgttttcttataacaacaacatatagtcgacttagcgcgttctgttttcacgatttcagatcgaaatg

SEQ ID NO: 28160 - DNA, 3000 bp, Unknown; identical to SEQ ID NO: 10348
  misc_feature (1)..( 3000): 2750-1469P.txt file - cDNA_ID_2994291; gDNA_ID_2213643; Annot_ID_132334

SEQ ID NO: 28161 - DNA, 3003 bp, Unknown
  misc_feature (1)..( 3003): 2750-1469P.txt file - cDNA_ID_2994295; gDNA_ID_2213649; Annot_ID_132436
ctgcaggaaatgaaggctcaaggagttgaaggagatcgacttcagttactaagagacgttggtggagctttcaggcctggcgtattgacagcattggtcggtgttagtggtgcgggtaagactaccttaatggatgtcttggccggtaggaaaacaggaggctatgtagaagggagtattaacatatctggttacccaaagaaccaagcaacatttgctagagtcagtggttactgtgagcaaaatgatatccattctccacatgttaccgtttatgaatcccttatctattcagcatggcttcgtctttccgccgatatagataccaaaacacgagaggtaagtattactatacataacgtttcatttgtttttcataatcactcgcatgattttataatctggtaacctttttttgcatgtagatgtttgtggaggaagtgatggagttggtggagcttaaacctcttagaaactctatagttggtcttcctggtgtagatggtctttcaacagaacagaggaagaggcttactatagcagttgaattggtagctaatccatcaataatcttcatggacgagccaacatctggtcttgatgcaagagctgctgccattgttatgcgtactgttaggaatactgttgatacaggaagaactgttgtttgtacaattcaccaacctagcatcgacattttcgaatccttcgatgaggtttgcttccgaaattttttccacttttaagtccctgaaccaggataaagttaatcaatcatctttggtttaatgcagttgctgttgatgaaacgaggaggacaagttatatatgctggaacactaggacatcactcacaaaaactcgttgaatactttgaggtgaatcattggttttgcttttcctctctcttggtcatatgaatatggaactatatctagaacttttcttgcaggctattgaaggggttccaaagatcaaggacggatacaatcctgcgacgtggatgcttgacgtcactactccttcaatggagtcacaaatgagcgtggactttgctcaaatattcgttaactcctctgttaatcggtatgtgttttaagaaaaatgctactactaatgcagagttgttacactgtgtttctaatatgaacttgatgttttactcaggagaaatcaggaactcatcaaagagctgagtactccaccaccgggatcgaatgatctctacttccgaaccaagtacgcgcaaccattttctactcaaaccaaagcttgcttctggaaaatgtattggtcaaactggagatatcctcagtacaatgccattcggtttctcatgacagtagtcattggtgtcttgtttggtctacttttctggcaaacaggaactaaaatgtaaggcatcttcttttctctattccataagtaaactatcatcttatcaaaatgtgacgtattcatccaaaaacaccaaaacagagagaaagagcaagacctgaataatttctttggagccatgtatgctgctgtattgttcctcggtgccaccaacgctgcaacagttcaacccgcagttgctattgagcgaacggttttctaccgcgaaaaagccgctggaatgtactccgccattccctatgcaatttctcaggtacttaaccattctaataattttgcctcaacttttatatgctacttttcctaagatatggttatctaaaaatgatgcaggtagcagtagaaatcatgtacaacactatacaaaccggagtttacacacttatcctttactcgatgatcggatacgactggactgtggtcaaattcttctggttctactactacatgttaacatgcttcgtctacttcaccctatacggtatgatgcttgtcgccttgacaccaaactatcaaatagctggaatctgcttgtccttcttcctcagtttctggaatcttttctccggtttcctcatccctagaccggtaaataaactaagcaacttccatttgaattaataatataaaaaaaaagtgttttaagagctagactaaacttttaacttttgatgcagcaaataccaatatggtggagatggtactattgggcatcacctgtggcttggacattgtatggaatcatcacatctcaagtaggagacagggattcgattgtgcacatcactggtgttggagatatgagtcttaaaacgttgctcaaaaatggattcgggttcgattatgacttcttaccagttgtagccgttgtccacatcgcctggatcttgatctttctctttgcctttgcttatggtatcaagttcctcaacttccaaagaaggtgaagaaaacttttattagaatagatttcaaaaatctttatagattagtgtttgaatgaattcatgtaaattttctttgtcttacctaattatttatttattgtcgtttggtaataataaataacagttcatgtttacaatatgatattttccttattcatacttggtatatgctttattctctagtgattctcattacaaagatatttgtgcaagtttggactcgtcccaaatcaagaaaaatgttgtagtcaaaatgcttttcagttacgagtctgaaacctgacaacacaaaattataaattgtttttatttattttttcctaatcaaaacgattttttcctaatataaaatttgatattttgaggggtaaaagaagcaataattgagaatattgagatactaaaattgtgacgagacgcttgatgggttccacttaaatatctgatatgattacacgtggcagactatgctccgtccctaatgagcttcgtgtgattttgattaattttgttaacttttatttttgtcgtctagttttttaaatttattaattaatttttatttatcttctaatttagattttattcctttaagctttttcgctcctcactctctcttcccaaagttctctgtaaaactctctctccgtcttcaatg

SEQ ID NO: 28162 - DNA, 3003 bp, Unknown
  misc_feature (1)..( 3003): 2750-1469P.txt file - cDNA_ID_2994303; gDNA_ID_2214450; Annot_ID_132911
aattatttccggaaatttcataaagatagacatggttcaataaatatcttaaaattcccaatcgttttcaataatatattattcaaatgccacagtcgtaatcttaaacggagaatcaatgtcttttctctcccacttatagtttcagattcccacatagaggtagatattgacatcttactctaacaatatattcttaattttgatacgcattatgtaataataataaataatgctacatgaatacaaactatacaaaaaacacactataatttaataaccaacaaagaaagattaagtagcaagtttagagagttttttttttttcattttgcttttttgttgttgttaattctctgtttttctcttcatacttttctccataacatttttcataattttactagttgatgactctactaccattgatcaacctattaataaaaaaaacttattacaaaataaaactaatagtaattgataacaagagtaattagtgaaggaaaataactcattcagaaatattattagcaggacaaaaaatatcaaatattaatggttaataaaaataggaataaatataaatagttaattaattaaaagccatgaagggtagccatagaaaaagcatcaagcatctcaccaatcaaaagcaaatgatcagaaaaactctataaaaacgtcaaaaacagaaactcaaatcacaaaacaaaaaatggcaaacacaaatcttgaatccaccaacaaatccacaacaccatcaacggatatggagctaaagaaagtcttcgacaagttcgatgccaacggcgacgggaaaatctcagtttcagaactcggaaacgttttcaaatccatgggaacgtcgtacactgaggaggagctaaaccgtgtattagacgaaatcgacatcgactgcgacggtttcatcaatcaagaagagtttgctaccatttgtcgatcatcttcctccgctgtagagatccgtgaagcgttcgatctctacgatcagaataaaaacggtttgatttcgtcctctgagatccataaagttctgaatcgtcttggtatgacttgctctgttgaagattgtgtgagaatgattggtcatgttgatactgatggcgatggaaatgttaatttcgaggagtttcagaagatgatgtcgtcgcctgagctcgttaagggaaccgttgcgaactcttagagttccgattttctttttataaaaatttacattttaagttttaaaggtttttaacaacaaatttactttatatgtaagtaagcattctgctgtgcaaattttaaacttgtttcttttttttttcttttttttttccggcattgcatttaaattttagatcaatttattatgagttgcataatttggatgaaattttattggagaaaagactttcactaaagaatcggttataataattatgaaagactgaataatgaaatggtcaacaaagacgctatttgtctggaatctgattcttcttttgtgtggcctgaaaaacgggaatctaattcggtttaaaatacgggctttttaaaggcccagctttgagttgagcccaattagaattctattcaccttttttttagtagcttgagagattccacttttttcttgtcaactgaaattgtgccaatgataagaaccaaggccttattagtctgtctctacaagcacaacacttttttttttttgttcctgtatatgtttaaaaactaaaaatgaattatgattataaagtaaaagtgactcaaaatatctatctcaccataaatcatagttattaccttaagacatggcgtgatcgagtcgattgatcgaggcattgagcatttatataccacacacacggttacataaggtcgggctatatatgaaacacgtgaaatgtcacatttcatagttcttttaatggtgcaaattctgatgtctccatctcaccatttaatactgctgaattaacttttgccccttccattccattgtatattctattgtatttaacttcacgtaatttagttcacgacgttgaccttttttttaattagcaaaatcagtggatcatacagtattttctaaatacttcctaatcgtaatatattcattttactatgaaaataaaatctgaaatcagattcattctcatcttgaataatcatttttctgcgttaaaacaataattcgcgtcgaaacacagttggtatatagaggaaaacaactttaaaagcgtgtgagcttaggtgaaaaatgtcaaagagaaaaggaaataggtaggtatgattcaatttgaacatcatgatttttaatctgatattttctaatcaacacaacaaaattacacatttaaggggaaaaaataaaactgaagcatatgcagtagtatttggtaatcccaacaaacaaaaaaacaatcagaaaaggaggataacgttatcattatgttgtaatccatgatttcacatgccaacagctgcacttatgataaagaacccctctcttattaatcttcaaacctaatcaacaaattattaagtgagatatatatatatatatatatatatatatattacatataaataaattattatatatccccaaatcttcgtcttattatttttgtttttgtttttttgtcgtctccctcttattaaaaatgaagctctccattatatggattcagtagaattattataatttcttggacgccatttttctcaccccaagttttccttctaataaatacgagtgagcaatgcgtaagtataaaaacccgatttgactatataatattctcaaaagaataatactactaaatctgattttcaaccaaaagccaaattcagcggaggaactgtcgttttcctttcttctttacttcttcacctttctcctatttcatcttaacatataatcatcagaagaaaaaaaaattctaaaacaaaagaggaacttgagaattttatgcttgagacaaaatg

SEQ ID NO: 28163 - DNA, 3003 bp, Unknown; identical to SEQ ID NO: 28162
  misc_feature (1)..( 3003): 2750-1469P.txt file - cDNA_ID_2994303; gDNA_ID_2214450; Annot_ID_182427

SEQ ID NO: 28164 - DNA, 3000 bp, Unknown
  misc_feature (1)..( 3000): 2750-1469P.txt file - cDNA_ID_2994309; gDNA_ID_2214670; Annot_ID_136605
aatagtttttgctcgttgtttctgtcttttgatcatgtggaatacaaaacgttattgcagggatcgctccgggaaaatccgagccaagcgaaagagtacattattccgtatggagattggtttgggatggtgtcttctccacatttcttggcagaaattgtaataaaccctccttagtagatatcttaacgttcttctatttttcttaactcttctttaatgatatgatgctgtgaaatttaggttttgtatgcgggtttactgattgcgagtggaggaacagatataaccatctggttactctttggttttgtggtatggttcactctctcatttgcaagatccactaatgaaatgcttcttttttctggattctgagaaatagtacttatgttttttctttttgggtgtttgtttttcttttgtaggctgctaatctgacatacgcggctggagaaacgcaccgttggtatctccggaagtttgagaattatccggctaatcggcatgccattttcccttatgtctactaaatggttaagagatacaatggttgtcttctgtaaatgctgaattctgaacatcgaagatttgtggtgctttgttatgttttaatttagctatgcttctcagttctcatcttctttatactggtgcttttttcgtttcaagaatgtattttacacaaacaaagagtgtgactttggcatttagctgtcttttacagtggcatgagttcgactcgtttacttggccagttgataatacctcctaagtttttttgttttttttgggttcaattttccttgtattcccgaaatgttgttaatataactatttgactacgatttggaatgaaaaatgttggttttagtaaactaactacgtaccattactaaatccaagacttccgaaaattatcttaccttgcttcttatgaaatcaatcttggcttcttttttttcatcgatacactttactaagcataactagcataatagacttaaataactaatcggtgaagagcaagtcttctccaacaaacttagtagataactaaggaaactaaaacataatctaaataatagagcaacaagttactcctacaatctaggagatttattttcaaaagactaattcaaaaccaaacaagaacaaacttattctcacaagtgtattaagagtcatataacctaaggaaaacaaccttaaagatacttggaggatatgggaactcaagatggccaaaaaccgtcaccagttctgatttatatagactttacttcaagggtttgataagggaggaaacaagagggtttgtggcaggatttggtgttgcaatttgcggccaagaggacaatctcttgtttcaagtgaaaagttcacttcatgactccgcaattacagttttggaggctgaacttatggcattgaagctaggactaactgaagccgtgagtttggggatcactcatatctcaatctactgcgatcattttcagatttttgaactggtaaattgttcttgaaatatttacacatttctttaggttttgattagttttgcatgccaaacttgttttttaaaataaatttaacattttaaccaaaacaaaaatttatgatgacgagaaaaatctcctaattgagtaggttttgtccttatcatctttttaggttatgtggagatcagtgcctgataaagatagcattgcaatgataatgtatgatgtgcaacgcataagacaacaattgacatcaagcacacctcttctggtgactggaaatcaaactaataagttagcttatgaacttgcactagaaacactagtttcagaaatcagcataagtatcgaagagaaagctctaacatgtgacaaaaattaaacgtggaaagtacgtaagctgcaggtatcatctctaatcacattctctagactctagctactatacattaattttaatttatcgtcgtggaatgttgattatgtttacgcctaatgttgtaatttcatggttgatggatatatatagatgtgggtattccttttgctatatgtgtggagtcgaatggaaacaacggctaggagctggtggttgcattcatagcaaagcagagatttattttatcattatttgttttgcagtcttgtttggagtgaacttttgtttctttttgattgttactttaatcaattgggttgtgaatttattcaagtgatttacccagagacttgtaaacgggacataaaaagaaataaaacctttcatttctatgtcttatgattgcatgagtagcccaaacatctatggtctagtggtaggagaagatttagggaatagtgaaacttgtagatccgagttcgatcctccctgaaaacaaaaatcatatttgttttgagaagtctctcagttaggccttgggtcaattggtttacctggtagttagaaatgcagccggtctgactatcccctttcattagtcggaaaacatttcaaattcagaacagacagtatggtagtccttcggtgagaagtccactctaaaatatttcggtgcgtttctgccgaggctgaccagattagccggtagggtttatcaaaaaaaaagaaaaaatgattgcatgagtacttctcaattcttcacgttgtcacaacaacttgttacatgcgactaaacaaattatattgaatccatatacagatttgccaaatactatttctatttggtcccaattagtgatgtttatatggatttaatagcccatttagttatatgggtctgttgttaaaaaatagcccatgtagacccgtttatggaaaaagataaatgggctttaatttcgacccggcccaaaattacaacgtgttcaacaacaactctattatacaaacagactacgtcgttctcttccactcatctgaaaacaaaatccaattctctctctctccctccagattcaaacgatccgatccaaaactttgagatccgagaagatg

SEQ ID NO: 28165 - DNA, 780 bp, Unknown; identical to SEQ ID NO: 13949
  misc_feature (1)..( 780): 2750-1469P.txt file - cDNA_ID_2994313; gDNA_ID_2214676; Annot_ID_136653

SEQ ID NO: 28166 - DNA, 3000 bp, Unknown
  misc_feature (1)..( 3000): 2750-1469P.txt file - cDNA_ID_2994316; gDNA_ID_2214676; Annot_ID_136657
tgtaataaagcaacaaacaaggattatggataaatgacacatacagtgttgtatcttcgataatattaagttctacaccatgccgtggatagtccatgatttaataccgttttgtcgatatattagggatgacttacacacgtaaaatcaaagagtgatatgttaaggatgagcacatgtaacattgaagagcctatgagttttattagagagcgttcacaatgaattttagtgtttgagctagttattgattcattctaaagataattagtttttgaggatgttaaagatgaacacataaaatcggagcgactatgagccttggagagctcacttagggttgtattgtttgagacagagttattttttgtctaaatatactaagaatttttgttgtttccattttggttcatcactatctaagtctatttagcccatattgttctaaggaacaatagacttagatagtgatgaatcaaaatggaaacaacaaaaattaatgaagtttagacaaaaaataatgtattaatatattcataattatgctttattcagcccatattgttctaagcttaatgaagtttggcccacttagttattgtttgtacacttcttatagaggctggctcaagttatttttgggcattgtgcccactgcccatttaaagaaaattctgaaaactgttcataatataaaatcataggaaacactacaactataaatatgtacttaaccctaagatacttctgatgagagcaataacattgtcgttcaattttatatcaatcctcactcgatcatggtatatcagagttataattatctaacaatcggttacattcctgtttttaagccatgtacttctactttttatatttgttttaacccaattgcttccaatattcaagttcatcataacctctgaattaagccaaagtacttccataattcaagtctataatatacctcgcaatcaacccaaattgcttctaaaatcaagctaaaatgtttttttatgcaataaaaaacaaatctcatgttttcttaagctgtatacatttattatgtcttcagagcttatatgcttctttaaagtttttgtttattaaaaaacagattttcttcaaaatatatttggttttagttttatctaagaaatacaagaaaagaaagaaaacagccttcggtttgttcttctcgacagaagatcaagcattctccatggcttcaaccatgcgctcatgcagcctctatttttcccttttacttcttcatcatacgaaacatcttgattgaatttagttctagtaaataatgttaagttttttttttcttttctactaaataaaaactcatgatgaggcataatctatatactttgcaagaaatgctttcatattagtgttttattcatccataaaaaaactatttaagttgaaataataataaatattagtatcatataggagtataacttatatatcagagaaccatttattaaacttgtcttaattatgtccttaagattgtacacatgacatggctctgcaaaacataactcagttcaagtatcccttgggatgacatgcgttttcggggttttgtttctcgatcattaattagtttctagaaagagagacgacgtcaagagtcaaaaccaaatgaaagtaggaaccacacacgcgttgaaatgttcatagttttcttcacctttgatattcgctttttacctgcatatccatgttttatgatagaagacaaaaacccttttgcttttttattgtttataagtcaacaaacgaataacattttgagggatattatttgtttttccttttgtcaagagagcagttagaaactgttcatactctttgtcccttttagttaattttttatcacaacaaaggaagacttgtgaaaccttgactacttacttactaaaccacgaccaagtaaaacattgttttttttttgtaactatataaagctttctttataatagttaggtttaaatctgaagtgtcaagaattttaaaaaacgcgtgcgtgctttgtgaccgaatcatcatttatgtttctctatgatttaatttcaaaatggtgcgggtttatagtctaatagcagtatttgtttatagataaatagcatttatttatttctttttactctaattaaattctttggttctttctttcctttctatttggttgtgacatttacatttcatatcaatacattgtatctcccttgttatttagctttcaactaataagaaaactcttcttaaagaaatctgactagttaacgtgatcaattatacgttctatattgtcgatcggtaagagttccatatattcactcgtttcaaacaaagttatatatcaaaaccggcagtaaaactaaattttaaaactgtcaagatccgaacaatcttaccatttgttgtgtacaataaaaacttatgactgaaaatgcatgaaaataatctattaaaaaccaaataaaaattcaaaatcctagttttcaaactaaattgttaactgttaatagatcaccattaattcgtcacaaagttcaccttaaccttttaatcactacttttaacttttggttctatgttggctctatcaaaataaattttagttttaactttataaaaataactagaaactagtataataaccaaaaatggcggtgaaatagtcaaacaattcatgcaagcttgggacatttggataccaaacccaagatttagtctctttgatttcaaaccattttttcaatacattgtcattttttaatatatctcttaattgattaaaccccaatcaagttaccaactctattgccttgctttttcctcttcatgacgctataatccacgaaccctctggcctatatatactttcgattcttcttctaatccttcatatctcctaccatcacaaagtcatctccttcttctttcttgatctagctagcggaaaatttgacaatg

SEQ ID NO: 28167 - DNA, 3000 bp, Unknown; identical to SEQ ID NO: 28166
  misc_feature (1)..( 3000): 2750-1469P.txt file - cDNA_ID_2994316; gDNA_ID_2214676; Annot_ID_189200

SEQ ID NO: 28168 - DNA, 3003 bp, Unknown
  misc_feature (1)..( 3003): 2750-1469P.txt file - cDNA_ID_2994328; gDNA_ID_2214693; Annot_ID_189441
atgaagtcaataactatgctcttgaccagaataataatgaagagagggtactcaacttgtaattttgttttactggagaaaatgtactggttctaaataattgagtttcaggtaaccttgactggatctccagatggacctcttgtggcgctggctttcaaattagaggagggtcgttttggtcaattgacatatttgaggtaaatgttgaatctccctcttgattatattgctgtgtttactaaatattaaaagtattttgtgcctttctgtcatatgactaaattggtgaatgctgaatcctaattcatgttgttggttgttatgaagagtttacgaaggtgtgattaagaaaggtgattttatcataaatgtcaacactgggaagagaattaaggttagttcttgcatcttagtgttgctttgagtttttcaacgccatgaagtattgtgcataaatttataccaaattacactgagtaagtatagttttctacttgtccctcatctgtcatgaatacttttttcatagaagcaaaatgtctgaaagtcagaccactttgtcatatattttatctcaacccttgcaagtagtgcatgtgatgtttgattttgcctaaaggttattcaatgtttcttggtgtaggttccacgcttggtccgtatgcattcgaatgatatggaggttagttgaagtttatttttctccttaagattccattatggtagctccgtggtggcaactatagtgccatgtgactggattctaaatttttattctattttcaggatattcaagaggcacacgctggacaaattgtagctgtgtttggtattgagtgtgcatcaggtacagtaaaatattcttccgtacttgttcgaacttaacataatttgcttctctggggatgaaattctgatattgtgtttgttgttgggtcaattttcctaaatcaggtgatacatttacggatggatcagtcaagtacacaatgacatcgatgaacgttcctgaacctgttatgtccttagctgttcaaccagtttcaaaagattctggaggacaggtaacttctgtgaactttgaagctaaaacagcaacatatttttccttcaattctggttttaaacatttgcaactgaaatctattttttggtgttagttctcgaaagcattgaatcgattccagaaagaggatcctactttccgtgtgggtttggatcccgagagtggccaggtatcatctaaaaactcttttgcttctcagcacctctctcttaattcaccccatagtatttaacattgatgattcttccatttatccttcatgggacagacgattatttctggtatgggggaattgcatttggacatctatgttgaacgcatgcgaagagaatataaggtgcctgcctgactttaaaccttcccaatgttctcactctattgcttctcgacaaaacccttatttctgcttatttttggaaatatcaaataggttgatgcgactgtgggcaaaccccgtgtcaattttagggagactattactcagcgggcagagtttgattatttacataagaagcaaagtggaggagcaggtcaatacggtagagttacagggtgagtatcaaaaacttatagaccctaaatgatgtggtatggatccctgctaaaccattcctaacgatgtgtataattgttaggtacgtggaaccgctaccaccaggctctaaagagaagtttgaatttgaaaacatgattgttggacaagcaattccgtctggttttattccagcaattgagaaaggtttcaaagaagctgcaaactcgtgagtgatcttggtctctcaaattctttgtctttctcaatttctacttttttctcttgttttggttgaggaaatgttgttgtaagtgatagtgaaacgccctattccattgcaggggctcactaattggtcaccctgtagagaatcttagaatagtattgacagatggagcttcacacgcggtagattccagtgaacttgcgtttaaaatggctgcaatatacgcattcagactgtgttatacagcagctagaccggtgattctagaacctgttatgctggtcgagttgaaagtaccaacagagtttcagggcactgttgctggtgacatcaacaagtaaactctaaaaactctaaaccctttaacaataccatttctttctccttgtcctattagtataataagtcaaacttgtttcaatttcaggaggaaaggtataatcgttggaaacgatcaagagggtgatgattcagtaatcactgctaatgtaagaaccaatatagaaagcaaagtttcctttatcaacagtaattaacaacacgtaatgtgtgtttattaacaggtgcctttgaacaacatgtttggctactccacttctctccggtccatgacacaaggaaaaggagaattcacgatggaatacaaagaacattctgctgtgtccaatgaagtccaggctcagctcgtcaatgcttatagcgccagcaaagctactgaataagcaaacccttcaatccaatatattatggtttgttttctcataatgttgacataatttatttatacggttcacacaaccatcaaaatcactcaacataaactgcctaatgggctatgtcagaaaatcacttatgtttattgggccattaggtaggtcacattttttggtatccaccagtcccaatcattttgataatggtaaaccagcatatatctttcttctttttttccacgcaacaacagattcctacattaattctctctatatagtaagatagggtcaaaaacaagccaaccaaaaaatcgttagaaacaacaatcattgacatagagtcgtcttcacgtcaaatagaagaagaagtagcagtctctaacgaacgaggtcagactttttctttataacttcatctcaaagccactcctttagttttcttgaagaggagttggtgatg

SEQ ID NO: 28169 - DNA, 3003 bp, Unknown
  misc_feature (1)..( 3003): 2750-1469P.txt file - cDNA_ID_2994331; gDNA_ID_2214702; Annot_ID_136890
gccattgaaatggaggagcttttttggatgaggaaggaagtgagaatgaagcaaaaggcttatccagcaccagatcgtaaaaactgtaaagataattgtgttggggcttttaaagtaattatcaagtttctttacaaattggccacaatatattttataataacatttgaaccctcatatccttttgtttgaatttgggctcttcgctcactcctccctctttgtggcccaatgaagtttcttcaagcccatacaaaagtaactagtagtaatccacatcaaaccctataggcttgcggatacatcttaggtttactaaatcttaaaatagaaaagatcagtgaccatatgctaattcaacattttatttttacatactttggtcatttttaatatggactttgttttaattaagatcgattatactaactacaatcgcatatgacaccaacgagcaacgttaattgcttttatgattttaaaagtatgtgatttgcaaactaattaaaaggtgaccatatataaaagagtgtactacaaaaagggcctactactattcaattaacgttgctcgttagtgtcacgtggggaagttaaggttcccacttcccccaccacttctctcagttctcttcttctttttattgtcccattccaaattttaaccaacacatcaagcaaacttcattaatttatgttcagtgttgtagttgcaaacgttatttattattttacgtttacaagtttagaactagttcgaatcgtgataatcttgaataaatcataactttgttcatctaatcataagaacatagaactttgacatggtgtctccggatcttgttgacttagttctatcttaaagttaagctacacatattatagggaccccatattatagtacccaaacaaacaattagagagtttgtatgcaaatccataatatttaccgtagaattgtatgggtttaatgaggaaagaaaaagaaaagaaaaagaaaagaagagaaggacactgaaggagaatgtgatgctgctgaataaaagatacaatcaaaaaattgacaggcagtacaataatgataagtagtgtcatgacagctgacgactctactgcccaatcttgacgttatttatttttgtccattttttcttaagatattatttcaacttaaaagaagtagaaaataaaccataagtgcataacaatattccttttataaattgggttcaagatattgattcgattctgtttatttcaagtgtcgtggaactcaattttatgttatgcctgcctcggcaacaaagattttcgttcaagtggctctatgaaaataagttagggcaaactagatcgattgatgtaaacacaaatagagctaaatagtggagatagtaaactggtgattttgtttcgtaaatagtcaaaaggagggggtgacaaaaaatagatttgtcccttacctctaagagatatagagcaaaacgtttgcatagcgctgtaccatttccttctatattttatatatgtggatgtgcatggatctagctgatgacataacacggcaaaatcatttaacatttgattagcattggcatcaatatttgacgacgctcctcattatttatatatgtggatgtgctgatgtgcatgaatctagctgatgacataacctagtatatgtgcatggttttatggtgtgaacaagttttttttttttcttttcttggttttaggtgtgaactttaagttagagatgatcttcaaatctcacgaaccacaaacctccttgcacgttaagaatagcctctctttttttcttttgttgcttctagtctcagagtgtcttcgagatatgtgtagtctttagtgtaccctgagacctgagtacaagatcgaaaagaaaatatctcgaataacagagttgtgtttgctgtttttaccatttaattatgctaatatctttgttttacataataccaattgaaaaatgaatacataattcaagtttggaccattcttgtatatccacttttggcttcgtggccccgatagctaatttgattgaccttatcatctacaccaaacaagaaattaaattgtcaaattaatttagtggtggccctatactataaaatcgtaaacacttctttttgaaactaaatataaaccttacgacacatttatgtgcaaattagtggacatattcctcagtaataacgtttttacaaacctacagttggataaattattgagtcactccatgattaaaccaacaacataagagaaaaataaaatagtacactacgaatgatcttttaaatatgttattcttttttgatacagaaactttaactaccaaaaaaaaaaagcgaatgattcataaaaacgcaatgtggtatgtttggtctgttttttagttcgaatctcaacttcttgttaccacaaaaataaaacattacacaatgtaaatttactgttcagtcttgcttttccaatcactacattagcacatattcttcacatgtattttccactaatctcgcgacaaaatgttcacagtgtttctcagtttctctctctcaatattttcttgtcaaacaacatgcatatttgaacccgcatggtgaaatagcatcggcattaacatgatcaaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcagatgagtatg

SEQ ID NO: 28170 - DNA, 3003 bp, Unknown
  misc_feature (1)..( 3003): 2750-1469P.txt file - cDNA_ID_2994331; gDNA_ID_2214702; Annot_ID_189712
gctgtcgccattgaaatggaggagcttttttggatgaggaaggaagtgagaatgaagcaaaaggcttatccagcaccagatcgtaaaaactgtaaagataattgtgttggggcttttaaagtaattatcaagtttctttacaaattggccacaatatattttataataacatttgaaccctcatatccttttgtttgaatttgggctcttcgctcactcctccctctttgtggcccaatgaagtttcttcaagcccatacaaaagtaactagtagtaatccacatcaaaccctataggcttgcggatacatcttaggtttactaaatcttaaaatagaaaagatcagtgaccatatgctaattcaacattttatttttacatactttggtcatttttaatatggactttgttttaattaagatcgattatactaactacaatcgcatatgacaccaacgagcaacgttaattgcttttatgattttaaaagtatgtgatttgcaaactaattaaaaggtgaccatatataaaagagtgtactacaaaaagggcctactactattcaattaacgttgctcgttagtgtcacgtggggaagttaaggttcccacttcccccaccacttctctcagttctcttcttctttttattgtcccattccaaattttaaccaacacatcaagcaaacttcattaatttatgttcagtgttgtagttgcaaacgttatttattattttacgtttacaagtttagaactagttcgaatcgtgataatcttgaataaatcataactttgttcatctaatcataagaacatagaactttgacatggtgtctccggatcttgttgacttagttctatcttaaagttaagctacacatattatagggaccccatattatagtacccaaacaaacaattagagagtttgtatgcaaatccataatatttaccgtagaattgtatgggtttaatgaggaaagaaaaagaaaagaaaaagaaaagaagagaaggacactgaaggagaatgtgatgctgctgaataaaagatacaatcaaaaaattgacaggcagtacaataatgataagtagtgtcatgacagctgacgactctactgcccaatcttgacgttatttatttttgtccattttttcttaagatattatttcaacttaaaagaagtagaaaataaaccataagtgcataacaatattccttttataaattgggttcaagatattgattcgattctgtttatttcaagtgtcgtggaactcaattttatgttatgcctgcctcggcaacaaagattttcgttcaagtggctctatgaaaataagttagggcaaactagatcgattgatgtaaacacaaatagagctaaatagtggagatagtaaactggtgattttgtttcgtaaatagtcaaaaggagggggtgacaaaaaatagatttgtcccttacctctaagagatatagagcaaaacgtttgcatagcgctgtaccatttccttctatattttatatatgtggatgtgcatggatctagctgatgacataacacggcaaaatcatttaacatttgattagcattggcatcaatatttgacgacgctcctcattatttatatatgtggatgtgctgatgtgcatgaatctagctgatgacataacctagtatatgtgcatggttttatggtgtgaacaagttttttttttttcttttcttggttttaggtgtgaactttaagttagagatgatcttcaaatctcacgaaccacaaacctccttgcacgttaagaatagcctctctttttttcttttgttgcttctagtctcagagtgtcttcgagatatgtgtagtctttagtgtaccctgagacctgagtacaagatcgaaaagaaaatatctcgaataacagagttgtgtttgctgtttttaccatttaattatgctaatatctttgttttacataataccaattgaaaaatgaatacataattcaagtttggaccattcttgtatatccacttttggcttcgtggccccgatagctaatttgattgaccttatcatctacaccaaacaagaaattaaattgtcaaattaatttagtggtggccctatactataaaatcgtaaacacttctttttgaaactaaatataaaccttacgacacatttatgtgcaaattagtggacatattcctcagtaataacgtttttacaaacctacagttggataaattattgagtcactccatgattaaaccaacaacataagagaaaaataaaatagtacactacgaatgatcttttaaatatgttattcttttttgatacagaaactttaactaccaaaaaaaaaaagcgaatgattcataaaaacgcaatgtggtatgtttggtctgttttttagttcgaatctcaacttcttgttaccacaaaaataaaacattacacaatgtaaatttactgttcagtcttgcttttccaatcactacattagcacatattcttcacatgtattttccactaatctcgcgacaaaatgttcacagtgtttctcagtttctctctctcaatattttcttgtcaaacaacatgcatatttgaacccgcatggtgaaatagcatcggcattaacatgatcaaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcagatg

SEQ ID NO: 28171 - DNA, 3000 bp, Unknown; identical to SEQ ID NO: 8343
  misc_feature (1)..( 3000): 2750-1469P.txt file - cDNA_ID_2994335; gDNA_ID_2214705; Annot_ID_136944

SEQ ID NO: 28172 - DNA, 3000 bp, Unknown; identical to SEQ ID NO: 8343
  misc_feature (1)..( 3000): 2750-1469P.txt file - cDNA_ID_2994335; gDNA_ID_2214705; Annot_ID_189805

SEQ ID NO: 28173 - DNA, 3000 bp, Unknown; identical to SEQ ID NO: 8343
  misc_feature (1)..( 3000): 2750-1469P.txt file - cDNA_ID_2994335; gDNA_ID_1971751; Annot_ID_175321

SEQ ID NO: 28174 - DNA, 3000 bp, Unknown; identical to SEQ ID NO: 11689
  misc_feature (1)..( 3000): 2750-1469P.txt file - cDNA_ID_2994339; gDNA_ID_2214510; Annot_ID_184224

SEQ ID NO: 28175 - DNA, 3000 bp, Unknown; identical to SEQ ID NO: 11730
  misc_feature (1)..( 3000): 2750-1469P.txt file - cDNA_ID_2994343; gDNA_ID_2214513; Annot_ID_133891

SEQ ID NO: 28176 - DNA, 3000 bp, Unknown; identical to SEQ ID NO: 12246
  misc_feature (1)..( 3000): 2750-1469P.txt file - cDNA_ID_2994352; gDNA_ID_2214539; Annot_ID_134435

SEQ ID NO: 28177 - DNA, 423 bp, Unknown
  misc_feature (1)..( 423): 2750-1469P.txt file - cDNA_ID_2994360; gDNA_ID_2214547; Annot_ID_134603
gtttgaactttgatgtttacaaaaaaaactcatttagtaagacacataatgttgttctactgaggaaaatattatattttcatgcaatggtttcggtttgtcacaaaactcattttatttaaaagccggatgaatttaatgggcctaatataaaaggcccaataagccactggttagagtatatgtggactggtttcaccaccgccgcaaaaagggagactgagataaattcgtacagcaatcggagttactatgtggacagtgaaactggcggcgatgccggttcaatttctcatggagcaatctccgttggctatttacagccaccaccaccgcataaagtaatgatcaagaattcttctgaaattttctgagctcaatttcttattctgtgaattgatttgtggcaagagcgactccatg

SEQ ID NO: 28178 - DNA, 3000 bp, Unknown; identical to SEQ ID NO: 12411
  misc_feature (1)..( 3000): 2750-1469P.txt file - cDNA_ID_2994364; gDNA_ID_2214548; Annot_ID_134623

SEQ ID NO: 28179 - DNA, 3000 bp, Unknown; identical to SEQ ID NO: 12412
  misc_feature (1)..( 3000): 2750-1469P.txt file - cDNA_ID_2994364; gDNA_ID_2214548; Annot_ID_185495

SEQ ID NO: 28180 - DNA, 3003 bp, Unknown
  misc_feature (1)..( 3003): 2750-1469P.txt file - cDNA_ID_2994378; gDNA_ID_2214555; Annot_ID_134770
tcgtgtagaaagtcgacgtttacgttcttctttgaaaccagagtgataattccggttcgagcaaataattaactcgtgtcttctcatgtatgttggattaattatttggttgtggttaatattaatgctcgttagtcgttaaaaaaactaaatattttaattgtcccagtgacagaaaccaatttcacatgaaaaaaggaaaaagctaattttgtcaacagttcacatatattgacattgaacacaactccggttcgacaaaaaaaaagaacacaactccggtcaactatttttggcagttgtaattaagaacaaaaagatgtaacttaaagaagagacaatttaaccgattagttcaaatctttggtcatcaaaaattccacaagttttaagaagactgattggtgattaataaacgttaaaaaaaaaaaaaaagccaagtcaaagatgtgtcggtaatagcgattgaccaaactctatctgttttagagcatcattaatggtagtttcttagcataattttaatatagtttttatgaatatttttataattgattttgaaaattctgaagttaaaaacttggttaagagattgaaatttaggcaatatgcaatggtggaatcttaacttggagttcttaaaaagaaaatttgaaaaaaaaaatagaaacattataattttaaaaaacttaatagttattacaactcataaaatttaaaacatacatgacataaaattttaaacaaatatgacaaacaattctatttaatacttaagttatctaaaaattaagattaattaaattaaaatattatatttaagacctaatttatctaagaattaacttaaaaaacattagatttggctcttatataagagctattcttaaccattaattgaattataacattaaatttaagatctactttatctaaaaactaacctaaaaaactatcaataatgatggtcttacgaatgcctagattctcttcaatatacaaaaagtacggtttagttattgtttggacatttgaaatctaactaattctctttttagtcttaatgcaatggaattgcaaatactccataaaccatagtgttgcaccctaaccgtatctctctctaaaagagaatctagtcaacaagattatgtttaatctctaattaatgacaataagatttactgccaaaataaataaataaataataataataagatttactgccatttattcttctatatttttcaattttttatttacacttgttccataatcgtcccaaggagtagactagggttgatgctctttcatctataaaacgacttaacacaacatgttctttcacatcatcatcataagcctcaacaatccatcaccatacatattagattctccctctttccatagtttatttttggttcgttttattgtaaaaagatatcaaactctttttgggggacattcgttcttcaagtgtaacagaaggagctcccttcctccaaaacgaagaggacaagatttgaggaactaaaatgcagaatctaagagttcatgtcttcctcatagagagtgcgcggtgttaaaagcttgaagaaagcacactttaaggggattgcacgacctcttagattctccctctttctctacatatcattctcttctcttcgtttggattgaagggagctccttttcttcttctcttaattagtctctgttcttcaaaacttggtttcgatctaacttgttttctttttctctagtgcattttttttttcaggttgtcatgtttatttgcaggtgtttgtggttgatgcttgcatggaagcaatattaatgttgtttatttacgagaagacgttcgtgtgccaatttgaaaatatgatattaatggaaatacagattaaaactgacaaatgtataaatatttcttgttccttgttttaattttaacattagtcgtgtgtttgtcgtaaatacgaaggggacatttcacctaaaaaaagaaaaaaatatattcatcaaaactggtcttggatacgtttttagttaaaacaagaacaataataaagttaggtttaacttcgatcagatcgaaacaagtacactataattgttttggtttgagaaaatataccatcgatggtttcaagaaataatagcagctgggttgcttgtagtcgatacgttaagtcgtatcatctcaaatgatccctagtagtacacaacatagtcaactggtttgtcatgtgttggcctacgaagaaatgtataccggccggatttcaatttataaattagtccttttttttttgtcaagttatcattgcatagccaagtttcactcggtcaaaatctaattaacaaagtctgtaaaacgttgaagtaattgtattttattaaaagaaaactccaaattagactttgattccaacgaatatttaacgacataaaaggcattgccgtttgttgaacgagttgtcttcttaccaaatttgacgctttccaactaaatacactcctaattttgcctattacctttttcctcctctaattaagtaaatgctaaatttcccccaaatactaaaaatcgaatccgataagtcaaaatcaaaatcgtacctacgcgatttatgcaaaataccggaaaaagaaccaaagtgcttattacaatcaaaagaccaaaccggttaaacaattagttaggctggcattaacgaacctctttgtctttaattagcctttatccgtcaccgccctgttaccataaccgttcaacgtcgacccgctctttgtttcagaaaaaaaaaacagagaaagacttttttagtgtttctttgtcattttcgttcctcaaaaaaaccttttcgaatttgacccttattgttatcctgattcttctgctcggttctcgccggagagaagacacggagaagagggttttcgaaaaggaggatgagaggttccaataacaccgatctatttgaccctaagacggagatg

SEQ ID NO: 28181 - DNA, 3003 bp, Unknown
  misc_feature (1)..( 3003): 2750-1469P.txt file - cDNA_ID_2994378; gDNA_ID_2214555; Annot_ID_185700
cagggaagataatcatcgtactctcaaggataagctgatggaagctcgtgtagaaagtcgacgtttacgttcttctttgaaaccagagtgataattccggttcgagcaaataattaactcgtgtcttctcatgtatgttggattaattatttggttgtggttaatattaatgctcgttagtcgttaaaaaaactaaatattttaattgtcccagtgacagaaaccaatttcacatgaaaaaaggaaaaagctaattttgtcaacagttcacatatattgacattgaacacaactccggttcgacaaaaaaaaagaacacaactccggtcaactatttttggcagttgtaattaagaacaaaaagatgtaacttaaagaagagacaatttaaccgattagttcaaatctttggtcatcaaaaattccacaagttttaagaagactgattggtgattaataaacgttaaaaaaaaaaaaaaagccaagtcaaagatgtgtcggtaatagcgattgaccaaactctatctgttttagagcatcattaatggtagtttcttagcataattttaatatagtttttatgaatatttttataattgattttgaaaattctgaagttaaaaacttggttaagagattgaaatttaggcaatatgcaatggtggaatcttaacttggagttcttaaaaagaaaatttgaaaaaaaaaatagaaacattataattttaaaaaacttaatagttattacaactcataaaatttaaaacatacatgacataaaattttaaacaaatatgacaaacaattctatttaatacttaagttatctaaaaattaagattaattaaattaaaatattatatttaagacctaatttatctaagaattaacttaaaaaacattagatttggctcttatataagagctattcttaaccattaattgaattataacattaaatttaagatctactttatctaaaaactaacctaaaaaactatcaataatgatggtcttacgaatgcctagattctcttcaatatacaaaaagtacggtttagttattgtttggacatttgaaatctaactaattctctttttagtcttaatgcaatggaattgcaaatactccataaaccatagtgttgcaccctaaccgtatctctctctaaaagagaatctagtcaacaagattatgtttaatctctaattaatgacaataagatttactgccaaaataaataaataaataataataataagatttactgccatttattcttctatatttttcaattttttatttacacttgttccataatcgtcccaaggagtagactagggttgatgctctttcatctataaaacgacttaacacaacatgttctttcacatcatcatcataagcctcaacaatccatcaccatacatattagattctccctctttccatagtttatttttggttcgttttattgtaaaaagatatcaaactctttttgggggacattcgttcttcaagtgtaacagaaggagctcccttcctccaaaacgaagaggacaagatttgaggaactaaaatgcagaatctaagagttcatgtcttcctcatagagagtgcgcggtgttaaaagcttgaagaaagcacactttaaggggattgcacgacctcttagattctccctctttctctacatatcattctcttctcttcgtttggattgaagggagctccttttcttcttctcttaattagtctctgttcttcaaaacttggtttcgatctaacttgttttctttttctctagtgcattttttttttcaggttgtcatgtttatttgcaggtgtttgtggttgatgcttgcatggaagcaatattaatgttgtttatttacgagaagacgttcgtgtgccaatttgaaaatatgatattaatggaaatacagattaaaactgacaaatgtataaatatttcttgttccttgttttaattttaacattagtcgtgtgtttgtcgtaaatacgaaggggacatttcacctaaaaaaagaaaaaaatatattcatcaaaactggtcttggatacgtttttagttaaaacaagaacaataataaagttaggtttaacttcgatcagatcgaaacaagtacactataattgttttggtttgagaaaatataccatcgatggtttcaagaaataatagcagctgggttgcttgtagtcgatacgttaagtcgtatcatctcaaatgatccctagtagtacacaacatagtcaactggtttgtcatgtgttggcctacgaagaaatgtataccggccggatttcaatttataaattagtccttttttttttgtcaagttatcattgcatagccaagtttcactcggtcaaaatctaattaacaaagtctgtaaaacgttgaagtaattgtattttattaaaagaaaactccaaattagactttgattccaacgaatatttaacgacataaaaggcattgccgtttgttgaacgagttgtcttcttaccaaatttgacgctttccaactaaatacactcctaattttgcctattacctttttcctcctctaattaagtaaatgctaaatttcccccaaatactaaaaatcgaatccgataagtcaaaatcaaaatcgtacctacgcgatttatgcaaaataccggaaaaagaaccaaagtgcttattacaatcaaaagaccaaaccggttaaacaattagttaggctggcattaacgaacctctttgtctttaattagcctttatccgtcaccgccctgttaccataaccgttcaacgtcgacccgctctttgtttcagaaaaaaaaaacagagaaagacttttttagtgtttctttgtcattttcgttcctcaaaaaaaccttttcgaatttgacccttattgttatcctgattcttctgctcggttctcgccggagagaagacacggagaagagggttttcgaaaaggaggatg

SEQ ID NO: 28182 - DNA, 3000 bp, Unknown; identical to SEQ ID NO: 12522
  misc_feature (1)..( 3000): 2750-1469P.txt file - cDNA_ID_2994382; gDNA_ID_2214555; Annot_ID_134773

SEQ ID NO: 28183 - DNA, 3000 bp, Unknown; identical to SEQ ID NO: 12494
  misc_feature (1)..( 3000): 2750-1469P.txt file - cDNA_ID_2994382; gDNA_ID_2214555; Annot_ID_185704

SEQ ID NO: 28184 - DNA, 3000 bp, Unknown; identical to SEQ ID NO: 14229
  misc_feature (1)..( 3000): 2750-1469P.txt file - cDNA_ID_2994430; gDNA_ID_2214712; Annot_ID_136981

SEQ ID NO: 28185 - DNA, 3000 bp, Unknown; identical to SEQ ID NO: 14226
  misc_feature (1)..( 3000): 2750-1469P.txt file - cDNA_ID_2994430; gDNA_ID_2214712; Annot_ID_189918

SEQ ID NO: 28186 - DNA, 3000 bp, Unknown; identical to SEQ ID NO: 11854
  misc_feature (1)..( 3000): 2750-1469P.txt file - cDNA_ID_2994434; gDNA_ID_2214519; Annot_ID_134033

SEQ ID NO: 28187 - DNA, 849 bp, Unknown; identical to SEQ ID NO: 12120
  misc_feature (1)..( 849): 2750-1469P.txt file - cDNA_ID_2994444; gDNA_ID_2214531; Annot_ID_134298

SEQ ID NO: 28188 - DNA, 774 bp, Unknown; identical to SEQ ID NO: 12106
  misc_feature (1)..( 774): 2750-1469P.txt file - cDNA_ID_2994444; gDNA_ID_2214531; Annot_ID_184951

SEQ ID NO: 28189 - DNA, 3003 bp, Unknown
  misc_feature (1)..( 3003): 2750-1469P.txt file - cDNA_ID_2994456; gDNA_ID_2214558; Annot_ID_134825
aatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaagatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtctttttgtaaagcagttttcatgttagataaacgagattttaattttttttaaaaagaagtaaactaactatgttcctatctacacacctataattttgaaacaattacaaaaacaaacaatgaaaatgcaaagaaggacgtaggcactgtcacactacaaatacgttaataaaatgtattttggtcgaattataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatctcctattgcaaacgaacataaaacactacctaagagatcaatatggctggagtgatgaagttggcatgcttgctcttggcctgcatgattgtggccggtccaatcacatcgaacgctgcgctaagctgtggctcagttaacagcaacttggcagcgtgcattggctacgtgctccaaggtggtgtcattcccccagcgtgttgctccggcgttaaaaacctcaacagcatagccaagacgaccccagaccgtcagcaagcttgcaattgcattcaaggtgccgctagagccttaggctctggtctcaacgctggccgtgcagctggaattcctaaggcatgtggagtcaatattccttacaaaatcagcaccagcaccaactgcaaaacgtatgttaatctctctcactctctcagatatttaagctataatttgtttctttttggggttaaatattcgaaaggttatattaacggtgttatattaatttgtatatatgtggttgcagcgtgaggtgatgagctagcaacggtgagatgatgctactaccggaagtttcgaatccttattatataatggatgagattaatattaaataagatgttcgaatgtttgtttttagagtttttaatttcttgtctttttctattgtggtgttcttgttatatgggtttgtctgtactatgttcgcaggcaacaacgttatatgaaatttcagagtacttgaagtttaagtttttctatattcttacttattaaatcttgcattagtttaatcgatatgaaactgattaatcaatatcgagtatggcaacattttgtgtaataacggaaatctgaggaccaaaatccacactaattttcggatttgtgaaaagctaaatattcgtcaataattggggacgtgatggaaccaatttataagaggaaataaagtaactccaagtttctatttccacaaaaggatataatctccaagtttgtagtaatattgaacacgtgtttagataaccgagaaaaagatggattggttccataattagtgttaaaaactctttaaccccaaattcatgaaaaaccaaagtttagttatagagacatacgtacacgtgttcaaagaaaattattggcgatggaaaattgggtgtatctgcattttcgtcattaccgtcctttacatggaattttggtagatcctgctttaaatgccttcacttctgcttctcccaaccataataaattgatatggatgcgatccattggtatttggtagatagatggtattattgtcccctcttaatggatttctttttaattttaaatatctaaattttgcctgaactatacataaattccgtaactatgtctataattatcatctcattgtttcaaagtgatacttttcttctgcaaacaataaaattgttgaagtcagttgttgactcaaggtttattagaacaaaagtcaggtttttagctcattaaagtcaaccggataaagacgaccggtctaattcggtttgggatttagaaagactctatatcgctcagagggtctaacgcagacgcttttcaactttcgagatatttttcttaggtatatatttccaaatgttacggcgtcgttttcaaaaacatatttttgttgttgcgtagtagtccttcggaaattctttgcttcctagttgaagcactcacaacacacagcttttgtaggaatccctaagcttaaagtctctattattctctaatctcttcttcgccgacgacttctctcaccaaggcgacgttttgatcaggcgatgatgagtatcccaatggagttaatg

SEQ ID NO: 28190 - DNA, 3003 bp, Unknown
  misc_feature (1)..( 3003): 2750-1469P.txt file - cDNA_ID_2994456; gDNA_ID_2214558; Annot_ID_185795
ctttagtttaatcgatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaagatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtctttttgtaaagcagttttcatgttagataaacgagattttaattttttttaaaaagaagtaaactaactatgttcctatctacacacctataattttgaaacaattacaaaaacaaacaatgaaaatgcaaagaaggacgtaggcactgtcacactacaaatacgttaataaaatgtattttggtcgaattataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatctcctattgcaaacgaacataaaacactacctaagagatcaatatggctggagtgatgaagttggcatgcttgctcttggcctgcatgattgtggccggtccaatcacatcgaacgctgcgctaagctgtggctcagttaacagcaacttggcagcgtgcattggctacgtgctccaaggtggtgtcattcccccagcgtgttgctccggcgttaaaaacctcaacagcatagccaagacgaccccagaccgtcagcaagcttgcaattgcattcaaggtgccgctagagccttaggctctggtctcaacgctggccgtgcagctggaattcctaaggcatgtggagtcaatattccttacaaaatcagcaccagcaccaactgcaaaacgtatgttaatctctctcactctctcagatatttaagctataatttgtttctttttggggttaaatattcgaaaggttatattaacggtgttatattaatttgtatatatgtggttgcagcgtgaggtgatgagctagcaacggtgagatgatgctactaccggaagtttcgaatccttattatataatggatgagattaatattaaataagatgttcgaatgtttgtttttagagtttttaatttcttgtctttttctattgtggtgttcttgttatatgggtttgtctgtactatgttcgcaggcaacaacgttatatgaaatttcagagtacttgaagtttaagtttttctatattcttacttattaaatcttgcattagtttaatcgatatgaaactgattaatcaatatcgagtatggcaacattttgtgtaataacggaaatctgaggaccaaaatccacactaattttcggatttgtgaaaagctaaatattcgtcaataattggggacgtgatggaaccaatttataagaggaaataaagtaactccaagtttctatttccacaaaaggatataatctccaagtttgtagtaatattgaacacgtgtttagataaccgagaaaaagatggattggttccataattagtgttaaaaactctttaaccccaaattcatgaaaaaccaaagtttagttatagagacatacgtacacgtgttcaaagaaaattattggcgatggaaaattgggtgtatctgcattttcgtcattaccgtcctttacatggaattttggtagatcctgctttaaatgccttcacttctgcttctcccaaccataataaattgatatggatgcgatccattggtatttggtagatagatggtattattgtcccctcttaatggatttctttttaattttaaatatctaaattttgcctgaactatacataaattccgtaactatgtctataattatcatctcattgtttcaaagtgatacttttcttctgcaaacaataaaattgttgaagtcagttgttgactcaaggtttattagaacaaaagtcaggtttttagctcattaaagtcaaccggataaagacgaccggtctaattcggtttgggatttagaaagactctatatcgctcagagggtctaacgcagacgcttttcaactttcgagatatttttcttaggtatatatttccaaatgttacggcgtcgttttcaaaaacatatttttgttgttgcgtagtagtccttcggaaattctttgcttcctagttgaagcactcacaacacacagcttttgtaggaatccctaagcttaaagtctctattattctctaatctcttcttcgccgacgacttctctcaccaaggcgacgttttgatcaggcgatg

SEQ ID NO: 28191 - DNA, 3003 bp, Unknown
  misc_feature (1)..( 3003): 2750-1469P.txt file - cDNA_ID_2994460; gDNA_ID_2214567; Annot_ID_134982
ataatttggtcaactatttcccatcataaatatgacattactatatgagtgagtatatagatatttcgtcaaaatgaacgcaccgatcaatggaaaataaaaggcacccatcaatgagaaccttataataaaacacacacacacaaattccgtatagaccaggtttcagtatttttgttagtttggagtgtaataactcttttttttttcttggagtaaaaatgagtacaagtaccttagtgaacaaatttattgttttgttggaattaaactgttgatcaataattcgacacgacagtaaataactcactgggacaaccaaaaaagtcatattaattcatggaacatatatatgctgacaaacaaaaacaaatcatggaacatctatttggtgttttccaaaagcaaatatcgtctttaagtcagaaaatgcaaacaattttggccgcaaaaaaaagcatgggttagaaagtttgaaagaaatcgagttatatcaaactggtgaaaattggcgacacaatctgttttttactgaatatgtttctattaaaacgagttcggttgtgatgtttactcaactagtagaaaaaaaaaaaaaaaaaaagaagaaaaacgccattctggtcaacaaattttgggccaatattccaaatacacgttactatattttcgattgaaatgtcgtattgtaattaatacagtatagtagtagaacaatattagagacacgtacgtaggtttggttagatgcttttgtctataactctatgccaagtaatgattggtgattcgtcaatcgtaattctttttttttatatataaacccaaataatttgctttacaatctctgaattctatgttttgagatcatccatattccaatctaactgtcgttaaggctcttctttcaaaggaagaccctatttgcaagttggacacagacggacaagttctcaacgattaggagaaaatcgttaggactaatcaaagttttagataggtaccactacctaaataaactatgtacgaggacgatacatccagtacaagagaaatatatatgcaacctcatcatataaaatcatagtcacgagattttatgacagatcttagtcgtacataaatggctgacagatttgcatgatatattgcaatgatatatttttttttaacccaaaacattttaccagcttatatcaacaatagacatatatataatctgaaataaggaatctaataaaatagctcttaatattgaatttaaagaagaaaaaaagtgaaacaaagcattcgagatttgatgtcgaagtccacatcgggaagcgaaggtcatcaaacggccacttggactccgatgagaaaatttcaagtgggctgcttgttggcttttagtataatattgaccacaaattatttatatgctttttagttataatatgcagatattgtatctatataatactccatgaatagtatacatatgagtgtgtttctttttgttaaatatccaaggaagagtgcataatcattttggaaccatttatgtttaaataataaaatttatgatatatatactgtatcaaaataactatgtgttattagagaaaatgaagatatagtcattaagttaggtaatttaatatgtacaatattttaagaatatcatgtcattttataaatttatattatttcaaaccaaactaaattgctttagcttctgtcgaaactgcctactatttaaatttgtttttctaaaaacttctttgatcgaattagctttcccgaagttctagtacaattctaaaaattgtgtactagaatctacaaatagcatattaaactttaaatttcctttgaactagcttgtacataaactaccatttcttttcttgtttatttgtgacttaagtgttaaaatttttcttcacaccatctagcaaaacacctaacattgttccctttccaataatcgaatcgcctatcctacaatcatcgataatttagtataggatctagaagacttactatgactaattttgacaatggtgaaataatcaaactttttttattaaactaatgtgttgtattggatcagaaaacatgatttacataatgtttgtaacattgatatcaccccctacatgtatattaaaagccttatcgactccaaatttttaccgaaaaaattgaaaaattgttcaaaaacacagttttaggatctcattatacagatcaaatcacacgaattcatatcataataatttttttggaagtccggttattttactaatttgatccaacatatctatgatgaatcttagttaagatgtggtgatcactcaaacagtaaatttgtaaattttgttcattaaaatcagtttcttgtggacaaaaccatcctatttttggcaaatcaaagaaaatataattaatctcaaagaaaaaagctacaagaaaaaaaaaatggcctcaaaataaaaatagaaaatatctgacaagactgcccgaaatcacaagtaactgtaacaaaactgacaacgggcaaaaaaaaaaaaaaaaaaaaaaaaaactgcccgtcgggcaaatcctccaatagagagtcgtctctctttatctccgtctctctcttttttttttaatcaactttataaaaaaaacaaaaaaaaaatttaaaaattaatatcttctcaacaaatgactctatcaatgtgtacataaatgtgaatcttcttccctcttcttcttctccattgttaaaagctctcacacaaccaccgttctccgtcacggtggcgctttattctctcatcggagcgcctcaccggtggcagacggtgtcgttgttcctctcctaaaacctccatcaatcaccatctctttacacagagctctaaccaaaatcttcgagagatggggcagagtatgagctgtggaagtcgaccggagcacggaatattcgcctctgtacagtgcggcgatatcatcactatccgtcgtgtgatg

SEQ ID NO: 28192 - DNA, 3003 bp, Unknown
  misc_feature (1)..( 3003): 2750-1469P.txt file - cDNA_ID_2994460; gDNA_ID_2214567; Annot_ID_186054
cccataccaccacaacacgctttgaatcatcttcaatagatgataagagtcatgtagtaaacgctatacgactattcagtaagaaaataaataatttggtcaactatttcccatcataaatatgacattactatatgagtgagtatatagatatttcgtcaaaatgaacgcaccgatcaatggaaaataaaaggcacccatcaatgagaaccttataataaaacacacacacacaaattccgtatagaccaggtttcagtatttttgttagtttggagtgtaataactcttttttttttcttggagtaaaaatgagtacaagtaccttagtgaacaaatttattgttttgttggaattaaactgttgatcaataattcgacacgacagtaaataactcactgggacaaccaaaaaagtcatattaattcatggaacatatatatgctgacaaacaaaaacaaatcatggaacatctatttggtgttttccaaaagcaaatatcgtctttaagtcagaaaatgcaaacaattttggccgcaaaaaaaagcatgggttagaaagtttgaaagaaatcgagttatatcaaactggtgaaaattggcgacacaatctgttttttactgaatatgtttctattaaaacgagttcggttgtgatgtttactcaactagtagaaaaaaaaaaaaaaaaaaagaagaaaaacgccattctggtcaacaaattttgggccaatattccaaatacacgttactatattttcgattgaaatgtcgtattgtaattaatacagtatagtagtagaacaatattagagacacgtacgtaggtttggttagatgcttttgtctataactctatgccaagtaatgattggtgattcgtcaatcgtaattctttttttttatatataaacccaaataatttgctttacaatctctgaattctatgttttgagatcatccatattccaatctaactgtcgttaaggctcttctttcaaaggaagaccctatttgcaagttggacacagacggacaagttctcaacgattaggagaaaatcgttaggactaatcaaagttttagataggtaccactacctaaataaactatgtacgaggacgatacatccagtacaagagaaatatatatgcaacctcatcatataaaatcatagtcacgagattttatgacagatcttagtcgtacataaatggctgacagatttgcatgatatattgcaatgatatatttttttttaacccaaaacattttaccagcttatatcaacaatagacatatatataatctgaaataaggaatctaataaaatagctcttaatattgaatttaaagaagaaaaaaagtgaaacaaagcattcgagatttgatgtcgaagtccacatcgggaagcgaaggtcatcaaacggccacttggactccgatgagaaaatttcaagtgggctgcttgttggcttttagtataatattgaccacaaattatttatatgctttttagttataatatgcagatattgtatctatataatactccatgaatagtatacatatgagtgtgtttctttttgttaaatatccaaggaagagtgcataatcattttggaaccatttatgtttaaataataaaatttatgatatatatactgtatcaaaataactatgtgttattagagaaaatgaagatatagtcattaagttaggtaatttaatatgtacaatattttaagaatatcatgtcattttataaatttatattatttcaaaccaaactaaattgctttagcttctgtcgaaactgcctactatttaaatttgtttttctaaaaacttctttgatcgaattagctttcccgaagttctagtacaattctaaaaattgtgtactagaatctacaaatagcatattaaactttaaatttcctttgaactagcttgtacataaactaccatttcttttcttgtttatttgtgacttaagtgttaaaatttttcttcacaccatctagcaaaacacctaacattgttccctttccaataatcgaatcgcctatcctacaatcatcgataatttagtataggatctagaagacttactatgactaattttgacaatggtgaaataatcaaactttttttattaaactaatgtgttgtattggatcagaaaacatgatttacataatgtttgtaacattgatatcaccccctacatgtatattaaaagccttatcgactccaaatttttaccgaaaaaattgaaaaattgttcaaaaacacagttttaggatctcattatacagatcaaatcacacgaattcatatcataataatttttttggaagtccggttattttactaatttgatccaacatatctatgatgaatcttagttaagatgtggtgatcactcaaacagtaaatttgtaaattttgttcattaaaatcagtttcttgtggacaaaaccatcctatttttggcaaatcaaagaaaatataattaatctcaaagaaaaaagctacaagaaaaaaaaaatggcctcaaaataaaaatagaaaatatctgacaagactgcccgaaatcacaagtaactgtaacaaaactgacaacgggcaaaaaaaaaaaaaaaaaaaaaaaaaactgcccgtcgggcaaatcctccaatagagagtcgtctctctttatctccgtctctctcttttttttttaatcaactttataaaaaaaacaaaaaaaaaatttaaaaattaatatcttctcaacaaatgactctatcaatgtgtacataaatgtgaatcttcttccctcttcttcttctccattgttaaaagctctcacacaaccaccgttctccgtcacggtggcgctttattctctcatcggagcgcctcaccggtggcagacggtgtcgttgttcctctcctaaaacctccatcaatcaccatctctttacacagagctctaaccaaaatcttcgagagatg

SEQ ID NO: 28193 - DNA, 3003 bp, Unknown
  misc_feature (1)..( 3003): 2750-1469P.txt file - cDNA_ID_2994464; gDNA_ID_2214571; Annot_ID_135073
aaagggcaaaatggtaattataggtcaccggaggcatcaaagataagggcaaagatattgtacgcaacgtcgaaagatgggctgaggagagtgttggaagggattcactatgaacttcaagctactgatccgacggagatgggtttcgatattatccaagaccgtgccaaatagattgatcacttaagagaatatgatttgactcactttgtcaataattaacattaattaggtcatcggttaatgtttaattattgctggttagtgcttactcttttttgagtttattatccttgatcagtcttaccggcactatcctttaattatgacgtttgtgttttgattgtgttgttaaaatatttttttgtcggttaagcaaacataaaaagctacgaatttgtcctacgagtaacggatattatacatttatgagagattttattttataggtcttgtggtcttctatataaatttgttgtgacttattgtgaaatattggccgtgtttgagatacatcgtgtatagaaaacatcatggattttttattttctggaattggaattattgggatgttgaaagctgagattgacaatagtagagttggtaagaagataaagttcggacaattacgtatgaagaagagattagatttgtccatctttaacgacgttgacattagtcttttttaaagtcaacttttctttttgtagtcaattaagttgggtctaatttgcctccgtgtcgtgtttaagcatttatgagtttttttctgaacagaactgtgtattagaagatttcaatcaaatttttattgagcatatattattgtcgaagggaccatttatgtattatcgatatgatctttatgtctacaatagccaataggtttgtgcatcagcattacaagtaagatcgttacataccatattcagttttgatatagataatctgattatctaaaactattatccaaaatatattttaaaatacaatatttaatgaaaaataatgttgatttggatctacatagtccatattttcctatgaattccccacacgtcacattgtcaattacatatttgcttctctaatagacaccgacataccaaatcaacaaatcttatcatcatctccactttcactcagagaaagaaagagagcgaccatatttttatctgaatagaagaataaaaacgaacgtattgatctttttattttttatgactttctcttttctatgcatactccgaccaaagccagctgtttgattctgtaaatcaaataatgaatttgtactaaggggtttagacaaattcacttctttcttatctcacaagtaatcaaaggaaaataattaggatgtttgaataaaaagttagggtttgctctttaatagtggtctcttgaattaggttaaagatggatctaatagatggcaaaacccttctatttatacaatgaattcaatatatcaaaatatgataaacttctaattatctaagaattaaatcttcattacttctattctgcacgagatcctcttctctgaaatggaagtcttccctttacaaggtttaggaagtcggctgggcgacctcaattgtcaaattaggtcttctggcgatctcataacttaggccgattaacaggctaaccggggtaccccggttaaatcgagttctcgattttatacacattttcctccgatttaaaccggtattgtcggaggtgccaattcctgcaccaacaccagccatgcatttcaaatgagataatcctttatgaatattttcgaatgtcatgcaagatctagaatgagcattaggtctcaactatggcttgtacagggccgaatgagtaagcccaaaagagggtgatgtgtaaattgaagtccaagtcttgtacaatgcagcaatacaagagagagagttcttcttgtggttgtgtgtcaagtgtgtgtgattttttctgtgatcttgtaacacattcgtttttactttcttagtgagatagaaagagttttttgatatgtttctcctttgattaatagggaatgtaaagaagtacaaacggcaaatatatatcactaagaatagaaaagggaaacccttaaaactacagttacttggcataatagattcattcattagccatgatcagtcacaccccacgcgactcacaatgggataatctgagttacaagaacagagttccgcaccacatgtcttccaccacaaaccaagtaacagatccaaaaaaattttcagcaaaaaaatgcttttaaaaatccttgtaaattttttaaaaactcttttaaaaaacattgtaaatttttttaaaagttttggtagttgttataaacccttgtaaatcattttaaaacctattaaaatctttctagagtctttaaaaacatatgtaaatactttaaaacctctttttaaacctttgtaaatcattttaaaaccttttacaataggtttacaagatttacaagagtttttaagagttttaaaaggatttacaaagattttcaattatttctttttctttttattataagggaatcttaaaagagaccaccattgctcatgctcttagttttagattttatggtgctatatacttgaatagtttatgaaaattggttaccttttgtaattcaccgattatttttaaaatttatttgtctgttttttgtttgctccgtaacttatacggcaaattcgaaaatagtttaaatattcaacactgatagtactaaaaaaataatattttggtatataaacgagacgagtccaatttagttttagtatatttatatatctaaatataatttgaagatatttgtatttctttaagcaaaagaaaacagacttgttcattttccaacttcggtttagaaaaaaaaaaggagacgtcgtcgtcttctagcttctgattaagtctgataaattatgcccctaaatctgtaattctccaaggattcggattcgatcgatg

SEQ ID NO: 28194 - DNA, 3003 bp, Unknown; identical to SEQ ID NO: 28193
  misc_feature (1)..( 3003): 2750-1469P.txt file - cDNA_ID_2994464; gDNA_ID_2214571; Annot_ID_186185

SEQ ID NO: 28195 - DNA, 3003 bp, Unknown
  misc_feature (1)..( 3003): 2750-1469P.txt file - cDNA_ID_2994470; gDNA_ID_2214573; Annot_ID_135129
aagtcagccaatggaatggatcaacccattagatatatatgctcacaaaaaaaaattgattccatattcatttgcaaataaaaaatgaagtgacgtcttaaaactcacgtgaaaaataagctggagaatactactacacatggatggagaaggtagacagtagatatactcttttgatattgaatcaaatctgcctcttgttccctactagaagaatcttgttgacattgttagaagcgtgctgctcaatgttacggatcggattcctgatgtctactcacagtaataaaaaagaaaagaaaagaatgaatgtgatcttagtagataatatttgctaactaatatgtagaagtaagagaaaaaatagatctgttgcaaatgtaattttttgttgcacaaggcctgaaattgaactaattaaaactgtgatctaaaactaagagtaaagataatagtttagtttagaaagatgattcaactgtgacttgatacacaagtaaaatgccaatagctccaatatgtagtatgttacgataagatcaaaccagttacgcgatatttccagattcccaccataataaagaaggaacacatccataaaacaaacagctaaataaaggataaaaaagcaaaattaagtggatagattcttagagaatatcacaactaaacatgttgtgattataaaaaaaacggtcttatcacaaatctgatgcttaattcacttcccatcaagctgaatggtccataacttgaaattaatattgtcaacacgcagttccactaataagtggaaatagacaaaaactttgtctcaaagaaaggagaagcagagagtttttgctcgttggcaaaagctgtgactgtgatgaagtgaaggctttagcctcactagtcatgggccttgagctataactttcagatccagcccaataaaaggagcgatgcatcagatattcagatggcagagatcctaaataatctcaaccgttctagagatcctaaataatctcaaccgtttatttatttaagccacgtcatcgatcctcgcgaaaaacaaatacccatttacaagcagttacatatctgtatataaacaattatcatcattcagcatcaacgcgtctctcaattctcacattctcaaaatcactaaaatcaaactcaattttcatcaaatatctctaatggcgccgaaagcagcggagaagaaaccggcagagaagaaaccagccgggaaagctccggcggagaaactcccaaaggcggagaagaaaatcagcaaagacgccggaggaagcgagaagaagaagaagaaatcgaagaagagcgtcgagacttacaagatctacatcttcaaggttctgaaacaagttcatccagatgttggaatctctgggaaagctatggggattatgaacagtttcatcaatgacatcttcgagaaacttgctcaggaatcgtcaaagctcgctaggtacaataagaagccgacgattacatcgagggagattcaaaccgctgtgagacttgtgttgcctggagaactcgctaaacatgcggtttctgaaggcacgaaggcggttaccaaattcaccagttagggttttcctgtaaatttccggttaagtgtttggtttagactcggtttgtttagatgttttgagtttcgtgaattgtttgatgatcactctaatggttcaaaattgatggttgaatttgattcttcttcttcctttcagtgatttataattgttttatttaacgtttgagtccctggaatttggataatatgcaaattgctccatcaggtatttataaactaatttctatccatcaattgcgttatagagttgcgtttgtgtgtgacatcgacaaaacaaactaaacgctatttctctaattagtggattttattacaagagaaacttgttatatcgtcgtcttctacaccaacaggccgttgaatcatgagacgctattgataagaccgacctaataattaggtagatttttttggtgtagtttatttccagtctattattctcagcccattagacccaaaaggaaaatatcaaggcccgtaaggaaagtctaaaaagataagggacacgtgtacagtcataaatctatctaaaggtaggccgccacatctatcaccgttggatattctagtttaaaatcgtcatcaatcataattattcatttcttcttcgtcttcttcttctttctcaaattagcttttctttatcgtcttcctcaagcgtgagattcgttgtggatatagtttttctccttgattctctggttctttccatgatccaattttaagggtttcacggcttcgtttttttgggtatatctagctctatcgttcgtggtggttttctttctggatcaaagttttctgagatctctgcgatttctgggattcgaaaattggagaattagggcttttttacggtaacagggtttcgaagagcataagataagaatgccttcggtgccctctaagcttcttcctctcctgtctttgattccttcgttgactccttatcattctggtttgagttctaatcgtttgaaacctcttgaaaagtgtgattggcgtggtaatcttagttaacatttcctttccttcttctctcctttttaccctttcttctctcgccctcgtttacttcttgagattttcttagctcgatttgatctttggtgctttaacttctggcggtgtttgatttgcagcacaaaaaggtgattttttttttgtttctttgacttctgcaaatttaattctgttcaatttgggatctaaacacatagtctatgttttaattcatgggcttctataatatcatgcgagtagagtgaataaaatttgagcatgagtctttgttttcgttgtgtgctctaaagatcatatttactgatgataactttaaatttgtttgtgcagttactactactactgtgattaccttgtactgttagttggatatg

SEQ ID NO: 28196 - DNA, 3003 bp, Unknown; identical to SEQ ID NO: 28195
  misc_feature (1)..( 3003): 2750-1469P.txt file - cDNA_ID_2994470; gDNA_ID_2214573; Annot_ID_186266

SEQ ID NO: 28197 - DNA, 3000 bp, Unknown
  misc_feature (1)..( 3000): 2750-1469P.txt file - cDNA_ID_2994479; gDNA_ID_2214588; Annot_ID_186682
aatgtcctctattttagaggaaatatatttgattttgtttcattgtatatctgtaaaataaagttaactctaaaatagagaaaaaatgtagaaattccttttttttactctatatatagagtaatctttacacttttcttatgttttatagttaactctattttagaaacatacaatagagcaaaactaaatatattttctttaaaatagaatcaactctaaaatatagaaaaaattaaagttaaatattggaaatggtccattacattaccgatctaatcgagagtagttttttcttccatcccattatctttttttaaaaaaaggttttagacttgagtcaaactttaatttacactaattttcatattttctatattttccaccgggtcaactctatagctatgacaataaccgattatataattcgttgtgtgtagcagattacgacatttaaaaaaaatagatataaaaatagataagcataaattgagataaagtaagtaacgtccctttcaaaaactaacgttttcattaatttcatacataggaacacgataagatgcatccaaaagaggttgttttggacaaagatgggaggttggaaattccaaaagttgacattgttccgcaacatgtttttgtttgatcaataaatagtaaactataaaacatgtacgagacatacataatcttggatacatcagcaggtaatgttgttagagaaggattgttcttatgagaaccgagaacgttatttaactttggtgagtacgaaggggtttgttcgaccattaggatgaatataatcaaccttctcgtttgatcgtgatttggtttatgtttgtcgatctcatattatacagaaacacgattaaaaggagatttcaagaaaagcccttataataagaactctatgaaacctaagttataagaagaggtgacttgactacattttatggttgggaatgaaattcgaagatctagctgttggaaagacaggcgtaaagtttgtgtaatgtataaacagaatctcttttgtacgaaagaccattctacagaattgacgtgttaatgtgtatatctggaattaggtattaaacattaattttgagtttgtatatcttctctctttttcttacgatcaatatgcaaattagcaaatagagagacgtaatgatgatgtttgtgcattaccgagtgagataactaaatgatgtttcaagaaatgcaaaagtgaaacaaggaaacctaaaagagtaagcaaacaaacaacaaatcagcaataaaatatttaaatcattttaaaatttaattaatattaattcgtttttactttaaggtttttggtaactttttttggagaccgtgatgtcgtcaaaacattcaagatgtatattgattattgacattctctctttctctctattgtccttcttttttttcttcttttactttttaactttaaaactatatatttatatccataaaatatataaaagaaatcttattagtaactaaaagttgtgcaagttttttagctattaattttatcggaatagtgcaaaactgttagaaaaaactgtataaaaaactgttaaaaaaagctgagaataaaattttttataacacttttggtaacaattttgtgattggtaaatgtcaaactatttatactgttttaaagtgttaagtggttaccattcaaaaccaaaaccttaaaaattaaagccgttatgctatttttttaataaagaagacatgattttgccctatcaaattaaaattggtgtgttgatgagtgcaaaagcgtaggcaaataaatcacacatcattaacaaaaaaaaaaaatcacacataaaagtgtaattgtgaggaaaaaagatgtttccaatttttaagtccaccaccaaactggacccactaacccctactcagggtatacaattccatttccacccatacacaattatagtagtccaccttttttcttttctttctacacatatctggattccagtttttaagtaggattattattggttggtaaaagatgcaaagaatatgagaaaaggtctaattgcgtgctccataaacccttattctagttcaaccataattgtcagtcaatagaagcaagataatttgaacgtccaagtcatcatcatctttttttttctttctgaaatttcgttttacaataaacaaagaaaggttccgagtcctcaagcatctctcacgtcggagcaagttgccatgcactctccaaaataaaataaaaaacagacaaagactttagacttgtgacttttcgacctcattatgtacttacttacttcatcttctatttggcacccacaaacagtagtttccactttcttcctcaataagttccatttttggattctttcctatttttacacaaatttgttgtattctaaaaagttatatattctatttgctgggctttagatatgggctggctctggatatgtgtgtaatggatacatattagtaaatagttaagtccaaaaaagaaattataaaccccctatgtagtttgaaaactggatcatctgacaaaacgagcagggaaggcccataataaggcctaataagtaaggtaagcccacagagaaatatacttacgggcttggatttccgaaccttcctaaaaagtgggacctacgcggctgagaagaaagacgaaggccatatcagaccggcgataactgaaaagtcaaaagtcaaaattcaagaggaagaggagtttctaatcatgtctctctctgttttcttcttattcttctatcaaaccgtcaagttgggaaacaaaacaaaactcgcaagtttaacaacgcgtcttctacctcctcctcatcggactatttatctatagtcttcgttagatcaattcctctgttttactcctaagtttcgagatccacatttctctttaacctcatctcatctcttagtcgagatcttcactttctgatg

SEQ ID NO: 28198 - DNA, 3000 bp, Unknown; identical to SEQ ID NO: 12994
  misc_feature (1)..( 3000): 2750-1469P.txt file - cDNA_ID_2994483; gDNA_ID_2214588; Annot_ID_135363

SEQ ID NO: 28199 - DNA, 3003 bp, Unknown
  misc_feature (1)..( 3003): 2750-1469P.txt file - cDNA_ID_2994490; gDNA_ID_2214595; Annot_ID_135478
atttttttctctctctcggactgtgcccaaagttgctcctttttttagggtttttgttttttatttacaaacgctgtttttttatcttctcccttgttttatacgcaacgttgatttctttttcttttttttttattattgaggcattttcgattaacctaaaaatcgaaatttttgtctaaccaaagcatgcttaggacagtatatacaattcgcaactgctcttagaacctctggtagtagaactaaatcattttcagacaaaaccaaaaagaattcgtaactcatgtatagaacttacacttcatcttttattccaacaggcattagcccaaacatataaaccccaatattcttttacaattgaaatgcatcaagccgtcaacagatatacacccaatgacccaaactgaacaaaaacaaaaaaagttaaaacagaacagaagcaaatgagggagggagggagagagagagagagagagagagatacacatggtggatgattttcagcttattcccagttgcagactccaaagtttgttttatctactattaaggcaaatgatgatcctgctgaattatttttagaagatgtgaaggggcgagagatattacgtgaaactattgcacaccgcgatcaggcagtcgacttgaagttgccagattcaaatggttagaggattgaaaatttccatcctctaagagaatcaatacttatctctgaggaggatcaactgtcctgacatttgcacctgtcataccttcaattttatctttggtgatctccacaaagtgaccaattacttcgtgaaactgcttaagacccgataacggtagaatgatggaagacctgtcagaacctgccacctatattgagaaatgctttaatgttaaaaccatggtaaatacaagctctcaagagataagccagcaaaagattgttcttccaagattacctcagatatccttaagaaatggcccctgttattgttcccaagatcaaagaagaaccgtttctggtcagctctgattactttagaaacaccagtcattccggtttcttcctggcctggcgagtcaattgttcgatccacattatgttctgaagaagatggctgctgactaccatgtccaggtataaaaccagctccaacatcatcaaccaagtgttcctgtccatcagaaggtttctgtttccaaaacgaagatacaatgagaccagagaacttagttaaaggcttttcaatcaaaggagacgataataccacctgatttggcatcacaaaaagtcctgatgcttcatgtatctcagccaatatattcctgaaagctgcccatccttcatcaggagagcttccagctggaacaataatggtacttcgatttctactaaccgatgcttctgacacctaacaccacaccaaaacccatcagaacattcctacaacttctgatacctcaggataattagtcacataaccaaaatgaaaagaacattcctaaccataagtctagtactccctaaatcttcaattcacatataccaaagaaaaaaaacttcagattcattaagtaaaacagaaaaatttctaccttcaagaagcgtcctcttctgttctcaccgatatcgaagtaaaacacctgaataaagcaacaacagcagaaattaaagagagtggaaaagtcaacgatcgccagaagagagtgatgataaagttgaaaccttggaatcaagctgcaattctttgctaaaaagctcgtgttcctcagaattgacatagtagttgaagagatcaaggaaccaagagatgccggaggaaggaacaatgatggttgacctcgtcgccgacgtcttctccgatatctttagataccttccacgaggattctccttaagatcaaaatagaatagcttatgctccacttgcaacgtcttgctcaccaattccacatcgctccctcctcctcctcctcctcctccggttaccgctcttccgccttcagctcctcctcctccgcctgaattagcttccatttcaatcttcaattgatcgatcggagtagaaaattcggtgaaagaaatctcttcactgaagagttgaaattgacgtctgatctggtaaaggaagtgcgattggaagaatgaggaattggtggaggtgagagattacggagcaataagggtttaataccggaccggatgttttaaaccggatacattgtttggtcggggtccgaacatttctgattggtcggatattcagattaagcaacagattaatttttcttggagtaactgcaattacgtataataattcttttttttaaagttggttttagtttcactgatagtcaaaccgatcggttcaaccttatggtttgattaaagatgtgttataaggagccgatgccacgtacttttactaatctcttttttgtcgaccatttttgtttctgagttgttcttcttgattagctttgtccgcttggaaccaaacatggcgagtcttggccatatagccagagaatcatcagacatcacacgcctcgcccagttttacaaagaggtaacgacacctaatcgacgttttcaatttcttacacttttctttttcttatctctcttcgtattctctgttctgggtttgtgttgttactaccaatttcgacccaaaaaaacaaacgcactgagtcgattacccatctggattagaatctatggtttgtaatttggctttttatttagagatttgtgttgctattgtggctttgtctctttctcttgtcacttatctcgtttctagtttctattgagagtgtccacttttggatgcctttaatccttttgattaagttagtgttatcttcatcttcgtggtttgttctgaaaccaatggattatatatgtataattgtcaggtgtttgggttcgaggagatcgaaagtcctgattttggagacctacaggtggtgtggctaaacttaccaggtgcttttgcaatg

SEQ ID NO: 28200 - DNA, 3000 bp, Unknown
  misc_feature (1)..( 3000): 2750-1469P.txt file - cDNA_ID_2994494; gDNA_ID_2214602; Annot_ID_135587
gttctccaaatccccattcaaaacacatttagtctccagtctttgcttcagttttactcttctctctatttattaccctttcttaagtctaatgattatgagtctgcctcctcttcttttcaattaggtaacctaaaataaaaatatcttctttgtttatgttattttaaacaaaaggtatgtgaaaaaatgatgaaaagaggtgaactagattagggttctgtaaaaaaaaaaatggaatatgtaagatattcaaaaaaagccaatattacgattacttgcaatgccatcattgcttttgcctgtagaagagtccaaacctgctttttctctctttaactacttttcattattacttccttttatataagtttttaaaaaaaattggtggatgtgctctttgtttgcagttgactggtgaaacagtaggagaagtaagagcagttgcagatatgcaccaaaggaaagctgagatggctaagcactctgatgcttttattgccttaccaggttgtgtttttaaaccccatccacccaaaattatcatcattttttcacattactttaaacctaaaacttttctttcaaaccaagtaatgatgataaggaaaaactggtcaaaactctagttacacatgagtctcaagaacaccagtttaggcatttgttagccttttaaatgaattttatgggaaatcaaaagtttaaaagaggaatatttgttcatgaaaatattaaaaaagtttgactgattttgccaaaagagagaagaaaacaatttggttaaactaaaaaacatgttgtcttggtcaagctgtagtgtgaaagctacactgaaaagttttttttggtatgaaatttttaaaaaaattatgaaaagtccctacagtctaagataaaggaccttgacccatcaacatctggcacttaaaattagacattttttttttgctcttctctttactctgtttattgctctgcttttaacttaggaggtactatccatatagcttgtgtagtcttactgtgaccaaagttttctccttacctatttcaaggtaagagacaaaacctgaaacagtcccacaaatagcatatttttgcccacactgaatctgaaatcattatggaaagtcaagttctttcaaagatcttgcttttctaatcatattcatcccattgtacaaacttgtaacagagaagagaagactctattatttggtttgtcttgtacataacaaacttgttgacttgaccatatcatagttactaatttatctcctctctttttttttcaactatcaaatctaaaagttttgtatgaaaattgtaggtggttatggaacacttgaagaattgcttgaagtcataacttgggctcagcttggtatacatgacaagccggtaaacaaataaacccttctatcacattttaatcaaaaagtttcaactttaataacaacatatcatgcatcatttttctgtaggtgggtttgctcaatgttgatggatactacaactctctgctctcattcattgacaaagcagtcgaagaaggatttattagcccgactgctcgtgagatcatcgtctccgcacctactgctaaagagctggtgaaaaagctagaggtaaattaaacttataatgaagatggatcattaatgtttcttcataatctcataaattgttgttgttgtctttgtaggaatatgcaccttgccatgaaagggttgcaacgaagctttgttgggagatggaacggattggttactcctctgaagagtgattcagatcaagattatctatataactatttaaaatattttataatatagatttgaaactttcggagatttcatgatttaatcttactaaaaaaggaagggatagattttgattagttgggtaaaatttccacttcggaggagatttttaatgtaaattattagtaatgtctttttaagtcgaagctaaatgtttttagtttatgtaattgtcgcaactctctactattgtaagttgtaaccaagacaagtttcacactttcgtatctatctctcttcacattaaaatcaatacagacgaaaaaagaaagatatatattatctgtataagattatgtattgtcaatactcaatgccagagactgtctcttaacaacaacaacaacagaaaaaacaaacgaaaacaacaaaaaaatctaaaaaagcttcataaaaaatgaaatctaaaaaagcaaccagcttttcttgaaatggaaaaatatcttttgccatttcaagaaaagctggttgcttttttagatttcattttttagccatttaatactaacctttattataaactgtctaaaaaatattcaaaaaaataaaggcgtatgtagatagattctaatttgcatgagaaattaagtaatacagtggtaaaataaaaataaaacgaaataacgtaatttagtaaaataacatgttatcaagcaaaataatttatatcatataataccataatccataactgcgtactttctaagaaaataaaacttttatttgttaccacgaaaattgtaaaataaattgtgaatatctacctaaaaaactcaatcatttacctaatttatgaaaaatgtaaaattagacgtcaacatctttcaaatagacgttcaaaacataaatcaatcaaaaccgacactaatactatgtttttgtcgatgttaaagttaacatatactgtttttataattttttaacaacgtcggttactctgttcaatggaatgttaaatgtaacattaaattattatatgcttttgttagaaatattaaagtttcaaactttaaagtttaagaacactaatagtaagttttgggtcaattttatttgttaaagaagttttgggtccatttacatgacattatttatatcatttgtcaaaaggcccaaacgtctttttcagttgctctttcttggtgggaactgtttgagctcgagttctatgatg

SEQ ID NO: 28201 - DNA, 3000 bp, Unknown
  misc_feature (1)..( 3000): 2750-1469P.txt file - cDNA_ID_2994494; gDNA_ID_2214602; Annot_ID_187101
accctcatgcctagagaggtaaaacatttcaagatttccctatttttaatactaaaacactattgtttgtttattaatatgtatctgtaggttctccaaatccccattcaaaacacatttagtctccagtctttgcttcagttttactcttctctctatttattaccctttcttaagtctaatgattatgagtctgcctcctcttcttttcaattaggtaacctaaaataaaaatatcttctttgtttatgttattttaaacaaaaggtatgtgaaaaaatgatgaaaagaggtgaactagattagggttctgtaaaaaaaaaaatggaatatgtaagatattcaaaaaaagccaatattacgattacttgcaatgccatcattgcttttgcctgtagaagagtccaaacctgctttttctctctttaactacttttcattattacttccttttatataagtttttaaaaaaaattggtggatgtgctctttgtttgcagttgactggtgaaacagtaggagaagtaagagcagttgcagatatgcaccaaaggaaagctgagatggctaagcactctgatgcttttattgccttaccaggttgtgtttttaaaccccatccacccaaaattatcatcattttttcacattactttaaacctaaaacttttctttcaaaccaagtaatgatgataaggaaaaactggtcaaaactctagttacacatgagtctcaagaacaccagtttaggcatttgttagccttttaaatgaattttatgggaaatcaaaagtttaaaagaggaatatttgttcatgaaaatattaaaaaagtttgactgattttgccaaaagagagaagaaaacaatttggttaaactaaaaaacatgttgtcttggtcaagctgtagtgtgaaagctacactgaaaagttttttttggtatgaaatttttaaaaaaattatgaaaagtccctacagtctaagataaaggaccttgacccatcaacatctggcacttaaaattagacattttttttttgctcttctctttactctgtttattgctctgcttttaacttaggaggtactatccatatagcttgtgtagtcttactgtgaccaaagttttctccttacctatttcaaggtaagagacaaaacctgaaacagtcccacaaatagcatatttttgcccacactgaatctgaaatcattatggaaagtcaagttctttcaaagatcttgcttttctaatcatattcatcccattgtacaaacttgtaacagagaagagaagactctattatttggtttgtcttgtacataacaaacttgttgacttgaccatatcatagttactaatttatctcctctctttttttttcaactatcaaatctaaaagttttgtatgaaaattgtaggtggttatggaacacttgaagaattgcttgaagtcataacttgggctcagcttggtatacatgacaagccggtaaacaaataaacccttctatcacattttaatcaaaaagtttcaactttaataacaacatatcatgcatcatttttctgtaggtgggtttgctcaatgttgatggatactacaactctctgctctcattcattgacaaagcagtcgaagaaggatttattagcccgactgctcgtgagatcatcgtctccgcacctactgctaaagagctggtgaaaaagctagaggtaaattaaacttataatgaagatggatcattaatgtttcttcataatctcataaattgttgttgttgtctttgtaggaatatgcaccttgccatgaaagggttgcaacgaagctttgttgggagatggaacggattggttactcctctgaagagtgattcagatcaagattatctatataactatttaaaatattttataatatagatttgaaactttcggagatttcatgatttaatcttactaaaaaaggaagggatagattttgattagttgggtaaaatttccacttcggaggagatttttaatgtaaattattagtaatgtctttttaagtcgaagctaaatgtttttagtttatgtaattgtcgcaactctctactattgtaagttgtaaccaagacaagtttcacactttcgtatctatctctcttcacattaaaatcaatacagacgaaaaaagaaagatatatattatctgtataagattatgtattgtcaatactcaatgccagagactgtctcttaacaacaacaacaacagaaaaaacaaacgaaaacaacaaaaaaatctaaaaaagcttcataaaaaatgaaatctaaaaaagcaaccagcttttcttgaaatggaaaaatatcttttgccatttcaagaaaagctggttgcttttttagatttcattttttagccatttaatactaacctttattataaactgtctaaaaaatattcaaaaaaataaaggcgtatgtagatagattctaatttgcatgagaaattaagtaatacagtggtaaaataaaaataaaacgaaataacgtaatttagtaaaataacatgttatcaagcaaaataatttatatcatataataccataatccataactgcgtactttctaagaaaataaaacttttatttgttaccacgaaaattgtaaaataaattgtgaatatctacctaaaaaactcaatcatttacctaatttatgaaaaatgtaaaattagacgtcaacatctttcaaatagacgttcaaaacataaatcaatcaaaaccgacactaatactatgtttttgtcgatgttaaagttaacatatactgtttttataattttttaacaacgtcggttactctgttcaatggaatgttaaatgtaacattaaattattatatgcttttgttagaaatattaaagtttcaaactttaaagtttaagaacactaatagtaagttttgggtcaattttatttgttaaagaagttttgggtccatttacatg

SEQ ID NO: 28202 - DNA, 3003 bp, Unknown
  misc_feature (1)..( 3003): 2750-1469P.txt file - cDNA_ID_2994504; gDNA_ID_2214603; Annot_ID_135611
ctcaagatgcggtgaggatacggcggcttcagaagcaaagagaggccgaacgcaaaaaaatacaagagctcaagagcaagtctgcctccggcaatgaccaatctggtcttctccaattcggcaccagctcgtgcgaggtaatcgatttctaaggtttcgagaggagaaatggtggattgtggtagaaactagatttagaacttgttctggctctgacttagtagcttccgcaatatttagggtttagtataattctaacgattagttctgagaagtatcggagaacaagattagatcatcattgcttgagattgtattgcagttttggtgtctcaagtgtttacgaatcacaaatgttatcttgctatttgggctgtgactaattcatttgtttttggttagattcttgacactgctttcaagaaggaaacagtgggtttagttacaagagaggagtatgtggagaaggtaattggagtcatggcttgtattactctccaactttaacagtcatctagattgtggtgtttaattctgtatgtgatatatgtagagggttaatattcgtaataagttcgaggaagaagagaaggagaaactgcagaagctacagcaagagtgagttttgtttttaggtctattgttcatagttattggtgttattctttggattaagcttgattgactttttttttttaactacagggaagaggagttgcagctagagaagcgtaacaagaagagaaagattaagggatcttcccgcttatcttttgctgaagattttgagaatggcagtgatgaagatgatggagaaaacagtaagtgcattcattcatcaatctcgtagataggacttagtctacctcgactgtttttattagattttcttaagcttttaacttgattcctgaatatgctgttgttacatcaatggtgaattgtggtatagttaggattaggtgtgatacatgctgtcattcaattaaaccactataacttttttcctttttgtaaaagttgaaaaaatatttatctatctttcgcagatttaataaaatcctttttaaaatgtatggaagttgacaaaatatagtctccatcttttgcagtaataaagaatctcatcatgtattacagacattaattctacaaatgtagattggaatattgcttggttgttggaggatttgagatgcaaatagcttgctgcgtaggaatttataatatcatctaatgttgtcctttttgtaacttctatcatgtacactatttatgcagagagttctgggacagggaacttacgctgcggaaaacttggcaaggacccctcagtggaaacgaatttcctgcctgacaggtgatctctagctctcttgtttatctttatcttccttgtctgcttttgcagtaagtctcaactttagctgtggtgttttgaggttgctgtttcagtgagagggaggcggaggaacaagctgaacgtgaaaggctgaagaagcagtggcttcgtgaacaagagcagattaaaagttgtccattttctagttaccttctaatttcagttgtaatacttgattcaaggaagattgtctaactattttttgtttttcagacgagcctcttgagattacttacagttactgggatgggactggccatagacgagttattcaggcaagcacaaactacacctttgtcatactgcttgagccttacgtgtgtgatcatttacttacctttatgatatatacccattttacaggtccgcaagggtgacccaattgggaattttctgcgggctgttcagcagcagcttgcccctgacttccgggagattcggacggcatcagtggagaatttactatatgtaaaggaagatcttattattccacatgtgagaaccctttaaacttaccaagttatcctccctttactatataggacttaacgataacatggggtatttttttgtaaatgtagcaacacagtttctatgagctgatcattaacaaagcgagggggaagagtgggccggtatgccttgtcgacactttttgaaattcagtttatatagaaattgtaaccgagactcacttctcctacattgttcttgttaacagctgtttcactttgatgtgcatgaagacgtgagaacaatagcagatgcaacgatagagaaagacgaggtatgtttccctgacccgatcacatgagaaaagagagtagtttgatgatggaaagttgtttctaaagcattgtaaaatgtggtgttaatgaagtcgcatgcgggtaaagttgtggagaggcattggtacgagaagaacaagcatatattccctgcttccagatgggaggtaactctcaaataatcttttctctgcacttttcattctcagctagactttgaatcttattgttttgcattataattgttcagatttacgacccgacaaagaaatgggaacggtacacagtccatggggattaattctggaccagaacatgcttttgatggatcgtttgttgacatgattgatcagatttggtgtaatagtagtggaatgttcatggcatttttaatgctcattcttcttccctcaatgtaccattacactcgttttttaatttttcttaaaataatggaactgtttgatttctttagtacccgttattttgtgatttttcatgtcatgtgaaaatttagtatgagatcttgtgattacaaatttataatgagagcacacaaattaagaatgttagaaaccaatttgtgaatcccctgatgtatacaaggcaacaaaatcacacgaaataaattgagagaccagacaaaacgctgtcgttttgcgagggtttctatggttgtgttgttatcttttttttttcagaaataaattaatttagtgtgaaagagcaaaagcataaatagcatcgagagagacactgttctcattcattcgcaaattcgttgaccatatttgatagaatcaagcgatgatg

SEQ ID NO: 28203 - DNA, 3003 bp, Unknown
  misc_feature (1)..( 3003): 2750-1469P.txt file - cDNA_ID_2994504; gDNA_ID_2214603; Annot_ID_187134
cggctcaagatgcggtgaggatacggcggcttcagaagcaaagagaggccgaacgcaaaaaaatacaagagctcaagagcaagtctgcctccggcaatgaccaatctggtcttctccaattcggcaccagctcgtgcgaggtaatcgatttctaaggtttcgagaggagaaatggtggattgtggtagaaactagatttagaacttgttctggctctgacttagtagcttccgcaatatttagggtttagtataattctaacgattagttctgagaagtatcggagaacaagattagatcatcattgcttgagattgtattgcagttttggtgtctcaagtgtttacgaatcacaaatgttatcttgctatttgggctgtgactaattcatttgtttttggttagattcttgacactgctttcaagaaggaaacagtgggtttagttacaagagaggagtatgtggagaaggtaattggagtcatggcttgtattactctccaactttaacagtcatctagattgtggtgtttaattctgtatgtgatatatgtagagggttaatattcgtaataagttcgaggaagaagagaaggagaaactgcagaagctacagcaagagtgagttttgtttttaggtctattgttcatagttattggtgttattctttggattaagcttgattgactttttttttttaactacagggaagaggagttgcagctagagaagcgtaacaagaagagaaagattaagggatcttcccgcttatcttttgctgaagattttgagaatggcagtgatgaagatgatggagaaaacagtaagtgcattcattcatcaatctcgtagataggacttagtctacctcgactgtttttattagattttcttaagcttttaacttgattcctgaatatgctgttgttacatcaatggtgaattgtggtatagttaggattaggtgtgatacatgctgtcattcaattaaaccactataacttttttcctttttgtaaaagttgaaaaaatatttatctatctttcgcagatttaataaaatcctttttaaaatgtatggaagttgacaaaatatagtctccatcttttgcagtaataaagaatctcatcatgtattacagacattaattctacaaatgtagattggaatattgcttggttgttggaggatttgagatgcaaatagcttgctgcgtaggaatttataatatcatctaatgttgtcctttttgtaacttctatcatgtacactatttatgcagagagttctgggacagggaacttacgctgcggaaaacttggcaaggacccctcagtggaaacgaatttcctgcctgacaggtgatctctagctctcttgtttatctttatcttccttgtctgcttttgcagtaagtctcaactttagctgtggtgttttgaggttgctgtttcagtgagagggaggcggaggaacaagctgaacgtgaaaggctgaagaagcagtggcttcgtgaacaagagcagattaaaagttgtccattttctagttaccttctaatttcagttgtaatacttgattcaaggaagattgtctaactattttttgtttttcagacgagcctcttgagattacttacagttactgggatgggactggccatagacgagttattcaggcaagcacaaactacacctttgtcatactgcttgagccttacgtgtgtgatcatttacttacctttatgatatatacccattttacaggtccgcaagggtgacccaattgggaattttctgcgggctgttcagcagcagcttgcccctgacttccgggagattcggacggcatcagtggagaatttactatatgtaaaggaagatcttattattccacatgtgagaaccctttaaacttaccaagttatcctccctttactatataggacttaacgataacatggggtatttttttgtaaatgtagcaacacagtttctatgagctgatcattaacaaagcgagggggaagagtgggccggtatgccttgtcgacactttttgaaattcagtttatatagaaattgtaaccgagactcacttctcctacattgttcttgttaacagctgtttcactttgatgtgcatgaagacgtgagaacaatagcagatgcaacgatagagaaagacgaggtatgtttccctgacccgatcacatgagaaaagagagtagtttgatgatggaaagttgtttctaaagcattgtaaaatgtggtgttaatgaagtcgcatgcgggtaaagttgtggagaggcattggtacgagaagaacaagcatatattccctgcttccagatgggaggtaactctcaaataatcttttctctgcacttttcattctcagctagactttgaatcttattgttttgcattataattgttcagatttacgacccgacaaagaaatgggaacggtacacagtccatggggattaattctggaccagaacatgcttttgatggatcgtttgttgacatgattgatcagatttggtgtaatagtagtggaatgttcatggcatttttaatgctcattcttcttccctcaatgtaccattacactcgttttttaatttttcttaaaataatggaactgtttgatttctttagtacccgttattttgtgatttttcatgtcatgtgaaaatttagtatgagatcttgtgattacaaatttataatgagagcacacaaattaagaatgttagaaaccaatttgtgaatcccctgatgtatacaaggcaacaaaatcacacgaaataaattgagagaccagacaaaacgctgtcgttttgcgagggtttctatggttgtgttgttatcttttttttttcagaaataaattaatttagtgtgaaagagcaaaagcataaatagcatcgagagagacactgttctcattcattcgcaaattcgttgaccatatttgatagaatcaagcgatg

SEQ ID NO: 28204 - DNA, 3000 bp, Unknown; identical to SEQ ID NO: 13223
  misc_feature (1)..( 3000): 2750-1469P.txt file - cDNA_ID_2994508; gDNA_ID_2214606; Annot_ID_135667

SEQ ID NO: 28205 - DNA, 3000 bp, Unknown; identical to SEQ ID NO: 13226
  misc_feature (1)..( 3000): 2750-1469P.txt file - cDNA_ID_2994508; gDNA_ID_2214606; Annot_ID_187237

SEQ ID NO: 28206 - DNA, 3003 bp, Unknown
  misc_feature (1)..( 3003): 2750-1469P.txt file - cDNA_ID_2994523; gDNA_ID_2214630; Annot_ID_136035
gggggtccaccggctatacccagttacctccaggtttcttccggtatcactggaactcgtgtaagagaagattaaaaaatcaattaaaataaaattaatctcaaacggatataatatggctcggcttatactaatcggctcagctccactcaagctatacgtggaaaggaatctctgtgttaaattaataatctatttttaaaaattgaataatcgagttttctttttattaatcttttgaaattgtctattcaccatgtaaaagttattataacatcacaatattgtgtttagaagttttatagtagtgtgtaacaaaattggttatcagaattattttgttaaatgctaaaatcatgaatgctttagagatatttttttgacaacattttacaaaatatgtttgtcttattcgcatggtaatctaatcatcatgtcttctttaatttgttaaagttgtaataattggattatatgcgttttttattttctctaacccattaaaaaatttataaattaaagttatagggtgatgactttcgtggcaatgcaaaaatgagacaagagctgttgggcctcgatgacagcaacaagagtgagttttttgctttctttttatttgggttaggttcttttgattctccaaaacatatttatattctcttatatatttggaaagtttttgggtttttggttctttgatttttttcaccttataagttcctatatccggtatcatccattgataatataattagtttgttttctttataaaatgtaaattatattttttaggtataacatcatcttaactatagtcaaaataattcttttggatcgaaactaacaaccttaatatcaacatgaaattgtgtttattttagaggtgaaaatgcgccaaacctcttcttgtctttggatttcggaggaccataggttctggaatgctgactcgcgtatggaaagatccatggattcccactatcctagcgcggcctgcaaagagcattcttaacataagagattctctactctatgtcaatgatttaattgaccaaaacacaaatttgtggaaattggaccgtctccaagcactgatcgatcccgttgatattccactcattttagggattcgcccaagtcgtacctacttgagtgatggctttagctggtctcacactaaatccggtaattatactgttaagtcaggatattgggtcgcgagagatctttctcgtcctacttgtgaccccccttttcagggaccaggtgtttcggcacttcaggcacaagtatgaaagcttaaaactacgcggaagcttatgcatttcgtgtggcaatgtatctcgggttgtttagccacttgtcaaagattgacatatcgccatatgggtacagataaaggttgtccccgttgcgaagaagtagaagagacaatcaaccatctattgtttcattgtccaccttcgagacagatttgggctttatcgcctattcctacctcagggaatattttccctagaaactctctcttctataatttcgacttccttttttggcgtgaccgagaatttggaattggagaaaaggtgttggaactctttccatggataatttggtatatctggaaaagtaaaaatcgttttgtttttgagaacttcagggaacctccccctgaaactttggttttggcacttcaagagacagctgtttggaaacaagcaactctaaaagaggatgattccactcgtccaatcgtgttcgtaggttcttctcagaccccgtccaccttgctccctgaatgtcaactcgatgcatcatggcatgtagatgacacattgagcgggcatggttgggtacttgttcgacaagacttggtcatccaccttggccttaagagcactcgtcgaaatttatcaccgcttcatgcggaatttaactctttgttataggcaatggagtgcatgatctctattggtgatacttctggtacttttgcttcggattgctcagacttgattgctatccttgataaccaagacgattggctgacttttgcagcggaattggcttcatatcgttctttagtttgttttttcccttcttttcgtattagatttctttctcgtagttctaatactcgagcagattgtttagctaagaaagctcgggctcgcaatagccttttttcccatgtaagcacattggttcctaaatggctctctctagcggagagtctcttcccgataacttaatataaatggtgtttgaagaaaaaaaaaaaaaaatgcaacaaaatctactcgattttctattttgatacaatgctccattcttataaaaaaaaataaaagaggaaaactgtaaagtaaggtgtaaatttggtgaagaaaatcattatccaatcaaaaacgttttgtgtaatagaaacgtaaataaaacgagtcaaggcaccgacacaagatgatctcaatggggatttgtgtttccacctaatacgacatcgtattcaattcctaaacgacgccgttccgctcgtgcttacccataaatggaaaaatatctatacaactgccacgtcagcacaccaaaaaatatcaccggcgaaaaacacacacagtgatattctacggcggtggttcagtctcttcgaagctcgtcgtctctctcttcaaaactccggtgaaaatggcgtcgcttactctccggtgcgattcgacgcatcttttgccttcccggtaatcaaattgaattgtatttctctctgtttcactgaatttgaattgatagtttttgattagatctgtttatcattcggaatttgaaattacgtttgcttatgattcgattttggattcaattgaaacacatatctatgtatttaggttttgatggttatgttgtcttcatgggtttttcagtgatgttgtcaagggaacaaaaccatttggaacgagcttggtgtatcctaggatcatatcgaagaagtttaatgttagaatg

SEQ ID NO: 28207 - DNA, 3003 bp, Unknown
  misc_feature (1)..( 3003): 2750-1469P.txt file - cDNA_ID_2994523; gDNA_ID_2214630; Annot_ID_187934
aatttaatgcatagtacttgatgatctttactctcttaaacccatcaagaaaagagaaaactttgaaggaagagagaaagagaaatggagagaaattaaagacaatggagattcttctatatacagagagagagaggagagagattgttgaggttgatgagcgttttccatatgaacaagcttggtttcacactttctctcagtttaaataaactcaaaggttgggttagaaagtaaccatggttaagtagatattgtcttgggtgttttcttttgtaaatgatttttttttttttgttaaaataaatttgagggggtccaccggctatacccagttacctccaggtttcttccggtatcactggaactcgtgtaagagaagattaaaaaatcaattaaaataaaattaatctcaaacggatataatatggctcggcttatactaatcggctcagctccactcaagctatacgtggaaaggaatctctgtgttaaattaataatctatttttaaaaattgaataatcgagttttctttttattaatcttttgaaattgtctattcaccatgtaaaagttattataacatcacaatattgtgtttagaagttttatagtagtgtgtaacaaaattggttatcagaattattttgttaaatgctaaaatcatgaatgctttagagatatttttttgacaacattttacaaaatatgtttgtcttattcgcatggtaatctaatcatcatgtcttctttaatttgttaaagttgtaataattggattatatgcgttttttattttctctaacccattaaaaaatttataaattaaagttatagggtgatgactttcgtggcaatgcaaaaatgagacaagagctgttgggcctcgatgacagcaacaagagtgagttttttgctttctttttatttgggttaggttcttttgattctccaaaacatatttatattctcttatatatttggaaagtttttgggtttttggttctttgatttttttcaccttataagttcctatatccggtatcatccattgataatataattagtttgttttctttataaaatgtaaattatattttttaggtataacatcatcttaactatagtcaaaataattcttttggatcgaaactaacaaccttaatatcaacatgaaattgtgtttattttagaggtgaaaatgcgccaaacctcttcttgtctttggatttcggaggaccataggttctggaatgctgactcgcgtatggaaagatccatggattcccactatcctagcgcggcctgcaaagagcattcttaacataagagattctctactctatgtcaatgatttaattgaccaaaacacaaatttgtggaaattggaccgtctccaagcactgatcgatcccgttgatattccactcattttagggattcgcccaagtcgtacctacttgagtgatggctttagctggtctcacactaaatccggtaattatactgttaagtcaggatattgggtcgcgagagatctttctcgtcctacttgtgaccccccttttcagggaccaggtgtttcggcacttcaggcacaagtatgaaagcttaaaactacgcggaagcttatgcatttcgtgtggcaatgtatctcgggttgtttagccacttgtcaaagattgacatatcgccatatgggtacagataaaggttgtccccgttgcgaagaagtagaagagacaatcaaccatctattgtttcattgtccaccttcgagacagatttgggctttatcgcctattcctacctcagggaatattttccctagaaactctctcttctataatttcgacttccttttttggcgtgaccgagaatttggaattggagaaaaggtgttggaactctttccatggataatttggtatatctggaaaagtaaaaatcgttttgtttttgagaacttcagggaacctccccctgaaactttggttttggcacttcaagagacagctgtttggaaacaagcaactctaaaagaggatgattccactcgtccaatcgtgttcgtaggttcttctcagaccccgtccaccttgctccctgaatgtcaactcgatgcatcatggcatgtagatgacacattgagcgggcatggttgggtacttgttcgacaagacttggtcatccaccttggccttaagagcactcgtcgaaatttatcaccgcttcatgcggaatttaactctttgttataggcaatggagtgcatgatctctattggtgatacttctggtacttttgcttcggattgctcagacttgattgctatccttgataaccaagacgattggctgacttttgcagcggaattggcttcatatcgttctttagtttgttttttcccttcttttcgtattagatttctttctcgtagttctaatactcgagcagattgtttagctaagaaagctcgggctcgcaatagccttttttcccatgtaagcacattggttcctaaatggctctctctagcggagagtctcttcccgataacttaatataaatggtgtttgaagaaaaaaaaaaaaaaatgcaacaaaatctactcgattttctattttgatacaatgctccattcttataaaaaaaaataaaagaggaaaactgtaaagtaaggtgtaaatttggtgaagaaaatcattatccaatcaaaaacgttttgtgtaatagaaacgtaaataaaacgagtcaaggcaccgacacaagatgatctcaatggggatttgtgtttccacctaatacgacatcgtattcaattcctaaacgacgccgttccgctcgtgcttacccataaatggaaaaatatctatacaactgccacgtcagcacaccaaaaaatatcaccggcgaaaaacacacacagtgatattctacggcggtggttcagtctcttcgaagctcgtcgtctctctcttcaaaactccggtgaaaatg

SEQ ID NO: 28208 - DNA, 3003 bp, Unknown
  misc_feature (1)..( 3003): 2750-1469P.txt file - cDNA_ID_2994527; gDNA_ID_2214630; Annot_ID_136027
gcaatgataatcagtaaaagggagtttttcctaattgatccatgttttctaaagctacaatatatatatatatatatatatatatatatataaaattggttgtatatatgccatgtaatacagaaaccgatagaagcgttgctaagtgtaggatttttcatttttgactcaaaagttaactatattatttgcaggaaacaatggatttagatatgattattgcattgcagaatgttcagaacattttttagatgatgtatgcaagccagtgtgtatagacaaggggtactcggatggaggatgtattggtttagcaccaaattttaaatgttgttgtaagaaatgatagaaaccaataatctttatagtaaaacggtgatggtgatttgatatcttgtatgttcttcgatgaaataaagctaatcttatctttgataagcttcagaagtcttaataatttcacaaaagcttagcattatcgatatcctagagataagaaggtataaaaaagagtaaaatttatattgaaccaaacaattcatgggactgttttatcagaggatttggcgagtaatggcaccggaacgagtccgtgtttttctctggttagtggtgcagcaagtgatcataactaatgtggaaagatatcgaagacacttgagtgatacgagggtgtgtcagatttgtcaaggcggggaggagacgattctacatgttctccgcgactgtcccgcaatggcagggatatggagccggttagtccctcgtgatcaaatacgacaattcttcactgcttctttgctggagtggatctacaagaacttacgggaacgtggatcatggccgacggtgtttgtaatggcagtatggtggggatggaaatggaggtgtggcaacatctttggcgggaatggtaagtgtagggaccgtgttaagtttattaaggatttggcggaggaagtggcgatagcgaatgcttttgtgaaggggaatgaggtgcgggtgagtagagttgagcggttggtgtcttgggtatcgccggaagatggttgggtaaagttgaacacggatggggcttcgcggggtaatccggggtttgcaacggcgggtggggttttacgggatcataatggagcgtggattggaggttttgcggttaatataggtgtttgttccgcacccttggctgagttgtggggtgtctactatgggttattcatcgcttgggggaggggagctcggcgggttgaattagaagtagactcgaagatggtggttgggtttctcacgacagggattgcggattctcatcccttgtcattcctattacgcttgtgctatgactttttatcgaagggctggatagtccgaatctctcatgtgtatagggaagctaatcgtcttgctgatggattagcgaactatgctttctcgttatccctaggtttgcatttgttggagtctagacccgatgttgttagttctattttgttagatgatgtagcgggggtttcgtacccgagacatgtccaagtgtaatttttttattttcttttaataaaacgggagacgcagtctccctcattctaccaaaaaaaaaacaatgcagatatttgcaaatttttcttctttttagatacagagtatatgtaggcatgtagctaaagatacttgatttggtgtgattttgatcatctggatgtaaaaggtatggtgatgcgtctagtgttggagcacttgaggctttggttattggtgttgtggtcattgttaattagtaccaatgtgaagcacctttatcgatttcacagggactggaccatagtgatgcttgagtgacgactcttattcgtcgtggtctaagccgcctctttatcatttttagggctctttggtcgactaattttattttatttttccctttcactagggtttcctgacttgttaaacaagctttagctctccgattaacagctaacagctcttttaccactcagaccctttatttttttatcccggccacctattatttattttgcttgattttatttcattaataaaatttataggaaaaaagaaaaaatttaaaaataagaaacaagaggtaggctcttctagcgaactcctttcatacgttttctctctactctcatcgcttttcttatctctctcggagctcttccgtcgtccaccattgattacggtaagattcaccttctcctactcaatttcataactatagataaataaatctctgtcttctctgcctctgttagtttttttctacgattgaaaccatcaaatcaattcaaggttttacacagtttcttatgcttgtcctgattgtttcgttcccggagagggagaaattacggcttttggaatccgcccagaaaatttcccgcccagctcggattttgatagaaatgttttgcctttttggtttctgtaaaattgatattcttattgtactttgattgaagtatgtgtgttcaattgaaattgatgttgtgtatttcttaagtttgaatctttgtgtaaggattgggggtttagggttttgactcatgattgctttctgcatttttaaagttaaaaagccagactttgaggcttagagctacttatattgtgttgcagggagtgtattgagctaaatatggctataatacaacttggaagtacatgtgttgctcaatggagtattcgtcctcaatttgcagtcagagcttattatcccagcagaatcgaatcaactcgccatcaaaagtatgatttttaagtctctggattgcattcagttctgtggctttaagcctttcaagtattttgatttgttcacattgcacatcttaagattagtcttcgtagaatgaagtttgtattatgtgatttctacactgagagttttatatatgaaatagcattaaaggttttccttttcacaacttttacagttccagtagccaagtaaattgtttgggagcttcaaagtcgagtatg

SEQ ID NO: 28209 - DNA, 3003 bp, Unknown
  misc_feature (1)..( 3003): 2750-1469P.txt file - cDNA_ID_2994527; gDNA_ID_2214630; Annot_ID_187922
taccaccggagattaaaaggggaaatcactttcataggatggccagtttgggcttcacactgcaattttcatttaagcttcgaaatcggagattcatgaaacgtttggccggagtttcgagcaaaataaaataaaattataggatcgattaattgacagagatggtgttgttcagctaagaaaatcacaattctagagctgtgtaaaagttctcgagaaaaaatgtacggtcaatgcttttaattggattgaaacttgtttatgtgattaaggaaaataatgtattttcaataaaatgaaattgtctattcttgttaaggcaatgaaaagttctacttttagcaatgataatcagtaaaagggagtttttcctaattgatccatgttttctaaagctacaatatatatatatatatatatatatatatatataaaattggttgtatatatgccatgtaatacagaaaccgatagaagcgttgctaagtgtaggatttttcatttttgactcaaaagttaactatattatttgcaggaaacaatggatttagatatgattattgcattgcagaatgttcagaacattttttagatgatgtatgcaagccagtgtgtatagacaaggggtactcggatggaggatgtattggtttagcaccaaattttaaatgttgttgtaagaaatgatagaaaccaataatctttatagtaaaacggtgatggtgatttgatatcttgtatgttcttcgatgaaataaagctaatcttatctttgataagcttcagaagtcttaataatttcacaaaagcttagcattatcgatatcctagagataagaaggtataaaaaagagtaaaatttatattgaaccaaacaattcatgggactgttttatcagaggatttggcgagtaatggcaccggaacgagtccgtgtttttctctggttagtggtgcagcaagtgatcataactaatgtggaaagatatcgaagacacttgagtgatacgagggtgtgtcagatttgtcaaggcggggaggagacgattctacatgttctccgcgactgtcccgcaatggcagggatatggagccggttagtccctcgtgatcaaatacgacaattcttcactgcttctttgctggagtggatctacaagaacttacgggaacgtggatcatggccgacggtgtttgtaatggcagtatggtggggatggaaatggaggtgtggcaacatctttggcgggaatggtaagtgtagggaccgtgttaagtttattaaggatttggcggaggaagtggcgatagcgaatgcttttgtgaaggggaatgaggtgcgggtgagtagagttgagcggttggtgtcttgggtatcgccggaagatggttgggtaaagttgaacacggatggggcttcgcggggtaatccggggtttgcaacggcgggtggggttttacgggatcataatggagcgtggattggaggttttgcggttaatataggtgtttgttccgcacccttggctgagttgtggggtgtctactatgggttattcatcgcttgggggaggggagctcggcgggttgaattagaagtagactcgaagatggtggttgggtttctcacgacagggattgcggattctcatcccttgtcattcctattacgcttgtgctatgactttttatcgaagggctggatagtccgaatctctcatgtgtatagggaagctaatcgtcttgctgatggattagcgaactatgctttctcgttatccctaggtttgcatttgttggagtctagacccgatgttgttagttctattttgttagatgatgtagcgggggtttcgtacccgagacatgtccaagtgtaatttttttattttcttttaataaaacgggagacgcagtctccctcattctaccaaaaaaaaaacaatgcagatatttgcaaatttttcttctttttagatacagagtatatgtaggcatgtagctaaagatacttgatttggtgtgattttgatcatctggatgtaaaaggtatggtgatgcgtctagtgttggagcacttgaggctttggttattggtgttgtggtcattgttaattagtaccaatgtgaagcacctttatcgatttcacagggactggaccatagtgatgcttgagtgacgactcttattcgtcgtggtctaagccgcctctttatcatttttagggctctttggtcgactaattttattttatttttccctttcactagggtttcctgacttgttaaacaagctttagctctccgattaacagctaacagctcttttaccactcagaccctttatttttttatcccggccacctattatttattttgcttgattttatttcattaataaaatttataggaaaaaagaaaaaatttaaaaataagaaacaagaggtaggctcttctagcgaactcctttcatacgttttctctctactctcatcgcttttcttatctctctcggagctcttccgtcgtccaccattgattacggtaagattcaccttctcctactcaatttcataactatagataaataaatctctgtcttctctgcctctgttagtttttttctacgattgaaaccatcaaatcaattcaaggttttacacagtttcttatgcttgtcctgattgtttcgttcccggagagggagaaattacggcttttggaatccgcccagaaaatttcccgcccagctcggattttgatagaaatgttttgcctttttggtttctgtaaaattgatattcttattgtactttgattgaagtatgtgtgttcaattgaaattgatgttgtgtatttcttaagtttgaatctttgtgtaaggattgggggtttagggttttgactcatgattgctttctgcatttttaaagttaaaaagccagactttgaggcttagagctacttatattgtgttgcagggagtgtattgagctaaatatg

SEQ ID NO: 28210 - DNA, 3000 bp, Unknown; identical to SEQ ID NO: 13515
  misc_feature (1)..( 3000): 2750-1469P.txt file - cDNA_ID_2994531; gDNA_ID_2214633; Annot_ID_136085

SEQ ID NO: 28211 - DNA, 3000 bp, Unknown; identical to SEQ ID NO: 13515
  misc_feature (1)..( 3000): 2750-1469P.txt file - cDNA_ID_2994531; gDNA_ID_2214633; Annot_ID_188034

SEQ ID NO: 28212 - DNA, 3003 bp, Unknown
  misc_feature (1)..( 3003): 2750-1469P.txt file - cDNA_ID_2994535; gDNA_ID_2214634; Annot_ID_136102
gaaaaatttgttacatagaaaactattaaagagttctcattagatgagggtcatttggtcattttacttaagagaaggggtatttttaaaaatagataaaagaaaaatgtattattgcaaaagggtagtacaaaaatggtacttttgcatatcccccaaaaatataaagatgatcaatcaagagtcattaaatccgtttttctattaccactttcgtaaccatcaacaaccaccatcgccacttgcataacaatcacacgttactcctatattttttagtatgacatgctattttattaaatgacattgcttttccccatgattctcgttggatatttctcttaagttgttaatattccaatattgactttttttttttggatttcgtgtaattagtacttattttactcttttttatataaattacaatacgttgttgtatgtttatcttttgtttgagattaatttattttttacccatggctatttggctattttcatacttattttaagtcaacggtggagtatttatgaaaaagttagttttcttgatgagaaaatatagataattttttatatatatagatgtgagtatttacaaaaaaaaatcttataggattagttaaataattgtataatttccttgtccttattctatttatcaatttatttctggtttagttagtaacttccaattaaaatgtttaaaatatttttttaatttctatatttataaaaaacagacatataattttattatatataaatatagtttccttccgatccttattaaattcacgacatatgacaccttcttctctttctccatacgcttgatggacatgttcaatatcttctctgcgtagaatcctggcgaacggttataatcgtacatcgttggagatctcctgcacacttgcctccattaatctgtaaatttgctaataaatcgcagtagctgggattcgaaccccagacctcttggtgtagaagcactaataaaccattggtcaaccattggaacaagggagcttccacaaaaaatatattcatatatatatatatatatatataaacagttgttacaatcccaatcatcataaaatctgtagagtcctcttccaatcttaacatcgtagacaacgtttggatttctgcaagtggagtgggtacttattactctccaggtattcctgtcctgcatgaagttgttgtcaactgtatagagtccgtcttccttaataagtatagtgaaagagcttgtttcaaggaacagtaaatggttgttgtcataaagcgttgtccactcagcagcattaagccaactttgggttgatgctttaagtacatgtgcgacatctggcaaatatagcatcaaaatatattagatttgtagatatataaataactatcttagttttgctacaatgtcttcttcaattagaattttccaagcatcagttctatcacaaaccttctcctagatctccctagaatccagatctgctacattcttagatttttaaatcttgcctaagtgttacaaattccatagatcttgcattccctaaatcttgatgttctaaaatttctaaatacaatgcctcgatttcccaaattcgccacagtatctcgatgatctccttcaaaactaaaagagtttttaactaaccaaatactcaaatactcctaatttgtattcttaaccctttaaccatagcctaaacaatacccaatttttaaaataataaataaacacttacattgtttttattgctttctttgtaaactatgaatttttttttgtatatatatataattttatatagatttcactatacatatgaagaaaattaatcagacacatattattagttgcactctcattttcttggaagtaggaaaaatgatataacttgtttaattgtacaaacattacccaattttttttattttatttttgtcgtattgttttggccgaaccattttcttcttttataaaatgggaatttttgcattctattttcgtagacaaagagtaaattaatcatttgtgagagataataataaactttggatgttcttgtctagtagcttaaaataaaattgagtatttttggtttagataaatgtataaatggtgtctaatgtattcttaccattggatgtttgacaaattacacatttctccattttctttagagtaatcaaagggataagcattgtaagagtttataacgatggtccttgtgatgatctaaataatgcattaggcagtgcttgttgattaaagaatgatgaaatcctttaacactcacatgttaaaatatttgttaacatcttgtccttaatattgttaaagaaacttaactaaacttgttaacattttgattatgggtgtcaaaatgggtcaaaatttatgggtcaactcaattcaactcaacccatgaactctaatgagttcaaaattttgactcaaatgagttgatgggtcaaatgagttgatgagtcaattggtttgatgagtaaaattagttgggttgtaatggttaatggtactatgagatcatttcaaattttttgatacatggtgttttcctcccaaatatatgactataatatcactaaatactatgagatctcgtagagttgttgagtacgataaaagaatctatgaaaaaagaacttaaataaagaggtatacgtttgacaaaaaaaaaaagaaaaaagaaaaaggaaaaggtataaaaaaaaacatttgagttgggcttatatgggcctgtttgaaatttggtgacattacttttcgccaaaagaattaaaaaggcccatataggcccaactttaaacattactctaatatttatatctttctcacttttgctttattctgatttcttctcctatctccttctccggcgaagaaattgaaaattcattatccctaaaaccctaataaaggtccagagagtcgtcagaaaccaccgattagcttttgaaatg

SEQ ID NO: 28213 - DNA, 3003 bp, Unknown; identical to SEQ ID NO: 28212
  misc_feature (1)..( 3003): 2750-1469P.txt file - cDNA_ID_2994535; gDNA_ID_2214634; Annot_ID_188065

SEQ ID NO: 28214 - DNA, 3003 bp, Unknown
  misc_feature (1)..( 3003): 2750-1469P.txt file - cDNA_ID_2994546; gDNA_ID_2214638; Annot_ID_136177
tcaacagaatcccatccaaaccggtcaacgtagtcttgaaccgattttctagcatcaagactcatcatctgtaaaactcttctttgttcgtctgtataattcgttcctcctccaacattcatcccaattttgacgtattgtctaacaaaattggagtaaatgtaagctgcaccactgaacattggtagcaccaaccacatacagaacaaaagcttcaagtatggccaaaatggtagcctacaatatgcaaaagaacaccatttttttgtctttataggcataaatttttgaattcgtaacagaatttagtgaataatattgtaattaccaggcaaggactctccaaacggatagctcgaatatcgttattaaagagtaaatgatccaatatgtaagccattgttgatcatctaacattgttggactctctattgctcgaaatgatgcatacctaatcatttattcagttaactatcaagttgcatttgtaaaaaccaaacatttaaattcagatttgatatcacttacagaggatagagaagcatgactccaggcctgcatgcaacaagaaaaaggaagaaaataatgttaaaaatttgacaaatatagtgtttatttttattatatgagacagaatttgaataaaatcctacccaactagagcatcaaaacgttttgcaatcgcaataatgaaacccattttctttttgagtttttactcttctttcaacagaaactttctcaaacgtctttagcactgtgacgttggatatatacacaaaagcttgaaatttcttcaagcaaaagaatctttgtgggagttaaggcaacaagccaggtaaagaatctccaacgcattgttacgttttcatgaacctatttattatatgttctaagaagaaaaaaaatatctcaaagtaaacgttggaaaatttctgatgaagggaaatccaaagtcttgggtttagtatccctatgaatggtatttggaatatgttttcgtcaaaacaaaagattcttttctttttcacaagagttagtgatcaataacttatgcactaattaatgagattggacgtatacacaatttgattatgatacttgagtaaaaatcacctgtcctttaatttggaaatctctctttcttacccatttatatactacttcttttcattaaaattaaatttcaattatcaatcatcgttcaatttgataaagatttaacattttttgtcacagggctagtaaaagcaatctttacataattcatctttcttacatatatatattacctttttcttcattagtattctatttgattatgattattttgtcataaagctagtaaattaaacactcgatatgagaattatattacttcacgctaattaactcttaacacaacaagaactagtgcatattcaactttcaaagcatatactatatattgagaatatagaccacgaaagtcaatcaaaagacctaccagctctcatcaagttctttcttgaaatgattttgcagaatttccaacttaattaattcgacatgaatgtgaaaatgtgtgttgctcgttaagaaaattgaatagaagtacaatgaaaatgatgaggaatgggcaaaacacaaaagagtttcctttcgtaactacaattaattaatgcaaatctgagaaagggttcatggataatgactacacacatgattagtcattccccgtgggctctctgctttcatttactttattagtttcatcttctctaattatattgtcgcatatatgatgtagttcttttgtctaaattacgtaatatgatgtaattaattatcaaaataaatattcaaattgccgttggactaacctaatgtccaagattaagacttgaacataagaattttggaaaaactaaaccagttataatatatactcttaaattgccatttctgaacacaaccaaataataatatatactatttacagttttttttaattggcaagaacactgaaatcttattcattgtctcgcttggtagttgacaagttataacactcatattcatataaccccattctaacgttgacgacgaacactcatataaaccacccaaattcttagcatattagctaaatattggtttaattggaaatattttttttatatataaaatgccaggtaaatattaacgacatgcaatgtatataggagtagggcaataaaaagaaaaggagaataaaaagggattaccaaaaaaggaaagtttccaaaaggtgattctgatgagaaacagagcccatacctctcttttttcctctaaacatgaaagaaaaattggatggtcctccttcaatgctctctccccacccaatccaaacccaactgtcttctttctttcttttttcttctttctaatttgatattttctaccacttaattccaatcaatttcaaatttcaatctaaatgtatgcatatagaatttaattaaaagaattaggtgtgtgatatttgagaaaatgttagaagtaatggtccatgttctttctttctttttccttctataacacttcagtttgaaaaaaaactaccaaaccttctgttttctgcaaatgggtttttaaatacttccaaagaaatattcctctaaaagaaattataaaccaaaacagaaaccaaaaacaaaaaataaagttgaagcagcagttaagtggtactgagataataagaatagtatctttaggccaatgaacaaattaactctctcataattcatcttcccatcctcacttctctttctttctgatcataattaatcttgctaagccaggtatggttattgatgatttacacttttttttaaaagtttcttccttttctccaatcaaattattagggttcttcagttaatccttataaaccatttcttttaatccaaggtgtttgagtgcaaaaggatttgatctatttctcttgtgtttatacttcagctagggcttatagaaatg

SEQ ID NO: 28215 - DNA, 3003 bp, Unknown; identical to SEQ ID NO: 28214
  misc_feature (1)..( 3003): 2750-1469P.txt file - cDNA_ID_2994546; gDNA_ID_2214638; Annot_ID_188198

SEQ ID NO: 28216 - DNA, 3000 bp, Unknown
  misc_feature (1)..( 3000): 2750-1469P.txt file - cDNA_ID_2994549; gDNA_ID_2214639; Annot_ID_136203
aaaaaactttttaagactgtttataaatgcggtataaacaatgttttatttgacaaacaccatttttaagatatcttattttgtattttttttttaaatagaccaaaaacagcggtatcataaaatcggtatttgcggaattctactttaaaaaaaaaaacataataccaaagggggaacgcaactagatgatgaaaccatatgactaaaattatcatgtaaaaaactattaaataaaatatttgctaaatattatttactatataatatattaatatggaagatatattaaaaaaatatatcatggaagattattgataaattctttcatgttatggaagatctattaaagtgagtttgaatggttcatatgatgttaatttattcaattctagtcaaaaccattaaaatgaataatagaaatattataaaaccaaaaggtaaatcatcaatattttgaccaaaaagaaaggtaaatcctaaatataatattaaacttcataaaaaaatgttgaatattttttttaaagaagacaagagatgtcctcttattacggattcttaacactgattttgattactttttctaggtttttctttcttttgaatctaactatattttccgataaaaaaaacttggtgtattctcaagaaacatctaatggccatcacaaaaatgtcatctcttataatactttcattgatgatgttgactttcatctatattcccatgatttcaggtaaaaaatttatctgtttataagtaattatctcatttttttcatagattatcttaagaaaatgatagttttgccacttgagtcttttttttggtggaaatccacttgagtctaaatagtaaatagtagatgcaaagaagaagaaaaaaaattatgtgggggcaataaaaatctttaaatgttctattgactatttttttactgttgatatatgaatcaaatagggcaattcagaggaatcaaacagtgtgagatgaaatgttatagcacaccagaatgcaatgcaacatgcttacatgaaggatatgaagaagggaaatgtctgaaaagttgggatggtggagttgagtgttgttgtctaggcctcctggctagttctcatcaagatagttctcctatttctagtcctcactatataatatttcatggcatatgtattctcaatatatgaattcaaaaatatatattcaaatattatgatcgacaatatctcatccaagttctacactaatcaaattttatatccattatcattacttattctcactgcaatctccacagatcaaaagtcttctcttttgtgccaaacattctcagatttattcttcgcactgaaccgattggttatttcggttaaccgttatttcgaatttgggataaaagaaaacaaaaataaccgattttgggaaaaaaacggcgagacgagagagagatataagtagttatgggcgttaggttattcattcggttttggtttctattaggttatcgattcttttggttctaatgtttaatccattcggttattttgaaatgttggttcggttccggttctttcggtttaaatatttagtatccattcgattattttgctttgtatatttttcgatatttcagttatttttaagtatttttattattttatatatattttcaagtattttaattatttagtataaaaataactaatattttaaaaatataattatatttccgatatttttgattacccgaaataattcaatttggtaccgattcggtttcggttctttcggttatagaatttactatccattcggttatttcaaattttcggttcggttcgattcggtttaattcttcggtttcggttccgtaagttcggtttggtttatttccccaggttttttttttttaacaatttctttcaattgatatgattaatagtgattacagtgtagggcgtttgtgataaaatttggtacaaagtaatgataaataaaggaagtgtcttgtggcagatgagattttgcaagcatatcagccggttggttgttcgttctcggcgtccaactgaaaataacttcttcaaaacgtttgctccatgaccaagcttcacgtatccaattaaaagctccaaaatgcatttgttttctgttcagtagttcttccacctgtttgctatcaccttcaaagatgactttacggtacccttgactccaagtatgctgcatggccatgaccaaagcttggagttcactttccaaagcattattcattgttcctccaactgcttgtgctgctcctttatagaatcctttgtcgtctctgattagccatcctgagtttgtttgttgtgtgcggtaattgaaagagccatcatagttgcatttaatccatcccattggtggttgttcccatttctgatgtgtcgattcccgattgttgcagccttctcttactgtgtaatgattcagactttggatatattcttgcgcattctcccattcttgtacgtcatcctttgctcgctttagtgtactttgccaagataaattctggtgctgaaaaacaagctggtttctactcctccaaagtctccacataatccaaagtgcaagttgagatagttgcggttgatttttagccaaaattcttgatagaatgatctccaactttgtctctaccgatgcaccaacgcttgttagaatatgatggggaatgcccgatgcgcgccaaacctgttgagcataaaaacaatcaaaaaataaatgctgtgacgtttcctcatcctgacagcatctgcgacatatagaatggttgttgatgtgtctgcgacgaagattatctcccgttgctaaagcctcagaacaaatcttccataagaaatgtttccccaggtttatagataaaagaatggtttacttcactgttgaaacgttcaaaacaaaatagcaaaaaaaaaagacataacgggcccattaaggcccaaaatatcatg

SEQ ID NO: 28217 - DNA, 3000 bp, Unknown; identical to SEQ ID NO: 28216
  misc_feature (1)..( 3000): 2750-1469P.txt file - cDNA_ID_2994549; gDNA_ID_2214639; Annot_ID_188250

SEQ ID NO: 28218 - DNA, 497 bp, Unknown; identical to SEQ ID NO: 13805
  misc_feature (1)..( 497): 2750-1469P.txt file - cDNA_ID_2994569; gDNA_ID_2214653; Annot_ID_188697

SEQ ID NO: 28219 - DNA, 497 bp, Unknown; identical to SEQ ID NO: 13805
  misc_feature (1)..( 497): 2750-1469P.txt file - cDNA_ID_2994569; gDNA_ID_2214653; Annot_ID_136458

SEQ ID NO: 28220 - DNA, 3000 bp, Unknown
  misc_feature (1)..( 3000): 2750-1469P.txt file - cDNA_ID_2994580; gDNA_ID_2214663; Annot_ID_136542
aaattctcagcttctatctcttatgtttgttgtgagcgatagtgtaatgactatattcaatttttaccgtacgaaacagtaaaccgtcagctctagtgatcgacaaaataacagatcgggtctcctcgcacctatattttaatatgacttgtcttcacgacctcattagatgttggctcgaaggaagaagtactgatcaagattgtttcttttcaacttccattcttctaaaagtctatttgtttcttttcaatcttcattcttttaaaagtctatcttttctttcaaacttttgaaattctctattaattaaaatataaatatctttgttgaagctaaattttacattccaacagaaaaagagaaagttaaactaatagaaatgtacagacggcacttattcccaaaatgtaagttacatttctataataaaactaacaacactgagaaatgagaatgatcttatcaaaaagagaatgataaaaaaaaaaagaaaaaaaaaagagggaatgatcccatcaagttttcggagtattgcttgtacacacttggtctaggaaaaatcttaggaggtgaaatgttacttttgcatttaggcccaattatatcttctgtttttaagaagttctgactagtctgtttatttgtaatctgggctaaactaaatttatttgtaaaagcaaaggtacatttaaaaaaaaaaaaagacgctcactctattgtgttcttcttgttcacgttttcttttgtcgctcaacaatatagagtaaaaacaaagacattagggaaaaaaaatgaacaattgaacattacatagaaagtatgaattaattaagcacattgttaactctaacgacacaatcatgttatatataaaatatatatagagcgagtgtcagttcttgaactcactctcacaattctccgacacaatctcaaccttcttcgcatctaatagtcccttaaccttaacatcacaagtcaccaccacttccttgttccgtttgaccggccctgcttcatactcagccttcagctccatattcagcatcagaacaaccggttgcttcgatccacgaggttgtacaactgcgttcttggtcgacccattaagcttcacattgaccttgtcggatccagatgcggcctgggacaaccccggaaatttcccgctccccaggctcttattcttgtacgttaaggaaacgaccccgttcttttccatcatgtagcgtactcccatgttagacgttggattctcggctcttaatgtgacctcaaaattactaggatttacggtcaatctctcgaccgcgaaaacaggaagagtggggttgaaagcgaaatggaggatgagaatgattgcaccgagtaagaatccgaaaatgaccaagataatgaagaaccacaaaagacgtttagaacaccctttctttttgtttttctccgggttcttgctgcgtttctcgacgtattttgcatgttccggaggaggggtccaatagacttgatctctcgggacttggacaacgtacgtctctaactcagggattgaatccggaggaggaagaggcggagaagatgtcgttgggagtggagacagattaagagaatgattacgccaatggtgtgaaccgtgcgatggaggatctaaagatggcaatgcggggaggctagaggttggacggtgccaaacggacggaggatcatcgggtttgtcatcgtcagagtcaggggcggtggcggaaggaggacgccgtggcccctccatcggagaaaggtgggagttacgagatgtgtggtggagattggtctacagagaagacgaaagagagagaattaagagaggatgcgaaaattagggtttgcatgggaaaagtaagtggttgttgttgcatgactcaaacttttggttggttttgagaagattttgctatttagagttagccagctcaccttaaatttccctttttctgttatttagaaaactatattacagaactcatataatatagtattatggcatttgatgatgatcaacgaagttgttactttttgtttacaagatatcgattttctaacataaattatatatgcatataagacatacatgagtaaaatcttaaaaaggttagcacatattggtaatgtttatcatgaacgagtcttattttattttgtacgtttcgaactaaaaccatttttgggtggtatttctggaccaaattttcattaaagtgttttttatttcaattctcttgcaacttctgtttctttagaaagcgaaaaatgcatatatacgaatatacgttgggattgacatgaacggaatgtatgtatttacacacattaatccgcagcaaccggccattcaaaattatgtttgtgggccttgttgctgcttcgctgacaatactatccaaaatttatttcatttttctttctttgaaaaacacacaatcacttaattttcatttataaatcaaacatatgtacatgaaaatatcaaggaaattaaaggaaatcttaccttcatatggtcgaaagttttctttcaaaaagcaaaaacaaaaattaatgtttctctaattcttccccggccccaatccacgtgaaacatgttatgttgcgagcattacactggaaactgttacattacattctaattggcgaaaaatgaagtgcatttgtattgtatctcacgaagatttgcgtttgtgacaaaaaaaaatatgcaatttttttcgaaatctgacaacccatgccgacctgtccgccgagttaacgacgtgcttataggatccttaagtatttttattcttatttcttactcattccaacggaccaaaaacgaccacgtcatcttcatacgcaactcccaaaacagacgataattaaatcattgaaatctaaactctcatatactttagcattttcaacatttctattaatatttccatagactagatctctctttcttatacatccatatcaccgatg

SEQ ID NO: 28221 - DNA, 3000 bp, Unknown
  misc_feature (1)..( 3000): 2750-1469P.txt file - cDNA_ID_2994584; gDNA_ID_2213638; Annot_ID_132206
gcccttttcttcctctgtatgaacaggcaatgtacaatgaattttcgacggcaaatatccaagtcgataaagatttcagcgccaagctatcaggatacggttgtgcaggccatgcgcctgagacagagacatctaatagttcggcacttgctaatctctctgtcgagactctagagagagggcttttgaccccgaagagcaatgtgtggagctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggctaggagcatagcagatatagcacagaaatgtctgcaggtggagccttcagagcgtccaaccatgagaaacatcgtggatcaactcaagatcatacaggacatgaagtactcgtgtaggttcccattgagagaacccgcaccggtcgtggcaaggaaacatatgggaagatcaagcagtctcaacacgattatttggaccccggcatcagtgccaccaaggtcgagtttttcaccgtcacctccaccacgacgaccgtctgtctcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttgatttgttcatatctctcttctttcttctttttcctatttgtttttaatttttggcgttgatttgttttttggattccaaatataaaaaattgtttttttctttttcttttgttgtttatgaatccggacgtcgatagagagggtttgtgatgttttgtacataataatcaacatttcttctttcacattaaaaagagatccaagtattgtgtactcaacagaaaaactgagaaaggaaaaagaaacctaccttattcaagaatctatctctctgattcgattcaaatctttccagtgatcgttcatggcttcctcaaagtgtttgttgttgccgtcgctaccatttgagttgatagaagaaatactttacaagattcccgccgaatccttgatccgattcaaatcgacgtgcaagaaatggtacaatctcatcaccgagaagagattcatgtacaatcacttggatcactactcaccggaacgattcataagaacctatgaccaacagatcattgatccggtgaccgaaatcctctcagacgcactaatcccggacgagtttcgcgatttgtatccgatttattccatggttcactgtgatggactaatgctgtgtacgtgtcgaaaatgggacaacagtctcgcagtttggaatccggttttgagggaaattaaatggatcaaaccgtcggtttgttacttgcacactgattacgttgggattggatacgacgacaatgtatctcgtgataactacaaaatcttgaagcttcttggtcgtttgcctaaggatgatgattcagatccaaactgtgagatctatgaattcaagtctgattcatggaaaactcttgttgctaagtttgactgggatatagatattaggtgcaacaacggtgtgtctgtgaagggtaagatgtactggattgctaagaagaaggaagactttactattataaggtttgatttctccactgaaacattcaaggagatatgcgtctgtccttatactttggtgactcgattaggctgtttcgatggagatagactctctttgttactacaaggtgaagaatcacaggggattgaggtttggatgacaaacaagttgagtgataaggttgtttcgtttagccaatatttcaatgtcactactcctgatcttccagcgttacatctccagtcttgtatggcttgtccgggatactccattggtaagcgcagaaatataagggtgtggtgtgagggaagtgtagacgtggatgataagtcgtatgttatcatcacgttttacgaaattgatgaaggtggggtcataaaacaaattgagacagcaagctatggacagtttgagtacgatgacccgtttatttgttgctatgtttatgttccgagtctgattccgattcagtgattcccgccgtccagaagaaaaatagttagcgatatgagtgttgtttcgtgttcttaaagctagggttttgtttggctttgtgtttggtgatcgtctaccatgtacatattgaaacgaactaggttattgaaattgacttctggttttggtttttgtatttatgagcttgagaagttttaggtttggtacagagttgtatcatcttccatatattgctaaaactaagcatcattatccgaagacctaaacatttacaatgaacaaatctaacatttcaattgatttgttcatgtgcatacatataaaaaataaaatgtaactatttgaggaaaaaaacatctaatggcatttgattggaattggtactctaaaaaatcagataaaagcgtatgtaaaccggataattgaattgaaccgaattacggttcggttttgttgttggtgtgataaaggttcgattgagccgtaaaaccttccgtcctcctcgagtcctttccatcaggaccttatccacagtccacacacagcgagactctatttactcgccggcggaagaacaaaatggcgggaagagcgattttctctgtatcttgttcatctactccttccttgtgtatcccttattcaactgcttcgttttcatcgatgaatcgactggcgctccccgccgtccggatttctccccgaaccaacagatttcccagttaatatctctattcgcttctttaaattcgatgcatgcattgattttgaaatttatattcagacacgtttgatttttgcagggattcactgctctatg

SEQ ID NO: 28222 - DNA, 3000 bp, Unknown
  misc_feature (1)..( 3000): 2750-1469P.txt file - cDNA_ID_2994584; gDNA_ID_2213638; Annot_ID_181109
gtgacggttctgacacaagaatgttggtgtacgagaggcttgctctgggcagcttggaccgtttactgcatgggagatcagatgggcctcctcttgattggaacactagaatgaagattgcactatgcgcagctcagggtctaaccttcttgcacgaagaaggcccttttcaggtacgctaaacaaaactccatcaacatttgtgaatttgggtggtaacaaggtttgttgtgattgagcccttttcttcctctgtatgaacaggcaatgtacaatgaattttcgacggcaaatatccaagtcgataaagatttcagcgccaagctatcaggatacggttgtgcaggccatgcgcctgagacagagacatctaatagttcggcacttgctaatctctctgtcgagactctagagagagggcttttgaccccgaagagcaatgtgtggagctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggctaggagcatagcagatatagcacagaaatgtctgcaggtggagccttcagagcgtccaaccatgagaaacatcgtggatcaactcaagatcatacaggacatgaagtactcgtgtaggttcccattgagagaacccgcaccggtcgtggcaaggaaacatatgggaagatcaagcagtctcaacacgattatttggaccccggcatcagtgccaccaaggtcgagtttttcaccgtcacctccaccacgacgaccgtctgtctcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttgatttgttcatatctctcttctttcttctttttcctatttgtttttaatttttggcgttgatttgttttttggattccaaatataaaaaattgtttttttctttttcttttgttgtttatgaatccggacgtcgatagagagggtttgtgatgttttgtacataataatcaacatttcttctttcacattaaaaagagatccaagtattgtgtactcaacagaaaaactgagaaaggaaaaagaaacctaccttattcaagaatctatctctctgattcgattcaaatctttccagtgatcgttcatggcttcctcaaagtgtttgttgttgccgtcgctaccatttgagttgatagaagaaatactttacaagattcccgccgaatccttgatccgattcaaatcgacgtgcaagaaatggtacaatctcatcaccgagaagagattcatgtacaatcacttggatcactactcaccggaacgattcataagaacctatgaccaacagatcattgatccggtgaccgaaatcctctcagacgcactaatcccggacgagtttcgcgatttgtatccgatttattccatggttcactgtgatggactaatgctgtgtacgtgtcgaaaatgggacaacagtctcgcagtttggaatccggttttgagggaaattaaatggatcaaaccgtcggtttgttacttgcacactgattacgttgggattggatacgacgacaatgtatctcgtgataactacaaaatcttgaagcttcttggtcgtttgcctaaggatgatgattcagatccaaactgtgagatctatgaattcaagtctgattcatggaaaactcttgttgctaagtttgactgggatatagatattaggtgcaacaacggtgtgtctgtgaagggtaagatgtactggattgctaagaagaaggaagactttactattataaggtttgatttctccactgaaacattcaaggagatatgcgtctgtccttatactttggtgactcgattaggctgtttcgatggagatagactctctttgttactacaaggtgaagaatcacaggggattgaggtttggatgacaaacaagttgagtgataaggttgtttcgtttagccaatatttcaatgtcactactcctgatcttccagcgttacatctccagtcttgtatggcttgtccgggatactccattggtaagcgcagaaatataagggtgtggtgtgagggaagtgtagacgtggatgataagtcgtatgttatcatcacgttttacgaaattgatgaaggtggggtcataaaacaaattgagacagcaagctatggacagtttgagtacgatgacccgtttatttgttgctatgtttatgttccgagtctgattccgattcagtgattcccgccgtccagaagaaaaatagttagcgatatgagtgttgtttcgtgttcttaaagctagggttttgtttggctttgtgtttggtgatcgtctaccatgtacatattgaaacgaactaggttattgaaattgacttctggttttggtttttgtatttatgagcttgagaagttttaggtttggtacagagttgtatcatcttccatatattgctaaaactaagcatcattatccgaagacctaaacatttacaatgaacaaatctaacatttcaattgatttgttcatgtgcatacatataaaaaataaaatgtaactatttgaggaaaaaaacatctaatggcatttgattggaattggtactctaaaaaatcagataaaagcgtatgtaaaccggataattgaattgaaccgaattacggttcggttttgttgttggtgtgataaaggttcgattgagccgtaaaaccttccgtcctcctcgagtcctttccatcaggaccttatccacagtccacacacagcgagactctatttactcgccggcggaagaacaaaatg

SEQ ID NO: 28223 - DNA, 3003 bp, Unknown
  misc_feature (1)..( 3003): 2750-1469P.txt file - cDNA_ID_2994588; gDNA_ID_2213638; Annot_ID_132201
atgtggctataaatcattacatgatgtgttttgtgttctcttgcagttgctgttgaatgagaaagctttgatgtgagcgagcctgagagtgtaacaaaggactgatgatgaagattattgcggcgtttctcttcctcttggtcacgacttttgtttcccgttgtttgtctgcagacatagaatcggacaagcaagcactgcttgagtttgcatctcttgttcctcacagtcgcaaactcaactggaactccactattccaatctgtgcctcttggactggtatcacctgctccaagaacaacgcccgtgtaaccgcactccgtttgcctggatctggactttatggacctttaccagagaaaacatttgagaagcttgatgccctcaggatcattagccttagatccaaccaccttcaagggaacattccatctgtcattctttcacttccttttatccgatcactatactttcatgaaaacaacttttctggtactatccctcccgtcctttctcatcgcctcgttaatcttgatctctccgccaactcgctctcgggaaacattcccacgagtctacaaaaccttacccagctcactgatctcagcctgcaaaacaattctcttagtggtccaattcctaacctccctcctcgccttaaatacttgaatttgagcttcaataaccttaacgggtcagttccatcttctgtcaagtccttcccagcatcctcatttcaaggtaatagccttctatgcggtgctcctctgactccatgcccagaaaacaccactgcaccatctccttcaccgacaacaccaacagaaggtcctggtacaaccaatataggtcgtggtaccgccaaaaaagttctctccactggtgctattgtgggcattgcagttggaggttcggttctgttgtttatcattcttgccatcataaccctttgctgtgccaagaaaagagatggcgggcaagatagcaccgcagtgccaaaagctaaacccgggaggagtgacaacaaggctgaggagtttgggagtggggtgcaagaggcggagaagaacaagctggtcttctttgaaggaagttcatataactttgatcttgaggacttgctcagagcctcggctgaagttttagggaaaggaagctatggcacaacgtataaggccatcttagaggaaggaaccacggtggtggtgaagagactgaaagaagtagcagctgggaaacgggagttcgagcagcagatggaagccgtgggaaggatcagtccacacgtgaatgtagctcctctccgtgcctattacttttcaaaagacgagaagctactcgtgtatgattactaccaagggggcaatttctccatgctgcttcatggtaatatgatgttttacatgttactcaaggttataaaaagtggctttaaagtaacactttagatgaattctatgcaggaaacaatgagggaggaagagcagcgttggactgggaaacaaggttaaggatctgtttggaagctgcgaggggaatttctcacatccattctgcatctggtgctaaactcctccatggaaacatcaaatcaccaaatgtcctcttaacccaagaacttcatgtctgtgtctctgatttcggtatagctccattgatgagccatcacaccttgatcccatcaagaagcttaggttacagagcacccgaggccatagaaacacggaaacatacccagaagtccgacgtatacagctttggtgtactgttgctagaaatgctgactgggaaagcagcagggaagactactgggcatgaagaagtggtggatctgccaaagtgggtgcaatcagtggtgagagaggagtggactggagaagtgtttgacgtagagctgatcaagcagcaacacaacgtagaggaagaaatggtgcagatgttgcagatagcaatggcatgtgtgtctaagcatccagattctaggccttcaatggaggaagtggttaacatgatggaggagattcgaccttcagggtccggtcctggttctggtaacagagcctcctcgccggagatgatcagaagctctgatagcccggtttagattggttttaaattctctttctctcattctcaaatcattatttatttttgcttttccttcttcttcttcttcataaaccgtttattttagttctctatgtctgactgcataatttattccaatcaatatctggaattgtagtgtaattgaaaccctcaccatgaatggttgtagttcttagattggttataagtgtgcgactagttttgaattttcatttgttgttgtatgattcgtttaaattaaatcacaagagtctttgggtgtttgaaaatctaactgaaatagtgatacaattatatgtgaaatttatcgtctcaaaaagataaactacatgagtaaataaataaaaataaaatcattgctctgtattttttgactgcatgagtcctaattggtgaaataaaaaaacttttggcacgagaattaataaatatatagaaaaggtgaaataggtgaggcggtacttgctgatagaatcagaagcttcgagactgacttgttttagattctctgactataaagaaaggcaaagtaacaagtttcgttttctcctttgcactccatttttattctcgattctcttctctcccgataaagaagctctcgctttgtgttgtccgtccttcttccaggtctaattccaccatttctctttggttaaaccctaatttctttctctcccgaatcgtcctctgtttttgttttgcgcgattagtttccaccgcttaataatagggtttccgatcacttacgttttgtgttgttttgttcggtctctggttcttccactgtgatctgttttgttcttaagttgattgtcttaagttatatcctctgttcaataatattctggtcttgttgggggtttccacaggttttctcgtctctgacgcatg

SEQ ID NO: 28224 - DNA, 3000 bp, Unknown; identical to SEQ ID NO: 10221
  misc_feature (1)..( 3000): 2750-1469P.txt file - cDNA_ID_2994592; gDNA_ID_2213638; Annot_ID_132193

SEQ ID NO: 28225 - DNA, 3000 bp, Unknown; identical to SEQ ID NO: 10221
  misc_feature (1)..( 3000): 2750-1469P.txt file - cDNA_ID_2994592; gDNA_ID_2213638; Annot_ID_181098

SEQ ID NO: 28226 - DNA, 3003 bp, Unknown
  misc_feature (1)..( 3003): 2750-1469P.txt file - cDNA_ID_2994596; gDNA_ID_2214450; Annot_ID_132909
tttatgttggtaatgcacaacaatcatatggcaattcaacggtttcggcacttttcgcttttggagactcaatacttgacacaggcaacaataatcttcttttaagtgtttctaaagtcaatttttatccatacggtagagactttataggtggaagagctactgggagatttggaaatgggagagttttttctgatataattggtatgtatatatatattgatctctacttgttgatatacttgtaacggatgaattcaatgtttgtaatactatgacacaaatattatctaatagcaagtctttgttttcagctgagggtttgggattgaagaatctcttaccagcatatcgtgatccatacctctggaacaatgatctaacgactggtgtttgtttcgcatctggtggatctggacttgatccaatcactgcaagaacaacagtaaatttttcttagtttgtccaaaagattataacaacttttattttatctatagcaaattttaatagattatattttggtgtgattagggaagtatatgggtgtcagaccaggtcacagacttccaaaactacatcaccagactaaatggtgtagtaggaaatcaagaacaagcaaatgcagttatatcaaatgctgtttacctaatctccgcaggaaataatgatattgctatcacttattttactacgggggctagaagattacaatacactcttccagcctacaatgatcaattggtctcttggactcgtgatctcataaaggtacaaagttagattgttttacatatatataggacatagtaagagattaaaattttggtcaaattgtatgtgacatattctattgttccccctttttttttgttatttgaagagtttatatgatatgggtgcaagaaaatttgccgttatgggaacattaccgctaggttgtttaccaggagcaagagccttaacgagagcatgtgaattatttgtaaatcaaggagctgctatgttcaaccaacaattatctgccgacattgacaatcttggtgcaacatttccgggtgccaaattcgtgtacgtagatatgtacaatcctcttttgggtctcatcattaaccctcaagcttcaggtaataacatgattcataattcaagaagaatactcatgtgtatatatatacgttacatttacaattatattttccaaaaatgtagggttcattgatgtagctgatgcgtgttgttgtacgccaacgcacttaataccgtgcttggatgcgtctcgttacgtgttttgggatgtagcccatccgacccagaagtcatacgaaaccatcgctccacagattattgaaaatatcaaagcaaagctcgcatgatcaagttatcaagctcttttgttttgataataagttatcaagcttttttttttctttttttctttcggcaagctttttagattgttatgattaatatcgatcggtaggttttaatatcgatcggttacctcaaccacaacgtcgctctttggtcaaaaaccaaatatttgttactcttaataaatatttgttttagatcttcgtgttgacttgatccctctcatcttttatgatccaaattaattaaactttgtcgtcactttatttccgatattgaatccaaaatatttagttaaaggccataggctttttgagttttctagtagcgcttactagccaatatcccgaagatacatgaactatatacatcaacgttggattttttcaatgaacatcaccaatttcatgtcaaaaaaaaaaaaaaacaaagaacatcagtatcaacaaattaaaaatctaatctcctgttttagtttttttttttttttaaatcacgtgcatagctttgttttgacattagaacatgacttttccaaaatatttcagatttatgaatgctactgtactatttcttttcgattcggtccatattccttactttattcagagagccttcaaacaccgttttcgtggagcatctttttatgtcgattgtgataatattgaagtttttgaatttatttttcttacagtttttgtctttttttgtaaaacgaaaactctagatttaaatctcacactgcttcatatagctagattcctttgcctgccactaaatccaaaacctcacgtgaattttagttttgaactagtccccatttcgagaattttagtgtaggaatagcaatataatttaaacgatcttgttaattataaaatacctatcagttcataaaattaaatttaatttgatatagtttggaaattagtgaactctacaaaagtgttttaacttttaacgattagaacttttattgcttagacaccagtacgtcttgtgattaaaccaatgtggagaagaaaatgtaaatggtatcatgtatgactagcaaattattgacttaagagtcatataaaacaaaagttcgaattaagttctttagtcttctgacagcatcgagaggtgagataagtttcctcattactacattccccaaaacacatattcgttaagacgttaacgttcgttgtctacaacaacaatgtaaaataactttaaaaaaaaaaaagtaagtaactaaatgtacaaatcttctttaggactgatggatttagattgatatatgatagttactagttacgttgttaaaaaaaatggtattaaatcactaacaacgaataattcattttatagctactagtcaatacgataattttagttttcagctaacaatattaatagttgataattctctactttcaacttatttcttgtacaaaccgtattatgtaatgtaggtaagcttattctcatgattagctcatttgatctaattttaatatttatataaaaaacttataaaccctaataaaaaaatatctgaccaaaaaaaaaaaaaaaccctaataaaaaacaaacagtacactgttttttctctctataaagagaaaatctccaaaagcaatg

SEQ ID NO: 28227 - DNA, 3003 bp, Unknown; identical to SEQ ID NO: 28226
  misc_feature (1)..( 3003): 2750-1469P.txt file - cDNA_ID_2994596; gDNA_ID_2214450; Annot_ID_182425

SEQ ID NO: 28228 - DNA, 3000 bp, Unknown
  misc_feature (1)..( 3000): 2750-1469P.txt file - cDNA_ID_2994621; gDNA_ID_2213619; Annot_ID_131956
taaccatttttaatcagaaaataacatgtatcattgtatcaaagcttaacggtaatgggttttaaaataaatgttttacaaattaataagaagtgaacaaaaaatttctctctacaattatcaacttgattcaagttaaaatagttaatagaacatatagtattttgagaatctgtctcaaggttgagttttggtagtagtacaccagagatcatcgttgttgttggacttatgtgaatcaaatggaagcgatttgaccagcgaggggcgaatgggacattattctctaatagttggaggttgatgcttctggatggtttgttcttgatgggacgcgcatgggagtcgaatcttgaaacaatagctaggtaggtgattttcgagacgacattcttaacgttaatcataatacgataagatgtcagaatagtgaaaaaccaaaaacaaaaaattgggagtagacaaataagaggtagaattgtgttcttatacttgatggtgagctcagaaaaaaagagagacttaagatgtagaagctgagtatcgtcgaatgtaataagcgatatatgttgcttgttgaatgcaagcccaattagcgatatctagttaaggagaacgacatatagatcaaatctcatatatcaaaggtatatgagctagtctttatgaattatgggtgtgttgtaatatatcaagagattctttcgatctgtacagatgtagtgaacgagtatttataagaaatatatgactggaactagtgacaaaaggttgagtgagttggtcgaatcgtttaagttgttggataacaaataatcgaatacgttatattgtgtgtaatttcggcagatggaacatgaactattaacactactagataactttttgtgatgcgtcgtcacttaggtggaagaaggcatgcacgcgttgtcgaacaacacgtttttctccatacatgcacatagccagtctcatgtggatcgtcaagcatttccagcatcataggaatttgatcatttttgcttgaaacatgatttgttctacgcagtatcaaaacttagttttgagatataatactctttaactattgtatataaaattttaattgacctatgtgatactattaatattgtttaattatttatctatatttttctttctaatttatatgtacaaattgatttatttatttttaatttcttactattgttattctatatagtatttttctcatctatatcctcataatttatttgaaatcgtctctaatattttgtttgtgttaattatctatataaaagtttaattccttttatactttatttgtaactagtattatacccggtgcatagcaccgaaaattaatgttatgatacattctttttttgaatttaaatgttatgatatgttacatattatcgatatttatacatgaaaaattaattttataaatagattagtatataatcgtgtagggaaaaatatatcgtttcatgtatttgtggattttattttttcagatgataatttgatatataatggagaattgaagttgatatcacaaaattattagtcttccaaatatagagaattagcttccaacttcaatgctttctagaatacatacaaaagctataaaataaaaaattacatatggtattcaaagactcaatacaaacatagattatagtcatagacaaaaaaaagttaccagagtgaagttgactcaatacatagatgatatcatttatgtcttaatgttgtacacttctacttcgtcttcaacctcctactactttgccattggtgtttttcttgctcaagtcttctactttgtttgtgttttatcctctatcgatcaagtttgcttgtttatttttagtggttgatctatgaagcaaaaagatattaaacatacataataaaagataattcaaaaacagaaagcattaatatactcatctaaacgcaatcaataaaataaaagaaatataacatacgctggccatattgccttatatgaactgattagagattgaagactcttgttacaaagaaggtctcgctcctaaatgattttactctcaaccttcttttaaaaaccaatatcaacaatagaaagatgataccgagatttgtatatataggtttgagatcgtatctgtctttgtttcccaatagttagtttgaatgttttaattgaaaaaaaagagttacatagtttgaatagaagaaaaagaaattgtgggagtatggagaatatgtgggttgatttttattttcttttgagagtgatcgtgggaaaattgacgataatgttttaattttgtacactgttttcacatttaattttattttgagttttgtcgaaaaattcatttttgttttacattgtggattttgtttttgataaatttgccacatgtcaaaacatgatttgccaagtgacttgtgttttataagataaaggatatataatgtattaatgtcacaaaaaaagaattacattgcataattaagagtatgcatcgattacatatttacatcatatcttttcatatttatcctttttcttaatattcagattacgttcaatcttttctaatattacttttttttttaaacaacgagattgacaccaatgggaaagtctgctatagattacggaagcacgatgtgacctaacttgtttgtattaaattcggcatcggaacatggatcttaaggaatatcctttcccaccaccgcaaatgtccgtttgttaaatctgagatttttcaatcccattatataataactcaacaaaatctctctgtccaatttccaaagtcaactcctttttggtttttgttttactttctgttttcctcttctctactctggaacaacaactacacacacacacaaaaaaaaacaattttctgtctatatatatattaaggatccaaattagggagagaccaaagaggaaattaataacaatcaatccaacaacgaatg

SEQ ID NO: 28229 - DNA, 3000 bp, Unknown; identical to SEQ ID NO: 10106
  misc_feature (1)..( 3000): 2750-1469P.txt file - cDNA_ID_2994632; gDNA_ID_2213625; Annot_ID_132033

SEQ ID NO: 28230 - DNA, 3003 bp, Unknown
  misc_feature (1)..( 3003): 2750-1469P.txt file - cDNA_ID_2994643; gDNA_ID_2213642; Annot_ID_132304
tgagtaaaacatgttccatatattgtaaaacatctcaaaagagcactcactggttgtttagttattaacaaagattgtttctcggtggtttaggttcttgctggatgcatctgtggttcactgaagttggtttcagaaattcgcaatctgcatcatgtgttgggaggaacacttaacccagtaaattacttgactgtctcatttatccctcttattatgctgttaattcatgaattctcataaaaggtttgttaacagaacgctgcgtacctaatcatccgaggcatgaagacattgcatcttcgtgtacagcaacagaattcgaccgcttttagaatggccgaaattttagaggcacatcctaaggtatgcaatatctcttttttgagtaaatatcctgacactatccaggtgagtcatgtgagtaaatatcgatgcaattttgatttgcaggtgagtcatgtgtactatccaggccttccaagtcatcccgaacatgaactcgccaagcgacaaatgactggttttggaggtgtggtcagtttcgaggtaatatgatctatcaccaacctaatctctatctactccagattagcatttaagtatgatcctgaacaccttgattatctttcttgggtagattgatggagacattgaaacgacaatcaagtttgtggattctctaaagattccttacattgcaccatccttcggtggctgcgaaagcattgttgaccaacctgctatcatgtcctactggtatgtctttggcaaaatcgaacaaagttatctttgattccatatgcttccgtctttgacaaaatcgaacaaatttccgatttctaatgggtggttttgatttcagggatctgccgcaagaggagagactaaagtatggaatcaaagataacttggttcgtttcagctttggagttgaagactttgaagatgtcaaagctgacattcttcaagctctcgaagccatctgaaaatgacacatcacacaaaaacgctgtcgtttctttgtcctttatttatctctctttgctgttttcagtcaccgtaataatgatgtctttgaactattgttccgcgacatttacgttccgaaataatcgtgtactattatgatgtttgttgtgctatataataaattctgtttagttcgttttgcgtcttaaagaggttaaattagataactggtcccatgtgaacgaccattgtggccattgctttgtggtaagaactccttgtgcttggaacctcaaggtcacggcttcgaacaatggtcatgaccctctagcttctgcttcttcttctctttgtttcaacaacatataaggcattcataaatgcctcgtctttttttgttttctttcctttcaatacgtagttcgatttcgatttcgatttgtagatctcagcaaaatccatgtcttgagagaatgattaatgggcctttttaataagtccactgataaagacgagagcccaaaacgtaattgtattattatcttctttatttgcttttaaattttaaattgacattaagacaagactaacttttgcttgtcaaatccatgtgttgtccagcgggtaatcaacccaaagttccggatccggacccaacagtaagcaacattttacgattcgttgtttttgaatcccaatgaaaaaaaagatggttatttttaaggaatggaaaaatcgagaaaaatggtatcgtgtcgcatcgaggacttattacgtatggcgagagagctcaaaccaaaagatcaccgcctcgactgattcatcttttctcctggtatgtattttggaaaattcgtctcttgctttttatttgatccagatcagaaaacgttgtgcagattgattctgggtttatcagttccttaccaccatagtactctccatgttcttctcaattgtaaattcctttcctttttgtgtgtcaatttacacatatctgatatcttcttcgtgttgctcccaaattttgcagattcttggcaggcttctcttggtctaagtgaatttggagttatgcttctgtcagcacttttaacttcagtgggaatcaatcttggcctctgttttctcttcttcactttgtattcaatattgagaaagcagcctagtaatgtcactgtatacggtccacgtcttgttaaaaaagatggcaagtctcagcagtcaaatgagttcaacctcgagaggcttttgcctactgctggttgggtcaaaagagcattggaacctaccaatgatgaaatcctctccaatcttggcttagatgctttggtcttcattcgtgtctttgtcttcaggttgattgattcattgagcatctgcttcaagtttgactttttttttgtgaaacttcaatgcttttttgtttggcagcataagagtgtttagctttgcatctgtggttgggatcttcatacttcttccagtgaattatatgggaacagagtttgaagagtttttcgacctcccaaagaagtctatggataacttcagtatctctaatgttaacgatggatcaaataagtaaagaactcgaagctatgcttaaacagtatcccgatttctacttgtccgtaaccgatctcttatgcttgtatgtgttttgcttcaggctgtggatccacttttgcgcaatatacatcttcacggcggttgtttgttctctactttactatgtaagacgccttttgttttgtccatccattctactttatatcgcctatatgggaacataaaataatgtttggactatctttgcaggagcacaagtacattttaacaaagcggattgctcatctttattcatccaagcctcagccacaagaatttacagttctggtcagtggcgtccctcttgtatccgggaacagtattagtgagacagtagaaaactttttcagggaatatcattcttcctcgtatctttctcatatagttgttcatcggacagacaagttgaaagttctcatg

SEQ ID NO: 28231 - DNA, 3003 bp, Unknown
  misc_feature (1)..( 3003): 2750-1469P.txt file - cDNA_ID_2994643; gDNA_ID_2213642; Annot_ID_181308
gctacctcgtctgcatctgcggtttcttccgccgcatctgcagccgcagcctcgtccgccgccgccgcccctgtggctgccgcgcctcccgtcgtgctgaaaagcgtcgatgaggaggttgtggtggccgaggaggggatcagggagaagataggtagtgtacagctgacggattccaaacattctttcttgagctccgatgggagcctcactgttcatgccggtacctcctagatccaccagattcagtcatttcatatctgattttgttgttggagattgataaattaggttttacacaggtgaaagattaggccgtggtatagtgacggatgctatcactactcctgtagtcaacacatctgcctacttcttcaagaaaactgctgagcttattgacttcaaggtccgttgattgattcagtctctttcttttatggattagaataacacctattaggttgaaagaatctcttactagttttattgactttgtttatcttcaaaaaattgaattattgtaggagaaaaggagtgtgagtttcgagtatggtcgttatggtaaccctacgactgtggtacttgaagataagataaggttattattattttatctttaataatgtgttttataattgcacttgcctttcctgaagattatgttgttgatgcttttggatttgtttgattaatatattgctgtagtgcacttgaaggggctgaatcaactttggttatggcatctgggatgtgtgcaagcactgttatgcttttggcattggttcctgctggtggacacattgtcactactactgattgctacaggaagactaggatcttcatggagaattttcttcccaagttggggatcactgtaagaagatttccattgcatctaaattttttaattactgtcttcctttttccaattccagtttttcaacttgattgtttaacatcatgtttatgtccaggtcactgtgattgatcctgctgatatcgcagggcttgaagctgcagtgaatgagttcaaggtcagttctgtaacattattgtcctttttacagttggaaagagagtatgtgtctcaaatttattccgacttgtctggcaggtatctctgttcttcactgagtccccgacaaacccattccttagatgtgtcgacattgagctagtttcaaaaatatgccacaagaggggaactctggtttgcattgatggcacctttgcaacacctctgaatcagaaagcccttgctcttggtgctgatcttgtcgtgcactctgctacaaagtacattggaggacacaatgatgtgagtaaaacatgttccatatattgtaaaacatctcaaaagagcactcactggttgtttagttattaacaaagattgtttctcggtggtttaggttcttgctggatgcatctgtggttcactgaagttggtttcagaaattcgcaatctgcatcatgtgttgggaggaacacttaacccagtaaattacttgactgtctcatttatccctcttattatgctgttaattcatgaattctcataaaaggtttgttaacagaacgctgcgtacctaatcatccgaggcatgaagacattgcatcttcgtgtacagcaacagaattcgaccgcttttagaatggccgaaattttagaggcacatcctaaggtatgcaatatctcttttttgagtaaatatcctgacactatccaggtgagtcatgtgagtaaatatcgatgcaattttgatttgcaggtgagtcatgtgtactatccaggccttccaagtcatcccgaacatgaactcgccaagcgacaaatgactggttttggaggtgtggtcagtttcgaggtaatatgatctatcaccaacctaatctctatctactccagattagcatttaagtatgatcctgaacaccttgattatctttcttgggtagattgatggagacattgaaacgacaatcaagtttgtggattctctaaagattccttacattgcaccatccttcggtggctgcgaaagcattgttgaccaacctgctatcatgtcctactggtatgtctttggcaaaatcgaacaaagttatctttgattccatatgcttccgtctttgacaaaatcgaacaaatttccgatttctaatgggtggttttgatttcagggatctgccgcaagaggagagactaaagtatggaatcaaagataacttggttcgtttcagctttggagttgaagactttgaagatgtcaaagctgacattcttcaagctctcgaagccatctgaaaatgacacatcacacaaaaacgctgtcgtttctttgtcctttatttatctctctttgctgttttcagtcaccgtaataatgatgtctttgaactattgttccgcgacatttacgttccgaaataatcgtgtactattatgatgtttgttgtgctatataataaattctgtttagttcgttttgcgtcttaaagaggttaaattagataactggtcccatgtgaacgaccattgtggccattgctttgtggtaagaactccttgtgcttggaacctcaaggtcacggcttcgaacaatggtcatgaccctctagcttctgcttcttcttctctttgtttcaacaacatataaggcattcataaatgcctcgtctttttttgttttctttcctttcaatacgtagttcgatttcgatttcgatttgtagatctcagcaaaatccatgtcttgagagaatgattaatgggcctttttaataagtccactgataaagacgagagcccaaaacgtaattgtattattatcttctttatttgcttttaaattttaaattgacattaagacaagactaacttttgcttgtcaaatccatgtgttgtccagcgggtaatcaacccaaagttccggatccggacccaacagtaagcaacattttacgattcgttgtttttgaatcccaatgaaaaaaaagatg

SEQ ID NO: 28232 - DNA, 3000 bp, Unknown; identical to SEQ ID NO: 10472
  misc_feature (1)..( 3000): 2750-1469P.txt file - cDNA_ID_2994649; gDNA_ID_2213653; Annot_ID_132483

SEQ ID NO: 28233 - DNA, 209 bp, Unknown; identical to SEQ ID NO: 32
  misc_feature (1)..( 209): 2750-1469P.txt file - cDNA_ID_2994649; gDNA_ID_1291; Annot_ID_144955

SEQ ID NO: 28234 - DNA, 3 bp, Unknown
  misc_feature (1)..( 3): 2750-1469P.txt file - cDNA_ID_2994649; gDNA_ID_1292; Annot_ID_144956
gct

SEQ ID NO: 28235 - DNA, 3003 bp, Unknown
  misc_feature (1)..( 3003): 2750-1469P.txt file - cDNA_ID_2994661; gDNA_ID_2213663; Annot_ID_132615
atgaggatagaggaataataaagaggtttgtgatcgcctactattccaatgggctttgaatcagaaaattcagaatcgtggaatgtaaaatatataaaacatgttccaaaacttgacaatgtcccaacgaaatcttaataacgcggcacaaaaccgctttaaggacgtatatatatatagaaaagacacattgtgatacttaagaaaaaaaatcatctcaataacacaaaaaagaacataatctaagatttatatcagaaaatgcatgatttataggttttaataattttacatattatataaagagcacaatattctaaatggccacgcggaagcaaaacacttccacgtacacagtagaggggcacattactaaattaaggattatatatgttgttctctctgcatattccacttatattttaaaaatgtgtttttagtagctattccatattgtaatttaattaagattaagaaatggccatgtcttagtgtaagtggtaaaggcatttgatcttctagctcgcatgaaacaatgccaactttgtttgcttaatttcaacttccactctcgcatatgcagccattgctatattcacatacttgaacaataatcacaacaaaaactaattagttgataatttttctttagtagagtttgtgtgtagcttatgtttatgataataacactgtgggtttttaatttctaaagttgaaaaatatgtggtttatgttttgattgtgtgcaagtatacatttgtgtatgcttgtatacattgatcatcaagcaaatttaaatcataatcacttcttctcacgttttaaattttcaggtaattgtggaaacttcggtttcaacacttcaatagtttgtatcatatttcaaaatttaaagaattataccacataattaatggagtaaatttgtttcataattcaacaaaaacaatgaagttacgaggaacctagctagccctctcataacgaacttgattcataaatttaaaattagttcaagaaaagaaattagcaaatgatttgtttcaaacgtatatatttacacgtttttttataacgatatttgcatttcattcaagatttttttttttttttatagtgatcaatttctcttacaaattgtaaaccccaaactaatctaacatgaatatagcaattacatctccttttttggtgcaaaaaataccagttacatcttgttatatatatattattttattttaacatctcatcatcattatcatcttcatcatacatcacatcttgttatatatgtttacattttaaacttacaaaaaaaagttaataaataagagaaactccataaacgttgcgacttgcgactttatttaacatgttatatatttatatatacatgtatataaactgcatacaattaaacctgcatgtgttatgtgttcaaacagaaaaatgaatgccaggatttccaatatttttaaaattttacttttattaggtcttgatatttccgtacaaactcgatcaatctatgtaaattacttgtaaactaaagtcaaatattattggaccactttttggactatatatagctcatgcatatgtttctcatgcaacatcgcttaatccacaaagaaagggaaaacaaaaccgcacgaacaattctatttgaaaaacaaaaagatgaaatatccttttcagtgttttctagctaaaatcattttgctggctttagcatcttcgtttgtctcttgttacgacccatctcctcttcaagactactgtgttgccgtccccgaaaaaaacggaggtaatctctaattattgttttatacgtaaaacaattagtttatacataagaataaccctatattttttatgttatttgatatggaagacgatgttatgatcataaaacttattatataactttcaaattcaagtctacatttcgttctttttttttattttatcgtagttttcgtaaatggagaattctgcaaagatccaaaactagtaacatcagatgatttctttgcttctggccttaacatcccgggaaacaccaacaaacgccttggctcctttgtgaaccccgctaatatccccggtctcaacactcttggggtcggcatcgcccgtattgactttgcccctggtggtctaatcccaccgcacatacatccacgcgcctccgagatcatcttagtcatcaagggaaagctcctagtcggttttgtatcgtcgaacgactacaactacacactcttctccaaaattctttatcccggagatgtgtttgttcatcccatcggattggtacaatttcatgcaaacatagggaagacaaatgcggttgcgattggggcggttgggagccaaaatcctggttatatctcggtaggtgatgcagttttcgggtcgaagcctccgattgacccaaagattttggctaaagcttttgcgttggacatcaatatagtaagatatcttcgaaaagtgttttctcctcaagatgatatcgttaatgattaagaaataagttgatggttatacaacagataaaatatatactaataaagggtaagaaatacagattaaaaatgaatgtgtgggaaataactacgaaagtgtgtgtaatatgtaaatgtaacagtttaatgaataaatatacacaaatcttgtatttaaaatttaggagaacaggacttggggcttataaatacgtttgtgatcctgtttaagaagagtttgaatcagaatcatgaaatgtgaaagattaaacatctcgttttcttgtcacagttcacaacgttttttattactctatcgacttacgatgaatattttaagaaaaataaatatgggccgaataaagacactaatgggcctaattaaatgggcagtatatccaattaagtagtaaacagaaacgtttcgtttcgaatcacacacaaactcacaacgtttctgtgaagctcgccgtcaccgtcgccggaactcatg

SEQ ID NO: 28236 - DNA, 3003 bp, Unknown
  misc_feature (1)..( 3003): 2750-1469P.txt file - cDNA_ID_2994661; gDNA_ID_2213663; Annot_ID_181906
gttggacatcaatatagtaagatatcttcgaaaagtgttttctcctcaagatgatatcgttaatgattaagaaataagttgatggttatacaacagataaaatatatactaataaagggtaagaaatacagattaaaaatgaatgtgtgggaaataactacgaaagtgtgtgtaatatgtaaatgtaacagtttaatgaataaatatacacaaatcttgtatttaaaatttaggagaacaggacttggggcttataaatacgtttgtgatcctgtttaagaagagtttgaatcagaatcatgaaatgtgaaagattaaacatctcgttttcttgtcacagttcacaacgttttttattactctatcgacttacgatgaatattttaagaaaaataaatatgggccgaataaagacactaatgggcctaattaaatgggcagtatatccaattaagtagtaaacagaaacgtttcgtttcgaatcacacacaaactcacaacgtttctgtgaagctcgccgtcaccgtcgccggaactcatggatcgaccaccgtcgttgccacactatcaaaaccctaatccgaacctcttctaccactatcctcctccaaattctaatcctaatttcttcttccgacctcctccacctcctcttcaaaatcctaacaattactccatcgttccgtctccgccgccgattcgcgagctctccggtacactctcttctttaaaatccctgttgtcagaatgtcaaagaaccttagattctctctcgcaaaatctagctttagatcactcttctcttctccagaaggacgaaaatggctgttttgttcgttgcccttttgattcaaatcactttatgccacctgaagctctctttcttcattcacttcgttgcccaaatactcttgacctcattcatcttcttgaatcctttagtagttaccggaacacgctcgagttaccatgtgaactacagttgaacaacggtgatggtgatctctgtatctctttagatgacttggccgattttgggagcaatttcttctaccgagattgtccaggagctgttaaattctctgagctcgatggaaaaaaacgaactttaacacttcctcatgttctatctgtggaatgtagcgattttgtaggttctgatgagaaggtgaaaaagattgtcttggataaatgcttaggagtcttaccgtctgatctttgtgcaatgaagaatgagattgatcaatggagggatttcccaagttcgtattcctctagtgttctttcttcgattgtgggttcaaaagtggttgaaataagtgcattgaggaaatggattctggttaattcgacgagatatggtgttataattgatacattcatgagggatcatatattcttactctttcggttgtgtctcaaatctgctgtgaaagaagcttgtggatttaggatggagtctgatgctactgatgttggtgagcagaagattatgagctgcaagagtagtacatttgagtgtccagtcttcattcaagtcttgtcttggttagcttctcaacttgctgtcttgtatggagaaggaaatgggaagttttttgctttggacatgtttaaacagtgcatagtagaatctgcctctcaggtaatgttgttccggttagaaggaactagatctaaatgctctggagttgtcgaggatttggatgatgcaaggttgagaaataaggatgtgatcatggagaagccctttgagaatagttcaggtggggaatgtggcaaaactttggacagtccacaggtgatatctgtgtcccgtgtttcagcagctgttgcagctttgtatgaaagatccttgcttgaagaaaaaataagggcagttcgatatgcccaaccactaacgagatatcagcggtaggtttgaaatctttcaaaggcgattctgttttgccgacttgatttttagtttatgaaagcatcatttcatgtttgcatttgagtttgattcctcatgatgtctctgtctgtcaatctgtagggcggctgagcttggttttatgacagctaaagctgatgaggaacggaatagacgttgtagctaccgacctattattgatcatgatggtcgtccgagacaacgctcattaaatcaggttaatactcaactaactgttatctaacattaagtaaacaaatattactgtagggaacttttattgaaggtactgaaatacatatattttactgtctataatgtgtaggatatggataaaatgaagacaagggaagagcttttagctgaagagagagattataagcgtcgtcgaatgtcataccgtggaaagaaggtgaaacgaacgcctcgacaggtaagagctgtttccttttcatgaatgacaatcacaaattccagtgttttgaatgtgctacaaaatgctcaatgtttggacaatctcattgaaattttgttggaaaaagtgtagttatatgctgactctactattgtcttgtcgaggcattttgcagattttgtgaaaaaaattggtccttgctaaattcatacttttagttatgaccacccttcagttagcaataaacttatactatcctcttcttccagtgagttttctccttcttttgtcttgtaggtcttacatgatatgatagaagaatatacagaagaaattaagctagcaggaggtattggatgttttgagaaaggaatgccattacaatcccggtctcctataggcaacgaccagaaagaaagtgactttggatacagtataccatcaacagataagcaatggaaaggagagaaccgtgcagatattgaatatccaatcgataatagacaaaattcagataaagtaaagcgacatgatgagtatgattcaggtagctcgcagagacagcagagtcacagatcatataagcacagtgatcgaagagatgacaagctccgtgatcgaagaaaggacaagcacaatgatcgaagagatg

SEQ ID NO: 28237 - DNA, 3003 bp, Unknown
  misc_feature (1)..( 3003): 2750-1469P.txt file - cDNA_ID_2994667; gDNA_ID_2213671; Annot_ID_132800
attgtgttctagaaagagaagagagagcagtagtaccgtggtaggtagctagcgacctcttcgttcgtcagtcatcacaagctttgaaagattttcagctaccactctctcctttatatattcattacacatctcttctttctatatctctcttaatttagtcttttgtcttcgtaattacaatggctccaggaactttgactgagctagccggagagtctaagctcaactctaaatttgtcagggacgaagatgaacggcccaaagtcgcttacaatgtgtttagcgacgaaatcccggtgatctctctcgccggtatcgatgacgtcgatggaaaaagaggagagatctgccgtcagatcgttgaggcttgtgagaattggggcatcttccaagtggtcgatcacggcgtcgatactaacttagtggcggatatgactcgtctcgctcgtgacttctttgctttacctccggaagacaagctccgtttcgacatgtccggtggtaaaaaaggaggattcatcgtctctagtcacctccaggtaaaagccacaccacaatcttctaggttaaatacgtaattatgttttaatcttgccgttaaagacataataattatactataaatacagggagaggctgtgcaagattggagagagattgtaacgtatttctcgtacccggtgagaaacagagactactcacggtggccagataagccggaaggttgggtgaaagtgacggaggagtatagtgagaggcttatgagtttggcttgtaagcttcttgaggttttgtctgaagctatgggtcttgagaaagagtctcttaccaatgcatgcgtcgatatggaccaaaagattgttgttaattattacccaaaatgccctcagcctgatctcaccctcggactcaagcgtcacactgaccctggaaccattaccttgctgctacaagaccaagtcggtggattacaagccacacgtgacaatggcaagacatggattacggttcagcctgttgaaggagcgtttgtcgtcaatctcggcgaccacggccatgttagtactctatccatttattggcttttttgtttctctgtttttggttttgacttggtcaatcttgatttgtcttgatgaagtttttgagcaatgggaggttcaagaatgctgatcatcaggccgtggtgaactctaactcgagcagattatccatagccacgttccagaaccccgcgccggatgccacagtgtatccactgaaagtaagagaaggagagaaggcaatattggaggagccaatcacgtttgccgagatgtataagagaaagatgggaagagatttggagcttgctcgcctcaagaagctggctaaagaggagcgtgaccacaaagaagttgacaagcctgtcgaccaaatcttcgcttagaatctttgtgttcttgcttacttgttgttgcgttggttctgttttgtacgttggtactgaaaattatgctaggctcggtgtgttttgtgtttatttatgttctttcgaatcataaagaaataatgataattgatgcacttgtctatgacaaaaacatcatactccacctgtatttgacgcgttgggtttatgtcaaaaagcattaatacttcaactcctctctattcagtggcatacatacattgttggtaactgtcattgtctaaacactttgtactactaatcaattttttttgttcttcctacttctcctttatgatttcttcgattgttattcttttatgttgaagcgttaaaccgaaacacataccttggcagtttagtgacgaattttagcaccaagaaaatcgacacagagatcgggtagagatcacaaatggaaatcaaccaccgttcaagtgtcaatggtcacaaagttatacattatgtcttctcttcaatcattcttttatagacaaaggaaaagaaaccataaagaaaaacatgattttggtgtctattgagaaataacttcctcaaaactaaaccagtttggtatcctgccaaatcataagcgcaaaccaaccataaaccaacataatgtacatattaagtttgctcagagtacagggtttcttgatgagatacacttgtcaaaccaccgtatacaccatctggcaagagaggatcacataaggtgtcataatgaagctccgaaatctgcaggcattctaacataatggatcgacaagcaaatgcgaaacaagatcaccaccattgaaagacaaaagggtgggcgatatgaagctagctttcaaagctgactccaaagtcagatttaattctctaagttttcattataatctctgctcttgatttatttttctatagaacacacgatgtactagttgtaaaaacgttattttttttttttgaatctaatttagtattacttattaaaaaaaaaaaaaagattcacaccggttcatctatatgatgaattgtaatggacttgtattttttccaagcacttcactctatttcgtggaatcaaaacttttgcaacaacggcttatgctagtctcacatgatgcgttttacacactctagatagattgacctcgcattagatcggaattctagtgatgccctctactaacatataattgatatcaatcaccatccataatcttatttggttttagatctcttgcaacactagctctttcttcctatcacaataggcttttcatttgggcatttgcaacttttttttatatttttcatgattatgaaaaccttaatagagtagaaaaggtggtaaatagatatttatgcgtgtggattcaaattgcgtattgcattaacgatatcgacaattttattggttaaaccggcgggagtacacttttatttatagtctatttttacgccacgtcatctctaccttgaaaaattgaaattcatcatttttcttcctccttaagattttttttttttcttttctaattaacgacaacacgacgaagatg

SEQ ID NO: 28238 - DNA, 3003 bp, Unknown
  misc_feature (1)..( 3003): 2750-1469P.txt file - cDNA_ID_2994667; gDNA_ID_2213671; Annot_ID_182313
gttacttataaataactaattactctgcagatgctttaaggctaaagaaactacaagaacctaaaaaagaagatgggaaagacaaacatacttgatgatgaaaagggaactttgaagtcagaatcagagtcgttgattgcagagatagcctgtgatctagtgacccttttggctgatgatggagtctccatttgaatttcgagttcttgtaaacaacaacgaaaactgaactgaaagagaatttgggaaaaaacaaagtgtgaatgaagctcgtttaggtcgcagtcttataacgttttataactaaactagccgttgtggctcctctcttgcaaagtggaagatgagccgttgccgttaccgttccgttagtaaacccacgaattatttttcttccaaaactagccgttggatccgttctctcatggaaaaagtagacgtctttgttctgtatgggcctttgactaactaaatggcccagcccgttcataacattaatcatttaaaaaatcacattgatggtataacactaattttttttttcacaggtgtataaccaactaatataaatatgcacattcacttaaaattaactaatatcataaagagtattatggcgtctgttttattgtttatccataactacatcaatcaaatccaagttgatatactagttagaacctaatactttacaaatccgatcattaatttatcttgtctgcttaagattttttttttgtgaataaggtttaattatctcatcaatacgatttagtaaaaagtctgtgcaaaaattaatgacgattgggatttttgtaacgcaagcccgtaccagaacatgtctccgccacgtgatttctccacagaccacaagcatttttaagacgtggctttctatcaaccgttaaaaacgtaaatcatattaaccatgtgtctactacctacggtgtaaacgaaactgtataacgtccctatcatataatagtaatgtgatacgttggaatgtagccaaaaagcataaaaaataaatagataattaagtttataatgttttcctacaaaatattattataccgtatgtattttttattttattttctgaagttaaaaacagatgtagttagttgagtaaattgtgttctagaaagagaagagagagcagtagtaccgtggtaggtagctagcgacctcttcgttcgtcagtcatcacaagctttgaaagattttcagctaccactctctcctttatatattcattacacatctcttctttctatatctctcttaatttagtcttttgtcttcgtaattacaatggctccaggaactttgactgagctagccggagagtctaagctcaactctaaatttgtcagggacgaagatgaacggcccaaagtcgcttacaatgtgtttagcgacgaaatcccggtgatctctctcgccggtatcgatgacgtcgatggaaaaagaggagagatctgccgtcagatcgttgaggcttgtgagaattggggcatcttccaagtggtcgatcacggcgtcgatactaacttagtggcggatatgactcgtctcgctcgtgacttctttgctttacctccggaagacaagctccgtttcgacatgtccggtggtaaaaaaggaggattcatcgtctctagtcacctccaggtaaaagccacaccacaatcttctaggttaaatacgtaattatgttttaatcttgccgttaaagacataataattatactataaatacagggagaggctgtgcaagattggagagagattgtaacgtatttctcgtacccggtgagaaacagagactactcacggtggccagataagccggaaggttgggtgaaagtgacggaggagtatagtgagaggcttatgagtttggcttgtaagcttcttgaggttttgtctgaagctatgggtcttgagaaagagtctcttaccaatgcatgcgtcgatatggaccaaaagattgttgttaattattacccaaaatgccctcagcctgatctcaccctcggactcaagcgtcacactgaccctggaaccattaccttgctgctacaagaccaagtcggtggattacaagccacacgtgacaatggcaagacatggattacggttcagcctgttgaaggagcgtttgtcgtcaatctcggcgaccacggccatgttagtactctatccatttattggcttttttgtttctctgtttttggttttgacttggtcaatcttgatttgtcttgatgaagtttttgagcaatgggaggttcaagaatgctgatcatcaggccgtggtgaactctaactcgagcagattatccatagccacgttccagaaccccgcgccggatgccacagtgtatccactgaaagtaagagaaggagagaaggcaatattggaggagccaatcacgtttgccgagatgtataagagaaagatgggaagagatttggagcttgctcgcctcaagaagctggctaaagaggagcgtgaccacaaagaagttgacaagcctgtcgaccaaatcttcgcttagaatctttgtgttcttgcttacttgttgttgcgttggttctgttttgtacgttggtactgaaaattatgctaggctcggtgtgttttgtgtttatttatgttctttcgaatcataaagaaataatgataattgatgcacttgtctatgacaaaaacatcatactccacctgtatttgacgcgttgggtttatgtcaaaaagcattaatacttcaactcctctctattcagtggcatacatacattgttggtaactgtcattgtctaaacactttgtactactaatcaattttttttgttcttcctacttctcctttatgatttcttcgattgttattcttttatgttgaagcgttaaaccgaaacacataccttggcagtttagtgacgaattttagcaccaagaaaatcgacacagagatcgggtagagatcacaaatg

SEQ ID NO: 28239 - DNA, 3000 bp, Unknown; identical to SEQ ID NO: 10859
  misc_feature (1)..( 3000): 2750-1469P.txt file - cDNA_ID_2994671; gDNA_ID_2214456; Annot_ID_132942

SEQ ID NO: 28240 - DNA, 3000 bp, Unknown
  misc_feature (1)..( 3000): 2750-1469P.txt file - cDNA_ID_2994679; gDNA_ID_2214460; Annot_ID_132970
gattccatggaggcactaataatattgcaagcaggtaaaatctaatgaactggctcatatcttctaggtttcttggattgcaagttaggggcaaagtactaatcttggattataagttagggcaaaaactaaagtatatgttgttgttattacagcaatggagcaaatgaaagagaaattttcgaaattgcttcttggagaagatatgtcaggaggaggaaaaggtgtttcatcggctttggctttatctaacgccattaccaatctcgcaggtaagatcttttcccaaatctttcagttccatggaaattttcaattttatcaccaatttgatgttaagttctgtaatttttttgttgttgcagcgtctgcgtttggagaacaacggcgtttagagccaatggcggtggatagaaaaacgcgttggaggagagaaattggatggcttatctctgtggctgattatatagttgaattcgctccaacacaacaaacaaacaaagatggtacttcaatggaagtcatgtcaacaagacaaagaacagatcttctctgtaacatccctgcacttaagaaactcgatgctatgcttctcgtaagaagaacaaacaacaacagcacaaaatatactaatcaaaggctgttaaataattaatctcacatttataatcattctcttgcaggattgtcttgataaattcaaggatcaggatgagttttattatgttaaaaaagattctcctgattcttgcgagacaaggaacgatgagaaatggtggttaccggcagtaaaagtcccacctaacggcctctcagagatatcaagaaggtttctacagagccagaaggaatgtgtgaatcaagtccttaaagctgcaatggcgataaacgctcaagttctgtctgaaatggagattcctgaaagctaccttgagtcacttcctaaggttatttaataaacacataaaaacattcatcaagaatctgttattgatctagtccttatcgatgttttcgtgtgttgttgagaacagaatgggagagctagcttgggagatgtgatatacagaatgataacagtagagatgtttgatgcagatcaattcctaattgaaatggatttatcatctgagcacaagattcttgatctaaagaacagaatcgaagcatcgattgtgatatggaagaggaaaatggtgcagaaggacacaaagtctccttggggatcaacagtgagtattgagaaaagagaacagtttgaagaaagagctgaaaccatcttgctactattaaaacaagggtttcccggaatctcacagtcctcgctcgatatcagcaagattcaattcaacagagtaatttaaaactcttaacttccaaatacattttgattgtgttttctctatggtcatgagaaaatctcattattggataattgttgttgcaggatgtaggacttgcgatattggagagttattcaagagtgcttgagagtttagctcacaccgtgatgtcgagaatagaagacgtgctttacgctgatcagcttactcaagaacctacaaataatgcaccttctaagaacagatatagcttgaaggagaatgagaaactaagagaggaaagactaagtttcacagaggatatggcttcaggaacactttctgatgttatgcaatggggtaacaaaaacaatgaaatgaagaaagaaagctttttcggagatagagagaaaccgttgttgtcgaaagtcacaggtataatgactaacaacaagaagagttcttatcttgataatcttggagctatgaggagtccaaccgcaagatactcctgagagaaaccggtttcttttttccgttcttgttaaattagggcttcttactgcattttcaatctgcttaaagattccacaaaatgcaccattgtgtgttgtagcagacttgaaatgcaatttcattgattcatcataactgattttcagaatcactagcttacaaagcaattaacacaacacagtacaatatacataaatagggttcatagaattggggagaaagtttctgactttttgaaagattttagaaagctaatttaaagcttgccgcgaggaccgagcttaggtggctcttgaggacctctcttaatcggaagaacatcgccggtagagttcgcactaacatatgtaagcaaagagcctcctccaagaatcaaaaatttgagaagcaaacctctctttgtgaaaggagcagcaaatgtctcaaagaacttgctctgcaagcaacataatcacaaagtcttagaatttgaagaagcatatagatctaaagatttaagagtgtacaaaaacctgaagtgggttataaggagaaggagcatcagatccatacacatcccattgtcctgttgtgttacccaaatcttctaaatcaaagtatacacttttgtctccatacttagccaccacagcaccagctctacacaaacaatcaaaagtaacatcctttctttaataccaatcctcatcaatgtcaatccaagattccaaatttcaaagctttaaactttacctggtggatttggttttgaagctttggcgagaaggtttgatgaagagcttagctccggcaagagagctacctccaagtcctttcacggcggcagaaggttgtacggcggcgatggttgcaaaagacgccatgttaatttctctctttgttgttgtttgtttgttgccaaagtaagtgagtggattgatgtaatttgtatagtggagaatcttcttcactcatttgatagatcttgttctgccacgtggcgaattgggttgtcatctttgagatttgatatgccacttaggaaatgccacgtggattataaaaagataaggctatctctaatccataaccaaaaatttcttcgtctctgtctccaaaatcgaatcaaaatctctaaagtttcaatttttttgttctgttctttttatttttttaaagaatg

SEQ ID NO: 28241 - DNA, 3000 bp, Unknown; identical to SEQ ID NO: 10894
  misc_feature (1)..( 3000): 2750-1469P.txt file - cDNA_ID_2994682; gDNA_ID_2214461; Annot_ID_132978

SEQ ID NO: 28242 - DNA, 3000 bp, Unknown; identical to SEQ ID NO: 10896
  misc_feature (1)..( 3000): 2750-1469P.txt file - cDNA_ID_2994682; gDNA_ID_2214461; Annot_ID_182776

SEQ ID NO: 28243 - DNA, 3003 bp, Unknown
  misc_feature (1)..( 3003): 2750-1469P.txt file - cDNA_ID_2994689; gDNA_ID_2214477; Annot_ID_133145
catcggtagttgaggaaacggaaccatctctgaatcgctctccattttctttgcttgtgatgatcttcagaaatgatacaatgattgatgacgatgaagaacaagtgtatctagagccgggtcgggtacgggtcaaagatccatattagtgattccactaccacacgaataaatgttgcattttttgctttgggtttggtttggatttagttaaatagtagccaagttcctatctttgtggtgtttgtttctgcaaagttaagttttttgttctatactaatcagtcatctttggtcttcaaatgatttgataccttatctgtggtcggctatattagctcgagcagcaatctgaattgtagaaaccattgaaactctggcaaaacttgctgtttgctgcccgtataaccgtatttgtcgaacataatatcaatgccctcttggattaaggagtaacctgttttggtaaggaagctggagattatagaaaacattcatatgccataaagaagttcaattttgcaggagtttacaattgtaatcagctacttatcataagtggtaaaaccacacctaggcaccttgacaagcaaagaagctctcccaattagagtgatccaataccaacctagccacaacacctactgcttgaataaagccactgaggtacaagtttgttttagatttaactcaaagagagaatgttaaaagtagagaaaaacatatggatatttccttttcatagatgcataccgatgtcggacacaattctgagtcaagcaaatctaacaggaccaggaaaaaaactcatccttcggaataagatatacaaacctagataaagaaattaagaaacagcaagaatatggaaataggtacactgtaccacaatgttagttccagcagcaaagcaattattactattgtaacatagtggataatggaacctagctcatctgtctggctatctgcttaaacactaacaagcccactcatacgggcacaaccttctacttcttccctatgttctgaaaagtgaaaccccttaggtttgctactgggtgctgctttgccaaaagaccaagctaactataacaggagaagaaattctaaatgctagtatctccctaatccctacccaaaaacatttgtttattgtctctcatcaatcaccataaatcatgatagatactaacaccaataatcactcactcatgcatcctagcatctttaccctggccacctttcattctcttcatgccacaagatgtttacacattcaagcaaaaccacatgaaaaatccttaagaacagaagaaaacggaaagatatgttccggtgttgcccctgtatttcctacaaacatctatactaatcaaactaaacccatcattcacacataccgtgatctaaaaacctgaatttcaacatgtcacacagcaatcaacaaaagtttgaatagagcaagaaagcaccttgaggcttgaagtgatcagacaaactctctttccagaaaacacaatactttcttcattgaattaataatttacacaaaccaagcatcattccaacaattcccattgcatccatcataaacgcaagaacaaatcttttccttttgtgccctaaatttagaatccagattccaatttccaacctcatttcttagccttagagaatctaagacaccgatatttctcaccactcacagtaatttccagagcaccatcttgattatcctgattcgacgcagtccccataagaacactcttctccttctccagattctctctctccatcttcaacctcgcttcctgtctagcgatctccgtctgtcaaaatcagaacaaaatcagtatccccacacagatttctccggattctccaaaagccctaaaaatcaaaatttgaaaaaaaaacgaacctcacggcgagagagctcagctttccaggcagcttctcgctcagcgacttcacgctcacgctcttctatataactctgcatctctctctccttcatgatccgatcttgtatatcagcgtcaagtgcttgcttaagctcctccacaaacttatccaccactaatttaattctcagcgacatcgtcttcgaagcaaattctaactatatacaaaatctcctccttcctcacactaaacgctgctacacataaatacaatctcctccttcttctggttttccgtcttttacttacggcggcgctttaccgacggcgagattccgatcttttctcgttgaagcttgcgtgagaactgaggaagaaagggacagagacattcacgaccttttgtttttttttccgctttctaatcttcttcagagtgggaaaaataaataaaagcgggctcttattgggcctatattgggcctgtacttaacataagtcacacgtgtggcagcggatttttggattacacatgttaaaaacttaaaattagggctttgtgtttcgcttcttctcaaaccctagaagatataattgagactggcttgcttagccgcggagaactcagaactcattcgctgcaaacatggttcgtaatcttcgtctctttctctaagtctcgtattcacaagcgtattgcgtcatgtgtttgttttggttttggatagtttgtctccatctgtgaattcattttgtgcgggattataaaatctctctttgtaatctagatagcatttccatgtaattatgggtaattgttaatgtttataaagtgaattcctttgtgcgatctgtaaaatgggttagggattgatattgagatctcaaaagataggactcaattagtcagatatgaaacctccctggcgttattctcttgttctgtgacttgaggtcttgagtgatgagacttttagtgattgagctattataaacatttattgtgttttgatttttatttttgttcgatattcttttgcaggcaagaggtttgaagaagcatttgaagaggctcaatgctcctaagcattggatg

SEQ ID NO: 28244 - DNA, 3003 bp, Unknown
  misc_feature (1)..( 3003): 2750-1469P.txt file - cDNA_ID_2994689; gDNA_ID_2214477; Annot_ID_183169
tttaatgggattttctggttaaaaaacaggattgcaactgttgcctataagcttccagaaactactcttgatgtaaataagtcaaaaaccaagtaaacccaggaaagtcaacacaaacaacaaaccaacgacattagtcgaatttagctgaaagacgaaaagtttcctgagctttttgatatttgaggctaagagaagtagttttttggtaacaaaatcaaagcttggtctgacccatgaacatgaacagagtctgaatctggtcaaagtaaatagaaactaaataaggtcggaagagagaagtagtgagaagagaatgaacttgaaagaaggaatggaattggcgaagacgttgatccacgagatttcatttggagtggctttcttgggatcatcagaaggaaatctgtaaggaattgtgcaagctctgtagttgttttctattggcatcggtagttgaggaaacggaaccatctctgaatcgctctccattttctttgcttgtgatgatcttcagaaatgatacaatgattgatgacgatgaagaacaagtgtatctagagccgggtcgggtacgggtcaaagatccatattagtgattccactaccacacgaataaatgttgcattttttgctttgggtttggtttggatttagttaaatagtagccaagttcctatctttgtggtgtttgtttctgcaaagttaagttttttgttctatactaatcagtcatctttggtcttcaaatgatttgataccttatctgtggtcggctatattagctcgagcagcaatctgaattgtagaaaccattgaaactctggcaaaacttgctgtttgctgcccgtataaccgtatttgtcgaacataatatcaatgccctcttggattaaggagtaacctgttttggtaaggaagctggagattatagaaaacattcatatgccataaagaagttcaattttgcaggagtttacaattgtaatcagctacttatcataagtggtaaaaccacacctaggcaccttgacaagcaaagaagctctcccaattagagtgatccaataccaacctagccacaacacctactgcttgaataaagccactgaggtacaagtttgttttagatttaactcaaagagagaatgttaaaagtagagaaaaacatatggatatttccttttcatagatgcataccgatgtcggacacaattctgagtcaagcaaatctaacaggaccaggaaaaaaactcatccttcggaataagatatacaaacctagataaagaaattaagaaacagcaagaatatggaaataggtacactgtaccacaatgttagttccagcagcaaagcaattattactattgtaacatagtggataatggaacctagctcatctgtctggctatctgcttaaacactaacaagcccactcatacgggcacaaccttctacttcttccctatgttctgaaaagtgaaaccccttaggtttgctactgggtgctgctttgccaaaagaccaagctaactataacaggagaagaaattctaaatgctagtatctccctaatccctacccaaaaacatttgtttattgtctctcatcaatcaccataaatcatgatagatactaacaccaataatcactcactcatgcatcctagcatctttaccctggccacctttcattctcttcatgccacaagatgtttacacattcaagcaaaaccacatgaaaaatccttaagaacagaagaaaacggaaagatatgttccggtgttgcccctgtatttcctacaaacatctatactaatcaaactaaacccatcattcacacataccgtgatctaaaaacctgaatttcaacatgtcacacagcaatcaacaaaagtttgaatagagcaagaaagcaccttgaggcttgaagtgatcagacaaactctctttccagaaaacacaatactttcttcattgaattaataatttacacaaaccaagcatcattccaacaattcccattgcatccatcataaacgcaagaacaaatcttttccttttgtgccctaaatttagaatccagattccaatttccaacctcatttcttagccttagagaatctaagacaccgatatttctcaccactcacagtaatttccagagcaccatcttgattatcctgattcgacgcagtccccataagaacactcttctccttctccagattctctctctccatcttcaacctcgcttcctgtctagcgatctccgtctgtcaaaatcagaacaaaatcagtatccccacacagatttctccggattctccaaaagccctaaaaatcaaaatttgaaaaaaaaacgaacctcacggcgagagagctcagctttccaggcagcttctcgctcagcgacttcacgctcacgctcttctatataactctgcatctctctctccttcatgatccgatcttgtatatcagcgtcaagtgcttgcttaagctcctccacaaacttatccaccactaatttaattctcagcgacatcgtcttcgaagcaaattctaactatatacaaaatctcctccttcctcacactaaacgctgctacacataaatacaatctcctccttcttctggttttccgtcttttacttacggcggcgctttaccgacggcgagattccgatcttttctcgttgaagcttgcgtgagaactgaggaagaaagggacagagacattcacgaccttttgtttttttttccgctttctaatcttcttcagagtgggaaaaataaataaaagcgggctcttattgggcctatattgggcctgtacttaacataagtcacacgtgtggcagcggatttttggattacacatgttaaaaacttaaaattagggctttgtgtttcgcttcttctcaaaccctagaagatataattgagactggcttgcttagccgcggagaactcagaactcattcgctgcaaacatg

SEQ ID NO: 28245 - DNA, 3003 bp, Unknown
  misc_feature (1)..( 3003): 2750-1469P.txt file - cDNA_ID_2994697; gDNA_ID_2214475; Annot_ID_133131
catagatatcagtatatcaaaaaactgaaaactcttccgtcttttgagaataaaagagtccaacttttgcattcgacatttgactataacagtatcttttcgagaagacgcaaagtcgttacgtgcgtttatatttcgtttattcatgtcccaatactacctcttaggaaataagagactattaagactttcttgcttcccaatacacccccactaatatcaaataacctagtttaatttcttccgtttctcaacacttttaagaaaatacttaacaattgacataaaagaaaaaacgtacagaggaatttgaatggacaaacaaaggtgaaacaactagaatggacaaacaaaggtgaaacaactagaatttaacaatagacaaaaaaaaaagaaaaggatttggttaagcaatattaaggtatgaactaacctaaaccataaaatagtaaaaaaggaggattaaggttactttgtttaggagcagcacgttgataaccaaaaagccataattatcgcttccttcagcgcaggatccttctctctcctatctctctgtatatatatgtggaccttcacgtaatagcttcgtacttcaaacctcaaaagcaatttagctctctgtcttcaagatgacttctcttttcttctttgttctccttttctcgtctcttctcataagcaatggcgatgccaacccaaattacaaagaagctctctccaagtcattgctcttcttccaaggtcagcgatctggtcctcttcctagaggccaacaaatttcctggagggctagctctggcctttccgatggctctgctgctcatgtacacaccttaaaccatatttaactttgatacagaatatatctttgttagtaacattgatatatgaattgcaggtggacttaaccggcgggtactatgacgcaggagacaacgtcaagttcaatttaccaatggcgtttaccaccacaatgctctcatggagcgcactggaatacggtaaacggatgggtcctgagctggaaaatgcacgtgtgaacatccgttgggccacagattatctgctgaaatgtgccagagccacgccggggaagctttatgtcggtgtaggagatcctaatgttgatcacaaatgctgggaacggcctgaagacatggacacaccacgtacagtttactctgtatccgcttccaatcctggttctgatgtcgcagctgaaacagcagcagctctagctgcagcttctatggttttcagaaaagttgattccaagtattcacgtttgctgctcgcaacagctaaggatgtgatgcagtttgccattcagtaccagggagcttacagtgattccctttcctcatctgtctgtcctttctactgctcctactctggttacaaggtctgctttcacatgaaactaaaccactcttaccactacatcagatcctcatttttaaaaatgtgaatttatgaacacaggacgagctaatgtggggtgcgtcatggctgctaagagcaacgaataacccgtattacgcaaacttcataaaatctttaggaggtggagatcagcctgacatcttcagctgggacaataaatatgctggtgcctatgttcttctctcacgggtttgtctctctgctaataaaaactcattgagaacatagcttttagcatcacactatctaacttttacattttggcagagagcattacttaacaaagacagcaactttgaacaatataagcaagcagctgagaatttcatctgcaaaatccttccagattctccttcttcctctacccaatacactcaaggtaacctacttcacgatatagaacacaaattgctaaacaacaacctcttctaatcatatgtttaccaattacaggaggattaatgtacaagctacctcaaagcaatcttcagtacgtaacctccataacattcttgctcacaacttacgccaaatacatgaaagccacaaaacacacattcaattgcggaagctccgttatcgtccccaacgccttgataagcctatcgaagcgacaagttgattacatactcggagataacccaatcaaaatgtcatacatggttggattctcttccaatttccctaagagaatccaccacagagcatcttctcttccttcacacgcacttcgttctcaatcgttaggctgcaatggtggattccaatcgttctacactcaaaaccctaaccctaacattctcaccggagcaatcgtaggaggtccgaatcaaaacgatgggtatccagatcagagagacgattatagtcacgcggaaccggcgacttatataaacgccgccttcgtcggacctttggcgtacttcgccgccggccgttcgacttgaaattgaattcgccaccgccacattctccgatttgtagttccattgttagttaaagatccgttggtccaagcctaacgtgaaaatcagaagggacaaagttatttaaatgtaaaactcttaatgggctaagacccaatactaaaggacccgacggaaatatttctcgtggtcttatttaactctaaccatcatcattacgcgtttcaaatattcaaccaaggccgttaattaagcaccacggaaatatttcatgtttggttatagcaccatgaaagaacactagaatatttacttgtcaattatgtcatgaaagaacactagaatatttacttgtcaattatgtcatcagtacaaagattaaacagctgaaagatatgcattaagtaggaaatgtaaagacaaaatatcgttttctgctaaaaggaattacacatatgccaaacaatgggccgagagagaattgaaactaatgggccgagagatattttttctcttagtgggcttttaggagaaactgtagcaaaaacaacagatttcgaacaaaattttgatgtagatcatagctaaaaaataatctggagtgagcgacaagcaagcggcggccgtcatg

SEQ ID NO: 28246 - DNA, 3003 bp, Unknown
  misc_feature (1)..( 3003): 2750-1469P.txt file - cDNA_ID_2994697; gDNA_ID_2213625; Annot_ID_195822
cgcatgcattaaccttgactaaagtaagaaaaaaactaaaaataatgattttaattctaaactgcatctattaattagtcctgatgtgcaacaagccaagatgtattaaacaccaccatatacgtttattacaactcatacaatagaaaagtacaacacaaacgagtcttttggaggacacacctgaaaaattcaatacaaatatgaacaagacgttacacaatgcttcacaaaggcatagagactacaagaaatgggtttagcgaacacttggggtgactatgactttttttttttttgggaccaaacttttcagcgaaccattcttgcttgtgtgaagaaaagatgtatccgatcaccaaaccacagaaaacaccaggtccataagctattgcagctgctacacagttaaacattttttcctcctcctctaactactagatccttgggttgttgtgatgtaggattcaggacaagggttaattctccacagtctttttcgagaccatagagtttagggtatatctattaaagcttagccaatttctattcctaaacgaattatatcatcgttctcaacagatggctagattatgtccatctgaaaatttgatttgacaaatcaaaagacttggaaattaaaactaccttttaactccggcaacatacacagatttcttcataacaagctgtgggataagataattgtcgttatatatcgtaattgactcaaacactagaccttggggcctgtgtggttggtttccaaattgattgcctgtgaaggcccattaatacgaatagcctacatatatgtgctaatttaaatccctaatacagtacatagtcgtgcatctatatataaatatataataaatctacatttattttggtgtagtttttattataaagaaagagtcaaatggttactagaggatccaagtccaactttagcaatcaaatcttcggctaaaaaaatttcctccaaaattttcctcgcatagtcgtggatggtatccactgtttgtcctcctcaacaaaatgtaaaagccattcagaagtacaaacatgaaagaataaaaagaaaacacctttttgacaaaaaggatacaaaaaaatcatttgccaacaaaacaaccgaaaattcttcgagtagtatcagtgggtagggccaccaggagtaaaaaaatcattaagcatgtgagtaaaaaacaagagataaactgttgcttaattctgaaatctctcttgatctatttattattctcatgcaaaccattaatctttacgggagaaaaatattagtatgatattttgagtcctgattgcgactagtgatatcgaatgattacaattactaataagtattacctgaagctttcatcacgcgtctgcttaaacattgataaatacattatacccaagttaatcattctcttaactcatataatgtcagaagatcaatgacatcgagcagacacgttgtcgcctttttactcgcttttgttattacacaagctaaacaaaaagaatgtcccatgaaagaaaaagcaaataaagagagtaatactataataaacacatgggataagaaagtggattaaggcatcaatttcgtctccattacactaaacacacacttttgattacgttccaagactcggcgccgttatcttggcgccattcacgcttcccttttatcttttgtctcctctttttaaattcaaaatcacttaatccccctaacctaattcaactatgcactccctaactatacccatatatgaacatattcttactacggtagatccattttaaccccgaaactgcccatttcaaaattttaaacagtctatgtatatcgtaactaggaaatatattaaaaacaaacttaggtttgcataaaaggaaaacgttacttgtttagcaagtattagatatcttagaaataaaatcgtttagttaggaatcatttccaattcagtaggtgtgattgaatgtcgattttatatggttcagttgatttatgagacaaatattaatggggtcataatttgtagcatttttataggaaacagtttaaatatcaaatattggtttgttaagttaatatacgttggatatttgctttgcattaaaatatgaaaccatttactttacaagtatattgtatatacacgataaattgaaaaaatcaatgattaaatgtcgtttggattttatgtaggaaaaatctcaaaaagggaacgatctgattcgattgcaaaaaaaaatcggatcaaaatctcatataaggaaaaatacgaatcaaagacttccgcttcaaatttttttttttgaaatccatccgattaatttttttaaaatacatagatatcagtatatcaaaaaactgaaaactcttccgtcttttgagaataaaagagtccaacttttgcattcgacatttgactataacagtatcttttcgagaagacgcaaagtcgttacgtgcgtttatatttcgtttattcatgtcccaatactacctcttaggaaataagagactattaagactttcttgcttcccaatacacccccactaatatcaaataacctagtttaatttcttccgtttctcaacacttttaagaaaatacttaacaattgacataaaagaaaaaacgtacagaggaatttgaatggacaaacaaaggtgaaacaactagaatggacaaacaaaggtgaaacaactagaatttaacaatagacaaaaaaaaaagaaaaggatttggttaagcaatattaaggtatgaactaacctaaaccataaaatagtaaaaaaggaggattaaggttactttgtttaggagcagcacgttgataaccaaaaagccataattatcgcttccttcagcgcaggatccttctctctcctatctctctgtatatatatgtggaccttcacgtaatagcttcgtacttcaaacctcaaaagcaatttagctctctgtcttcaagatg

SEQ ID NO: 28247 - DNA, 3003 bp, Unknown; identical to SEQ ID NO: 28245
  misc_feature (1)..( 3003): 2750-1469P.txt file - cDNA_ID_2994697; gDNA_ID_2214475; Annot_ID_183092

SEQ ID NO: 28248 - DNA, 3003 bp, Unknown; identical to SEQ ID NO: 28246
  misc_feature (1)..( 3003): 2750-1469P.txt file - cDNA_ID_2994701; gDNA_ID_2214475; Annot_ID_133130

SEQ ID NO: 28249 - DNA, 3003 bp, Unknown; identical to SEQ ID NO: 28246
  misc_feature (1)..( 3003): 2750-1469P.txt file - cDNA_ID_2994701; gDNA_ID_2214475; Annot_ID_183091

SEQ ID NO: 28250 - DNA, 3000 bp, Unknown
  misc_feature (1)..( 3000): 2750-1469P.txt file - cDNA_ID_2994712; gDNA_ID_2214475; Annot_ID_133111
cgtaacttaatatcttttacaaaaaaaaaacttaatatacatacatatttaatatcttatacaaataagttagtgcgtttctatcacattttgataagagagaattcacaaaagaattttttttagtgttttagtgccaccgaaaaattacagcctcagtttcatgtaggtgggttttgagacttcgtgtttttagaagatctcatcccttaatatgatatcatagagacattttttgtatgctcattcttagtctgttccacattttacagttaaaacatgaaaacatattattgagaaatcaataggcaaatactaattggagctcgtctgatgatgaggaccaacattctaagcgaccacgatcaatatgcaaacactaattcaagggatatctgtataacccttttaagaaaaggcttttaagctagagtccagttcacttgattgggctcaagtggtgcctggcccgggatggagttcgtaattagttttctttctggtgtttactattttttttttttttaggagttcttatattttctttttccctcacaactctcttaaatgagtttacacataatctttctttctttttttttttttttttcacatagtctttctatatccttttctacttcatctttatctttatttttatttttttctctttatcaatagtcttttgacttttgttatcaacaccttttatcaacttttaattggtctttagttcttaagtcgtatgactctaatttataaaaacttggctcgtgggctgctaatttttacaatttgcatttttttaggaaaaaaatgatgatcggtctttttttgcatatatatttatagaatttgctttcggctctttttcgttggttgatagagtaagggaatcaatgtctcatacgtttctaatttttttatgacagctttacaatatagtttaatgtgcatgttatatataacgtaatcaaagttgctgttaaaaaagaaaagaatttatagatgtaatcaaagaccatgatagttcgatcattgtacattttgcatgcctggagccattatccttgatcattacgtaccaaaacattcggagacatcccatagatttaaaacgatacaaaaaatggtaatttcttttccactttccacgaaactcttagcttaactccttgtttttataaatcgttcaaaatacgttcatcataaacatagagaaaaaaggacgtgatgcgagttttatgaaactagtcccattaaatgtctgcccacacccctaatttctgcaaacctaaataagtttatagtgttacttagtcatctgttcctagagtaatcatgtggaggtaaatgatttataaccatatattaattgttttaacccaaaaaaatagagagttacatatactatttttccagcgtgtatccacatcatatgcatcaatataatttttttaatcaaattattaatgttgtccgaagtattagaaattatgcacaaacattaaatgaattgaaagaaaataacttaagtttttttttgtttaaaaatgagataacacaaaatgtttctaaaatcggatagaatgcgaacaataactgtttcggaagtccatggtaatctatacatgttttgactacaatatatgttataaatatacgtatttttaatatatatatatatatatatatatacgtatttttagtatgtatatgtatatatatatatatatatatataatttgtgaaatgtcttgttatatagaaaacaaacttattttcgtccaaaattattttttcacagcagttcatacacatttatgggcatgtactagtttttccgactataagcaaaatttatgtcgatttttctggatgtaacgtatatcttaggaaagagtaagcatatgaacgtggctgaaacaaactaaaagtgtctatctacacatacagatgctagcctctatgaaacacacttgtttggtcattggtggtggctactctcacgtgctcgctttgcattagtttagtttttttcaaacttcaaaagtcttttatcctttttggttatttcaaatgtccccaccatttctgcaaagtcacaatcttcataaaccatttacgatcctctactgactcagcgaatatgccaacacaagggcgcgtgattgtcttgagattcttccactgctatgcgagtttcttcaaaaattcctcatcgatcgacgcacttacctttttttttaaatggatcaaattgtttttgcatcttagaccaataaaaccatattgtatatattacgtaaacataatcactagtccatgatactatttatgaaaggtcataaagaatcctctctaagcatggaacatatgcaattcgaattcgggttcagaagcactaaaacaatactctttttaaccggttaagtatttgaaatagtgcacacaaaaataactaaaaagtttcgtgttactctaattagtagtagtactatatatataaccattgtcaatatagtctaactgatataataggtggaccactgtcacgaacttgaatgccagcgggaaaaaaaaatatactcgatcgcacgtatttatttgctttaatgtttgatccgaaaaagaatctctttggtaagaaaaaaagaagcctttttctattgacaatagtaattggtacgttgaacacagggtcacaggaacgaccgaacgagaccagacgcaaagcttccacttggatattttttttcctttttgaaaagcaaagaaatatactctcctttaatcacaataaatatatagaaggaaaagacttcagtattcctttgccttttaacataagaaaaatatatatacttaaaagatagaaataagacacacaaggactgaaggaccaaaattgcctataaaagcaaagtccatctattccacaagaacaagaaaaggcagagaagagagaggctctgataaaaaaaaaaacaaaaaaaaatg

SEQ ID NO: 28251 - DNA, 3003 bp, Unknown
  misc_feature (1)..( 3003): 2750-1469P.txt file - cDNA_ID_2994712; gDNA_ID_2684228; Annot_ID_192126
gtacgtaacttaatatcttttacaaaaaaaaaacttaatatacatacatatttaatatcttatacaaataagttagtgcgtttctatcacattttgataagagagaattcacaaaagaattttttttagtgttttagtgccaccgaaaaattacagcctcagtttcatgtaggtgggttttgagacttcgtgtttttagaagatctcatcccttaatatgatatcatagagacattttttgtatgctcattcttagtctgttccacattttacagttaaaacatgaaaacatattattgagaaatcaataggcaaatactaattggagctcgtctgatgatgaggaccaacattctaagcgaccacgatcaatatgcaaacactaattcaagggatatctgtataacccttttaagaaaaggcttttaagctagagtccagttcacttgattgggctcaagtggtgcctggcccgggatggagttcgtaattagttttctttctggtgtttactattttttttttttttaggagttcttatattttctttttccctcacaactctcttaaatgagtttacacataatctttctttctttttttttttttttttcacatagtctttctatatccttttctacttcatctttatctttatttttatttttttctctttatcaatagtcttttgacttttgttatcaacaccttttatcaacttttaattggtctttagttcttaagtcgtatgactctaatttataaaaacttggctcgtgggctgctaatttttacaatttgcatttttttaggaaaaaaatgatgatcggtctttttttgcatatatatttatagaatttgctttcggctctttttcgttggttgatagagtaagggaatcaatgtctcatacgtttctaatttttttatgacagctttacaatatagtttaatgtgcatgttatatataacgtaatcaaagttgctgttaaaaaagaaaagaatttatagatgtaatcaaagaccatgatagttcgatcattgtacattttgcatgcctggagccattatccttgatcattacgtaccaaaacattcggagacatcccatagatttaaaacgatacaaaaaatggtaatttcttttccactttccacgaaactcttagcttaactccttgtttttataaatcgttcaaaatacgttcatcataaacatagagaaaaaaggacgtgatgcgagttttatgaaactagtcccattaaatgtctgcccacacccctaatttctgcaaacctaaataagtttatagtgttacttagtcatctgttcctagagtaatcatgtggaggtaaatgatttataaccatatattaattgttttaacccaaaaaaatagagagttacatatactatttttccagcgtgtatccacatcatatgcatcaatataatttttttaatcaaattattaatgttgtccgaagtattagaaattatgcacaaacattaaatgaattgaaagaaaataacttaagtttttttttgtttaaaaatgagataacacaaaatgtttctaaaatcggatagaatgcgaacaataactgtttcggaagtccatggtaatctatacatgttttgactacaatatatgttataaatatacgtatttttaatatatatatatatatatatatatacgtatttttagtatgtatatgtatatatatatatatatatatataatttgtgaaatgtcttgttatatagaaaacaaacttattttcgtccaaaattattttttcacagcagttcatacacatttatgggcatgtactagtttttccgactataagcaaaatttatgtcgatttttctggatgtaacgtatatcttaggaaagagtaagcatatgaacgtggctgaaacaaactaaaagtgtctatctacacatacagatgctagcctctatgaaacacacttgtttggtcattggtggtggctactctcacgtgctcgctttgcattagtttagtttttttcaaacttcaaaagtcttttatcctttttggttatttcaaatgtccccaccatttctgcaaagtcacaatcttcataaaccatttacgatcctctactgactcagcgaatatgccaacacaagggcgcgtgattgtcttgagattcttccactgctatgcgagtttcttcaaaaattcctcatcgatcgacgcacttacctttttttttaaatggatcaaattgtttttgcatcttagaccaataaaaccatattgtatatattacgtaaacataatcactagtccatgatactatttatgaaaggtcataaagaatcctctctaagcatggaacatatgcaattcgaattcgggttcagaagcactaaaacaatactctttttaaccggttaagtatttgaaatagtgcacacaaaaataactaaaaagtttcgtgttactctaattagtagtagtactatatatataaccattgtcaatatagtctaactgatataataggtggaccactgtcacgaacttgaatgccagcgggaaaaaaaaatatactcgatcgcacgtatttatttgctttaatgtttgatccgaaaaagaatctctttggtaagaaaaaaagaagcctttttctattgacaatagtaattggtacgttgaacacagggtcacaggaacgaccgaacgagaccagacgcaaagcttccacttggatattttttttcctttttgaaaagcaaagaaatatactctcctttaatcacaataaatatatagaaggaaaagacttcagtattcctttgccttttaacataagaaaaatatatatacttaaaagatagaaataagacacacaaggactgaaggaccaaaattgcctataaaagcaaagtccatctattccacaagaacaagaaaaggcagagaagagagaggctctgataaaaaaaaaaacaaaaaaaaatg

SEQ ID NO: 28252 - DNA, 3000 bp, Unknown; identical to SEQ ID NO: 28250
  misc_feature (1)..( 3000): 2750-1469P.txt file - cDNA_ID_2994712; gDNA_ID_2214475; Annot_ID_183068

SEQ ID NO: 28253 - DNA, 3000 bp, Unknown; identical to SEQ ID NO: 11243
  misc_feature (1)..( 3000): 2750-1469P.txt file - cDNA_ID_2994722; gDNA_ID_2214485; Annot_ID_133355

SEQ ID NO: 28254 - DNA, 3000 bp, Unknown; identical to SEQ ID NO: 11243
  misc_feature (1)..( 3000): 2750-1469P.txt file - cDNA_ID_2994722; gDNA_ID_2214485; Annot_ID_183493

SEQ ID NO: 28255 - DNA, 3000 bp, Unknown
  misc_feature (1)..( 3000): 2750-1469P.txt file - cDNA_ID_2994737; gDNA_ID_2214494; Annot_ID_133526
cggaatatcaatgttctcgtcatacacaccttcctttacatatatcagcaccctgtcgttactcatattaggagcaaagcttatggcctcgttaatagtcgaaaaattccctgttccatcggcagcgaccacgaggctctcactcgggtcatactcatcatacccgtcgctagaatcttctaaaaaccggtgatctttcttatagacccagtcaggaaataacccaagtaaccggcggttcttagtgtttccgccggtttttggatttgtggttcttctctgttttggaagagcagagagggagttgcttatgtgtttgtaagtggtcgtgaaggaggtcacgagctttggcttgagtggacctgaggctgattcaagaccttccaagcatgtgatcttgttggtgagagcggcgcttaggtacgctctagcgtcggctagtttccgtgaatcgttaacaccgtcttggatcttggagattgatcgtttcaagaaagaagaagtgatgtggtgaagatctttgcagtcttgaagagagccacgttgtccctcaactaggttgttggagaccccagcgccagaaaggagatcggtgagtttcccagcctcggaaagagctgtttggagggtttggaggaggaaagagagaatgttggggcttatgttgatggagatggatagttttaaggaggtaaaacatgcatctggatatggtgtgtttttgcagaaacttgtagcagaagtttcatgagggtttagagaaggttgatacgaatacgagaaaacggaaggagtgaagaagaggaggaataatagagaagagagattgaaagaggagagcgccatttgagaagaaaatgttgaaggcttggagcaagtagagaagagactgctatgtttttaaaagtacaaaggaatgggtttacttaatgttttgtttagtcttcgttagacgacaaaacaaatatcttttttggttgaatattcgatcgatcgtgtttaagtaaatatagtatatagagaaaacgatgtctctgattgttgtttaatttggattttgattttgttagtaataagatcacattcacatcggttactattttaataagatctgtaagattgaaacaatctctcttttaacgataactacgaggaaccataacgtttcaggcaatggttttagacttttagacccaacccagtcacaattgtatattttgatcatacgacacttggtcctatccagtcccggctcaattcattatgggacctattgcaaaactcaaaataaaataaaatttcttagtaaaatttttttttggaaaaattggggctttttagtcttaacaatttttttgaaattgattagtaacggcatttgcctacgatgtgaaatataagtttgatacataaataaagtaatgattgattcttgaattgctttttgtacttctagatcagtattgattactttatttacgagaaaatagttcatttaagcacatttatagaaaaatgttaagtaatgttaaataggatagtccgattaaacctattaattatgcaaattttctttcaaataaataggtacccataaaaggccattttaatttctaacttaactacaaatgacatcgtttatgtgtagagtttgagatttcacattaaaattctgatttcaaacaaactctttcttcttcactatagtgtctcgatttcgatcttatcttctttcgaacttcgacgaatctcgaaatttgatatgaattttgagtacctttactgtaattttgtgttttatttctggatttggtagttcgaatctaagagcatacaaaaattatgggctgcatttgtaacttttgatttgaatatattttgcgggtctagcaatcaaatattttattttccaaattgaaaattataaatttgtcgtgttgtctccctgaatgttggcaacacattttaaaatttagatgcatgatccatcagaactttttatcgaaatttttaattttagattatttaacatctatggaaggagcagagacatcaccacagttcaaacaatcgatctcttaattagttaattacatgtatcatcgaatcctaaaaacatttttcttccttcctaagcccaataagggcctagttagagtaggcccaattattttattttcttcctttttgctaatttctcttcttttttttccctcacttctccaacaaactcgatttcccgatttcgtcgcctcttctcgtctctccgctctcctcgccgcgagtctgtttcgccgccgtctatctcccaattccggtacatcctaaaccatttccccttttaatccaacctgtgttgatttctaatcgcgattaatctcagttaggtttaattgcttgatctcagttgaaattagggcgtaatctcattactaaatgtagcaaaaatcgacaatatagtctcgtctctctgttatagcaatcaatttgtgagattctgaattttggcagaatcctaattctgaagtttggctaatatagaacctgtaattgtgttttttcatttatgagatgttttattaactttgttagtcacaaattgatttcatgtgtataatgttcattatttcgattttgttctcgtatgcgatattacgttcttggctgtgatatctgaagtaaagctgttgtaatctaagtttttcttctcttgattttaaacagtgaccgttgttgtttagtgaatcgatgatttacactgctatcgacaatttttacctatccgacgagcagctgaaggcttcaccttcgaggaaagatgggatagatgaaacaactgaaatctctcttagaatctatggatgtgatctcatccaagagggtggaatattgctcaaactgtatcctttttcttggtctaattattaagcaagactcaaatgttacgtagctgtgattttcttaacttagattgtttattttagaccacaggcagttatg

SEQ ID NO: 28256 - DNA, 3000 bp, Unknown
  misc_feature (1)..( 3000): 2750-1469P.txt file - cDNA_ID_2994737; gDNA_ID_2214494; Annot_ID_183761
taaaattaaattatatggtcctagttgacaaaaaaaaggcaaaaattctacggtcctaaagtctacactatgccccaaactataccacttgagtcttgttttatataaacaagatttttaaaagagtcaaagatgtttaccaagagtagcagatcggaaagtggtccatccatctccgacacttcggtttccggtaataaatgtaacatcggatccatctcctatcaaaacaatattagtcttgtagatcggaatatcaatgttctcgtcatacacaccttcctttacatatatcagcaccctgtcgttactcatattaggagcaaagcttatggcctcgttaatagtcgaaaaattccctgttccatcggcagcgaccacgaggctctcactcgggtcatactcatcatacccgtcgctagaatcttctaaaaaccggtgatctttcttatagacccagtcaggaaataacccaagtaaccggcggttcttagtgtttccgccggtttttggatttgtggttcttctctgttttggaagagcagagagggagttgcttatgtgtttgtaagtggtcgtgaaggaggtcacgagctttggcttgagtggacctgaggctgattcaagaccttccaagcatgtgatcttgttggtgagagcggcgcttaggtacgctctagcgtcggctagtttccgtgaatcgttaacaccgtcttggatcttggagattgatcgtttcaagaaagaagaagtgatgtggtgaagatctttgcagtcttgaagagagccacgttgtccctcaactaggttgttggagaccccagcgccagaaaggagatcggtgagtttcccagcctcggaaagagctgtttggagggtttggaggaggaaagagagaatgttggggcttatgttgatggagatggatagttttaaggaggtaaaacatgcatctggatatggtgtgtttttgcagaaacttgtagcagaagtttcatgagggtttagagaaggttgatacgaatacgagaaaacggaaggagtgaagaagaggaggaataatagagaagagagattgaaagaggagagcgccatttgagaagaaaatgttgaaggcttggagcaagtagagaagagactgctatgtttttaaaagtacaaaggaatgggtttacttaatgttttgtttagtcttcgttagacgacaaaacaaatatcttttttggttgaatattcgatcgatcgtgtttaagtaaatatagtatatagagaaaacgatgtctctgattgttgtttaatttggattttgattttgttagtaataagatcacattcacatcggttactattttaataagatctgtaagattgaaacaatctctcttttaacgataactacgaggaaccataacgtttcaggcaatggttttagacttttagacccaacccagtcacaattgtatattttgatcatacgacacttggtcctatccagtcccggctcaattcattatgggacctattgcaaaactcaaaataaaataaaatttcttagtaaaatttttttttggaaaaattggggctttttagtcttaacaatttttttgaaattgattagtaacggcatttgcctacgatgtgaaatataagtttgatacataaataaagtaatgattgattcttgaattgctttttgtacttctagatcagtattgattactttatttacgagaaaatagttcatttaagcacatttatagaaaaatgttaagtaatgttaaataggatagtccgattaaacctattaattatgcaaattttctttcaaataaataggtacccataaaaggccattttaatttctaacttaactacaaatgacatcgtttatgtgtagagtttgagatttcacattaaaattctgatttcaaacaaactctttcttcttcactatagtgtctcgatttcgatcttatcttctttcgaacttcgacgaatctcgaaatttgatatgaattttgagtacctttactgtaattttgtgttttatttctggatttggtagttcgaatctaagagcatacaaaaattatgggctgcatttgtaacttttgatttgaatatattttgcgggtctagcaatcaaatattttattttccaaattgaaaattataaatttgtcgtgttgtctccctgaatgttggcaacacattttaaaatttagatgcatgatccatcagaactttttatcgaaatttttaattttagattatttaacatctatggaaggagcagagacatcaccacagttcaaacaatcgatctcttaattagttaattacatgtatcatcgaatcctaaaaacatttttcttccttcctaagcccaataagggcctagttagagtaggcccaattattttattttcttcctttttgctaatttctcttcttttttttccctcacttctccaacaaactcgatttcccgatttcgtcgcctcttctcgtctctccgctctcctcgccgcgagtctgtttcgccgccgtctatctcccaattccggtacatcctaaaccatttccccttttaatccaacctgtgttgatttctaatcgcgattaatctcagttaggtttaattgcttgatctcagttgaaattagggcgtaatctcattactaaatgtagcaaaaatcgacaatatagtctcgtctctctgttatagcaatcaatttgtgagattctgaattttggcagaatcctaattctgaagtttggctaatatagaacctgtaattgtgttttttcatttatgagatgttttattaactttgttagtcacaaattgatttcatgtgtataatgttcattatttcgattttgttctcgtatgcgatattacgttcttggctgtgatatctgaagtaaagctgttgtaatctaagtttttcttctcttgattttaaacagtgaccgttgttgtttagtgaatcgatg

SEQ ID NO: 28257 - DNA, 3003 bp, Unknown
  misc_feature (1)..( 3003): 2750-1469P.txt file - cDNA_ID_2994744; gDNA_ID_2214497; Annot_ID_133590
ctcaagacgtctccgccgtaatcatgacgaacgcttcttcagcgccaccgccgccgcaggcaaaacgcagacttgggagaacgagtaggtccgctatgaaaccaaaaatccacagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtgatggggagttgcataacataagagactctgaaggagccagagggttctcggatacttggaaccaagggaatctcgactgtcttcttcagtcttgtccatcggtggagtcgtttctcaactacgaccaccaagttaacgatgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatctattccacgtcgtatcatatcataaagtttaggatctaaatattagtccattagttaaaattatctaatgcaataaaacccatgggatgtttggattgtacgtaaggttaaaatattgcagtctttgctttagtggaagaattaaactaatatgatgtttttctttgtaacgtatttactattttcatgtaatttaataaagagggtacgaaatgtaggtgtacatttgtttgggctgtatatatttctattgacattaaatacgccaaattagaaaagaaaatctttagttggaagcatctattatatgtacctctttcggaatgtaaaatcacgtttaatatttctgaactggtaatcaatctcatctcctaaaatttaatacatatcatcattgtcaaacaatcggagtagcgacgagaactatcattgtttttctcttgtgatattgccggccaaatattattacctcaatcattttgaagcgagtaaacatagtttttttcccccttttttttgttcttgtacaccaacagaaagctgcatcacatctgcgaatcatcacgtgccattcaagtgattactggaacgtgacatgaacgaatcttcacattgagtgttccaactctcctttgtacgaaactccaaacaagtagatatatattcaattattatggatgttggaacaatcaaattaactcttgtccttcttatcgtagagacatgaaattaacccaattctgtaaatgagtagtaagtaatctatatatatatagttgacaacagataacactataatatatgcgtccttataatgttaatgtaattatcatggtttgagttaacgtatagaagcattgaaacttagttgcagaccgaaaatgatatacgatcttaagagttaagaatcttgaactcggcaaattttatgaaaaaaaaacaatttcaaccatttctaactagtgattagatgaccaatagcaagcatgcaccaacgacttcatttttataaacatcatagggacctagacatatgcattttgtgggcaacggcctacgcattaaatttgtgtttcgaagattaaatttatgaacagaaggcaacttgcaaatttgctatgtacaaaaaacacaaaggaaaagtttgtaaatagagacaataagggagaaataaaaagatcgctttctcataagtccgacttggttccacggtatctagaatgcccacgtgatgtcatgtacttttccttcttctctattctaatatgttgtttaacaaaaagaaaattgattgataaaaaaaattgaaaaatttcatagtgatatctaaagtttaaacaaattatctctaagaaaattgttagtatgccttggaatataatttctcaacacacaaactgaagaaattgcttttaaaactgaaatttatatggtaatggcatactaataaacagctaaacttttgtagttttatgtgtgtgtattaagagatttttcaaagtgaatgcaccttaaggtcatgttttgtgaggtttgatgttggagagagtctttgatccgctgaagaattggccaggtatcaaaatcatttcttaatttatatataaaatttcaactttaaaaaagaaacgttcaatctgagtctcttaaaataacaatgtgaatgttaacactttgtagatatcagactatcatagataagattgctacttaaaacattgaaatgttttgatgattcgttaagcctagcaatatatcatgtcgttattgggcttgtttacttacccagttacccgtattccagttataagcccattaatcagcctcgtacagttctattgttggtcagattattaatttttaaaataagggcgtattttccgaaactaaagaaagtatagggtcttcttcttttctctaattaggaaaaagactttttcaattgtcttgtccgtgaaattatgtggagagctaaaccattcatagcccgacatgtaacccagccacgtaattagaccactcgatcaccgttcgtattaatgtgattaaatcaacgattgatatcacgccacgtcattgtttttcttttttcctttgtatcttctgttctaagggaagaaataataacgagagaagaacgttttaataaacagagagcagagcacttgttctaaagatcaaagcttaagtgagaagcagaaaaaaaaatg

SEQ ID NO: 28258 - DNA, 3003 bp, Unknown; identical to SEQ ID NO: 28257
  misc_feature (1)..( 3003): 2750-1469P.txt file - cDNA_ID_2994744; gDNA_ID_2214497; Annot_ID_183859

SEQ ID NO: 28259 - DNA, 3000 bp, Unknown
  misc_feature (1)..( 3000): 2750-1469P.txt file - cDNA_ID_2994757; gDNA_ID_2214502; Annot_ID_133700
ttcctacatttctattacagattaacaggtgtcctataacctttttattttccttttcatgtgttgtttctagaaaacaaaatccagattattataattcttgatatcacaaaaatgtagaggaaagggaccatttctaaggaaaagtaattttaaaatccctttatctatgtgttgtgtcgtgtgtcggtgaagagtaagaagtcgagagacaaagttaaaagtagagaagaaaatgagtgaggaggagaggaagcaacacgtcgttctagtacatggtgcttgccatggcgcctggtgctggtacaaggttaagccgcagctcgaggcttctggccaccgcgtaaccgccgtagatctagctgcctccggtatagacatgaccaggtcaatcacagatatatccacatgcgaacaatactcagagccattgatgcagctaatgacctcactaccagatgatgagaaggttgtgcttgttggtcatagcttaggaggtttgagtttagctatggccatggatatgtttccgaccaaaatctctgtttctgtctttgtgactgctatgatgccagacaccaaacactcaccatccttcgtatgggataaggtattttgatcttatcttaaatcaatgtctataccatatatatatacatatatgaacatataaggtatattgtatatctgaacagtgaacaacactagtccatgactataaatatgaaaagagttgtagaatataatttagataattcttagttatgtttagaatatacttttgattactacttcatttcttatgagcatatagatgaaaaaaaaaaatagtctcaagcatatgatacattaaagatttccatctttggactctttattatttgtattatatatgctccaagattaattgtaagttggtcaaatgaatttgctagatttaagcaaattagttgggtcatctttgtttttcagatggcacttgaatcactaacgctaggataccaatttttagaagctatggcttcttattcccaacataatgaggggttcattttgatgattttaggtaaatttaggatttttaatggtttattatgaaatcttttcaaatcccattttaaagcaagggatttagatttgtctttttttttttaagagattggtatgcaagtttaaacaaaaaaagctactaaaatccctttagaataattaagaatccaatacttgaagtgttttcaataataacggattttaaaaaataatatttcaaatgcttgattgaatacacttccgcaagacaacatccccttttagtggttaccttagaccaactccagcagtagtttcttagtagaaactcatacaattaacaaaaaaaagaattgaaaagttaatgagagagaatctctaaaattcataatattaggatcgtttctattactcgtataccttggttttttggttttttagatgtaaaagtaaaatattaatactttttgttttttagaaactacaaaaattctatacgctggagttgctcttacttacataactgttaaaaactttcagaaaatgaaaataaaactacctaatcttatccaacaagtcatagttctaactgttattgactttacatgaaaacttatagcttacataatatttttgaatctaacaccaagtaattcggatatttgactgaaatctaacagctaagaaaagaaacttcacgagaggaatggttagacaccgtgtttacgagcgagaaacctgattttcctagcgagttttggatttttggaccagaattcatggccaagaacttgtatcagttgtctccagtccaagtaagactcttagcttcataagaacctctttttttcaagcacaaataagattgtactagtaatctatgtcaatcttttgttgatttttgttacggtgaactaggatcttgaattggcgaaaatgttggtgagggcaaacccattgattaagaaagatatggcagagagaagaagcttcagtgaggaaggatacggatccgttacacgtatatttattgtatgcggaaaggatcttgtgtcacccgaagattaccagcgatcgatgatcagcaactttcccccaaaagaagtaatggagatcaaagacgcagatcatatgccaatgttctccaagcctcaacaactatgtgctcttctcttggagattgcaaataaatatgcctaaataaatctgaaatatcatcatcactgcatatcaattacaaattcagtgtccaccacaataataagccatatgagaatacataatgtatgagaactaagcaaatgataatattcacaagaatggttttatgaataatgattcgtgagctagataactatattattacctgaaaattatgttttatggtttctccattgatttaaacttataggatacagatttatacaccatatttcatgataatctctatcaaaataatgaatttataagcaatcgagtaaatacaaatataggcgccgaatggagatgtacggtacaactgcgaatttttttaagtcataagtaatttttaaaaaatgttatctctatttttagttacgagtaattgttttaatattatatcaaaaattaatattattgtccaactagtgtgatttgacctggtacatgacacggaacaaacatctaacacaacttgtcaagttgtatatcactgtaacatcagctttaattagaaagatacttttattttgcattttaataagtgtaaagtttcttatccgcagagccaaaatgtcgcttttaaaaagaaaaattccaaagttatttctttatgcaagaaaaaattcgaaattttaattatcacgtaaaatcataaaagaatctcaaaggaaagcgacaattttggaaaattcaacgataagctttataatttttctacttatgagtggatgtgtgaagagtagggaaaaagtacgaaaggaaaatatg

SEQ ID NO: 28260 - DNA, 3000 bp, Unknown; identical to SEQ ID NO: 28259
  misc_feature (1)..( 3000): 2750-1469P.txt file - cDNA_ID_2994757; gDNA_ID_2214502; Annot_ID_184035

SEQ ID NO: 28261 - DNA, 282 bp, Unknown; identical to SEQ ID NO: 420
  misc_feature (1)..( 282): 2750-1469P.txt file - cDNA_ID_2994796; gDNA_ID_1590883; Annot_ID_150199
  misc_feature (52)..(52): n is a, c, g, or t

SEQ ID NO: 28262 - DNA, 3003 bp, Unknown
  misc_feature (1)..( 3003): 2750-1469P.txt file - cDNA_ID_2994800; gDNA_ID_1620761; Annot_ID_50015
atgaaaaacaaaaaacaagtctcattttgattgcatattagaaacgatctaaaacattttcgactaatatattgacatacctggaagtacctgctttcaacagtttgcttatatgataatgtgaatgaagaagacgaaggaaaataagttttagcctttctatccacggcttgagagtttttgcattcttttgaaacgaaagcaataacaactaattatgttctctcttgttttgccctttttctctccttgagaatagtagatttgatcgttatacgaccataagggccaaattctttatttaaacttttttttttggtaattaaaacccaatttcataggaaataaaaactagtacattttaggaccccagctaaatatgatgataattaatgtaaaaatacgacttgggaattcatatgtttttaatgctcgacttttgagctgactttgcaataggcttaccacttccgttaaaggataagtttatgaaattattaaaacataaccaaacaatgacatgacgagttgtatctaagaagagatgcaattaaaaaaacacttaatctaaactaatactacttagttagcctggccatactattattaaagatgttttaatcttatgcaatagtttttttttttgtcaaacaatcttatgtaatagtttaagtttgtcaatttgtcttattaaaacaggaggaactgcacaactctaccaaaaaaaaaaaaagtctcaaagactgtgccaaatcttgcctttatgactccaaagtgcacgtttattcagataaagtattcaaaaaacaaccaaatggaaatgagattagagagcgaggttcagagatgatgggcgactagttgcaaatacaaagtgttgtttaaatgaaaagtgattaattatttatatagatctttattggacccaatgctatcacctcatctcaattatcaagcccatgggttggtctcatcaaagcccaatcaaagcttcccaaacaaaaaggaattaagatgaacaaacaaaaaaaaacacttcggagcaaaagatctggccaccacaacacaacgatcgacgaatacaataggaaaatttgaaatctcgtcgatgaagatgactgctaagatgcgccgtgaattcccgacggcgttccttctcttgtttctggttccggtgatgattccggtcggtgaggctgtatggctagatgtgcctcccaccggaacaaagtgtgtatctgaagaaatccagagcaatgtcgtcgttttggctgattacctcatcatctccgaggatcacgaggtcatgcccactatatccgtcaaggtaagtgtcttcgattttctgttcctatcatcttgcttgttcagtgatttgaatctgcattttgtgttactcgatccataatttcaactgattcatgagtcacgtttaggaattagaaaggcatgtattaattctcgatccaagtttccttatttggaaaattatgatcatgcatgtctttctttgattgtttgttatgatgattttcggatttgtataaatgctcagatgcttgtgtatagcttaatccctgtgaatacccttttttttttgccgtaatatcagtaattagctgtgagattgagataagaaaaattgaaactttatgtggtcttttaatgaagtctgtgtttttgatgtgtatgtttgggaacaatgataattattacgaacaagggagtttcttttattgagcaagtatcatttggtatttagtaatcattgctatgtgctagttccagatagtttgatggattgtttaagatagtgtcctttggattgagagcagtctttgaagtcgacttgaaaaaaggaatacaatgtttctgaatggtaacctctgttcctttttattcttggctctgagttttgagaatcattatggtgcaggtgacatccccatatggcaacaatctgcacaatatggaaaacgtaacgcatggccaatttgcatttacaacccaagaatcagggaactacttggcgtgcttttgggcagatgaaaagagtcacggaaacaaaaatgttagcatcaacattgactggagaactggaatcgctgctaaggattgggcctctattgctaagaaagagaagatcgaggttagctttcaagagattttacagttcagagagtggtattgcttataattttgcttcaaaatatttctaaaatttgttactctatgacaattgcttaagggtgtggagctggagatcaggaaactcgaaggcgcagtcgaagccatccatgaaaatatactctacctaagaaacaggtaaagtcatcttcagctgcatgaactgctcttgccttctttgctgactctcattatcaaaatggtaattgcagagaagcagacatgaggacaatgagtgagaaaacgaactcgcgggtggcttggtacagtataatgtcactaggtgtttgcattgctgtctctggtttccaggtactctacttgaagcagtactttgagaagaagaagcttatatagagattccctgatattcaggtcctttaatgagagtttcttcttaaagaataatattcaattcatctcctttctttcctctttacacgcctcctttttactgacgctgtaaaatttttgttcatggattgtttatgtagcttctctctgataagaagtcattatttctgattctgaaataataatattaacttcttgtcatctccaaagtccaaacgaaagagattctagaaccattgatattgggttgtaactgatactttatgttagtttggggctataacacgtaagtttgacagtacaagggttaagattacaagaaaaaactaatcaaatgggtattacatacaaatcagcccaaatttctgacccaacaggcccgttaagagcaaaccctaatttcaaagagaatatatataaaccctaatcacatttcgcaaccaccaaagcggaggaaaaatg

SEQ ID NO: 28263 - DNA, 3003 bp, Unknown; identical to SEQ ID NO: 28262
  misc_feature (1)..( 3003): 2750-1469P.txt file - cDNA_ID_2994800; gDNA_ID_1620761; Annot_ID_167165

SEQ ID NO: 28264 - DNA, 3000 bp, Unknown; identical to SEQ ID NO: 12724
  misc_feature (1)..( 3000): 2750-1469P.txt file - cDNA_ID_2994808; gDNA_ID_2214568; Annot_ID_186095

SEQ ID NO: 28265 - DNA, 3003 bp, Unknown
  misc_feature (1)..( 3003): 2750-1469P.txt file - cDNA_ID_2994821; gDNA_ID_2926262; Annot_ID_143249
tggaaggtttatataaacttttggatgtctttatcttgtcaataaatatttttctttttagtagtaaacaaaattattttgtaaattgattcatatttttcttcttcataaaagctatgttgactaaaaatgatccaattccaacaaaacgttccaatccaatccgtaggaaccaagcagaagaaacacgtttcaattaggccataaaagctattcacattttaaccacaatgcaggggaattttttttctttcattgttgttgtaagtaatatattggtttatccatttgaatactttttttagatatggatataaatttgtcctgtcatcaaagaaaaaagaaatgcaagatacaataattaacaaacctttgattttgtttttcccttttttgaggataaataaataaaatttagtctttggtgtaaatctatatggattgaataacattaaattttcggtgtaaaggtaagtctttttttttttttggtcatctgtaaaggtaagtctatatggattgaataacaatatttgttttggtgtaaatccatatgcattgaataacaatagtttttttacttttttctccttttaaaaggcttatttttggattaaaaaaaaaacatatttggtgtggtgtaaataaaagaaagaataacaatattcaaaatcatagattaaaaaatatgtttttataaaaatttctaaatcacaaatagagcaagacactatttatgacattattttcaatattagtgatcaaataacttatcagtagtttttttgcaagaccttcctcttgatattactaatgtttgggtttggctttcaagttgtgaagtgattgctcattgctccacggtcttaacaagctaatactactaatcaatttttatttttccaatacttgaataaatagtagagatttagtatcacaaaaacaaattatgaagtgtgttcatataaaacatttctgaataccaatctttaatcataaccgagacaaataaacgcacaaaagaaagtaacatcttcacaagttttgtcttccaaagtaaagataagagcatagaagaaaacagagggaaaaagaaagagaattacttctgaataatctcaggccaaaactgagcgtttttaactttggaaatactcgccaacacagttaacggtgtcacgtctcccgtcacggtaaccttctttgctgcgaagtctatgttatacgacgtcactcctgcgttcaacaatcatcaaaggaccaaaaacagagtatttttacaaatcaagtatatattttcatgaatagaagaaatactttacttgttagttacctttcaatttcgatagatgtttcttaactttccctgcacagcctttgcaatgaagtgacactctcaaaacaaccacctttaagcaacgaaagaaagattgtcaagtttaatctcaaaacattaactcatgattaaatattatggttttgttcgattacttacttgatcggaagatgagtttttctccggtggtgatggcggcgacgactgaggaggagaaggaggtgggggaggaggaggagagaatttgaaatccggggacgaaacatctttatcttcaagagagctcagagaagctgtaggagaagcttttgtgggttcagagaaaggattatcgggagatagaaccggttcataatccaagaacccctcgaagaaatcgggttgcttcttctccaagaaagaagcagaagttgatagatactttgaggcgtttattatgagtcgatcttcatgaaaattatttaaatcatcagctttggttatctccggttcatcaataggtattggaatcgggtcggaatccacaaacccgtcaaagaaaaccgggttactcaataagtaccttgaagaaccctgaggtgtgtcactgctaaaacaactaaccggtgacttaccaacatcactgtcacctttcttgctcttcctcttcgctaaccgtttttgttcactactctcgagacctagtctagtcataagaggagtatgataagtagaagaagacgaagaagagggattaaggtttggggaaggtggaggagtgagtctccgaccgtcacgtatgattgggttatgacggtcaatggctcgaccaccgagccggatcgtggctgaagaagaagaagaaggttgtgaggtttgatccatggttgagcaaagggttgttgttgatgcttgagaagcacacaacatgttttgtatggtttacaagaaatttaagaaaaagtctttagtgtttgcaatgaaaatgtggagagatttctatagtcacatataaaatcaattaaaaatgtacatatttttaggttcgagttaaagatatttttttgggtgatggaatcgactttagaaaaaagtaagtttattcgtattcttatcaaaccaatgtgtgagagattgattgctagtagacctagaaaccgtgtgaaattattttgattcgattgaactgacgatttttggaccatctactacaaataaatacagtgtagtttactctcttttagatagaagaagaagaaaaaaaaaatcattttgttagaaaatcatatttttttaaaacaccaaaaagaaaatagaaaggccaattctttttgccaacccttaatgatagttccgaatctcattctcacaaacaaaaaataatcagaatctgatgcttatgggttttattgacgaatttattcgtattagctttcactattcacaccttttctcttttcggcatacgacgacccaattaaatgttctttaataaaaagcccatgttttgtggaaataactattgggctattacacggcccattatatttgccaagagaatcacgagggttttctaactcaaatcgatttcacaaaggcatcgtataaattttcttcttcaacaaaattagggtttggagccagaaaagagcaaataggcggcacatcagttctcaacactcacgatg

SEQ ID NO: 28266 - DNA, 3003 bp, Unknown
  misc_feature (1)..( 3003): 2750-1469P.txt file - cDNA_ID_2994823; gDNA_ID_2926139; Annot_ID_197347
catgacacaagcttttccatgaatgtatttatgtccgccttcttatctttcttgaggaagatgaattcaccgaagatccaacttgagcttgacaatcaatcaaatccgaaacagaaacagagctttttgacatctttgatttagcagtctttgatcttgaggaatatcaatgaacactagatacactcacacttgcaggctttaaactggattttaaacatgaatagaagcattgattccatggaatgtggtaagtgacatagctggacttcttaaacaaatgtatgaacgggtagggttcattacaatgtagttatacagcactgagatttatggaagaaaaaaaggacacagctttaactatctacagagagacaagaacactaaagacaagagaatcataagttcaggagttcgttaaaatggctctattcaaatcacacattggcacaagaccactaataagataccaagtgggacaatcgaaagataataagagatagcatatcagagagagagagagattttttgaggagggagaagttcgccggaggcttctgtttctagtcggcgttgtgattggaattgtttgagcggtctttccagtcccggaattggaaacaagagggctaattttggtccttttggaaagatttgaaacgacatcgttattaagccctaattctactataacgatgtcgtttacgagaaacatacatatacatacttgagaataaagcccattaccaagagaccaattttggtctttttcgtatagtattaactctacggcgattgatctaagcccaataattgtggaacttgctcgacttaggtctcaatctctattttctaccaatgccaaaaaacaatttccttacaaattttttatttttcccatcaaaacaattcccaccaatttacatttaaaaatcattgtaatctatcacatttccttacttttaaaaccatttacaaatctatttatcgccaaaacaaaaacgggaaaaatgtttttggaaaaaaaaaattgacagaaaaattattttcggaatatttttggcgaaaaaaatcgatattctattttgttaacctaaaatattttcaaaatatgagtaaaatagtcattaaaaattaaattaacgtataaatgaaaatgactaacaggaaaggttataattaaaaaatgataattttggaagaacattttttacaatttctctttaatcattaaccctcgttgtatggaactccggtggcgttgagccacgaatctctatttatgaactctctaaccgtaaacatgactgcttccatcgggtctgtgatgatcttgttcccattcggatggactctctggcttgcgtttgctctggggcctttgttttgatattcgcggtagaacaatgtggacaaatccccactagtgctgctatttcatggagtccatcccactggatctatcaaaacatccatttaagattccataatcaccaccgttgataaatcaccccacggtcttactagaaacatcttcaccattctgtgaatgtcgacgtgtcggtcgagagactgtaaaaagcctacgtattcatagaatttttatttttatttgtgatgtttatgatagttttttgttcactttattttttttgttcaatctattttaattttcttaacactgatataaaaaatttcatagtttatgttgtgtatttattttttaattttttataatatttaatttaattttgtcaattattgttttatttaatgtgtgaattaattttagctgtaatgttttgatttcaataaataaaatttaggcaggccacaatatgatgacttggatgttgatgtagacatcgtagatcgaaagtgaacttttctattatatagacgtattttacttattttttgcttaatttatgcttacttttggtcaaattattttctctttattattcaaattatttcaataatcataacatattggtagatatgtagtcgctataaaaaatttggatgtaaatgttaactgatgaaataaactaggcctaatttgtgtgaaagtagaaacctattaattgtgaaagtttgaaattccataatctcggtcgcatattgaatactcaacatataattttggtagtgtttgaagaatcatatttgagacataatcaggtataatgaataaaagcagatgacacagcaaacgaggaagatgtcatcacttgtcacaaatccagtgcatagatggatcaagtgcaattctgatgaagtataaaaacattagagaaatactctgaaattggatggatactctatgacgaccaggtggtgtttgtaacatcttgcatagcgttaatcttgagctaaaaacagctttagaagctgaaagatagatttttggggtcagactgaaaactttaattaagttagggtaaatatgtaaggaaaaggaagtaatgtgtaattttataaatttcagaaagaaagaaatgaaaacttaaaactccgttttaattaccacaaggctcaagcccaagcccaataccgctaacgaaatccgacgaaatcacaaacattataatattacatagagataatcatctttctgtctctctgtctctctgtctcacgcgagaactctggcttcgtctctatattattgacccttttgatctctctctgtctcgctttcttcctcgcgtggacctttttcgaaaaatatcaatcccagaatttcgcttcattttggattataaactcccagatctgctactctctatctccgattttgtgatttttcaaaccctagatttctccggaagagtttatttttttctctgtaactaaaccgagatttttttttcaaaattccgacattaccctaggttgtgtattaccgtagaaaaccctagttcctttttggtattcttggtgtacagatcccttccttagtcagagtttttggttattagtgtttagaggtttgtgatg

SEQ ID NO: 28267 - DNA, 3003 bp, Unknown; identical to SEQ ID NO: 28266
  misc_feature (1)..( 3003): 2750-1469P.txt file - cDNA_ID_2994823; gDNA_ID_1972140; Annot_ID_179266

SEQ ID NO: 28268 - DNA, 3003 bp, Unknown
  misc_feature (1)..( 3003): 2750-1469P.txt file - cDNA_ID_2994827; gDNA_ID_1620746; Annot_ID_49719
taataataataataataataataataataattggatatttggattagagaaattattgaaagtaatgtataaactattgaaccatgaaaatatatttgcgaataaatcatcaaactgaaactatcaaaatgtataagattttgaaaaacataatttcacgaaatatttttttttttttaaatctatgttttgactttttatcaaattaacaaaagcactatctgattatctcaagctgatttagtagaccgaccaacaattttatcttttaagccaaacaagtaatatactttatcataccaaaaattaatatatttatgatactaaagaaaaaactttatatatctcctctagtatatagtaaaagcaacaaaaaaaattaaaaataaatgttaagagagcgttttatggtcggcttttcacgcgtttcactttccaattttcatttcactttataagaatagaagaactccaaaacattaaaaataaggaatcagaaaaaaaatctataataaagttgtgattaaatcattagttttttttatataataaaacgcaggtgatcctaaaagttttcaaagcccaaagactaattgtaagatccgataaattactcgaattttggtgactaatgttacttaaacccaaatagtggaattaacactctttaccagtagaccaaagcaacttggtttaatttattttcttcaatttaccagatcatgatgccgtttaggaccattggactagtccatgctgagtgaaaataattcactcaaaagaataccgtaaatcagaattttccacgtttatcaaataactgactaaaaagcacacataacaaaattttcatgcatcaacttgtactaaaatttatagaaaactggcgtatattggtaaataaatagcagaaacaaaagtggaaaagttttgtggcgccacttgcgaagtgaactttggagctggagcacagctggacacgagcagtggggctgcagctgctaagtgctgacccaaattggggtcacaacctttcctcttataacggtccaatatatattaccgttatgttacatacaatatagtaatttatatatatatatatattttttatatagtaatttatattattttttgcacactatcgatttgatttacaacaagtccttttgttttttgttttttgttttttttgcacaatatcgattgtttgaaccttcaaaattcatgatagaactcccggggtttttcctttttatttttatttttttactctcaaaataagaaaatcatagtccgacgactccatttaaaagacttaaaaaaaattatggtcaaaatatgaatattttatatagatacttaatgcagaagctatagttgcactttttcctcgacaagactcttgtctcttcaataaaaaatgcgttggtttagttttatactgtatttagtaagtatatatgcttttccccacggcccacactcatgcattgatacataccactttattggtctccagactaatctggttatatgtgcccatcattaattcaaattcattaacttacgtaagaataccacccttacaaaacaacttaaaaaaaaaaacttgaatcaacatttaattaaaatttgacaaacatcgttataaattttatataactattacttagttaatttgaaaaatccgttgcttaatagttaataattaatcaaaaacacattgatttactacatattctttttatgccctcggtttggtatcttgatatatcaagcggcttgtaacttgaattcagaatctacgttttcaatgttgtttcctatgatggtcaagtggccgctacttgatttcagaatctacgttctatgatggtgaagatattgaaatgaatgttggaatttcttttattaaatttttagttggtatgactgattagccatacaaaataattaggttgcagccacttattttaacttgtataaaaaataagtgatactactaatttaaatcacctattattactttttttttatgggcacaaaatcacctattattactaattgatacttttattgatttatttaatattattcaatcaatttggtgtaaatctatattaatttccgctaacatcatcctagtactggagaaacttgatttcgtatctacagcctttctagaacaatttttatccaaaacttaaatttgtttacgttcattttccttgttccaaataaataattttctttttttgacattatgcctttgttgaagtaatgcatgtcacatacagtacaagaaaacacgagtttcagacttcagtgtaaaacaggattacatgtattgtaagcgaaaataattaacatcaagtagtcaaaatattttacactatgtaatgttaatgatgtgtaagattagcaagacttacacgttcgcggaaagtaatctaaattatatatttccattaacaaaaggtaatctagctagaattcttaattgactttgatagctagttcttgtataaacaataattcttttctcgttgatatttatatcaaagtggttatcatctatctaaaaatctatacataagaattagaatatccttaaaaattctaccagtaactttcaatagagagttatcaaatatgaatcatgattacatcagtgtttattacacacatatttacacgtaacacataattagtttcatggtcatcgttaattactctgacgataatgtaaactaaaaccgggtggatttaaccggacccatttgccatcactctccataaatcctaaccgtccatctaatcaagcgtagatctaacggtggatatcaaatcaaaggttaattccctccctatatatattagaaaattgatcctgaagcgtgtaccgtacacacatccccatacgaacactcacaatcgttaaaaagaaagaagagaagagagagaaagcttaaatcggaaaaaatggtttcgtggatgatg

SEQ ID NO: 28269 - DNA, 3003 bp, Unknown
  misc_feature (1)..( 3003): 2750-1469P.txt file - cDNA_ID_2994827; gDNA_ID_1620767; Annot_ID_167379
tagatgaaataataataataataataataataataataataataattggatatttggattagagaaattattgaaagtaatgtataaactattgaaccatgaaaatatatttgcgaataaatcatcaaactgaaactatcaaaatgtataagattttgaaaaacataatttcacgaaatatttttttttttttaaatctatgttttgactttttatcaaattaacaaaagcactatctgattatctcaagctgatttagtagaccgaccaacaattttatcttttaagccaaacaagtaatatactttatcataccaaaaattaatatatttatgatactaaagaaaaaactttatatatctcctctagtatatagtaaaagcaacaaaaaaaattaaaaataaatgttaagagagcgttttatggtcggcttttcacgcgtttcactttccaattttcatttcactttataagaatagaagaactccaaaacattaaaaataaggaatcagaaaaaaaatctataataaagttgtgattaaatcattagttttttttatataataaaacgcaggtgatcctaaaagttttcaaagcccaaagactaattgtaagatccgataaattactcgaattttggtgactaatgttacttaaacccaaatagtggaattaacactctttaccagtagaccaaagcaacttggtttaatttattttcttcaatttaccagatcatgatgccgtttaggaccattggactagtccatgctgagtgaaaataattcactcaaaagaataccgtaaatcagaattttccacgtttatcaaataactgactaaaaagcacacataacaaaattttcatgcatcaacttgtactaaaatttatagaaaactggcgtatattggtaaataaatagcagaaacaaaagtggaaaagttttgtggcgccacttgcgaagtgaactttggagctggagcacagctggacacgagcagtggggctgcagctgctaagtgctgacccaaattggggtcacaacctttcctcttataacggtccaatatatattaccgttatgttacatacaatatagtaatttatatatatatatatattttttatatagtaatttatattattttttgcacactatcgatttgatttacaacaagtccttttgttttttgttttttgttttttttgcacaatatcgattgtttgaaccttcaaaattcatgatagaactcccggggtttttcctttttatttttatttttttactctcaaaataagaaaatcatagtccgacgactccatttaaaagacttaaaaaaaattatggtcaaaatatgaatattttatatagatacttaatgcagaagctatagttgcactttttcctcgacaagactcttgtctcttcaataaaaaatgcgttggtttagttttatactgtatttagtaagtatatatgcttttccccacggcccacactcatgcattgatacataccactttattggtctccagactaatctggttatatgtgcccatcattaattcaaattcattaacttacgtaagaataccacccttacaaaacaacttaaaaaaaaaaacttgaatcaacatttaattaaaatttgacaaacatcgttataaattttatataactattacttagttaatttgaaaaatccgttgcttaatagttaataattaatcaaaaacacattgatttactacatattctttttatgccctcggtttggtatcttgatatatcaagcggcttgtaacttgaattcagaatctacgttttcaatgttgtttcctatgatggtcaagtggccgctacttgatttcagaatctacgttctatgatggtgaagatattgaaatgaatgttggaatttcttttattaaatttttagttggtatgactgattagccatacaaaataattaggttgcagccacttattttaacttgtataaaaaataagtgatactactaatttaaatcacctattattactttttttttatgggcacaaaatcacctattattactaattgatacttttattgatttatttaatattattcaatcaatttggtgtaaatctatattaatttccgctaacatcatcctagtactggagaaacttgatttcgtatctacagcctttctagaacaatttttatccaaaacttaaatttgtttacgttcattttccttgttccaaataaataattttctttttttgacattatgcctttgttgaagtaatgcatgtcacatacagtacaagaaaacacgagtttcagacttcagtgtaaaacaggattacatgtattgtaagcgaaaataattaacatcaagtagtcaaaatattttacactatgtaatgttaatgatgtgtaagattagcaagacttacacgttcgcggaaagtaatctaaattatatatttccattaacaaaaggtaatctagctagaattcttaattgactttgatagctagttcttgtataaacaataattcttttctcgttgatatttatatcaaagtggttatcatctatctaaaaatctatacataagaattagaatatccttaaaaattctaccagtaactttcaatagagagttatcaaatatgaatcatgattacatcagtgtttattacacacatatttacacgtaacacataattagtttcatggtcatcgttaattactctgacgataatgtaaactaaaaccgggtggatttaaccggacccatttgccatcactctccataaatcctaaccgtccatctaatcaagcgtagatctaacggtggatatcaaatcaaaggttaattccctccctatatatattagaaaattgatcctgaagcgtgtaccgtacacacatccccatacgaacactcacaatcgttaaaaagaaagaagagaagagagagaaagcttaaatcggaaaaaatg

SEQ ID NO: 28270 - DNA, 3003 bp, Unknown; identical to SEQ ID NO: 28269
  misc_feature (1)..( 3003): 2750-1469P.txt file - cDNA_ID_2994827; gDNA_ID_1620746; Annot_ID_166663

SEQ ID NO: 28271 - DNA, 3000 bp, Unknown
  misc_feature (1)..( 3000): 2750-1469P.txt file - cDNA_ID_2994835; gDNA_ID_2926230; Annot_ID_203623
agtcattagagtaaatattgagaggaagaagtcttatcgtcgccccatttcacttatcattgggtgagatcggtcttgaagaaagagagttagagaggaaaaagaagaatcttattagctctataatatctgatattgcttctcatttagtttttcactttttacattaagattggttgtttgtaacattatggagtggttaatagtataaagataatctgaatattataatatataatgtagagtcttgtccacctaataaccatctcttcaaaagcattgttctatgatctgatttttcggaaagactctgcacttctgttgcacttctgttgttggacactttctctttgctaataaaccactaacacaagtccaagcgaccagagaatccatttcttcttgttttattagagcattcataataaggccaagattataaatcatccgaaaagcccaagtgtcctatgtaatttattttccaaagctcatttaattagatctaagcaactaggttcatatatatatagtctcttgtaatgaacatcaaatagttaactttgaaagcaatctcaaaacattgagatttatgttgttaaagagcttattaagatagcaacacgagattgaaattagatagcttattaaagctttaattagctcacacgaaccaatgtgaaatggggtttgttgttgggtccaagtccaacgaaacgattatatttcttggatggtagttttaataatgggcctgaatcatatgggctttttgatgagactgtgacggtaagaaaataaaaaagggcaaaaccgagaaaacagatctctctgtctcaactcaaacaatcaaaagccctagtaaaaccctagcccccaaagcccttgtgccattgagccgttatataaatccttcactcgctccttgagaagacgaatttgagattgcctctgcaaaggtacttcatttcggtgaacccaattcatgttttcgatgatttttgcttctctatttcttcgattttgcgttttatcgcgttaaaagcacatatcgaaggcttgcagataacgtataataaaaaacgcctgcgagctcaatatttgtgcaatatcctaaaaccatccatttgaggtttcgataaatctctgtgttataagaatttatcttttcttatcgacaatttcgatggatgggacatttattaatcggttttatgatttttaacattgtatgagaaaatctgagtcagatctgaataattgaatccttattcgtctgcattgatcggaaaatagtaccacttgggttttatctagtttactttaaggtgctcatagagtggtaatctcacaattgttgttgtttgaacaatttgggacctttgtttgcatgatttagtctcttatataccaattagaatttgggaccatctgctgattcatatctttgtaattgacagagtaaaatggcgaatcctaaagtcttcttcgacatcttgattggtaagatgaaggcagggcgtgttgtaatggagttatttgcagatgtgactccgagaacagctaataatttccgtgctttgtgcactggggagaatggtattgggaaagcagggaaggctttacactacaaaggctcagcctttcaccgtataatcccagggttcatgtgtcaaggtggagatttcactcgtgggaatggaactggaggagaatctatttacgggtctaaatttgaagatgagaacttcaagttgaagcacactggtccagggattttgtctatggctaactctggtcccaacactaatggttctcagttcttcatctgcacagagaagacttcgtggcttgatgggaaacatgttgttttcgggaaagttgttgatggatacaatgtggtcaaggcaatggaggatgttggctctgacatgggaaatccttctgaacgagttgtgattgaagattgtggtgagctcaagaacccaagttcataagttcttaaaacattgggtgggttgatcttgacaggttattctatcatatgctgtgaagcagagacagcatcttagcgttaaggtcaatctagtctgtgatgcactactttggttttgactatatcatatgaaccttaggaagtggtccatccttgtaagttgttttcttaaaactcttgtgtgagaataggatggatgataataatggttagtttctttatgaagacatttggttttgtagctttcttattttggtgtagttaatatgaatgaaccaaactcttcttaggactcatttgcgaatatgtatccaaaattgctgacttttcgaattgggcagatttcacttcatatgcagaacaagataaactttctgatcatgtgatgataaatattgtttagccaacgcatcacacatttctttgagtagtttctacttatggttaagtttcagcatcaatagtcaatagccaacaatatttggacagtcttctttaaatactccaacaactagtttgccttggcaattaatgtaacttaaagtctagccaactctttggtattagcttcgttattttatacatttcttaaaaccattttattcacatttcttgaccacttggattccaacatagtggccagccatgctgcaccacctcgtcaaaattaccacaataatttgatttggtcaaatcatcatttttttggaaaacaacaacaaaaaaacttaaactttgtataataaggaccctggggttaaaagtataattattactatgtaacaaatcaaagtctaagatggaaaatactataatccgttgacttaaatgtgctagaaaaaataaagaggtcgaagccaggttatcatcgaataagacttttgccgcaaccgtgagagatgttcctgtttgttttttcttttctaaatgttggtttataaatagcatattttttttccttggccccaatagataaagaaccaaacctataatcttcctctataatg

SEQ ID NO: 28272 - DNA, 3000 bp, Unknown; identical to SEQ ID NO: 12817
  misc_feature (1)..( 3000): 2750-1469P.txt file - cDNA_ID_2994839; gDNA_ID_2214573; Annot_ID_186257

SEQ ID NO: 28273 - DNA, 3003 bp, Unknown
  misc_feature (1)..( 3003): 2750-1469P.txt file - cDNA_ID_2994843; gDNA_ID_1971909; Annot_ID_177033
cacgctaaactttttacaattggaattttttttagttacatattgataaatattaggattcatcccgcggtacacggcaagcgtaggtttttattcggtttccatattatattagaatgtattatttgttatttaacaaaaaatataaatttttattgttgttgattaaatattaattagtagaagtaattattaatggggttttctaaaaaatgttaaatatgagtattatttgttttaaatttgttaatttgcaaaaaatcctaggatatattaacttgaatatcttcttgattaaatttgtgaaacattcattttgattaattaatttcttttcttttgattaattagttttttaaaaggaaaaatgttattgaaagaaatcttaaagttaaatgactttctcaaatcaattactattggtagcagagggggagaaccaatcaagccctaattcctttagaaaacccttttaacaatcaaaatagtattggtcaaacaatatttctgcattaattagttttttcatatttagcaaaaaagaattaattaaaaaattcatccctattcgacttcactttctctctctgcctgaaaattttgatcggtttctggtttctcggcgaaagaagtaaagtggccgacaaatagtgatctcgtgaaggaatcagtgtgtacagtggaagaagatgatacatttggctggatttacatgttgcttaggcggcgtcgctctttatcttcttaccaggagcacaggcaggttaggttttttttcttgtctttactatttacgaattacgataactagggtttactgttattcggtggtaatgttcttctttcgtgggacagagatatcaaatcaatcactagggtttaccaactcaaggatttgggtaatgttcctgcattgttctgcatttcaattttaggtggatgggttttggttatgtgtttgatatcattcgtttttattcagaacaattagtagaagtagagagcaaggtggtacctttgatcatcgcagtatcaggagatgttggctctgagactcctattaagtgtgagcatagttatgttctcggtgtatttctcaagagaacggtatgtatgaattggattagataatctagtttttcgtttctgtgattttggatatgttaaaaagaaacgatttttttcaggcagaacaacaggttttgagacgtaattggagattttcatgggttcgaaatagtacattgatgcagccgatgactaaggaagtcccctggtatctggtatgtctgttggactttgattggagtgtattactttctaaagtcatttacaaaatatgatattggttgcctataggacgacgggacaggtcgtgtgaatgtagatgtatctcaaggtgaattaggcttggcgttgacggttggtagtgatgtatttgaaaaggcagagccggtatcgcttgttcaaggagcgttgggttatcttaaaggctttaaggtcttttcttttcctttcctaccacttttcattgatttgcttttgttttgacaatgcttatacattgtggcaccattgttgtctatagatacttggagtaagacacgttgagcgtgttgtcccaattggtacaccgcttacagttgttggtgaggtatgtcttttatctgttagcggtccaaaatacgttttatatctctctttgttatgttgcttaccatgttaacaggctgttagggatggcatggggaatgtcaggattcaaaaacctgagcaaggacctttctacgtcacttatataccgctagatcagctcatctctaaattgggagatttgtcaaggttgtttcttttctctgtttttgcctattcttttcttcgaaaactatgattgaaaaaaattctaaaagatctctttcttttggcaggaggttcaagtatgcctccatgggtttaactgttcttggtgtgattcttatttcaaagcctgtgattgaatatattctaaagagaattgaagatactctagaaagaaggcggcgacaattcgcactgaaaaggtatgacgcaccctaaccacagccacgtatgaagtattcattgcgagttgcgagttgcgagttaagtgttgggtaacttgttgcagagttgttgatgcagctgctaggagagccaaaccagtaactggaggtagtaatagtatctatccattagagtttgtactttgtagtagtaacatgtgaatcctttttctgcatacacttggaattgctctgcttacaaaaacgtcttaccaggtggtacaagcagagatggtgatacacctgatctctgtgtggtttgccttgaccagaagtataacaccgcttttgttgagtaagtataagaccgcttttcttctaaaagctcttgaaaaccctctcactgatcaaacatggcatcttttgattcctctttttgtttggtttggacttgtaggtgtggtcatatgtgctgctgcacaccatgctccttgcaactaaggacctgtcctctttgccgggaacgaatacaacaagttttgaaaatttaccgccattgaaggacaaaactcagaacgatttttacaagcgaacaattactagtcttgtacatatagtaaagcctttgtatcatgagtttttgactagaaatttttttgcattgatagattgtgattgaacaaatgctaatataaatttcaagcttagatttacatttactaatgaagttatataatcacgtttcgatgttaaaataagaagtgaaaaaacgtgaacggcaggattcgaacctgcgcgggcaaagcccacatgatttctagtcatgcccgataaccactccggcacgtccactttttgttaattcctcactatcttaaatatctaattaccgttaattattacaaatcaggttgggcttaattaagcccaaagttaaagacagattagtgaaggagacagagaaagaaacagctctaaaatg

SEQ ID NO: 28274 - DNA, 3003 bp, Unknown
  misc_feature (1)..( 3003): 2750-1469P.txt file - cDNA_ID_2994862; gDNA_ID_2926235; Annot_ID_142748
atacgagataactaaaccaacgaattgttatcggcaaaacaacaaattaataaaatcgaacgaagtgttagaacgaaatgttgtgatcataactccgacacctacaaatggaccgccatactttttatactttcactttaaaacctaccaaaacccctaaattaaatttatacgtgtctatatatacgatctctcgtcgagacaccaattaattttgtataaagattacaattctcacaaaacatgaaaactcccatgagttcttctatcacgtttgcactcgtcttctttctcctttctctcaacccaacttcatcattaccgtccaaacgcgaaagctacgttcaaaacgcgtgtagtgttacacgctaccaagacctctgcgctaaaacgctattgccgtttgcatcagtcgccaagaacagtcccagcaaatgggcacgtgccggcgtttccgttgccataaccgacaacaaagacgtccttagacaccttctcaaaacgaggctttcaacgattgggaaacgagaccgaatcgctttgtcggattgtcgcgaacttctccaagactctcttgatagtctccacaagtccttggccgtcctccggacactcagagccagcgagtttcagcagcagatgagtgatcttgctacgtggcttagctcttccctcactgacaaggacacgtgtcttgatgggtttgaaaagacatcgacgaggtcatcatcaacggtcaggatgattcggaagagagtcacgacgtctatgtacttgtccagcaattctctcgcactcctcaacaagctagcggctaatggtttgtaatctcttaaatcataaacttttacaaaagctttaattttccatgaaagtgtaagatcatattattaataaggtggttcatggctgatcactacgataactgtatctctctcattataatggaattatttacaggcgaaataataatgggcctaatgtcctatattgggccaatgttattagtcaagtattgtcatttttattcgaccgtcacaagcccatgccacctaacgagtaacgaacctctctctcatcaagtcaaaacgtgagaagaagtcggtgataaaaacctaataaaaatcactcgaaagatatttttttcttggttaaacactcaaaaagattttgtctaactactataactcgttttagtcctttccataaaccattttaattccttttacgataataacttgaaattttcttactcttaacgccacaacattgctaaacgaatttcatacaaatatagcgcaattattactttgatagcatattattgttgcttcatatcatatgtttaggtagttgcaacttttgttttgtctacatgtatatatcaccgtgttaattatatattttgtttcatattgttaagatcagtatataactttttaaaacaagatgctttgattttgtcacttacatatacatagtttcatataagagatccttcctaacattgtagttagctagtcttattccattagttttaaatgggtataaaatttaattgttatttataagaaaacaaagaagttgattagagaaagaaaaaaacaattatttataagaaattcaattattagccatcgcgaatctaaaaagttaggcaagaaagtgaaggagatgtggggtgacataactagctaaccgccaggttagcatcacaagtcaacgtaaacataaaacaccaatgctcttccatttttcaaaaaaattgtattcacatccgagtctgaagtttttttgtgatttgtttagatcacaagttaggaattttgtagttttgcgcagggagggagacgccgagggaggtgtttagggagggagggaggtagacgccgtcgctacttagtgtaaattatcttttcagatcgtaaagctagtaaaatattgatagtataattcatatgtagctattaaaggtagatccaaaccatcatggtttaaccatgtgttattgtgtcgtaataagcaaaggctttatcttatataatcagaaacacttaaggacgtaactcaaaatatacaagtttcattaactataatcaaataattgtgtttgagcaaatgtttcaaatatatggttagtttcaatcaaaacgggttttcttttattctagaccattccatttttttctaaactacttagacaatcgtaatcactcggtaaaaaacactgttacaaaatggggtcgtagagatctaccactaattaaattggatttaccttttactctttggctcctttttgaaaaaatttgaagttaacaaaataaccaaataaaataagaataagtcgtcacatttaatctcataggcaatttttgaatctaatacaaatcacgtttttccaaccctgatggtcaaaagcgttatgaatgtgctttgtaaaaaactgtttagtttgttaggacatgcttttatattattacaaattttaaatatcatgtttatgctataattgaaaaatacgaacgtcgaaatcactcaaagctcacaccaatctggctttgagtgctaagttagggtttggcattgactttgtttacgtgagattaccatacctaacgaacctatcatttcattaattacaaattgagtattaaaaaaacatataatatgtgttttcgtgttgttgcaaataatggactaagtaacaatattcattggtccgattttgaaggaaagttcaatgaaataaataaaagggtaatctcgtaataagagtgaaaaacaagccttaacctgtaaacgcttacgctagttaaatacacaacaaagaccgattcgcttttcactctctcgttcaaggtccgactcagttcccggcgagttcgactcggtgattgattttttcctagaaaaataaaatttcttcttaacgattgatcgattttggttttctatctttcgattctagatctagaattcaatttgtgaggtttggagatg

SEQ ID NO: 28275 - DNA, 3003 bp, Unknown; identical to SEQ ID NO: 28274
  misc_feature (1)..( 3003): 2750-1469P.txt file - cDNA_ID_2994862; gDNA_ID_2926235; Annot_ID_203844

SEQ ID NO: 28276 - DNA, 3000 bp, Unknown; identical to SEQ ID NO: 2979
  misc_feature (1)..( 3000): 2750-1469P.txt file - cDNA_ID_2994866; gDNA_ID_2926238; Annot_ID_142811

SEQ ID NO: 28277 - DNA, 3000 bp, Unknown; identical to SEQ ID NO: 2979
  misc_feature (1)..( 3000): 2750-1469P.txt file - cDNA_ID_2994866; gDNA_ID_2926207; Annot_ID_141771

SEQ ID NO: 28278 - DNA, 3003 bp, Unknown
  misc_feature (1)..( 3003): 2750-1469P.txt file - cDNA_ID_2994869; gDNA_ID_1620433; Annot_ID_156918
ggtttaagagcaggaaatcaagaaagatcctacaagctcttccttcttatctaagcctctgacctcatatctctgaacttggtattcctcaaatgtggcaatatactgcgaatacgaattggttagcccggctattaccacgctgaattctcttccattgctgccttctttaagcactgttttcacggcatcacgtagtcgcctccctgccattgttgtgaattcttgcaagcagaacaatagagaaaggaaattactaatgttctacatcagtttagaaatgattttttttgttctgggggagaccggaatacctccggggacgcagagaatcactagctggccaatgcggaggatctgaactggtaatatcgacggctgaaaatggattaagaaacagtttttccatcacaaatagctaagtgggattcaatttttatccatcacagtacaagattatgctctcaccgcccagtcgtatggttgtttcatttcaccggtatcaagcaatatgggtttaggtcgttggcatcgtacttgttcctcagttggattcttgagaaggttccttacaagcctccagaaaggatttcccttacacaaagtcacaacataaagtatagtactaaacatctttcattaccaagttagaaggagaatttgggttttacctgatcatctccttgtttaaagtcaaatgctccaggtccatcagttgttcctgcagcgaaaccaaaacccattgcagctggacatgttttcaccacttcggaacctccattttgtccattaatcgtcacttcaagctgagagaaatcaacatatgcatgacgatagtcaacttttccttgtatctcctcagaggctttagtgaaaagatccgcagccttcttgaactgcctctctccaataatgcgggtactctcaaattcatcagggtagctgaaacatttagtcatgccaagttatacatctaacaagcttgactctctaaataccatattgtactaagagagaacataattttctgtgattggtttccgcattgctgaaagtaaaagtgtgcagttaggaataagacgtaccctggtccacggccgtagcattgctcattctttccaccacaagtactttggttgaattcacaaggaaggcctgtgtctatacagaaggctcccaacacattcggactaacatcaccgcagttagtttgacagaaggcagagacaaatctaggtttgtcagcgtgtctaaatctacttctgacccgtctagcaacgcttgacatccttgtaacggttttaccgccggtagacagtaacgaggatgccatttccatcaaatcttgatctgcaataaaagcaacaaaaagttagttttacaataacaagccattactaaaactcttggagctatggttatttacgctcaccataaggatcactgattatgcttgagactcttctaggagattcaacatcaactgatctacaaccgttttctcgttcaaaccagtcttccatgatacgtgctgcagtgcctttattgtccccgctgattcaaggcatttgtacggctcatcgaagtgccatgagttgcaaaccaattgaaactacccactggaccccattgatcatcaacgaatttgacaagtgtcatctctttatctacatcatattcatatttactacgttcatgtgccggattgttaaggtaagcactgggactacggttcacaccagcatccaagagctcccctgcaagctcagctccaaaagaaatgtctttagagaaagcaacatataaaatgaatcataaaaaaagtgtcccacaagctaaatcactcacctttgttgattaaaatggacccgggacgaagattttcatgagcttgtataatactttgctctataccgtccacaagagcattgaaagattgatgaacaaacccgagagatgtaactaagtacaaaatgtattggagataaccccctggaccagcatgagtatgagttccactaattgcaacattttcctccgtataaagctcaccgtacctctgtttcaatctttcaatcactttgatggtcacaagctgtgaggccataccagcatcaagattaacaaaagcaatccttttcttgtatggctcagccacgatgaacgcacgagctctgagcctgaagtgaacaccagatgctacttgttccatgttagcataacccatcatgttaacatcagctgcaggtcctgtgatgtcatagcttccaagacccatcaaataatcggaatctgagaatatacaagtgagcctcaacagaaatagcaagaacaatgtgcagtgcatagacatagaccacctcgtcatcttcacactcaatatggagtaatcaactctttctcatttctagtccttcctagagaataatacaaacgtaagcaacataaacaaacacacatatttcatgaatctaaaattattaaacccaaaatattatccaacctgaagaagaagtaacgcaatccttaatgattttagctgatgaacacactaaccatttgctggagctgatagaaactaattgatgtgaacgatgtgaagcaaaacaaaagaagatgagagaaactcaaatagacaaatactcaataaagtttcgtttttttttctggtaacaacgataatagtatgtaagtaagagtaaagtgtgaggaaagttcttatttttaaggttgcggagaaagaaagctacccaatttcagctgttttagcgtatctgtccttctcaattcggttttcacttcttattcgatttctaattttcaaagtttggatttttggggtaaagttagttaaaatgcatacataacgggggtagaatgtaatttataaaattgtattgggtctgtttgtgaataaaccaaaacttgtggttcttctctgtctcaacctcagtcgccgatcttcaacagtggctgaaacaatagagagagagcgatacaatg

SEQ ID NO: 28279 - DNA, 30 bp, Unknown; identical to SEQ ID NO: 1142
  misc_feature (1)..( 30): 2750-1469P.txt file - cDNA_ID_2994873; gDNA_ID_1620363; Annot_ID_154744

SEQ ID NO: 28280 - DNA, 3003 bp, Unknown
  misc_feature (1)..( 3003): 2750-1469P.txt file - cDNA_ID_2994876; gDNA_ID_1972176; Annot_ID_180023
tgtagcatatcatcgttttaccaaaaaccgttttttcatccatgactaaaattagttttgtctatatttttgttaaaagaaaacatgtatgtttctacatatatattagttatatatttttctattacattataaacaatatgtagtcaaagttcgttaatttatttaatactctctagtctctattatcaatgcgcatgcatgccagcatagagtagatattttaacaacataacttcgatattagatatatataagtctaacgatacatatcgttacatatgccatatagtttttaattttttttatatagtttttaatttatgtctagttttttttccaccatttatgtctaggttaaatagaggaaatgtatagtgtattccgatccagtgaataacattagttttcagattgtcttgtgtcttattacgtgcatgtgcccagatcatagaccagttagctgtctgaaatataaatgtctgttgttccattaaatgccatgatccataaaatatcacgcatcaaattcatacaaaccgtgtattctatattttcgaataattttaaaggtatgaagcaatcatatggttgtcccaataaagacaaataaaagtgatttattgagaactcgcatcgcatctaatactgaattgtaagatcttccgtatcaaaaattgacccaaatagttcgcatctaacagagaagtttccgaagcagtttcttctttaactattgcttttagtccatttttctttttcctataaagaaaagcctcgacaaagggctgcttttttcactccattattttaataaacaagtaaacagacttttttttttcatctatcacattccttttactgctttacataattagatgccaaattttactggacgaacttaactatcacaaatgttgaatcagtgatccaattgttgtgtatctgtatatccaagactgtaggctaggccatataatctggcaatctattatatatacgatttaaatcaaagcttttatattataaacataaaacttctcactcactaggccagccattagatcaaaattatataatttacagatgtacatgttagaacaaaatgaattttcaggaaacctactattgtgtataaattcgaagttaatgagttcgaagtagattttgtcacgggtttcttggcaaagtttttaatcaagaaacaattatttaaaactttgaaaagtatctggtcgtcaagagtaaattcgtgatcagtgtataaactgctgtttggaggcacgtttattttcttctaaaattatattttgccggcttactttatttttgacttgtatagatgcttgaaaacaaaggtatatgtgtttgaaggcgatgaagaacctaacggtaagcgaaacgtcgtcgtttcttgttctacagcatgtaagggaagcgatgtgtactctaattaaggcttagcgtaaacggtaaacactaattgacatattcccatgagaaccttagccacttttttattttcacgttgttgtaagaatataacaaattgaaaactatatgctgtaatttgtatgttgcatatttcgtattatactaatccctataacaaacatctttgcatacaatcctagttttttcttcagctatgacaatttatattagtccctagaaatcgatatataatcttgcaaaggtataacttcgattcttttcgtataaaaatttgaacaatttgcgtttacgctatatattaattaataaaaaattgttttacaaattctaaacgcaatgttttttgttgttgttgtttgcgtatgaaatagaaacaacttttgactaaaacagtaaagttacacgattagatctagattgtatgatttgccaaactgaacatctggctatctgagttattacatattagaaggatcaccggcgaggattctatgattcaacaaacacaacgttaaaccaatgatttcttataaagaaaataattctctctttagaatatttctgagaaggggttgttgttttttaagtgtcgcttactcgcttcaaactaaagggaataaggatagtaaatagctcatccaggcggctatcacaatcatattaaactataggttacttaaataaatatatcattgaaatttttaattagattttcatgctaattccttagaagttttctttttctttttttttgttaaaactaatttcttcgaagttttgacggtcacgccgacactttgttttgacatgcccgtctaactctttttttgtttgtctttctttaatactactaatatacaatttgtatgacacttaataatgttagtgtttaaaaataattatagttctacataccccaatacaggacaataataagtacatctcttttatttcttatgcgatttcatttatgtctactacgaaccaactagaatttgcatccatcacgatgaccaattgacaaaaacaattgcttaacatttaggttttacggaaattatcattccttaagaattttgtttattttattacagatagaaaaagacgaaaacggaaagattttgacttgaaggcaacgtgaaatttgtgcatttgagtaaccgacacacatgaagctcaaacacaaagacagagctgagctgttgttaattccctgaaaagctcaactcttggcttcatgttttatcgacgtcaccatacatttatttcccttatagacccacttctcctccccaaaataaatactataattagagaaagcattaaacccacccacccaaaaccattaaatcattaagaagaaaatgtttattaataataagaaaaatgaaattatacacaactaaaaaaaaacaaaaggaagaagaaacatcacaatcaccaatcacctcactatatcaaattctttccttattcactaaccaaaaaataaataaactcaaaaccattcttcatttcgccgacactttcttctccaccaccaccatg

SEQ ID NO: 28281 - DNA, 3000 bp, Unknown
  misc_feature (1)..( 3000): 2750-1469P.txt file - cDNA_ID_2994890; gDNA_ID_2936585; Annot_ID_195052
tttatactaaatatttgagtaaatttgatatcctaaacttataaatataaattttttaatcaaacataactaaaaaataatttggattttttttgttgttatttagtgataagaagaatgtgttaaaatgtgattaaattttttttgcttgttatttatttatttttgttgaacggtttagattgaagggaattaattttattgaacggtttagatttaatcgaatcatataaagtttagaagattgttaagaccaaattacccttaatgattttgaataacaaagaacaaaatccaaatttgaaataaaaattaagatcaaattagacaaaattcaatttgtacttcccttataataataagaggatacataacagaatccactaaactcaaatcaaatgtgctacaaaatgggtctcacaatattgtaatgtaatctggtacaaagttaaatttaagtggattacgtaagaaagaatatcaaagctgagttttggttgtctggattaaactataaggtggggaaaataagaattaatctaaaggtgattaaagataaaatttattaagtaaaagatgatttaagattacgttttttacgaaagcgtcggctaacagagagagtcacaaagatccgcccacagggagagaagaagaaaagatcaaaaaccggaaaccataaaaccagaaaccagtcaatagttttggacatagttgaaagcagtattgttaaaacagattcttttccagaaaaccaggagctaagtgtgggccccagttcttccaaatgctcctcaaatgactcaaatcccatctggatgacttacgtggcgattcgaccaaatttcttactcgcgagcgtggaggccacgtgtcttatcacagtctcttcaaacacatttaagacaatttaaccaaaatcctactccatagatactctgaattggtcagatactttaatcaacaaccatattaaatcgttttagaacgaattagattgtataatccagaatttatagactattcactagtaattaaaaaatggtaacttgatatgtcacgtgtatgacacgcgcattggatagagtggggacaaaaacataacttggggaagaaacacaagaagcaaaaccttgaatcagggtgaagaaaaacagcggcggttctgggaaaataaaggaaggattttgtaattaaaagacaaaacaacccttgtctttagagaaaaacagctcttcttatcttgttttctttgtcttctgccttcttcccttggttttataatctctctccgcttcccccaaaaatccaggggcttcttacacgcacacaatcctttaaagctatcgtctttcttatataatcagtgaatcttcattaacacctcccacaaaatctcagaaataactttcacaacagagtcaaagagttccaaatcgtttgtttgtattttgtacgatcaaagttgttggtacttgtaagataatcgaaaccaaagatgcggatgagctgtaatggatgcagagttcttcggaaagggtgtagtgaggattgtagtataaggccgtgtttggcttggatcaaatcgcctgaagcgcaagctaacgcaactgtctttctcgccaagttctatggccgtgctggactcatgaacctcatcaacgccggtcccaatcaccttcgtcctggttagtggtttttcttttaaccttttgatggcagttttgaattatactttccaacgatgccgtttcgtcttaggtcattttttgaacctaattagatcaaatatttttgcagggattttccgatcgttgttgcacgaagcttgtgggaggattgtgaatccgatctatggttcggtgggtttgttgtggtcggggaattggcagctttgtcaagacgccgtggaggctgtgatgaaaggagaaccggtcaaagagatcgccacagacgctgcgacgatcggccaaggtccgcctcttaagatctacgacatccgacatatctccaaggatgataactctgccgccgcggctactggctcaaccgatttgaaacttgcgaaaactcgccgtgctaagcgggtctccaccgtcgcgatacaggcggaatcggagggaaagtctgacgaggctagtcacgattcgtcgttgagtcatcagtctgaaatagtggctgctcatgaaggagagagcaaggaatccgagagcaatgtctctgaggttttggcattctcgcctccggctgtgaagggctccggcgagataaagcttgacctaactttaaggctcgaaccggtgtcacgtgcgtatcatgtggtacctgttaagaagagaaggatcggcgtgtttggcacgtgtcagaaggagagcacgtgtaagactgagcttatgctctaagctccgttttagctatactcagaagttttgcccccatcagctctattcggctcggctctgatgatcttcaagtcgagccggtaacttttttttaatatatagttctctatttccccctttaatgttcactttccatttgtgacaaaagaatagagtatatgtacaaaattatttacagagattaattcaagaattggctgagatattatctattttttaacgaataaaagcaaaaaatttataaaaagaaagttgatttatttctaaatattatgggcctatctgctatcatttaataagtgatattttgggcctatcctttcacgactgtattaaggaaattgtcaataccacgtggcatattttaataggataatggcggctgacctggcagagttgaaagcacaagccatgtgcttcgggtgtgatccagtggagatatcgagggaacgcaaaggtaggggccagattctgtagtaccttcttcgcctacctactctctttcccgaatttatttgccggcggtgatcaatcagaacgggattttagcctgagtaatcggtcactgggaagagaatttcgacggtgagagaagatg

SEQ ID NO: 28282 - DNA, 3000 bp, Unknown; identical to SEQ ID NO: 28281
  misc_feature (1)..( 3000): 2750-1469P.txt file - cDNA_ID_2994890; gDNA_ID_2936585; Annot_ID_143838

SEQ ID NO: 28283 - DNA, 3000 bp, Unknown; identical to SEQ ID NO: 2281
  misc_feature (1)..( 3000): 2750-1469P.txt file - cDNA_ID_2994894; gDNA_ID_1620515; Annot_ID_159238

SEQ ID NO: 28284 - DNA, 3003 bp, Unknown
  misc_feature (1)..( 3003): 2750-1469P.txt file - cDNA_ID_2994902; gDNA_ID_1971923; Annot_ID_177196
tagtgcttttgttagaattggaggatttgatttgattctagatatatataaatgtaggcgattgaattggtggagcattttgagttctcctatggagtatggtcttagctttgaacaaacaaagaatatagtgatcactcaaataatgtacagttcgtttcaatttcctttgttgggattagtttttctatcttataattaaaagaatgaaattgaagtggttgaatctttgctcggttacttttgttgccgatatgtattcaaactgagtttggaatggttcaagagatttgtttaatatttggtatttgatttgaaattgaatggttaaaggaacttataactttaacactgtcgtgccagaaaaaaagcttggtaactgaaaattattactatatacaaaatgaattcacaactgattggctttaccttagagaaggaactagcttcccagagtaggtctattttgaaacaagaagaagatcgttttaagtgaagtatcaatgatttcaagtgtaatcagagtcgagagttccggttatgttgatgctacagcgatgctagtaccgagccttgttcactcttgtattggttaagatatagatttgaaagaaaaatcttacagcctatgtcaccgcaccataaactatttctctttttgtattttttgggtcaaaaccccaccacagactatcttcgataatacgtgcatgagccaatgggcttctttttttaaaatataaataaacaaaaaagaaatctttcaaatttgtgggtatgtgtagttgaagatgttacttgtgcatggcgacaattaaacttgagaaagatttattatttggtatttggaagagagttacagttttataacaagaattgggttagagaaactttggaaaaattcttaaaccctaaacccatggagctaataaaaatctttgtgacttgctttctcctcaagaaatataattgatgttattgtatgaaatgaatacaattaattattaataagattatcaactcccgtttttctcttattcttcttctagtgtcttctaaatacatttgaaatcgtaaataaaacaagtaaacaactcgttcccctagatatatacatacgcttaaaagtaaacgttgtatgcaacggtaactttcgtaatagtaatggggaatatgtaattattgtaatgtaacggtaatattttgttttatcaaaaaaaaggaaaataattaacccacacgactctttaaatacggcctttgcttcttcattaacagatcaaaattctcgtactcaagagagaaaaaaaaaccctagaatcgaatcctctctacaaaagtcctctttgtagaaaaacctatttctcaatcgatcagtggttcagagaatctcttacggttatggttctgttctaatttaatcgtcgtagctagtgcgaagatccggcgatgaagacttgcatgaaagcgatggcgttgaagaaactcgctacagaagactcatcgatctgccgccgagtcaccaccgagattcgctctgttttgcggttctaatgattaattcaagacaacgttgggcttcgtgaatcgtgacaatcgacgacatagagagagcttcccgatcacggtggtggaggaatgctttaccgcgatacagatttgtcgtggattagggtgcaatttttcaaagcccaacaacatcaattctagcccatcaaaacaggtcaattctcagcccattcatcttttaattttttctcatcccaataacaaattcacattacaaatagggttttatacacggattttttatatataaataatacaactttttattcaggtcttcttttttttggaaattttagatagaaaaactttaaagtctttttcttattattttaaataaaatattagataaacagttttttaggtataaataatatttttattttttattttttgaagtgttaaattttatatatgtgtaaactaatcggacacaacatcccgtccataatatgaggtccttcagcggtgtcataggttcaacatgtttacacatcatttgaatttaacactttttttttttttttttttttactaaaaatactttttttgatttttaaaataaaatattattttcttattaagtatacataatatttttattttttatttttaagtgttaaattttagatgtgtgtaaactaatcggacacaacatcccgtccataatatgaggtccttcagcggtgtcctaagttcaacatgtttacacatcatttgaatttaacactttctttattttcatacttttattaaacttaattttaaggtttgcaaataatgttataaatatattgatgtatgttaaaaaatttatcacttaattttagacataatttaaaatcttaacacttatttcttttatttaaaaacatttatatatcaatatctaaactgtaaagtttttttttgtttttaacttaaatttagataaacagttttattttcttacataatatttttgtttttaaaaaaaagttgtaagtatttttgtttaaatgtgtaaaaagaattgaatgataacagattctttactcacagaacaagagatattaaattttctttatgtttatagtatttaataaagtttatagtatttatttccatatatacatttgtttctgtaagaactatccatttgatactagaataaatttcttcatttggattagattgttcagtacaaaactctatttctggcatgtcaataaataacaaatgctaattttggctcttaatcttgttgatagaatactaaacttgcaatgctttttacactaatctttatctctttatatatttatttttaaaaactcttctttcctttttttctgatttaaagtacaaaaaaaaaacaatacatctttccattgaactagaagaaaacattttcactgtccttttgaatcagaagaagaaagagaaaaaaaagagatg

SEQ ID NO: 28285 - DNA, 3003 bp, Unknown; identical to SEQ ID NO: 28284
  misc_feature (1)..( 3003): 2750-1469P.txt file - cDNA_ID_2994902; gDNA_ID_2926219; Annot_ID_203206

SEQ ID NO: 28286 - DNA, 3000 bp, Unknown; identical to SEQ ID NO: 7046
  misc_feature (1)..( 3000): 2750-1469P.txt file - cDNA_ID_2994916; gDNA_ID_1621124; Annot_ID_172206

SEQ ID NO: 28287 - DNA, 3000 bp, Unknown
  misc_feature (1)..( 3000): 2750-1469P.txt file - cDNA_ID_2994957; gDNA_ID_2214559; Annot_ID_134853
gaagatatattgtgtgtttttctttgaatcttgcttcttatcatattttgttcttgtattatagctcatgtgttccatagagatctgaagcctaagaacatcctcgctaatgctgattgcaaaatcaagatctgtgatttaggacttgctcgtgtctcctttactgattccccttctgctgtgttttggactgtatgtatcttcctctatctttctcaattcatatgttctttaataatgcatagtatgttagttcaaatgattcaatgctttcattaagtaaccaatcttgtcatgtgcttttgcaaggactacgttgctacaagatggtaccgtgcgccagagctctgtggttccttctattctaacgtaaagccttgttctttgtcctgtttccatatacttatgcatattgtgatgatgtgtgagcttatggaattgatgtgtgtgtgcagtacacgccggcgattgacatgtggagtgttgggtgcatatttgcagagatgctaactggaaaacctttgtttcctggcaaaaacgttgtgcaccagctagaactcgtgactgatctgcttggaactccgtcgccgataactctatccagggtttgttttgtttttatttttcccggaagctaaactaactctcccaatacagaggcttctctctctctatctccgagagatagacttgctttgaacgcaagtgtgtttttattagctttgtgtgtcatgaagttgtttataatgaatctgtgtagattcggaatgagaaggctagaaagtatttgggaaacatgaggcgaaaggatcctgtacctttcacccataaattccccaatatcgatcctgtggcgctgaagttacttcagcgtttgatcgcttttgacccaaaggaccgtccctctgcagaagaggtaactaagaggaaaaaagagacactgaaatcttggtttgtccagtgttacttgcattcattttaatgatgctttcttctttctgcaggcattggctgatccgtattttcaaggattggcaaatgtggactatgaaccatcgaggcaacctatctcgaaacttgagtttgagtttgagaggaggaaattgactcgcgatgacgtgagggaactcatgtacagagaggtaaataaagacatcatgttcttatgagactgaaaagtatggtttgagttttaggaatctcttaaaacttttttttttgttctctttctggatatgaaacagattttggagtatcatccacagatgttgcaagagtatctacaaggagaagagaacataaactctcattttctatacccaaggtttgactcatttttccaataaacttggttctttataaagagaaagtgtgtcttactttggtgaatcaatcttgatatccagcggagttgatcagttcaaacaagagtttgcccgactcgaagaacacaacgacgatgaagaggaacacaactccccaccacatcagagaaagtacacttcactccctaggtgagttactacttcttgaaactgaaccatcatgagttttaagcgaatcaggctataagtacatgtttgggtttggttgcagagaacgggtgtgctcatcagaagacgaaggttctgattcagttcatgctcaatcgtcttcagcttcagtggtgtttacacctccacagactccaaacacagcaactggcttatcatcacagaaggcgtcacaagtagacaaagcagcaactccggtaaaacggtctgcatgtctaatgaggagtgatagtatctgtgcttcaagatgtgttggtgtctcctctgcagtgtcatagtcagaaaaaaattgatttctcaagttgtttagcagcaaaccattgattgttgtgttctgcctattgtatcatgatgtctctcctgagtgttttcattgttgtaactctcttcttcttcttcttactctctgctcatattggaatctcgtgtgtaatggtttctcttggaacttgaaattcatatatatattcttattaccacaatctacctaaatcatcatttacttaaattagatgttgatatctacaataaacaatagcaagcaaaactaaaatcttttgcataatcttttgctattatcttcataagaaatgattttgagttcataaacaaattcaaacttggactatgaatcgatcaaataaacatacatgaaaaaactcaaaatgagtaatttttaattgtccaagactccaactttaactcttgtagaaataagacaaattaaacccttgtagtccctctctctctcactctcacaaagttgtcaaagactccaactttaactcgaatcgtgctcaggaacttggaatttgaggttcccttctcagggagttcctcttattaacctaaaacccaattcgaatcctttgtttgatcaatcaattaccgctcgattgacgtgtctgtagacttgaagcaagctatgttttgatctcttccaatggcggcagtgactctatcaccctgtagcatggtactcgtccccttgtattttatctatcatggtgcttcttcgtagtcgtagaacgtttccctgatgtaattttttggttttgaaatgttgttattagtgttgtggtagtagaagattgcgtagtgtcattgtaatccaagctcagagaggaaactggaacagaatcaggtacttgtaggagttcttgtgtttgttgtttgttgaaattaggttgcttttgttgatcaatcaagctggttctgtaggttgagtaatttcttcttctccaaagtctggaacatatcttatcgttcaaagcataaatattctgacaatcttcttgagcaagttgagaagtatgcctctgctcggctcgagaatcagtccaagttgattactaaggtaactccaggtttcattgtctcatctgaaacattctatatagattttgagattcatgttttccctatgcatcaggttgcagctttgatg

SEQ ID NO: 28288 - DNA, 3003 bp, Unknown
  misc_feature (1)..( 3003): 2750-1469P.txt file - cDNA_ID_2994961; gDNA_ID_2684256; Annot_ID_193144
acgacgaccttggttttctttcttcgctatctcagtttttagtcaggatcgtactgtagagttaatttcatcattgtattataaaaattaacctaaaagacaaaagtgtaattaggtctgcttttatatatttttaaacggactaacaaatatgaaattacgaataaagagagagatagaaagatgagagactattgaaaggactctatgtttctcaccaaccgtgccctactcgtgtagtttagagtcatataaaccccttaaaaattgacttattatttgttgatttatatacatattagtcaaaatgttgtctttccaacataaattggtgatcaatatcagagtgagactagtaaattgtttataatctcatgtttgattgtagatacacagatatttatctaaactagcagcaatgaaaaatcagaagattaaacgtgaaagggcacacaatgattattaaacaattgactagaattaattaaaacactaactaatatatgggaaactaaacatcaaatctacttttttcagtgtccctctgtctgtcacttgtggaaataaaaatgaaaaatcgcaaaattaaccaaacattaaacctttttaatttgattatgttactctttgtctatgtttccatatgtccccttttcaccgtttgggtgatatggatatcttaaaaggtattgggctttactgtcctctctttcagttctttcggccttcttcctcagaattattatatcaataaaattcattggatcacacttcggcttgggcctttgttcattcatgaacatcttatcgagtggtatatttttggtaaagggtttatcaagtaagatttcttaaaactacataaatcttctatccttaaccaatagtaaacaaatattcggaaataactctaaaaatcataacgataaacaatcatatttgttggaacccatttaaatttcatgacaacaaggaataagaaaaaataattagtataagcttaaaagttatgaaatttcgccgtgaagtaaataacacaatgaacaaaactaacgtggttaaaccatctccatcaatggtttctcattgagaaactgtttaatataaaaataaaatataattaaaatgtatgagagagagtagaattagtctctcaaatgagaaactctgagaaacccataagaacacttgtatatttggtcaaatattattttattattaaaatttaattatataactaatatttattaaaatactaatatttcttttttttgagaaaccaagaaagtatctcactgatggagatgcacttagtataaaattcaacgttggaataatacaaaacgaaataaattaatacttatagatttcagcttcctttttaaaatgcttagattgataaattttctacttttttttcggtgtgccagtctttgtttcagtttcagtgaaagagaaaaaggttatctcttgagcggtgtaggaaggtgaagtaataaatgaagaggatacatcaatcgagtggacacgtacttgaagttgtctgatccacttcaactttgaattgtgagtgtcgtaacaagatgccgtatctattaaaacgttaaacacaaacaatttttaatcacaaatgctattttattggacgaccaaaataactaatgaaagaaaaaactagtatcctgttactagtttgacaaaagttattcagagatgaattgtctgcatgttggtttatactacgtcttaaaatttatataaagatattaaactttgtcatggatatagtaattgtgtatccacaaaatgcaaagatagaaaaaagtcgttatgtttgttgaaagcattagatagatatatgtctcccatgtgagtgcacatggagttatgcatgcacgaaaactgcctctacccttttgtctctctctcgattcttcaatcaattccccaccttaagtttgcatgatctctatatccacctctgagatctagacacgttgctcctcctcttcatcgaacggttctctttgatcatcttgctaagagataagaggaaaagtggcataaatccatgccgagattgctcttatcggtccctttatttgttggttggtcccaatcacttgcactggatatgtaactgtttctccatgttactccttctcttttaccaatatacccttcattttcttcaatttgggtgtagtcccaaatgtgactcttttggcctaattgtatcaacttgtttactttttcttatatatgttcatcaatgttacgacgaatgtaaaaaaaaaaatattatttggaatttgataccgaatctcgacactattagtatattattggacccgtcatatgtatttatcaccagagagatgtgagttttacgatacatagtttttttctttcatctgaaaagaaaattaaacacatgtaaaataatttctgcctgtagtcttttaatcactgaagtaactcgaatttgatgttagataattttttcacaaaaatattcaaattcaacagattaagttgttgatgacagatagctctctgggaggaaaaaaagaagaaaagataatggtccgtattaatatagttgaaaacttgaaactactttttagtttgtatataatacagtagactagggatccagttgagtttctttctttattttgagtttgtgtttatgtttgattttacgtttttatatgtaaataagatattttacgaattatggttttatttgggtagaagttgtagaatgacttaaacaatcaagtggcagaatgagatatataaagtaatataatatatgtaccgttattaacttattgtacatgtgaatgaggaagcttacacacacacaccttctataaatagctgacaaaactggttgttacacacaacacattcataaatctctcaaagtaagaactaagagctttactacagtcctactctctacacatcttctctctctctcaagagctagtcatg

SEQ ID NO: 28289 - DNA, 3003 bp, Unknown
  misc_feature (1)..( 3003): 2750-1469P.txt file - cDNA_ID_2994961; gDNA_ID_2684256; Annot_ID_138117
aatttcatcattgtattataaaaattaacctaaaagacaaaagtgtaattaggtctgcttttatatatttttaaacggactaacaaatatgaaattacgaataaagagagagatagaaagatgagagactattgaaaggactctatgtttctcaccaaccgtgccctactcgtgtagtttagagtcatataaaccccttaaaaattgacttattatttgttgatttatatacatattagtcaaaatgttgtctttccaacataaattggtgatcaatatcagagtgagactagtaaattgtttataatctcatgtttgattgtagatacacagatatttatctaaactagcagcaatgaaaaatcagaagattaaacgtgaaagggcacacaatgattattaaacaattgactagaattaattaaaacactaactaatatatgggaaactaaacatcaaatctacttttttcagtgtccctctgtctgtcacttgtggaaataaaaatgaaaaatcgcaaaattaaccaaacattaaacctttttaatttgattatgttactctttgtctatgtttccatatgtccccttttcaccgtttgggtgatatggatatcttaaaaggtattgggctttactgtcctctctttcagttctttcggccttcttcctcagaattattatatcaataaaattcattggatcacacttcggcttgggcctttgttcattcatgaacatcttatcgagtggtatatttttggtaaagggtttatcaagtaagatttcttaaaactacataaatcttctatccttaaccaatagtaaacaaatattcggaaataactctaaaaatcataacgataaacaatcatatttgttggaacccatttaaatttcatgacaacaaggaataagaaaaaataattagtataagcttaaaagttatgaaatttcgccgtgaagtaaataacacaatgaacaaaactaacgtggttaaaccatctccatcaatggtttctcattgagaaactgtttaatataaaaataaaatataattaaaatgtatgagagagagtagaattagtctctcaaatgagaaactctgagaaacccataagaacacttgtatatttggtcaaatattattttattattaaaatttaattatataactaatatttattaaaatactaatatttcttttttttgagaaaccaagaaagtatctcactgatggagatgcacttagtataaaattcaacgttggaataatacaaaacgaaataaattaatacttatagatttcagcttcctttttaaaatgcttagattgataaattttctacttttttttcggtgtgccagtctttgtttcagtttcagtgaaagagaaaaaggttatctcttgagcggtgtaggaaggtgaagtaataaatgaagaggatacatcaatcgagtggacacgtacttgaagttgtctgatccacttcaactttgaattgtgagtgtcgtaacaagatgccgtatctattaaaacgttaaacacaaacaatttttaatcacaaatgctattttattggacgaccaaaataactaatgaaagaaaaaactagtatcctgttactagtttgacaaaagttattcagagatgaattgtctgcatgttggtttatactacgtcttaaaatttatataaagatattaaactttgtcatggatatagtaattgtgtatccacaaaatgcaaagatagaaaaaagtcgttatgtttgttgaaagcattagatagatatatgtctcccatgtgagtgcacatggagttatgcatgcacgaaaactgcctctacccttttgtctctctctcgattcttcaatcaattccccaccttaagtttgcatgatctctatatccacctctgagatctagacacgttgctcctcctcttcatcgaacggttctctttgatcatcttgctaagagataagaggaaaagtggcataaatccatgccgagattgctcttatcggtccctttatttgttggttggtcccaatcacttgcactggatatgtaactgtttctccatgttactccttctcttttaccaatatacccttcattttcttcaatttgggtgtagtcccaaatgtgactcttttggcctaattgtatcaacttgtttactttttcttatatatgttcatcaatgttacgacgaatgtaaaaaaaaaaatattatttggaatttgataccgaatctcgacactattagtatattattggacccgtcatatgtatttatcaccagagagatgtgagttttacgatacatagtttttttctttcatctgaaaagaaaattaaacacatgtaaaataatttctgcctgtagtcttttaatcactgaagtaactcgaatttgatgttagataattttttcacaaaaatattcaaattcaacagattaagttgttgatgacagatagctctctgggaggaaaaaaagaagaaaagataatggtccgtattaatatagttgaaaacttgaaactactttttagtttgtatataatacagtagactagggatccagttgagtttctttctttattttgagtttgtgtttatgtttgattttacgtttttatatgtaaataagatattttacgaattatggttttatttgggtagaagttgtagaatgacttaaacaatcaagtggcagaatgagatatataaagtaatataatatatgtaccgttattaacttattgtacatgtgaatgaggaagcttacacacacacaccttctataaatagctgacaaaactggttgttacacacaacacattcataaatctctcaaagtaagaactaagagctttactacagtcctactctctacacatcttctctctctctcaagagctagtcatggccaaactcataacttcttttctcttactcacaattttattcactttcgtttgtctcactatg

SEQ ID NO: 28290 - DNA, 3003 bp, Unknown
  misc_feature (1)..( 3003): 2750-1469P.txt file - cDNA_ID_2994973; gDNA_ID_2684256; Annot_ID_193118
atacaatatatcatctcgtccgaccaaatgattttctaatcgagaaaacaaatcgaaacatgtattcaatcaaaaaatttaaaagaatacaaaataaaataaaaacaacaatgccatgaaatagtcgaaaaattacactagctaatgaataaataaaaggatagatgatatttatgtttgattattgattttgattttcatcggatgccataattgagagaatatggttacaatatattgattagtttttttaataaaaataagatatataaaagattagattaatttaattatagtgattatggtttgggtggaagccataattattttaattaattaaaaaagattattttttttaacctaactgctaccgcccgcgaccgcaaacgcttgcgggaaagagctttcaaaaattggcgatttcgaacggtccaaagcgatatctagcggtttctatgattggtgtcaatcgctaacaaccgttaccaactgcaaacgctgggtttgcgggtggtagagggagaaccaatcaaaccctaaatgtgtgtgaccactgaccacaccagccaaagaggtccccgtgaagtgaaaccgtagcacggccatcatgataagatatcaatataaaatagtaagaacatcgattttttatatcattttgtttaaagaccccatgaaatatatagatagcttttacgaaaataatacttaacacgtcttttggacaaactatcttttcatttatttactaataaatacctaaatcaatttaaaatgtgcattgtggtccgacacaacaacaatccaggatacaatgaaagaaagtctacacataaaaacaaaaacgcgcgagccatgtatatacacacatggtcttgactcttataacctaataataaatttatatatatataaaaaataaatacattgttatataaaaaaatcaaaataaattccgaacataacaaaattgatattgcgtccgatcaacattagctccacaggccacaacatatggatgtcatacaaatatacacataagtactctgagtaattgggtagcaacaattacttcttggatgattcagttctctctctaacaattgtatttttgggtctaattacaatctcacaattgataacattttcattttacctatgtgcaaacaaatttgtgaactattccatgatatattttggtataatcatttctttcaaagtgggattacaaaataaataaataaataagttctccgaaaagacatattcacattaaattagtcaaaagatactgcatactaggcataaagacattatgctaactcaaataaaatcagctgcttaagtaatgtattgaggaggacatatatagcaaaacagttagaatccatcaaaacgaacgtacttgcggataacaattctgaaggttccaattttcttatgtctaaaatggattagggggggtttgggatcgagatgggaaatcaaatacggtatcaccaaaccaccacggccataatatgttttgtagctttcgtaaaagagcaattcatcactttcagtaacattattaatttttgtcttaatagaaatagaggaacaatgttgatcacacaataaaaataatagatgatcatgtaaaaaatctaaacgagtgtaaactactaaccacgtcaatatcaaaaccaaagcaaaaagatgttcacaaatgaagactcaaccgagcgacagtgtcttttgaatgagccattttcccttcttttttttaataaacatattatgaattataaataacagaaagaaaatatcaattcttgagaaaaattcgtaaatgtgtaatcaataaatgttggaaataagttattaaaattatagactggggcatatatagtcccagtgccgcgtaaccccacaaagaaactgtagtatactaatgctgtctttcaatcatttattacaattaagggtcctactatttttgcgtatacagataattgcatatttcacacttaccaaagtacatactttcttcgctattcaccaacgtgtatcatatatcaccttttgaaccggcgttgcctctacaatattgtgcttaagcaatgctacaaaaagaaaagggactattgaaatcgaaatgtaataaagattatttgtttagggctgtttctaaattttcaggaactctcgaggtgaaaatttcatacaacaaaacaaacaaacaaaagtagtacgtagaatttaaaaaccacatgtgttcttgttcgagtaattctgtaaattaaatggtgtgaaacgatttctgtaaattaaattaaatggtttatccaagcataaaataacaattttagctaaacagtatttgtactagtctttgtgctattcctaaacaagtcagaaagttgaagaagcaggaaacaaacatagctttactcaaataaattaaacaataaaattatatattgctctacataacaataaaatttgttaatatgtttaattcttgttcaaatactaagcttgaaaatgagcatttgtatcatgtgatgtgaaattgtgaatacgctattatatgtgtgacttaaccccttggaataagcatgtttgcatattctgaatatatataaaaaaaacgtacaaaataagaatcaagatatgaaaaggaaatatcagcatcaagaatccaacggttgaaataaatcaccaaaaaaaaaaagaaaaaaaaggaagggactatatatacacataaacatcccccattccccactttataaaagaccattctacttctatatatatatatagtgtgagtgagacagagcctcacataaataaaaagtctcctaatctgaatacaactattactaacaataattcacttatctaaagaccatcatctgactgactctacgctgaatcatcacgaggaagacttgaatcgaccggagaagagatacgtgtagagatctgattggctcaccggagagaacaaaacaagaaatg

SEQ ID NO: 28291 - DNA, 3003 bp, Unknown; identical to SEQ ID NO: 28290
  misc_feature (1)..( 3003): 2750-1469P.txt file - cDNA_ID_2994973; gDNA_ID_2684256; Annot_ID_138095

SEQ ID NO: 28292 - DNA, 3003 bp, Unknown
  misc_feature (1)..( 3003): 2750-1469P.txt file - cDNA_ID_2994977; gDNA_ID_2684256; Annot_ID_193116
attagccactaacttcccattacttcgtgttctgggactttttcgtggggaaaaccagctcatgtctgtaagaatgtcaggaacactggactcctgtaaacaccaagtacttaagctcagtgattttctgttatcatgtcatatgacaaagtatactgcagtcttgcagatcatgttcagggcttggaaaagttctggtctgcgaagaaacatggacacaatttttgcaaactataatcctaaaagttacagtttatcacttattcaagaaatgagaagacatcattaccagaaacaagacggttgcacagtacttgacaacttcaagattcatccggacatcatctaagctcctggtgaatcatatccattgtttagtcccatattgaaacaactgttgaatcgctaaaaggctcagggcatcgtttagatttacctgtgagcttgatctcctagcccgaagtatgtagcaagtgatgccatctacattagttaaaaggagtaaactttagcaactctgatgtgaatctaacaagaaagctacaggcattgaggtttatcattgagaatcgggaaaaagagagaccttcatgtcaccagctctcttcccaaacttctgagacaacaatgaaagcgaatcaattgtagctttcggctctggcggagagagaccaatttctgcaaatgcttctcttattcttacacaatcgaatcgaattatgttatgtcccgcccaaattcgtcctacaaaaacaccaaaatcaacacttttagcttcgtgagaaagaaagcgaggaagagagagaatcccttaccgtgaagaatgtcatagaccttatcggcgatttcagagaatgtatgtgcagagagaactccgtcgcgcgtaatgccgctacgtcgctttgtgagcgtagagattaaggaaagatcagtaggtcgaaccaaagtggagtaactatagagctcctctagcctccttgggcaaactaagatggccccaaactccaaaatcgcgaaaggctcccctgatttggtcggaaccgccgtctcaaggtcgaaaaacgctatctcgcttctctcatcgccgcccagactcgaagccattgttgaaaagtgaaaactgatagaaagaaggagaagctaataggtgggttttaaagcgaatgagcttcacgcgccacgtcctctttttacggaaaaaatctaaactttgagagacgcaactgtagaatgaggtttatcttgcgtcatctgcattcacttggagtgatcaacaaatttgattcctttcttctacattttcacaccaaatcgcttaaatctaaccacactttgaagcaatatcttgaatctggggaaccaatcaaagctcttttagatttccggcaccgattcagacaaagtcctagttttgttgacagtttttctgttttgtttgccattaaagtttcgtcagctcagaaagcttcctcacttgatggtagacagatccacgctcttgtaagaaaactaggtttcaatgccgttattcaaattcaaacatctttagtgggattctactcttccgtgggtgatgtcgattatgcacgccaagtgttcgacgaaacgcctgagaaacagaacattgtcttgtggacagcgatgatttcagcttacactgagaatgagaactctgtggaagctattgagctgtttaaacgaatggaagcggaaaagatcgaacttgatggagtgattgtgactgtggctttatcagcttgtgctgatctcggggcggtgcagatgggagaagagatttattcgcgtagtatcaagagaaaacgaagattggctatggatttaactctgagaaattcacttcttaacatgtacgtgaaatctggggaaactgagaaagctaggaaactctttgatgaaagtatgagaaaagatgtgactacttacacatctatgatcttcgggtatgctttaaacggtcaagctcaagaatctttagaactcttcaagaaaatgaagacgattgatcagagccaagatactgtcattactccaaatgatgtgactttcatcggcgtcttgatggcttgtagtcacagtggcttagtagaagaaggaaaacgacatttcaagagcatgattatggattacaatctgaaacctagagaagctcatttcggatgtatggtggatttgttttgtcggtcaggtcatttgaaagatgctcacgagttcatcaatcagatgccgataaagccaaacacagtgatatggagaacactgctaggcgcttgcagtcttcacgggaatgttgagctcggagaagaagttcagagacggatctttgagttagatcgtgatcatgtcggagattatgttgcgttgtcaaatatctacgcttcaaaaggaatgtgggatgagaaatcaaagatgagggatcgtgtgaggaagagaagaatgcctggtaaaagctggattgaactcggaagcattatcaatgagtttgtctcaggacctgataataacgatgagcagctgatgatgggagagattagtgaggttttgagatgtttagtttcttgtatgacaagttttgattgtgtaatagggaaaaaaatgtagaccaaaagagtctagtggaagttaatcaaagcccacttgtaggagcctgtggcccaacaaattaaatcaaaattgataacttaaataattttaagttttcacttttatcaaaaaggggcctgggaaaaaaacaaatatcaaagaaagcccaaaaaagacggagaaatcagatttttttgaatttaagaaattaaaaaaaaaaaaggagagctccgtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctctatg

SEQ ID NO: 28293 - DNA, 3003 bp, Unknown
  misc_feature (1)..( 3003): 2750-1469P.txt file - cDNA_ID_2994977; gDNA_ID_2684256; Annot_ID_138093
tatcttgcgtcatctgcattcacttggagtgatcaacaaatttgattcctttcttctacattttcacaccaaatcgcttaaatctaaccacactttgaagcaatatcttgaatctggggaaccaatcaaagctcttttagatttccggcaccgattcagacaaagtcctagttttgttgacagtttttctgttttgtttgccattaaagtttcgtcagctcagaaagcttcctcacttgatggtagacagatccacgctcttgtaagaaaactaggtttcaatgccgttattcaaattcaaacatctttagtgggattctactcttccgtgggtgatgtcgattatgcacgccaagtgttcgacgaaacgcctgagaaacagaacattgtcttgtggacagcgatgatttcagcttacactgagaatgagaactctgtggaagctattgagctgtttaaacgaatggaagcggaaaagatcgaacttgatggagtgattgtgactgtggctttatcagcttgtgctgatctcggggcggtgcagatgggagaagagatttattcgcgtagtatcaagagaaaacgaagattggctatggatttaactctgagaaattcacttcttaacatgtacgtgaaatctggggaaactgagaaagctaggaaactctttgatgaaagtatgagaaaagatgtgactacttacacatctatgatcttcgggtatgctttaaacggtcaagctcaagaatctttagaactcttcaagaaaatgaagacgattgatcagagccaagatactgtcattactccaaatgatgtgactttcatcggcgtcttgatggcttgtagtcacagtggcttagtagaagaaggaaaacgacatttcaagagcatgattatggattacaatctgaaacctagagaagctcatttcggatgtatggtggatttgttttgtcggtcaggtcatttgaaagatgctcacgagttcatcaatcagatgccgataaagccaaacacagtgatatggagaacactgctaggcgcttgcagtcttcacgggaatgttgagctcggagaagaagttcagagacggatctttgagttagatcgtgatcatgtcggagattatgttgcgttgtcaaatatctacgcttcaaaaggaatgtgggatgagaaatcaaagatgagggatcgtgtgaggaagagaagaatgcctggtaaaagctggattgaactcggaagcattatcaatgagtttgtctcaggacctgataataacgatgagcagctgatgatgggagagattagtgaggttttgagatgtttagtttcttgtatgacaagttttgattgtgtaatagggaaaaaaatgtagaccaaaagagtctagtggaagttaatcaaagcccacttgtaggagcctgtggcccaacaaattaaatcaaaattgataacttaaataattttaagttttcacttttatcaaaaaggggcctgggaaaaaaacaaatatcaaagaaagcccaaaaaagacggagaaatcagatttttttgaatttaagaaattaaaaaaaaaaaaggagagctccgtcttcgttgctttttcgagcggtgcctagtctcaacttccatggctgacatcttaccttcaaattttctcaaaccaaccaaaaagcttcttctccttttctaaaatttcatcaaaccctatagggttttctcaatacaattgattttttttttcttcttcttctctatggatacgaccctttctcccgccgtggaggcggaacaaatcgccgactcaacgatcgacactgtttctcgtttgatcgccggcgttttctccggcgcacttactggaatcttcgctatgggtattaatatgttttgccgttttgatcatcttttgtttgtgcatttgagtagaggaaagttttcccttttgtgagaattgtgacgattttgttccctctaagttgttcgtttctatccttttggtcaactcttgatctcttgcaacaaatatttcttgtgggcctgcaaattttgtgaaaaaggttacatttttctgtcttgagagatttggttgaacatcgttcagatcattagtcagattatcatacgtgttcaacatcttacagctaatgattttgaacttaattctcactttttagaccaatcctgggtttaagattaggaaagtgtgatgttgttgtctctaggttatttgaataaatcatcgtctctgcatgatccctataaaccattttgttttttaatgttattgtagctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggttagtctttaattctaacttctgtgcaatcttacacgtttgtcaattttggagatggtttttggagtttttcgactgactttatgatcgagatggtgaaatgattctgagagaaatgtagtttggtggaagaaataatgagatagttttgacatgttactggtgggccaactaaattatgggatgacaggatggcttggtttagtcccttggtaatggtaataggaatgattttgtgttgctaatgccacgaggcagtctaacaaaggatttttagctcgacaaagtctgagtctgttttttttaattgttttttttctgtgggaaggacttgaaccaattgcacggtgtttttgcaatgctggacaagtggacagctctgtctttttttccacctactgccaaatttggtagtgatgactgtttaagtatgagtaagctgagcccttggtatttttgttttggatacaggcagattttgtagagcaactgtttcgtgggagactggtagatgaacaacttatg

SEQ ID NO: 28294 - DNA, 3000 bp, Unknown
  misc_feature (1)..( 3000): 2750-1469P.txt file - cDNA_ID_2994985; gDNA_ID_2684097; Annot_ID_190168
aacaaggaaacagtgattcaagatttgggcttgaaatacttcacactacacaagttgttacactacattgcacacatcccccaccataaaagagtcaacaacataacagaactcttttagtgactaaaactgtaacttgaatctttctggattgtgacattgaatatcctcttactcgttcggttttcggatcatcgaagcttctataaacctcggagcttgcgatttctgagaaaaaatgagtccataagaccaagtaaataagatgaatatggctcaattggggaacatgattcaaagagtaattaccattggggaacaggattctgagaactgatacttttgtagaatttggcgattcgaccacgagattcaggttttggtataaaggttttcttcctcaagccaaagatctcttgtactagaggaacatggcttaatacaagcttccatgctagaaaccaccctgcaaaaccccaaagcaaaaacaaagtcaaattttcaaattaagatcaaagagccctaaagatctaaacttcaggtttgaggagagaaagtacaaagagcgatgaagcagatgacgaatgagatcgccagaagcggacgtatgaggaagaagaagaagagattgtcaaggaacgaaggagatgattccatggattagaatttcttgctttcaaagatctctctctctctctctttgtaatttttgattacgtggaagaagaagatacgaaaagaccaaactgaaattaaaaagagtttttgagatcaggttttggttttgtctttaaacaaatcgagtgatgatgttaaaaaaatgatatatcatgtatgggcttataatagcccactgggcttttggatgtttctagctctcacgtctacatttctacatcaccgctgtaaacagttaaatatgttttttacgagtgtgagagaactcattctcaacaaattttttgttttcttgattgtgtttatatattaaaatattgatatatttccttcgtttttattcatcattttagtttattcatcgttttagaactcaaaatttgttttataataatcatcgttttagagttttaattcagatgtttggaaaacattttagttttgtccctattgttttagtgctttgactaataaaaaaattataaatatatgaataaagggcaaaaacgaaaatttaattattttttgaatttatgtgcaaaattattttattttaaaacggagggagtattacataaattttatcaaatatttatgttatttcatgaatatttctataaatctttttcaaagattgttaaaacaatattatgattaaaaatgtacagaaagaaatataatttaaaacacgatctttgtaaacatttttttatgaacttataaatatttttagtgaaaaatacataacaaagagttataataaagagctgagactgtacaaaacaatttttcagaaaatgataaaatttattttcaaaaatattttgttaaatcggtaattgtaataaaaaaatcaaccttaagagaatatatgttaactaagtttttaaatacttataaaccattaatatgtataagtgagataatgttttgttttaccaattaaacaataaataagattggaaatacatgagtagtaaaaagcgcacataatgaaaactacatgaagaatatttataattaaaatctttcgaatttataaaggggcattttctatatgaaaaatactttatttagttgtacattttcgaaacttcccttcattaaaagcgttaaattgtttttgggactttgagagcgttaaattgtcaaaagattatacagtccaaaagatcatacatgttttggtttgatttttaaaattgaagggaaaaaatggtcaaattcatattatcccagttgttgttatgcttatagagaaacatattcgtagtcatctgtacatcttcctttaaaaataagaaaattgacgttactgttgttggaaatcgtaagttttaatattaaatataaattaagtcttatggctattaatttttctcttttttgccttgcttttcagctgctaagtaactagcggaccaacacgcaatgcaaagtgattcaggtagtcgtctatacattctggcggtcattgttattttgtttatatacaaattttgttaagatttttcagaaatacgtacataaaacgaaacaaattaaccaaatgcatatatcaaaccaaaagaatagacatatattacgtagcaaacatttgcgaaaactatcgccgatatatttgcaagaatcaaaataacaaattttagtttgtaactgtaataaatttattaaaatcaatatattttaggcaaatactagtccgggtttcaatattcaaagacaaatctactctaatacatacaatataccatagtccaactccatcccatttcgtccacttctcacttttcatgcggtttagcattaccaaaatcttgatgctattggtatggtctatttttattggtaaaactttttttttctatttttttttgttatcatccattcataccctaattacttaaagtaagacaaaactatttaaggagatcaaaagctgatcttgcatagttgcataataagatatttatttgaacttatctttgcactttgaaatctaaaatttttctaacaaaaaacgttttatatcggtcaaaatgaatctaactaactttttgggctagattagctttagaaacccacttttttcatcaaattgacacgatcctactactaccggctattaccagtcgacaaggtccaccgcataagctaatcaaacctgaaaagcgtccagatacataactctctattaccggtacccggtaatctcctttctcatttatttgttccttctcttcttctcaaatccacagaaccaaaaaagcgaattaggtcaaaaaaacaaatcccaaatcttcatcatcttcaacgtttatg

SEQ ID NO: 28295 - DNA, 3000 bp, Unknown
  misc_feature (1)..( 3000): 2750-1469P.txt file - cDNA_ID_2994985; gDNA_ID_2684097; Annot_ID_137063
cactacattgcacacatcccccaccataaaagagtcaacaacataacagaactcttttagtgactaaaactgtaacttgaatctttctggattgtgacattgaatatcctcttactcgttcggttttcggatcatcgaagcttctataaacctcggagcttgcgatttctgagaaaaaatgagtccataagaccaagtaaataagatgaatatggctcaattggggaacatgattcaaagagtaattaccattggggaacaggattctgagaactgatacttttgtagaatttggcgattcgaccacgagattcaggttttggtataaaggttttcttcctcaagccaaagatctcttgtactagaggaacatggcttaatacaagcttccatgctagaaaccaccctgcaaaaccccaaagcaaaaacaaagtcaaattttcaaattaagatcaaagagccctaaagatctaaacttcaggtttgaggagagaaagtacaaagagcgatgaagcagatgacgaatgagatcgccagaagcggacgtatgaggaagaagaagaagagattgtcaaggaacgaaggagatgattccatggattagaatttcttgctttcaaagatctctctctctctctctttgtaatttttgattacgtggaagaagaagatacgaaaagaccaaactgaaattaaaaagagtttttgagatcaggttttggttttgtctttaaacaaatcgagtgatgatgttaaaaaaatgatatatcatgtatgggcttataatagcccactgggcttttggatgtttctagctctcacgtctacatttctacatcaccgctgtaaacagttaaatatgttttttacgagtgtgagagaactcattctcaacaaattttttgttttcttgattgtgtttatatattaaaatattgatatatttccttcgtttttattcatcattttagtttattcatcgttttagaactcaaaatttgttttataataatcatcgttttagagttttaattcagatgtttggaaaacattttagttttgtccctattgttttagtgctttgactaataaaaaaattataaatatatgaataaagggcaaaaacgaaaatttaattattttttgaatttatgtgcaaaattattttattttaaaacggagggagtattacataaattttatcaaatatttatgttatttcatgaatatttctataaatctttttcaaagattgttaaaacaatattatgattaaaaatgtacagaaagaaatataatttaaaacacgatctttgtaaacatttttttatgaacttataaatatttttagtgaaaaatacataacaaagagttataataaagagctgagactgtacaaaacaatttttcagaaaatgataaaatttattttcaaaaatattttgttaaatcggtaattgtaataaaaaaatcaaccttaagagaatatatgttaactaagtttttaaatacttataaaccattaatatgtataagtgagataatgttttgttttaccaattaaacaataaataagattggaaatacatgagtagtaaaaagcgcacataatgaaaactacatgaagaatatttataattaaaatctttcgaatttataaaggggcattttctatatgaaaaatactttatttagttgtacattttcgaaacttcccttcattaaaagcgttaaattgtttttgggactttgagagcgttaaattgtcaaaagattatacagtccaaaagatcatacatgttttggtttgatttttaaaattgaagggaaaaaatggtcaaattcatattatcccagttgttgttatgcttatagagaaacatattcgtagtcatctgtacatcttcctttaaaaataagaaaattgacgttactgttgttggaaatcgtaagttttaatattaaatataaattaagtcttatggctattaatttttctcttttttgccttgcttttcagctgctaagtaactagcggaccaacacgcaatgcaaagtgattcaggtagtcgtctatacattctggcggtcattgttattttgtttatatacaaattttgttaagatttttcagaaatacgtacataaaacgaaacaaattaaccaaatgcatatatcaaaccaaaagaatagacatatattacgtagcaaacatttgcgaaaactatcgccgatatatttgcaagaatcaaaataacaaattttagtttgtaactgtaataaatttattaaaatcaatatattttaggcaaatactagtccgggtttcaatattcaaagacaaatctactctaatacatacaatataccatagtccaactccatcccatttcgtccacttctcacttttcatgcggtttagcattaccaaaatcttgatgctattggtatggtctatttttattggtaaaactttttttttctatttttttttgttatcatccattcataccctaattacttaaagtaagacaaaactatttaaggagatcaaaagctgatcttgcatagttgcataataagatatttatttgaacttatctttgcactttgaaatctaaaatttttctaacaaaaaacgttttatatcggtcaaaatgaatctaactaactttttgggctagattagctttagaaacccacttttttcatcaaattgacacgatcctactactaccggctattaccagtcgacaaggtccaccgcataagctaatcaaacctgaaaagcgtccagatacataactctctattaccggtacccggtaatctcctttctcatttatttgttccttctcttcttctcaaatccacagaaccaaaaaagcgaattaggtcaaaaaaacaaatcccaaatcttcatcatcttcaacgtttatggatttgagtcgttctcaaacaaattttcaattagggtttggttgttcacacgcatcaatg

SEQ ID NO: 28296 - DNA, 3003 bp, Unknown
  misc_feature (1)..( 3003): 2750-1469P.txt file - cDNA_ID_2994992; gDNA_ID_2684098; Annot_ID_190204
attattatggttttggatagcaatattatttaagcagataattattattttttgatataacggaagggaccatcatgttccgttgtctccaagagtttacgaacagatacaagttatctagaagattagttccaaatcataatatatatatttttttaatacaagtatacaagtttccacatcttttgttgactgtttattcgagaagaaacaaagataacaccttttgtccgtgtaatcatatatcaactcgtgggtcatgactcatgtatgatcaaacctaaacatcttcaaaaccggtaaaaaaatcagtaagtaaaacaaatattgagctgtaaaaaaaattcttagaattgttttaggcagatttatctttagaatttagagataaaacaaaaattgttaaaccaacaaatggatccacaaaacaaaaccatgagctctgaagtcaatctcaccagtcaccatgactcacttactacgtgtatctgtcttttttacatatattttgaaagtttcatcctttatcccgatggatgcgaataatacaaataacctaacaaaactcgaatcagagaattccagatattacttacataagacaattttagcaattagctttcaaatctcatctctttattctctctctctatctcttctcctcaagaaccctaaaaatctccagaaaaaagatcccaaatttcgtatttcaacgatctgaatctctctctctttcgggtttattttgtttcccgatatggtttagaatttgtgatttaaatggaagctgacgtgtcaatttcctgaaaaaacccttatcgcgaaattttccagattaccaaaaaaaaaaagattgaaacttttttcgatttgtttgaagaagaagcacggtaggaacgacgacgatgaatcgtgctttggtcctacttttatatgtttgtactgtttcttgtttagcttcaagcaaagttattttgatgaggaataacatcactctctcttttgatgacatcgaagctaacttcggtgagtctcttccttatcactctgttttcatttcagatttttgatgaattgaatctgtaattggggtcaacgcataaaaaagaagagatttttaatctgtttcttgcaacagctccgtcagtgaagggtacaggtgaaattggagtggtttatgtggctgagcctcttgacgcttgtcaaaatcttatgaataaaccagaacagagctccaatgaaacttctccttttgtgttgattgttagaggaggctgtagttttgaagagaaagttagaaaagctcagagagctggtttcaaagctgctattatctatgacaatgaagaccgtggaacattgatagcaagtatgaaaatttatgtcttgatcttgtgattctgttgtttctacattttgctgaaagttttgagatttgcagtggcaggtaactctggaggtataaggattcatgcggtctttgttacgaaagaaacgggagaagttttaaaggagtatgcgggtttccccgatacgaaagtttggttgatcccaagttttgagaactcggcgtggtctattatggcggtttcgtttatctcgctgcttgcaatgtcggctgttctcgctacttgtttctttgtgcgtaggcatcgaataagaaggcggacatctcggtcctctcgagtgcgtgagtttcacggtatgagccgccgcttggtgaaagcaatgccgagtcttatattcagttcgtttcatgaagataacactactgcattcacttgtgctatttgccttgaagactacactgttggagacaagctcaggctcttaccttgctgtcacagtgagtacattgtatacaaaatcctgtaactcagggcacatttgttagaacttagaactaactaacaatttctgattctgtttttgtgtgtatgttttcagagtttcatgctgcgtgtgttgactcatggttaacctcttggagaactttctgtccggtgtgcaaacgagatgcaagaacgagcacgggagagcctccagcttcagagagcacgccattgctctcatctgctgcatcgtctttcacttcttcctctctgcactcttcagtcagatcatctgcactattgattggtccttccttgggctcattaccaacttcaatctctttctctcccgcatacgcaagctcatcctatattagacaatcattccagtcttcctctaaccgtcgatcacctccaataagcgtaagtcgaagctcagtggatctcagacaacaagcagcttctccatctccatcaccatcacagagatcatacatttcccatatggcttctccacagtcactaggttacccaactatctcccctttcaacacgaggtacatgtcaccgtatagacctagcccgagcaatgcatcacctgcaatggctggatcatcgaattatccgttgaatccactgcgttacagtgaatcagctggaactttctctccatacgcctctgcaaactcgcttccagactgttagaaagtctacagaaccaaccactcttggttcaggtcatataagattatttcttttgcatttgagttttactacgaaacgtacttctggcgtttgtgtgtggtgtgtgtgtgtgtaacgatgcttttatagtcttttggttgagatgaaacatcatcggatttaggttagagagattttaacacttcgacaattacacaaactcggttcctttgtacaaagaaatatgagcttatgtatatacacgtctctttccttgttattactatctgatcactcttatctctatccgtttgcattgatacgatcctatctagtaaataggcccagtaggcctaattaaggtccagtaacataaactgatttgggctaaagtgaatgaagaaaactccatcccaccgttggccggtctattctcctccggcgtcgttgaggatctccggtggtttaaggaatcaatcacaccatg

SEQ ID NO: 28297 - DNA, 3003 bp, Unknown
  misc_feature (1)..( 3003): 2750-1469P.txt file - cDNA_ID_2994992; gDNA_ID_2684098; Annot_ID_137079
attatttaagcagataattattattttttgatataacggaagggaccatcatgttccgttgtctccaagagtttacgaacagatacaagttatctagaagattagttccaaatcataatatatatatttttttaatacaagtatacaagtttccacatcttttgttgactgtttattcgagaagaaacaaagataacaccttttgtccgtgtaatcatatatcaactcgtgggtcatgactcatgtatgatcaaacctaaacatcttcaaaaccggtaaaaaaatcagtaagtaaaacaaatattgagctgtaaaaaaaattcttagaattgttttaggcagatttatctttagaatttagagataaaacaaaaattgttaaaccaacaaatggatccacaaaacaaaaccatgagctctgaagtcaatctcaccagtcaccatgactcacttactacgtgtatctgtcttttttacatatattttgaaagtttcatcctttatcccgatggatgcgaataatacaaataacctaacaaaactcgaatcagagaattccagatattacttacataagacaattttagcaattagctttcaaatctcatctctttattctctctctctatctcttctcctcaagaaccctaaaaatctccagaaaaaagatcccaaatttcgtatttcaacgatctgaatctctctctctttcgggtttattttgtttcccgatatggtttagaatttgtgatttaaatggaagctgacgtgtcaatttcctgaaaaaacccttatcgcgaaattttccagattaccaaaaaaaaaaagattgaaacttttttcgatttgtttgaagaagaagcacggtaggaacgacgacgatgaatcgtgctttggtcctacttttatatgtttgtactgtttcttgtttagcttcaagcaaagttattttgatgaggaataacatcactctctcttttgatgacatcgaagctaacttcggtgagtctcttccttatcactctgttttcatttcagatttttgatgaattgaatctgtaattggggtcaacgcataaaaaagaagagatttttaatctgtttcttgcaacagctccgtcagtgaagggtacaggtgaaattggagtggtttatgtggctgagcctcttgacgcttgtcaaaatcttatgaataaaccagaacagagctccaatgaaacttctccttttgtgttgattgttagaggaggctgtagttttgaagagaaagttagaaaagctcagagagctggtttcaaagctgctattatctatgacaatgaagaccgtggaacattgatagcaagtatgaaaatttatgtcttgatcttgtgattctgttgtttctacattttgctgaaagttttgagatttgcagtggcaggtaactctggaggtataaggattcatgcggtctttgttacgaaagaaacgggagaagttttaaaggagtatgcgggtttccccgatacgaaagtttggttgatcccaagttttgagaactcggcgtggtctattatggcggtttcgtttatctcgctgcttgcaatgtcggctgttctcgctacttgtttctttgtgcgtaggcatcgaataagaaggcggacatctcggtcctctcgagtgcgtgagtttcacggtatgagccgccgcttggtgaaagcaatgccgagtcttatattcagttcgtttcatgaagataacactactgcattcacttgtgctatttgccttgaagactacactgttggagacaagctcaggctcttaccttgctgtcacagtgagtacattgtatacaaaatcctgtaactcagggcacatttgttagaacttagaactaactaacaatttctgattctgtttttgtgtgtatgttttcagagtttcatgctgcgtgtgttgactcatggttaacctcttggagaactttctgtccggtgtgcaaacgagatgcaagaacgagcacgggagagcctccagcttcagagagcacgccattgctctcatctgctgcatcgtctttcacttcttcctctctgcactcttcagtcagatcatctgcactattgattggtccttccttgggctcattaccaacttcaatctctttctctcccgcatacgcaagctcatcctatattagacaatcattccagtcttcctctaaccgtcgatcacctccaataagcgtaagtcgaagctcagtggatctcagacaacaagcagcttctccatctccatcaccatcacagagatcatacatttcccatatggcttctccacagtcactaggttacccaactatctcccctttcaacacgaggtacatgtcaccgtatagacctagcccgagcaatgcatcacctgcaatggctggatcatcgaattatccgttgaatccactgcgttacagtgaatcagctggaactttctctccatacgcctctgcaaactcgcttccagactgttagaaagtctacagaaccaaccactcttggttcaggtcatataagattatttcttttgcatttgagttttactacgaaacgtacttctggcgtttgtgtgtggtgtgtgtgtgtgtaacgatgcttttatagtcttttggttgagatgaaacatcatcggatttaggttagagagattttaacacttcgacaattacacaaactcggttcctttgtacaaagaaatatgagcttatgtatatacacgtctctttccttgttattactatctgatcactcttatctctatccgtttgcattgatacgatcctatctagtaaataggcccagtaggcctaattaaggtccagtaacataaactgatttgggctaaagtgaatgaagaaaactccatcccaccgttggccggtctattctcctccggcgtcgttgaggatctccggtggtttaaggaatcaatcacaccatgccaatgagatacctcaacgcaatg

SEQ ID NO: 28298 - DNA, 3003 bp, Unknown
  misc_feature (1)..( 3003): 2750-1469P.txt file - cDNA_ID_2994996; gDNA_ID_2684098; Annot_ID_190203
atatattgtttcggtttaagataaatgtatcacgcaattcaaacatatgtcaaaaaatcaggctgggaacttattcccagaggtttgtacctgttgctgtcttggtttacttaagacttgtgatatcagtttgcaatgtattggaaaataatatagtatttgccacaagattgttccatttcatcttctttttgtattttaatccgtatttgtatcaatcatattgctctctattgcaaggttcgtagtcaactcgcaaacacccccaccttacaattgccagttatcgattatttttacgctaataaatctaaaattccattttgtttcgttttttttttgcaatggaaacatttaaataaatacaaaagaaatacctacgataatggggtatttatacaaaaaaatgaatttgaaacaaaaaaatataatgaaaaaaagagagagttaaatttgctaagaatttattcttcaggtttctgttttcgttggaactaagtttggagttggagcaggagcaggagcaccgagaggaatttagtggggagcgaaaagaacctaaagaaacgtggaatattaatgatgaccaattctctaataacattgttagacataatttaatatgaacattactttcatcattgtcatttgtctgctaatgtattcgcgtgtttgcttttacattattgacttatgtctgaatattataacgccatatagttaaaacaatagacccctaaatgtatcatgagcacatttggtatccataaaaactgatggaaaatcatcacaaaagtgatagctatctcggtttatttagtatattatatcagattttgaagtgacttcaactcagtagtgactatttttacgtactaacttatatatgtaaatattcagcattcgcattcgcatgtgtatgggcatatatattatacataataaatgaaaattggatgagacaagatggaccgctctaagtgtgattgagatgtagcttgagaccaaagagaccgttatcatcatcaaccatcatgtcctctctttagcacatggaaagcaatatactatagaaattgtactatatatatggatcaagcatacgaatcagagtccattttgatgtgaaggcatcaaatctgcaaaattaaatcaagtttcttgagcgacaaagctgatgatatcattcttgcacttggagtattttctacaacataacctaagccggtggttatttaataatgtttagtaatcttgaattccatacatttacgagggagtgtctgcatagttgatagtaatcatgaagaagctaggtcggttcatttcatcaaattatatgttttacaaaaattgtatcaacatgacttgaatccattatcacagtaataaaagtttgaaacggaatgaatacaatattgagatgctgcaagataaatggatataattaatgctttgtcttttctttcttcttttaagccttaagtgtcacaaacgtaaacatcaagattcaataccataatgatataaaagatcgtgcgtgaaccatgtgaatgtgatcaaacccaaagtgaagctaacaagtaataacacatgtcaaagatatacaaacatttgtatttagagtgtataactataaccccatcccaagagtgtcgaaccaaaaaccataatctaagagatttataccgatcagatcacggaagaagttatagaaaaccgcatctcgttgattctgattttcgacaaataagatacaagccagcccaccgtctgcacggatactcaacttccctgttggtaatcgagttaatttcgaattacatgggtcaaattagaaaaactgttcttgttttatttgtttttaaatgggccatggggttttaatgtcttagtatttaatgggcttatttaaggccgactctaataatagacgaaattaaaaataggcccatttatccgttaattttgccatggtttttttttccatgaatattgcaagttttttttttggtgtaaatcttacaaggtttaagaaagaaaaagtgaattaatactactatcaaaaccgggagtaacagctaattatgtgtgtattattatggttttggatagcaatattatttaagcagataattattattttttgatataacggaagggaccatcatgttccgttgtctccaagagtttacgaacagatacaagttatctagaagattagttccaaatcataatatatatatttttttaatacaagtatacaagtttccacatcttttgttgactgtttattcgagaagaaacaaagataacaccttttgtccgtgtaatcatatatcaactcgtgggtcatgactcatgtatgatcaaacctaaacatcttcaaaaccggtaaaaaaatcagtaagtaaaacaaatattgagctgtaaaaaaaattcttagaattgttttaggcagatttatctttagaatttagagataaaacaaaaattgttaaaccaacaaatggatccacaaaacaaaaccatgagctctgaagtcaatctcaccagtcaccatgactcacttactacgtgtatctgtcttttttacatatattttgaaagtttcatcctttatcccgatggatgcgaataatacaaataacctaacaaaactcgaatcagagaattccagatattacttacataagacaattttagcaattagctttcaaatctcatctctttattctctctctctatctcttctcctcaagaaccctaaaaatctccagaaaaaagatcccaaatttcgtatttcaacgatctgaatctctctctctttcgggtttattttgtttcccgatatggtttagaatttgtgatttaaatggaagctgacgtgtcaatttcctgaaaaaacccttatcgcgaaattttccagattaccaaaaaaaaaaagattgaaacttttttcgatttgtttgaagaagaagcacggtaggaacgacgacgatg

SEQ ID NO: 28299 - DNA, 3003 bp, Unknown
  misc_feature (1)..( 3003): 2750-1469P.txt file - cDNA_ID_2994996; gDNA_ID_2684098; Annot_ID_137078
attcccagaggtttgtacctgttgctgtcttggtttacttaagacttgtgatatcagtttgcaatgtattggaaaataatatagtatttgccacaagattgttccatttcatcttctttttgtattttaatccgtatttgtatcaatcatattgctctctattgcaaggttcgtagtcaactcgcaaacacccccaccttacaattgccagttatcgattatttttacgctaataaatctaaaattccattttgtttcgttttttttttgcaatggaaacatttaaataaatacaaaagaaatacctacgataatggggtatttatacaaaaaaatgaatttgaaacaaaaaaatataatgaaaaaaagagagagttaaatttgctaagaatttattcttcaggtttctgttttcgttggaactaagtttggagttggagcaggagcaggagcaccgagaggaatttagtggggagcgaaaagaacctaaagaaacgtggaatattaatgatgaccaattctctaataacattgttagacataatttaatatgaacattactttcatcattgtcatttgtctgctaatgtattcgcgtgtttgcttttacattattgacttatgtctgaatattataacgccatatagttaaaacaatagacccctaaatgtatcatgagcacatttggtatccataaaaactgatggaaaatcatcacaaaagtgatagctatctcggtttatttagtatattatatcagattttgaagtgacttcaactcagtagtgactatttttacgtactaacttatatatgtaaatattcagcattcgcattcgcatgtgtatgggcatatatattatacataataaatgaaaattggatgagacaagatggaccgctctaagtgtgattgagatgtagcttgagaccaaagagaccgttatcatcatcaaccatcatgtcctctctttagcacatggaaagcaatatactatagaaattgtactatatatatggatcaagcatacgaatcagagtccattttgatgtgaaggcatcaaatctgcaaaattaaatcaagtttcttgagcgacaaagctgatgatatcattcttgcacttggagtattttctacaacataacctaagccggtggttatttaataatgtttagtaatcttgaattccatacatttacgagggagtgtctgcatagttgatagtaatcatgaagaagctaggtcggttcatttcatcaaattatatgttttacaaaaattgtatcaacatgacttgaatccattatcacagtaataaaagtttgaaacggaatgaatacaatattgagatgctgcaagataaatggatataattaatgctttgtcttttctttcttcttttaagccttaagtgtcacaaacgtaaacatcaagattcaataccataatgatataaaagatcgtgcgtgaaccatgtgaatgtgatcaaacccaaagtgaagctaacaagtaataacacatgtcaaagatatacaaacatttgtatttagagtgtataactataaccccatcccaagagtgtcgaaccaaaaaccataatctaagagatttataccgatcagatcacggaagaagttatagaaaaccgcatctcgttgattctgattttcgacaaataagatacaagccagcccaccgtctgcacggatactcaacttccctgttggtaatcgagttaatttcgaattacatgggtcaaattagaaaaactgttcttgttttatttgtttttaaatgggccatggggttttaatgtcttagtatttaatgggcttatttaaggccgactctaataatagacgaaattaaaaataggcccatttatccgttaattttgccatggtttttttttccatgaatattgcaagttttttttttggtgtaaatcttacaaggtttaagaaagaaaaagtgaattaatactactatcaaaaccgggagtaacagctaattatgtgtgtattattatggttttggatagcaatattatttaagcagataattattattttttgatataacggaagggaccatcatgttccgttgtctccaagagtttacgaacagatacaagttatctagaagattagttccaaatcataatatatatatttttttaatacaagtatacaagtttccacatcttttgttgactgtttattcgagaagaaacaaagataacaccttttgtccgtgtaatcatatatcaactcgtgggtcatgactcatgtatgatcaaacctaaacatcttcaaaaccggtaaaaaaatcagtaagtaaaacaaatattgagctgtaaaaaaaattcttagaattgttttaggcagatttatctttagaatttagagataaaacaaaaattgttaaaccaacaaatggatccacaaaacaaaaccatgagctctgaagtcaatctcaccagtcaccatgactcacttactacgtgtatctgtcttttttacatatattttgaaagtttcatcctttatcccgatggatgcgaataatacaaataacctaacaaaactcgaatcagagaattccagatattacttacataagacaattttagcaattagctttcaaatctcatctctttattctctctctctatctcttctcctcaagaaccctaaaaatctccagaaaaaagatcccaaatttcgtatttcaacgatctgaatctctctctctttcgggtttattttgtttcccgatatggtttagaatttgtgatttaaatggaagctgacgtgtcaatttcctgaaaaaacccttatcgcgaaattttccagattaccaaaaaaaaaaagattgaaacttttttcgatttgtttgaagaagaagcacggtaggaacgacgacgatgaatcgtgctttggtcctacttttatatgtttgtactgtttcttgtttagcttcaagcaaagttattttgatg

SEQ ID NO: 28300 - DNA, 3000 bp, Unknown
  misc_feature (1)..( 3000): 2750-1469P.txt file - cDNA_ID_2995000; gDNA_ID_2684098; Annot_ID_190197
taattaaattttctattccaaaattattgcttttccaaaagctggcttatgacatttcatgattacacttgtcgagtattgactatgcatttgttcatttatttattgactttctcaaacttttgttccactcaaattcagttttaatcttcttgataatcctcgtaagaaaaaagcataccacgtgtttaggatagactaattattcaccttacttagcataagcttatctaaggaaaagttaacttcaaatagattatttgatgatgctcaaacattttccatttattaaattttggaatcgatatcatgaagaagctaaaattaagaatcatagtggcgaccttatatgctttcttgggtggactctctcgtctctccaccttgattggtcagctttacttgcaaatcatatcttattaattagtcaatttattaatttaaagatgtttgcttttgttacgattaataaattaatgggtccaacatagtgtcaaaacctgtttaagtatatttgtttggtcggtccaaagaacacgattggctgattcgctctcgcctctgttcggttcaatgccactttgaattgtctttttctttttataattaggttaattatactggccaattaactttcgtctatttggatgataacttgagtggttctttttcattagtaaatagttctaattttgattggtagattaattaattaattaattaatcgctaggatatttcgtataattaatttatatccgagtggtgtgtcatcgtaaaaatgctaatgtcacgatagtgattagcaaaagcatgaaaaatttcctagtttctaaaacacttttttgggataaatttatctctaagctgcttgattttctttaatatgcaggagtttgtcagactgacggtgtaacggaacgggaaaagccaaacgtgagacaaacgctggtcacggcttatgatacattgctagccccacaagtcaaaacttgtatcgaagtgtcacattttcctcaagacaacgcgcgtttcgtgaaaacgcgagtaaacggcggtggaataacaacatgtattgcaacatggtttagccaactctgcattctcctccacagacttttaaaagaacggcgtcacgaatcctttgacttacttcgcattttccaagtcgtcgcggcttcgatcctttgtggtctcatgtggtggcactctgattatcgagacgtacatgtaagtaccaaacttcatttaaaacaaaacattttggcgtttttgctaataataatgttgttataacaggaccgactaggcctactcttcttcatatccatcttttggggagtacttccatcatttaacgcggtcttcacgtttccgcaagaacgtgcaattttcactagagagcgtgcgtccggtatgtacacactctcttcttacttcatggcccatgtactcggatcgctctccatggagctcgttcttccggcatcattcttgacgttcacttattggatggtctatctacgccccgggatagtcccattcctcctcaccctctccgtgcttttactatacgttttagcgtcacaaggacttggacttgcccttggtgcagcgatcatggacgctaaaaaagcgtctacaatcgtgaccgtgacaatgctagcgtttgtcttaaccggtggttactacgtcaacaaagtgccatccggaatggtgtggatgaaatacgtttccacgacgttttattgttaccgtcttttagtggcgatccaatacgggagtggggaagagatattgcgaatgcttggatgtgattcaaagggtaagcaaggagcgagtgcggcgacatcggctggatgtcgatttgtggaggaggaagtgatcggagatgttgggatgtggacgagcgttggtgttttgtttttgatgttttttgggtatagagtattggcatatctagctttgagacgtatcaaacattaaataaagagagggagagggggagaaagttaaataaaaatgagtgggtaaatttaatttttagggttctagttcggaatattaaaacgtcgctaattgtaattttgcgatttagcgacgggttcagtttttaacatgtgaaaatgaaaatgacaagtatttttaattgtttttaataaaatgtatattttcacctattggttttgtattgtttttattgtcaaaacctattgaatgttttgtgtgatattaaaacagagaaaaaaacagagccatttgtgatacggtaaaagaaaaacagagccatttgagttttctgagtagtcaaagactcatagttaatggcccatgggcttgatcaaggcttattttgatggttatacttttactggtggtgaacccaactagtctggattcaaaaagttattttagataaaaatttaattttcaaactaccaaaagattgagattcattcacaattttttttccaattagttaaatttatttttccaataaagtattagagaacaaataaataatagaagtggaaaatggtcacaaaaatataaaaattctaataggaaaaatctgtatgaagtcaaagatttgtatcaagaaaactaatttaaagctagaaatttaaaaaacattaaaaattccttaaaaataaaatcttgaataccataaagaaatattgtaattaaagataaaagctcacaaaattttgattagctttttaattatcatttttttttgctaaaatcaaagtagtcacaaaaaatattggctgattcattttattttttaagttaaatgtcacattgtaggcaaggtaattacaaaaatgagtggaattataaaattatctacataccgacatcattcaaccgtcagattatggattaaccatttgagaccgtccatttatgagtcggtttaaattgtgacataaatggaaaatgtcacctctcacgcgttattgaaaaaaaattcccagattctataaaaaagagaaatg

SEQ ID NO: 28301 - DNA, 3000 bp, Unknown; identical to SEQ ID NO: 28300
  misc_feature (1)..( 3000): 2750-1469P.txt file - cDNA_ID_2995000; gDNA_ID_2684098; Annot_ID_137075

SEQ ID NO: 28302 - DNA, 3000 bp, Unknown
  misc_feature (1)..( 3000): 2750-1469P.txt file - cDNA_ID_2995011; gDNA_ID_2684104; Annot_ID_190353
agatatttaaaatgagaaatttattaagaatttataagttttgaaattacaaaaaatctttaaaattataaaattgaaagtatatataaatcattttctgaattatttattcatttatttattatatttagtaaaaacatcaaaagtaaacaatatagtaacatttattcttattcattttctgaatcattactatcatttttttactcaacgctttcagcagatttgctgaattcgtcttattgtttttcttcttcggaaccgtctgtgatgtcttctaattgtctattttgtaggtcaatgtggataacatcttctgttgttatgtctggtatggaaacttctctgagactttcttgttacatcacaacatcatcaactaggccgactatacggcctctggaattaactttaataaccgataaccacacttcacgcctaggcctcacacgcgggtaagatagaaagcttgtgatgctaggataaatggtttgaactttgcataagtcttgtttgcattgacatcgaccacgaatgattttgcggttgtgatcttagatcttggttcttgaacgatctcatacaaccaaagtagtaaaagttcattttcacatccgttagtaacctacataaagtagattttaattaagtttatcatttcaacataagtcattaagatatcaaaatttccaaatattacttacatataattttaaccatccagcgaaatcacgatctttgtaagtttcgtcgcaaaaattcccacagaacaatatttgtacttgcaagtccctcgcaatttgcaatgactttgcgaggaattttttcgtcctcgcaagttcctcgcaaatttcacgcaatattgcgagggaattatccctcgcaaaatttgcgacggaaaagcgacgtgtcttctctccctcgcaaatgtctcgcaaatctgtagcaatttgcgagggattgtttccatcgcaaattgtcctcgcaaatcgcttgttttcttgtagtggtatttggaagtttataaggtttatcaactccaacttaaatacttcttccgtctttgatactagatgtttaaatgttttgcacacaaattaattaatcatttatttttatttattttttaaactaaaaatcatttattatgtacctaaatacgattcaacaaataataaaacaacctacagaacttaaatcgtgaaaacaattaaaaaaatttacattgaaagttgaaaacattatctagtttaaaacacattttttttcttctctaaaatatgaaatatataaaaatatcaaactgaatcattcttttttcttcttcttatgatctctgtctttctgttagattatatatatgagaatcttatatttgtatatatctaatatcttaggaacagatttatgcttatctcatgtaaccctatatatatgttcaatacataactctccattcacggagattcatacaattacactttcattatcatcacacttgtaaatactgaattttatagttgccttcatgatttcgaactagatatatattctgttggttctgattacatttatatacataaatttattccaagttgcgtgttatttatttgatcagaattagtatatgacccaaaaataaatattcaaatcaaagttcatgcggtttcatcatttagctacgcgatgtaggaacatacttgacatcttatttttatttggtcgttcttctctatgaatcacgtggaaaagtataccaaatgatttttggcagatacgtattactaaagtatccgagattaaatattaatacactatatagaagaattaatgggacataaatcataaatgcatggaaacattggtgaaagacacttaacacttgggacgaccaatgttgtttgatatgaagtgaaattaacgcgtctgcctaattgttatggttcatattatgtcacatggaccaacttcttgttcttcttcattcaagaaccaactcacgtacacgttttttcattttcttccctcaaatatctagctgtatattatattgcaaaatccagatttgaatatgatcgatgcaaaagattgtttatagagtagagtagtagactaaagaaccagattactcttacctattcagattatttgtgttatattttgtaactaacttaggtcactaagtaacgaatttaaagctaaatgcatctattcattctatcacaaaatccagccgttattttttagaaatgtgaacaaatattaagcattaagatatttaaaataggaaaaataatagccacaaataaagtaaattaaagaagaaaaaaaaaaacattagtgatagtccgatgatagacgtgtcctattgattacatgttatttcccactcaacttccttaattctaattccaatccttgatgtgagggtttttttcttcattgattctcaaatctacattatgtgattcttgatgtacctgtatgtacaatttgtattcaactaccaaataaaaatgtgagcaagaataggctaagaaataatactaatacagtatccttagaatacataattgtatattattaaggataacacatgtaatgtttaggaaagatggccaatgataaatcttataagaaacctaacaaatattaacaccggtaagatttgttctcttaaaacaaatcctatataaacaaaaatgaagaacaaggacccaacatatgtctctcatgtgaccgaccaacacatcctcagttgacctgtctttggtctaaccttgtcttcctccacaaagctaacagaaataattatgaatgttagtctcttccatgtgtcagtatattattggatcttgttggagcaacttgacaacatataaaagcacgaggcagctcaatactatcattccaacaagagaagtgcttgagagaaaaaaaaagtatcaaaacttcatatagccaaatttaaacaaaaagaaaaaagagaagaaataaatg

SEQ ID NO: 28303 - DNA, 3000 bp, Unknown; identical to SEQ ID NO: 28302
  misc_feature (1)..( 3000): 2750-1469P.txt file - cDNA_ID_2995011; gDNA_ID_2684104; Annot_ID_137113

SEQ ID NO: 28304 - DNA, 3003 bp, Unknown
  misc_feature (1)..( 3003): 2750-1469P.txt file - cDNA_ID_2995015; gDNA_ID_2684104; Annot_ID_190345
atttttgtctaaattcaccggcaaaagttaatattttgcagtttgatcgagtgaaagattgacgatgagccttcttgtaaccagaaaaacccgatttacatgagagaacctgcaaaataccatagaaaagagatgagcttcaaccacaaatatctcaagctaataagtgagaacaggagagcagtgtttttacagcttcttggtcaatcttgtggtacattagcttccttcttgctccacagctttttcgataagctaccacgacatgagctagaccgaaaaccgcagaagatagtaacaaaaccggcattccccatgagatcttgaggtgatagaccttagcctcctcaagagtagaattcacagtgaaaacacaagttttaaccaaaagaagaagaatccctccaaaggaagataacattactgtttcaagatacagaccataagctaatcttgtgtcttcacataaccaagagagacctgtttcaatagaagctcaatgaatcagaatgctaacatttgtgttttgagtaagagagaattaatgagtccgtacttacagataatgacgagagatctaatgagcgagacgagtggtacatcaatgagagaggtcttgaaactatactgacgaaaatgttgtgcaggggagtgacacgtgaggcacgtgatgctagagacgataagacaaggaactaccacatcagccaccgtgatcagaaccggtaatgaagaagctaacagagacgccgtcattgctgccacaaagaacatcgtccttaaacatcttcgtgctttctccgccacaatccatgacttccacgccgccatctataaatccggtggtggctaaaacaacttcaccatttttttcgaattcagacaaaacgttatagctttatgtaattaaaactttgtaacggttgatatattatagaaaacaatgcaattttcaaatattattggtacacagaataaagtaatgagttgtataagataaagtaaataaatgagtgggaaatattaaatgattaatggaccaaaagacagcaaagacaaagaaatgataagtgtgtttggaggaagagtggcacatagaagcatgtgaatgttaggttcactcttataatattcttccagccattttcttctgtctttgttcccccaaaagtttagcttacttactatgtatacaccttttgtttttactaaaattcgtttttattaaataatttggtaacaaatcatatcgtaatttatcaaatcacgactgctaattttctttgtttgtttactctataaataacgaatatccatttttgttatgtatgcaaagaaaggaaaaaaggttttaacttttcagaaactagaaaatatggctgtctacagataattgagatgcaataattatgaagcaatgatctggcagaagaaatcaagatgttgtttatgaattatgactagataattatgggatctttaatatcagaaagtaaacaaaaatcttcttataatgcataattgaataacaaatcaatactttaataattatgttcccatgcatgttactgcagaaacattggaataaaaatggtacaccgatttatgtacgttgcatatcaatacaaatatacaatacgaggaaactacttaataatctatttttttcttttctttcaaagaaatacttaataatgtatatactatgatttatcttatatgttcaattgttcataaacattagatgagtcatccttcttattattacacatctttctcgtatcaaattaatttatctatctataaatcattgtgattttgtttattattcatgattgctcggaagcttcttgtttaataaaaatttattgccaaaataatagaaatcgtaatgtatattagacttattactttattagtattacgcatttggtggttcacaattaggaatactgtatacattttgtctagaagagaagtataaatgggccgatagtttaactaccagaaggcccaatgtgttttaaaaaacaatgcccacttaccaattctttcaagttttcaactagattggtggggaaaattgacgattaaaccggacggacggtataatccattggggtaggtagggaaacgagcgaaccgaaccgggggtaggtgaagtcttatccgacatgaaccaaatcgggtcgggtcgaatccttacaccaacttttcgcaccaactctctactgaccctaccaacccccatagtggttggtgaaaggactaatcattttctaattttttcttaatcatatattttttacatttaaatcacatggataagatcgtaaagttgctaaatgacgaaccaaaatgatctgtaataacgacacaaagtcatactataatacataaaaaaaatatgcaactgaaaccagatgataatttatagttttacacttttattgaattattagaatgtgaaaaatgaatctttatttaaatattgtatgcttattataaattttaaatttacataaacgaattactaatatttttatatataaataatttacttattgtaggactataaatatataattaagtaatgtgaataataagatacaaaaaatttaaatatatttatggtatgttttctattttcagtgatatatttttattaaaaagagccgaactttattagacagtatactaattgttgtctaaaccaatcagaaggctaaccaatcttattaataaaatataatttgactaaaaccaaaatgttcacatagttttgatatacattattatggctaatgggttaatctttaggacaaaatggattatttttgcattatacaaaatttaaaataatataaatgacattttctttaattaattgtatttaatgccgtatatattaagtataaactcatttctcttcctcttgaaaaactcactttatcaccaccaaaaaccaaaattcactgccaaaaaaaacacatcaaaacgatg

SEQ ID NO: 28305 - DNA, 3003 bp, Unknown; identical to SEQ ID NO: 28304
  misc_feature (1)..( 3003): 2750-1469P.txt file - cDNA_ID_2995015; gDNA_ID_2684104; Annot_ID_137106

SEQ ID NO: 28306 - DNA, 3003 bp, Unknown
  misc_feature (1)..( 3003): 2750-1469P.txt file - cDNA_ID_2995025; gDNA_ID_1971889; Annot_ID_58470
agtgtaatgtagcaccctagttaattttcttgcagctaacttgagtgttctggataagcagtaactttagccattgttttgtatataacatcttaagattttaagcaacacttcaaattttttttttggtttataggtgggacgatgtcaatgagttattggaggagatgctttcaaatagagtatcaaatattcatcaagttattgggcaaatgatcaagggagattatgatgatgactcaaattggcagatagtggaatacgtgttggacaaactcaattcagaaggatgtggtttgggaataaggttttacaatgcacttctggatgctttgtggtggctgggccagaaagagcgagctgcaagagtactcaatgaggcaacaaagcgtggacttttccctgagttattccggaaaaacaaacttgtgtggtctgtcgatgtacataggtagcctaagatccctacactggcttcgtttcatgtgtatgaaatggttgagtaccagtcaatctaattcttggttttcaatgttctgcaggatgtcagagggtggcatgtatacagcactatcggtttggctaaatgatataaatgatatgcttttaaagggagatcttcctcaactagctgttgttgtttcagtgtaagtattttgatactgggtacctacctcattgcaagatgccttcaagctttttatcttgccttttgccttttttaattctttctttctaacctctcagacggggacagttggagaaaagctctgctgcaagagaatctcctatcgcgaaagctgctttctccttcttgcaggatcatgtctcgtcctcattttccttcacgggatggaatggaggtcgcattatgtgccagcgatctcagctcaagcagttactgtcaacgaaagagccaacttcagaagaatccgaaaataaaaacctagtggcattagcaaactcgccaatatttgcggctggaacaagagcttcaacaagcagtgacacgaaccacagcggtaaccctacacaacgaagaaccaggacgaaaaaagaactagcagggagcacagcttaagaactagacaacgtagtttctgttgccaagtccagaaatcaaaggcctcttctgccttcctccatatagactggtgggtgaaaactgtgggcgtatttcacaagcactccatatccatgataactatgctatggtttcaagcagtagagtcaacctctgttagacagaagaagctggagaagaagataaatggtgatcttagtttatatgaagaagcgtctatatgaaaatctcaagtaagtagccaactaagtgttttgatggattgttagacccatgattttgcagccatagattttttttcgtttttttttccattcaactatgtttttgattactataaagctaaatgctaatgtaagatcaaagctctagttacaattaaaggatctattaatcaagattcctcagggaagctctagtttttgcttgtgacctcacctgatgaactctctctgtttcgaaatctaacttattacatagcaatgacccaactccacccagaataaagaaaacaatctgttgtgcaagattccttcttcggtctgattaatctttttctctctctcgtcctcagatatgtgtttgttttctgatttaggaaagtcactacaagtttgtcatccaaattggtaataaaataagaaaaagattggagaaagaaaggatcttcctatagtgcttcacacattacaactttaagattccactttgtgtgcgcataaaagtaatggtggctttgctttctaaccgatgctagtgctttgtgtgattttgctgtcttccaaaactatttaccaaattttgtaaatactttttagaatcttttccctacaaatctaaaatagataaataataatagtatgtgatcatattgcttacagtcaaatcacatcctaacattctactaaaagactaaaactatcacctttttgttttttaatgctatatagttgtgatcaagtctggacatacgatcatgctgtttatactacaattaggtccttaacagcgtcttaaaatttactcttagctagaaaacgacaaattcgactacacaatcatttttgttgttgaattagattcctgaaattgtaagtttttgtgttgaaattcaaagttataatttccaaaaaggattcacctgtctcccaagatttttttcttaataatcaactcatagatccacaagatatagtattttagaagaaaaaaaagtacaaggatggagctgtaactaaatagattattagagcagagtacagaatcatttcagaagctgactatttttctaagctcaagttgcatgcgcttaggccttagagacattgcgttgaccagtacattataacctgtagatttttatcataaaaatacatgagggtaacgttaagaaaaataaaagcgtcgatttcatttcatttttctcattctgttatttcatttttttgtatttaactttgagtttgcgaaagtcaataaatatttcttcgttatacgacctacattttttggtcgacatagcgaaatacttttttaacttcttattataggataacatttatttaactcttttttcgtcatcctataagattaattaaactactaacaaaaaacctaataaatctagtcagccaatgaataaaaaaagtctatccaaatgaaaactctgtagagagacaggcaggtaagaaaaaaatacaagaacagacgaataaaaacaaaacacgtgtcatatggtaccgtcaccaacacctacaacatgtaatagtttaaaaaggaaccacgtggcttttggcttataaaagggtccccaaagaagctcagatctaactcacaccactccattgcccattgctctgtgtactttgcttctttaggagaaagaaagcacaaggggcaaaatcggaaagattatcatg

SEQ ID NO: 28307 - DNA, 3003 bp, Unknown; identical to SEQ ID NO: 28306
  misc_feature (1)..( 3003): 2750-1469P.txt file - cDNA_ID_2995025; gDNA_ID_2684202; Annot_ID_191260

SEQ ID NO: 28308 - DNA, 3003 bp, Unknown; identical to SEQ ID NO: 28306
  misc_feature (1)..( 3003): 2750-1469P.txt file - cDNA_ID_2995025; gDNA_ID_1971889; Annot_ID_176820

SEQ ID NO: 28309 - DNA, 3003 bp, Unknown; identical to SEQ ID NO: 28306
  misc_feature (1)..( 3003): 2750-1469P.txt file - cDNA_ID_2995025; gDNA_ID_2684202; Annot_ID_137235

SEQ ID NO: 28310 - DNA, 3000 bp, Unknown
  misc_feature (1)..( 3000): 2750-1469P.txt file - cDNA_ID_2995033; gDNA_ID_2684204; Annot_ID_191349
gtgcgaacggatccattgaggggaggcattaaagggcatactaccatcttccgatggtctagtcattactttacttgcgggaagcaacgaaacaatcttcacatcatttgctaaaacactcttgaattgctctaaatcaaatatatctgaaaactcgctgcaaataaaaacatgttgaacacaaaaaaccatgaacatttttgatgatccattactctctaaaattctgctctaagaaatcaaaaatacctctcgtcaccccaaatgagattgatttgcaatattgggacaacaagaacagcacctagaatcctcgcaatcacaactgcatcaacaatctgaatcttctgctgattcaacccaccagagacaaccaccatcagatactttctcctctctacaagaatcttcttactctctcttctgtattcaatgctgaaatctaagcaaggcttgtaacctaatccatcaggctgtttccagaagtcataattcttatcatcatgtccatttccattagggatgatcaaatgtgattggtgaccaccaaaggtttcatttttctccactcccatatctaaagatcgatcctttgcgtttgaaatctcaacttgagtagtgcttgatcggatatacgcaaaacccatatgggatttgggcgagccattagaatctgaactctgaagttgactttcgtgatcgccagaaccgaaatgagaaagacaaagaccgagtcttaatgatatccccaaaatagaaagtaagaagagagagaaagcccagagctttgggtttctgagattgaagaagaacttgcttgtgttcttctttgaagatttattatcgagaaatttgtgtaaagatgatgatgaaactgagtttatgatctgagctgggactgaaatgtagctaactctgttcttcttattactgtttttgttcttccatgttcccatcacaacttttaaacagacgaaatgagagattttggagacaattagttacggcgggaagtggaacacagaaggatcattatgttacaaaacagagactgtgttgtgtagtttcgtttccaagaaagattctcatgttattttaaaatttggtggtattattcaataattgaaaattagttggagaatatctgtatttttggtattttttatgggtcaatttcaaaaaatgcacccaacaaggcaacaacacacacgcaacaactttttaaatatatcaaaaattatagaccaatattatttggagagagacaaattattataatatagtttatcagatgagacgaccttgttaatgaagttccttacattgattagtatgttaacaaaacaagacggcccaagatatatgaaatgtcactggcccaatatggagctgattgtggtccagtagtagaaaagtcgttaatttttagagatatcggtttgaatattattatcctctaattaatatagtcgctttattcatcttgtatcttaccggcgacactacttaatcccaccttagagagctggtttcgtccccttggtgggaatgcatattttgtttttttaatttctcataagtaaaacgaacaagatcatatatctagacgtagatgaatccaatagtgtttggtacgtaattaaactttgcatatggttcgagtaacaaaaacatatatgcatattgtatagtttgaacgatttgggagggataaacaaaggttagagttagagactcaaagtttatcaaggttagtggagtcgtggactcacgtatctttgaagcaaaactgataataaaatcaattatgggataccatatacattgttctcaaaccatagaataatatgtatattacaattaatcgtagaaaaatgtacctgtctttatcatatgaacatcacattagatacatatgctatatgtcacttcagcacgttttattaccgacgaattgtggaatttgaaatttaaaatttaataaatccagtgttaataattattttacatcgtctctttctctctctatcttgcaatttaaatctgatatgaacatcaagaaattgctttatttaacacatcgtttatgaaattacacatttgtccttagaaatgacagagccaatcaatacaaacaaagttcagggctataatagtcatttaacgaaaagtaaggagaaattcataatcttgctgccataacaatgattcaaagttaaacctgcgtcactaatgactctcttacttatccaatctctacgtagttgtaaatagtaacgtttcaaaatcacaatctttcattaatattataaaataaccccataaaaattaaaagctctcaatccaaccccagctctatctaaagttagggataaactctcccatttcctcaacaatcaaaatctctatctcctccaaattccaactctcataatttctcttcttcgacaaccgagagacgcggagattcaattcaacgctcctctggaattttttgcatttctttcagttataattattttcctttttcttttctttccttatttctatttatttaaagttgttttaattctccttttccaactttagtgccatttgttcacgagatagagaaatcataaaaaagaaatcatctgttcttagcttcttttagtttctggaaatatctctttttttaacagaagctgtaattttttttttgactgcgtagaggagaagaagattagaggtgttcaaaggtgataacgtttgcagaacgtgaccacaattataatattgaaaggtatcagaaaactttgctaagatttattataaactccttttttatttaaattcaagagatatcaaacaactacttcatttttttttttgtagcagccgagtactcttttttgacggtgtccgtgttcgtgcttggtctgaaattgacgaaaaatattccgacaagacaacaacaacaattagagagattcagacaagggatttgaaattcggaggatg

SEQ ID NO: 28311 - DNA, 3000 bp, Unknown
  misc_feature (1)..( 3000): 2750-1469P.txt file - cDNA_ID_2995033; gDNA_ID_2684204; Annot_ID_137288
gggcatactaccatcttccgatggtctagtcattactttacttgcgggaagcaacgaaacaatcttcacatcatttgctaaaacactcttgaattgctctaaatcaaatatatctgaaaactcgctgcaaataaaaacatgttgaacacaaaaaaccatgaacatttttgatgatccattactctctaaaattctgctctaagaaatcaaaaatacctctcgtcaccccaaatgagattgatttgcaatattgggacaacaagaacagcacctagaatcctcgcaatcacaactgcatcaacaatctgaatcttctgctgattcaacccaccagagacaaccaccatcagatactttctcctctctacaagaatcttcttactctctcttctgtattcaatgctgaaatctaagcaaggcttgtaacctaatccatcaggctgtttccagaagtcataattcttatcatcatgtccatttccattagggatgatcaaatgtgattggtgaccaccaaaggtttcatttttctccactcccatatctaaagatcgatcctttgcgtttgaaatctcaacttgagtagtgcttgatcggatatacgcaaaacccatatgggatttgggcgagccattagaatctgaactctgaagttgactttcgtgatcgccagaaccgaaatgagaaagacaaagaccgagtcttaatgatatccccaaaatagaaagtaagaagagagagaaagcccagagctttgggtttctgagattgaagaagaacttgcttgtgttcttctttgaagatttattatcgagaaatttgtgtaaagatgatgatgaaactgagtttatgatctgagctgggactgaaatgtagctaactctgttcttcttattactgtttttgttcttccatgttcccatcacaacttttaaacagacgaaatgagagattttggagacaattagttacggcgggaagtggaacacagaaggatcattatgttacaaaacagagactgtgttgtgtagtttcgtttccaagaaagattctcatgttattttaaaatttggtggtattattcaataattgaaaattagttggagaatatctgtatttttggtattttttatgggtcaatttcaaaaaatgcacccaacaaggcaacaacacacacgcaacaactttttaaatatatcaaaaattatagaccaatattatttggagagagacaaattattataatatagtttatcagatgagacgaccttgttaatgaagttccttacattgattagtatgttaacaaaacaagacggcccaagatatatgaaatgtcactggcccaatatggagctgattgtggtccagtagtagaaaagtcgttaatttttagagatatcggtttgaatattattatcctctaattaatatagtcgctttattcatcttgtatcttaccggcgacactacttaatcccaccttagagagctggtttcgtccccttggtgggaatgcatattttgtttttttaatttctcataagtaaaacgaacaagatcatatatctagacgtagatgaatccaatagtgtttggtacgtaattaaactttgcatatggttcgagtaacaaaaacatatatgcatattgtatagtttgaacgatttgggagggataaacaaaggttagagttagagactcaaagtttatcaaggttagtggagtcgtggactcacgtatctttgaagcaaaactgataataaaatcaattatgggataccatatacattgttctcaaaccatagaataatatgtatattacaattaatcgtagaaaaatgtacctgtctttatcatatgaacatcacattagatacatatgctatatgtcacttcagcacgttttattaccgacgaattgtggaatttgaaatttaaaatttaataaatccagtgttaataattattttacatcgtctctttctctctctatcttgcaatttaaatctgatatgaacatcaagaaattgctttatttaacacatcgtttatgaaattacacatttgtccttagaaatgacagagccaatcaatacaaacaaagttcagggctataatagtcatttaacgaaaagtaaggagaaattcataatcttgctgccataacaatgattcaaagttaaacctgcgtcactaatgactctcttacttatccaatctctacgtagttgtaaatagtaacgtttcaaaatcacaatctttcattaatattataaaataaccccataaaaattaaaagctctcaatccaaccccagctctatctaaagttagggataaactctcccatttcctcaacaatcaaaatctctatctcctccaaattccaactctcataatttctcttcttcgacaaccgagagacgcggagattcaattcaacgctcctctggaattttttgcatttctttcagttataattattttcctttttcttttctttccttatttctatttatttaaagttgttttaattctccttttccaactttagtgccatttgttcacgagatagagaaatcataaaaaagaaatcatctgttcttagcttcttttagtttctggaaatatctctttttttaacagaagctgtaattttttttttgactgcgtagaggagaagaagattagaggtgttcaaaggtgataacgtttgcagaacgtgaccacaattataatattgaaaggtatcagaaaactttgctaagatttattataaactccttttttatttaaattcaagagatatcaaacaactacttcatttttttttttgtagcagccgagtactcttttttgacggtgtccgtgttcgtgcttggtctgaaattgacgaaaaatattccgacaagacaacaacaacaattagagagattcagacaagggatttgaaattcggaggatgtttgggatccaaagcagacgtgatttaacgatg

SEQ ID NO: 28312 - DNA, 3003 bp, Unknown
  misc_feature (1)..( 3003): 2750-1469P.txt file - cDNA_ID_2995037; gDNA_ID_2684204; Annot_ID_137267
tgcaagacactgctcatgtctttttcctttttcttttcctcagttatgaagatctaagaagcaggatattttccaaacaccctcaacttttccctaaagaggtaactggtatacgcccattttgctacagcttactatttggacatgtaataagatgcacttctgtaattacaactagtgttggttctattttattatctgagcttaaatttgttttgtccacatgtatatgagtgtgctatttcttggttgcaggttttcaatgatgagacatttaagtggtcttttggaatcctattctcacggttggtaagaactactgtatcataagcaatcattatcttgataattgatgtaaatctagatgtcttgaatttgaaacaacagacttgttctttaatcttagcatgactttctgcataatatagctgtctccaacaatttattgtttgaacaatgaccactcacaaccaaaatattgcattatttcgtttctctttccttccgtgtgctgcgtgcttgtctctgcaattcagacttaagcttctctaacacaggtgcggttgccttctatggatggaagatttgccttagttccatgggcagatatgcttaatcataattgtgaggtacttctacttatctttatgaccaattagctcctagattctcctaatcagaaagcatgattgacttatggtaatcaatatttcaaaatctgcttggaaaggttgagacgttcctggattatgataaatcttcaaaaggagttgtctttacaacagatcgaccatatcaaccaggtgagcaggtaaataagataaattcattcagataacctgagcgagcattgaagtttaatataagtcagtgtataacacaaagaagtcccgtttacacagtttgccttttagcgcttcagtaagtcagtccaaagtggaaccaatgttgtctgaagtctctgatatgtttcagtaacatgacattgtgcaggttttcatatcctatgggaataaatctaacggagagctattgttatcttatgggtttgttcccagagaaggaaccaatcctagtgattcagtagaactagcattatcacttaggaaaaacgataagtgttacgaggaaaagctggatgctttaaagaaacacggattatcgacgtattccattctccaccatccatgttcccctctcaaatttgtagatctctcttgattaacttgagttttgttttgattgtttgtgttaacttttctctggcagacctcaatgctttcccgtaaggataacgggttggccaatggagctaatggcatatgcttatcttgtggtgagccctccagatatgagaaacaactttgaagaggtttggcaactccatcttgaccctttttaccatccaattcttcccaaattcataatacatctcttatcaattattatccatttcagatggcgaaagctgcttcaaataagacatcaacaaagaatgatctaaaatatcctgaaatcgaggaagacgcattgcagttcatactggactcatgcgaaacaagcatatcaaagtacagccgatttctaaaggtaagtaacaaaacagctcatctctctctctttgtgggaaaattttcactccatctgcttatagtttgctttgtcaattatctaattgtaggaaagtggatcaatggatttggacataacatctccaaaacagttgaaccgaaaagcgtttctgaaacagctagctgtagacttgtccactagtgagcgcaggatactgtaccgtgctcaatacgtaaggaacaactttctagccaatacgatagataagagtctgtggatcgatccatgatattgtggaatctgtgtttttttttttgttttgtttgggtcagattctgaggaggagactgagagatatcagaagtggtgagctgaaggctctacggctcttcagtggacttaggaacttcttcaagtgaatgttgaatgaggacatttcaacagctttaagatggatcaaaggtaggcctcgttgtgcttcaaccaaaaatgtagttttttattacaaaaaaattgaacgttggtgtaggcatggttggatctgtctcactcgtataggaatatattggtccagccatatatgtaatttgatcattttctataaactcaaaacctgaacctaaattgattaattaaggaaacgcatgagagagtaagggtagaaacatgttcttcgtatttgatccgaatcgaactgaaataatcgatccaacaaacaaagataatttgaaaattaagaatatatctgactacaactcataacgaaaaccgtaccaaaactcacactccttgttaccgcaaacaagataatctgatggtacacgtcagaacatttgtttctttagcaaagcaagtaaacattccactgtggcaaagtaaaaaacgagaaacctataaagtcttcctaatgaaacgtactgattttatggagtttccattttcgacataatatgacgtggcaatatctaaatggtttaaagatgttttatctccaatgatataacgccacgtaagcccgctgaccaaataacccaaagagtaagcaagcgacgtcgtttatagtttgatgatcttgtcgggtaacgaaactgccccttgagtcaaaacaggcttcttcgtgtccgattctgaacgagctcgctctttctcatccaattctctccaccgtcttctactccgatcaatcttcaaattttcttaacactcatcgaccagatcgagtttccatcgatctaatcaatcaatcatcagatttgatcttctcaagaaggtaaatccctctcactctctgtgtcaaacctaatcacctcgtaggaatcgaaattggaacaattcaatttggtttggtttggaatctctagtcgattcttcttctaaacgattgaattgcgttttgtgctttgatataattcgaaattattgtggcagatg

SEQ ID NO: 28313 - DNA, 3003 bp, Unknown
  misc_feature (1)..( 3003): 2750-1469P.txt file - cDNA_ID_2995039; gDNA_ID_2684211; Annot_ID_191515
ccgagggatgagagatcaacgtcgacggtggctttcttagaattccggccgagtataatggagtaagactgcatatagtactcgaaatcctcaccttgaagcttcgcaaatccaacctccacatcgcttccgccaccaacagccgtagccatgccgtgaaattctccgatttgatcgaaagaggaaccgggacttccaaattagggattgcaatcgtaataatttgtgaatcgaagcaagatttgtttggaaactggtttagcttatccaggacaaaggcttattttgtgaaattgacgattatacccatgattttaagacctgaataaaaaccctaatgacacaactatttaaaacagccgaagaaacattgagaatggcggcgagatctgtgagcttaaaggttccatctctcccgcaaatagtggagcatcttattgattgtttgaattttttgatttcgtttgctttagaacataggcttggttagttttatgtaaccttttgtttattttcgttgttggtttgattgaataagttgccaaatgatgattgaaaattttgcgcaagggttttgagtttcggatgattggagtttactctggtctgaaggaaccgtgacaaaattattttctaataattcattctgatggcagctcaatcattgttagatatatcaaatttcaattcgagttttgggtgcatggtttgattcggatggttaattgtagtttgttttgttagtagaagcttggttttggggcagcttaatgaattttaggattcaagttttcaaatcatttagcctataatgttctgaaatgtgttgtgtaatggctttgatttcctgaggatctgactatagaatgtttaaaatcctgaggaacggtgggaaatcatgtatttgtgtttctttttttttttaagattcaggttctacaaattatgcttaaagggctttgagctcctgaccgcttgtattatgagatccaagaaaatgtgaaaagtcgtttttttttcctttcccattttgatggtttgggttgcattttactgttcttttagttatcatgactatgctagattctggtctggacataagttgcttaagatgtgtggaaattatgcgtaatggatttagaattggcaatttgttatttgaaggaattcacttctatagatatcctttaatggcacccgttcatggtcagctccaaatatgcaagaaatcggaaaatgcattagtgtagtcctcttttctggtatattgtcaatactcaaatcttacataaactttgtttcaaggacaatgaagcatgtggtcaagattttgagcctgctggtagctgtctctgccttttagtttgctctcttgcaggctgcaattatggctcgtagccaaacatagttggttagtaatgagtctgttgtgctcatttttgcttattgctattctcagttagtcaatattaataatgtatatctttgcaccagctacctatatacgttgtagtgtcctttgctattaattgttggaatcggtttagtgcagttccctacctctcctaaagaagcagtttttctgcagcgggtactttcagtactcttttctttctttgttaactcgaattgttaattaaggttaaattaagttcttgactagtgcttttgctcctagctgttgttaatgttgattatgtactagtttgttttggtgctattgttatattgcaggatattgcagatgcaaaaagacttcttaagcgctaacggaattgatgttggatcggatttgacacattatggtttacttcttttcaactccctaaccagtgtaatagaatacttggagtcttcgatggttcatagaaagagttcccattttcattatgtacagtcgtttactatgtttttttgagagatgtacattgagaaaccggtgtttgcaattggattttgttttggggttttaaacatgatgaagaacaatgttattctgataagttcactttaattgacttttttttttggaatatcgtttgttacattttttctcgtgtatacaataagttgtgaatccaactctttcaagtttaaactacttgagattaacttaaatgctccaataaaattgattgaattggattttctagttttgtttgttttgaagtaaaaagttggacttgaatgctgataagtgataataaattgacttgcaaccataactgaaccaatctaacaacatgtaactattccaagtttattataagctagatttctgaaatggaaatgtcgttttaattttacatttttgccgagatggttaaaactggtaatcatatacattacaatttggttaaatgaccaaatctatttgataacaaagagagatataagttaatgaaaccatgattagacaaatcgacaagcaaagaaaacgttaagcaaaaaacactaatcataataagcaaaaagtccatccatgttcatcacatgtacaaagatcctctctgtcactctagacttttcctctgtttgcttcttcttacaaaatgacacacttaaaccaaataaagaaaacatttcccccaatctttatacattttcttttgaattaaagaaaaaaataaaagtgataaaagaagaagaagaagtccccagctagctccttaaagaagcacatctctttactcatttcacgattcccctgtctcttgtttctctctcacttacctcttctcgagttttctcccattcttgggtcttcatcgagaccaaatccggagaaagttgatgtttttacagcacaaacagacacagacacatacatgtgttgtgtctccctaatcccattattactaactcgcatccaattcacacttctctcctaaattcccatccttttcagatccaaaacactctcctccaaaacccagattgccaaattagggaatttgacacaaaacccatctgagagcataatcaagagatagagagacaatg

SEQ ID NO: 28314 - DNA, 3003 bp, Unknown; identical to SEQ ID NO: 28313
  misc_feature (1)..( 3003): 2750-1469P.txt file - cDNA_ID_2995039; gDNA_ID_2684211; Annot_ID_137339

SEQ ID NO: 28315 - DNA, 3003 bp, Unknown
  misc_feature (1)..( 3003): 2750-1469P.txt file - cDNA_ID_2995053; gDNA_ID_2684232; Annot_ID_137644
ggaatgtaagtcattttcgttgcttttagatttctgtcagctggcatgaaattgctatcccttttttttctcgcagcaattcattcttgtttgttatattttggaactgcagaacgcaagtgggttcgcaacccatcacttcaatttcttggcttcctatgttgcgtgtacttgtcactgtgtccaaggatggatctcttcaagtgtggaagacacgagtaataattaatcccaataggccttcgacacaaacaaacttctttgagcctgctggtaagcctgatatctcttatagagaaaatatattttcctccccgacttaggaataattcccatggtttggtttggagactttgattacgcattgtagcactatccttttttttttttctttgcagctatggaatcaatagacattcctaaaattctctcccaacagggtggcgaagctgtttaccctttaccacgaatcaaaactttagaagttcacccaaagctgaacttagcagctttgatttttgcagttaagaatacttcctactggcactccttccttaggtagaagtgtggcttctgtctttgacatactgggtttcttatacagaacatggtgggtaatgagaacactcaaaatcgagcagctcagactagagaaggaaggaagcagctctttgcagttttgcaaagtgctaggggatcttcaggtgaatcttgaacactaatgttattcaaacataacaattgatactcttcttaagctgtatggatgtgtctcttgagagtaaccaatcctctgttaatagtatgggttgtgggttcgaccagagtcgttcgtatcaatatccggctttctaacatgtgagatgattaacagcttctgttctaaaggaaaagctttcgtctatgggttcctctggaattttagccgagcatcaacttcaagctctgctacaggagcacaaggggtaggtggatatttctcatgcaatcactgttggaaaattgcgcaaaaaaaagttactagcatgtgctgtgaattccgtaccaaatgactcaaatttcatctgcttcatagttcactctgttacttttctacagccagagtcagctaacaatttcagatatcgcacggaaggcgttcttgtatagtgtatgactgctttaccttcttgcttagacattatgtttgttttattatttggaactattttgagcttagtcgatgaattaatccgtacagcattttatggagggtcatgccaaaactgctccaatatcaaggttaccccttattacggtcgtggatacaaaggatcaacttaaagacattcctgtttgccaggcatgtaactgttgtttagtgtttcttttctgtagtatctgatttatgcctgactgattggattatctgacagccatttcatttggagctgaatttcttcaataagccaaatagagttcttcattatcctgtgaggtccttttatatcgagggccttaacctcatggctcacaatctctgttctggaacagacaacatctacaagaagctgtacacatcggtataatctgatatcatgtgatttcgttttagtttttggtttccttttacttacagaacttttctgtttcagatccccggaaatgttgaatatcattcgaaacacattgtttacagtcgtaaaaggcacctctttctggttgtctttgagttcagtggtgctacaaatgaagttgtgctttactgggaaaatacaggttcccagctgcctaatagcaaaggaagcactgctaaaggtttgtctaatcattggattcccttgctattctttagagaacttcctatcctgcctcataacttttagttttgaaaacattaaacggtatcatactgcatccagtcatttaaatataccaggggtacaatgtatgctataaaacagtagttactaacaatcaaggaagctgaacgtttcaacgaatgatctgtttacttgatagagatgcaagcttagaattatttaagccgttcatcctttttgttttcctatgtttccaaaggcgtaaacgaacaagagaagagtaacctcaaagctatacttttttggtatgcaggttgtgatgctgcctttatcggcccaaatgacgatcaatttgcaattcttgacgaggataagacaggactgtctatgtatatcctcccaaaacttaccacaatggaagagaatgagaagaatttgttatctgaagaaaaccaaaagaaagaggcggatccttctggaattcagggtccacaacaattcatgtttgagacagaagtcgatcgtgttttttccacaccgataggtgatgttgcatcagataatctcattcttgaagttacagataatctcattcttgaagttacttatcaattggagcatgccatcgctaactgatgcctctttaaattacagagtccactctgatgtttgcttgtaatggaacccaaattgggctggcaaagttgtttcaaggctaccgtctctcagcttcagatggtcattatatttcaacacaaggtgagggacgaaagtcaatcaagttgaagaaacatgaaatagctcttcaggtatgcaacatctattataacttcgtactgtttattagtagtttggtgggaaattttccaaccaaataaacttttgatatctagtatttgattctatgaccagctcagtaaatgcagtcgttttattccttaccctttaatgtggtttacatctggccggttctctttgaaattaaaacgatcatgttcagaaaattgactcgtcatgttggtgttagcgttctattgctgtcaaaaattggttgaatcgacaattgatattcctgaaattttggtcaatcaacttttgtattacgtagagattcttagaatatgatttagatttctaaagtagttttttccatcaattgtataaagaactaattgttgtctcaaaatgtacaggttcaatg

SEQ ID NO: 28316 - DNA, 3000 bp, Unknown
  misc_feature (1)..( 3000): 2750-1469P.txt file - cDNA_ID_2995061; gDNA_ID_2936555; Annot_ID_194202
tcaaaggtatcctatgtagttttcaaactacatgtatataataattattttttagttcctatatatattttctcaagaataatcaatggatcaacaaataaataaactatattttatcataacaatcttataatttgaatattgaaactcatattttatgtttgatatattacaggaataggagtccaaggaaaagtaccgtgtctttcgcgtatgtttaataaaaataatacgtgttctttcctaagatgtgaagctaattgtgcacggaagtataaagggtatggtgattgccgtccaggagacaggccacacgacaaaaaagactcgttgttttgtttctgcaattatccttgttaaaatttaaaacacctaaggagtgcacatacattttacctccatgcctttttaacttttttgtatttacagtaaaaatcaaaccatatttataataagtgttgtattgtaatataataaaccatatgttcggaatttatggtctgacggtttgtactagtgaattcttaccaaattctagtaaagaataaattttggtaatttgcgtttatatatcgtaattttttttaatctttcatctaattaaagtttggatatgaggtataatgcataaacaactaaacggaccttatatcaacatctcgtttccacatattcaaagagttaacgtgagaagaaagaaaagatgaagattcttccttacaccagaaaaagctatatcatcatcattcacaaatgtgcaaaaccatgggaaaagctagcgatatcagcaacacatgggccgctagatctagccgttacatgactcttttacagttttacttttacccatagatacacattcccctctttacaaaagtcaaaactaatataagatatcgttggagcatcaagaaaagataaaagaaggatggagtcttccacatcgtgtgatcaaagatagttaggcttacactcttgaagctacccgttgacttagaaagctaatgctttaaatgatgaaggccaaactatccatgcgcatcaccaagcccaagtattattatattcacaatagcccatttgttgttacattattttgttgattgaataatacctaaatagtttaactaatcttctattcgagttttagttatttacatgtttatgtaaagattaggaagttttgagttttgagtaaatactattgaatacaatgacaacaacaaggttagacatagaacagtaaaaccaataagaaaaacatatcacacctttgcagcaggaagaaaagacgatctcgcaaactcttcataagttgcgttatggcacttgtgtatctttagtctacaatttcgctctttgttactattagtggaaatcttgttagatatctcctaataatactagcaatttaaatcaatgatagatgttgtggaggatggagacgatagagcaatttgtagtgtctgatgataaactataatttcatatttatgaaaaaaaaaacaaaaaaaaaacttttacaaatggtttcaattgtagactttgtagtagagaattttatatgtaatagagagatttatagccaacgacttcttattttggttcaacgactcgagtggggaaatgcttttgatgtgtttaccaaagattgcgcatcaatcaatggttacaaaagtcaacaaagtcaaagctatatagattacgaccattctcagccgtccgataaataaagggtattctgtctttttgaatgacaactagcatttctggtgaccacgagaccgggaatgttcgtcacgggacgttttcattgtcgttcgttcccaccaacatttatcgttattaatttacaaacaaaaccgtttttagcaactagtaatatttaattaatcactaaagcactgatttattgttctaacaactaattgattgcaaaaactacaaaaactactccaccgactccacaattccgcaaaatcagttttgtagtttttttttttgtatcaaatccacaatccgtaaatcagtacatttttcagtcattatacatacattaaattatttttgtcaattgaaacaaaagttaaatctaagtttttcaactatgacttacggtaaaacctatcacaatcatatacaaatacaaatatttgtttacctagttgatgttcgtttctccattaagatcatttatctgaatggatttgaatattgatgttcgttttaaccaacttaatagagcaatgagataaatcagttaaatgaattttaataaactcatccaaaaatgatcgaaatctggctgattctgatcagaacagttaactggaagtgattcagtttaaaatactaaatgttataaatacaaaaaaaaaactaaatactataaataccaaaaaaataaaaacgaacatcattcagataaattaatgagatggatcatttgaataaactatttggatgcatatcctaaataagcaaactaacaagaccctaaaaggattagatattgttttgaccttttttcctaatcttgttctacatcaaatttgtaaccactttcgtgactagaagtttattttatacccttactagaagtttaacgagacctctctcatttgagctttcttattcgatatacgcatacatggattttgtggtcgacatttccaaagcctataagatcatcaatccaatggttaaagataaatgacattgagcttgactacgataacttaagtgcgcatcaaaacatttgattattcctcatccaaattaaaaaaaaaaagaacggtgggagcatttaataagatatttatttacctgcactcacgtcctctctcttcttctttcactcttacacgaaaggaaaacaaacaaaaacgaaccaaataaagttattttagtgctctctaatggcgatatgagagattcgtgagagaagatacagaaaaaagcttcataatttgagattctttctagaaaaatcaatcaatg

SEQ ID NO: 28317 - DNA, 3000 bp, Unknown; identical to SEQ ID NO: 14936
  misc_feature (1)..( 3000): 2750-1469P.txt file - cDNA_ID_2995061; gDNA_ID_2684234; Annot_ID_137693

SEQ ID NO: 28318 - DNA, 3000 bp, Unknown; identical to SEQ ID NO: 9727
  misc_feature (1)..( 3000): 2750-1469P.txt file - cDNA_ID_2995065; gDNA_ID_2684236; Annot_ID_192430

SEQ ID NO: 28319 - DNA, 3000 bp, Unknown; identical to SEQ ID NO: 9727
  misc_feature (1)..( 3000): 2750-1469P.txt file - cDNA_ID_2995065; gDNA_ID_1972175; Annot_ID_179974

SEQ ID NO: 28320 - DNA, 3000 bp, Unknown; identical to SEQ ID NO: 14959
  misc_feature (1)..( 3000): 2750-1469P.txt file - cDNA_ID_2995065; gDNA_ID_2684236; Annot_ID_137720

SEQ ID NO: 28321 - DNA, 3000 bp, Unknown
  misc_feature (1)..( 3000): 2750-1469P.txt file - cDNA_ID_2995069; gDNA_ID_2684236; Annot_ID_137719
tattttggcccaataataacacggatgagagttctcagttctcacatttgacatcctccgcttcaattctaaatctcccggcgaagaaaattaccggcaaatttcacggagaaacctcgccaacgaagcggagttatggcgggcatggctgcggtggcaggattacgaccgtggaacgcttttattcaagctctagttctgatatctctatcatttccctttctctccagcgcttaccgacctggagatatcgtccggatgagcaagatggggcagtatcactctgttcgtacttctctttaacatattagctgagattattttctaatttgatcggagactaaggatctattgattctctggcagtcgagaacgacttggcatgatgtgatcggaaagcattgcccgatcttcgccgtcaatcgcgaggtactgtgtgcaaataggcttaagacatttgatggataatttggaaatttagattgaagcttgcctttctttgccaatttttaggtgttgatcccaatagcgaaaccaattggctacacaggaactgatccttataagatgtgagaattttctggtatttattttgattgcatttcaaatgaaaattttgtatagctctatttggtgcttttgaattgagtttacttgcttagttcattactggtttaaccagcttttagattgtatttagcaatttcgattgttgctactctgaaaggaaatgatgaagatactgtgatgttttcgccatttctctcatctcttttgattagcttaagccatttcgtatgttttttttagctctgtcttactgcagtttgtgtttttctgatgtcttatctgtgctgaacatggagtactgacatggctacatctttatcgtgtttgtacattattcatatgcaaattaagagtaattttgtgcctgatgtgtgtttatggatgatttttacatgcagaaaattccaagttggaagtgagaaatttctgattcactggcttttggtaattaatcgtaagagctcagaagttccgatgatcgatgtaaatttggtatgtttagcattgattttgagtttttatctaagctttgattgattagattatttgctaccaggaaaaaaggcagatttatgtaataccagtttttggatttttcggtgtgggttgattttttcatttgcgcagagatattctggaggagatctgcttggagtcacagctcaagttatcgacatgcctcatagctgtacgtaatactacctatctagctatattgtgtcctgattaggtgctcctgtttattaacaactgttttctgagcgaataagagaattgtctggtctggccaaaccaaatatgccaagtcctacgttcatatttgaaaactctagattatatgatatattaggtgatagcttctcggtgttgtgatgtttggttgcaaagcctatggccctagttaagctggcttcaatttgacactattcttattatatccagagtcttacagtatctggtgtaagttaatatcatcttcaccttcttagagacactgggtgctaatatattggcagtttgcattatagtccatttttctgttgttattttttgtgtcgattacatagactgattcaatctgtctgtctggtggcattactaaataaatttacagtttcatggttatgttaatagtggctttgaaaatttcttgtaactaatgaatctcatactttctctgctctgattattgaattttcatttctgcttgccttagagtagcactcagttatagtttaattgagttgagatcttacccatgaacagatctgaatacacacccggagatccgcaaacagttttgggatcctcaacactggccaaaacatgttcttgttagatacacatggtacaataacttttctcacctcttttcctatctctcctagctaataagtttgtgcatatggtcgaatcacaaagcttaaggataccacgttactgatacgtggctgagatactttattgtgatgcaggaaggagcagtcagagattgatgtatcctcaggattctatgtcctgtttggctcaggtaaaccatttttcgtcttgctaaacaattaattaaataagggacaataagctcatacacttatgtattctcatttttttgtttacttgtgatcagctctcacattttcttttgtactctccatttacgtcttacaatcgtcacgagagaagctggcaaggtaaatggtattcatgtcccctccaattcatacttgtatctttctttcttgaaccttattcttgaaaatgttgttgtaggtttgtaagagagacggtggtggagagcagcagcatgaatgttggagaatttggcaagggggattgagtcacatagtcaagtatatgtatgtttctacaattttagatacttggaatatggaattggccgttcaactctcagaaaagatttttcatcaaacatgaatagtcgaaagcaaaaactttgtccttgtaacattatggtttaatagatttacgtttcttaaaagttactgaaccatcaaccatggttttggttcaatatcaattacctagtctagtcttaaattgtctatagtttgagggatccaagacaaatcgtttcttattttgtaccagcgaggccagacacagtttcagaaaaaaaaaaaaaaaaaggatgtgtatacaagagtgaattacatttttatatagtatatagtatagatctgacaaaacggagagtacgtagtaattaaaactacaaaagcgaaagataagagaagagaaagcaatgcaataaatgaaaccaaccaccaactaacctcacaccttctactttcatgcatttgcactcataagctctctctatataaacccaaccttcattaccattcttcattatccaatccaatccattacttactaagtaaaaagagaaaaaaaaaaaattaagatatg

SEQ ID NO: 28322 - DNA, 3000 bp, Unknown
  misc_feature (1)..( 3000): 2750-1469P.txt file - cDNA_ID_2995075; gDNA_ID_2684240; Annot_ID_192548
tcaattagttaattaacctctttttatattgtttgcttaactaatgaattaacctcgtcttatattaatttgcttaactaatactacgatgattacgttttgtttttttttactttacaagatgtctagtcgttagcctttcacagtctctcatttaatttgttatccttttcgcatagaataatattcaattgtgtgttctgaatagaaaatatgtgaacttgtaggataatcacttcggctcttcttcttgtttttgttttttggttttagggttatgattacgttagtgaataaacttttgtgctatgttcgatgaaattgttgaaatatgaatactttagggttttgtgtacatgacgcaggcatgggatcttccataaactaacggtttgggcagatggaccgagtatgataacgcagtgcccaatccagcctggccaaagatacgcttacagattcaacatcaccggccaagaaggcaccttgtggtggcatgcacacgcgtctttcctacgcgccaccgtatacggtgctctcgtcatccgccctaaatctggtcactcttacccgtttcccaaacctcacaaagaagttcccatcttatttggtacgtcaatatagtaaaatcttttaccaaacaaaatacacacaatttctgagtatatacatataattaaaaaaattgtatttcataattgatctgattttattttttaaattgttaatcagacgacacgttagtatttcagttggtgaatgatattgaaggataaggacgttggtccttgtcatttaaaattgaaacttctatatacttcagtagtaatattgaccaaattaagtcttctatgttttaaattattatatagtactgtgtaataatatattagtaaacaggtgaatggtggaacaccgatgtagtcgcgttagaggaggcagcaatcgccaccggagttcctccaaacaattccgacgcttatacgatcaatggccgtcccggaaacctatatccatgctccaaagacagtgagtccaaagaaacctaatctcatgatatttttttcttaagtataacatacatggcatttttttttttttttttttttctctaacttcgctgcatgaataaatattaagaattaaattcacattccaaacttattagtttgcaaattaacctttattttcttaatgaatgaaaataggaatgtttagcctaaacgtggtgaaaggaaagagatacttacttcgcatcataaacgcggccatgaacatccaactgtttttcaagatagccaatcacagactgacagttgtagccgccgacgcagtctacaccgcaccttacgtcaccgacgtcattgtcatcgcaccgggccaaaccatcgacgcccttctcttcgccgatcagtccgtcgatacctcctactacatggcagctcacccttacgccagcgctcccgccgtccctttcccaaacaccaccaccagaggcgtcattcactatggcggcgcgtcgaaaacagggcgatcaaagcccgtgttgatgccgaaactaccttccttcttcgacacgttaacggcttacagattctactccaacctcactgccttagtcaatggacctcactgggttccagttccacgctacgtggacgaagagatgctcgtaaccatcggtcttgggctagaggcatgcgcagataacaccacgtgtccaaaattctcagcttctatgagcaatcactctttcgtgttacccaagaagctatcgatcttggaagcagtgtttcacgacgttaaagggattttcaccgcggattttccagaccagcctccggttaagtttgattacacgaacccgaacgtaacccaaacaaacccgggacttttgttcactcaaaaatcaactagcgccaagattttgaaattcaatacgacggtggaggtagtgttacagaaccatgcgcttatagcggcggagagtcatcccatgcatctacatggatttaatttccatgtattggctcaagggtttggtaattatgacccgagccgtgaccggagcaagttaaatctcgttgacccgcaatcccgtaacactttggctgtccctgttggtggatgggctgtgatccgtttcactgctaataatccaggtataaactctctatccaattccttagttatactaaaaatgtaattatatagtttagagttttacaaaggctattattgttgtttatgcatgaaacctaaatattggctacattgtttcaggtgcgtggatttttcattgtcatatcgatgttcacttaccattcggactagggatgatatttgtggttaagaacggaccgaccaagtcgaccaccttgccaccgccaccaccagatcttcccaaatgttaagcaagataaaaaaaacatatttcatcgaaaacaataaaaagaagattatttagagcaaagaagacaaaaatttgtctctctgtctcacatttgttttgatgtagtcggtaaagaaattgtattgtagtccattcatatgttgttaccaattgtgtgtgctgtgagtaatttatatgatttattattatttttgtcacttttacaagttttaatttgatatttttgaaaagaacgtcacttgaaccaaaataaaagttctactaattaaaaacatttttatagaacaagaaaaaaacagtttttgataatttgcataagctaaaaacatttgtaatctagacattacccgaaaaatatttattcaaaattttaaaatacaaagttagtgccccatatctttgtaaagtactccaattttgtgatttgcagtttaattactacttcaatccggtaattttaatctgatttagtttcataccggcatttgggataaaccgggttcccggttaaacaaattccaaaacattatccaaaacaaacagagaattttatcaacggaattttcccaaaagaaaaacagagaatg

SEQ ID NO: 28323 - DNA, 3000 bp, Unknown
  misc_feature (1)..( 3000): 2750-1469P.txt file - cDNA_ID_2995075; gDNA_ID_2684240; Annot_ID_137748
attagttaattaacctctttttatattgtttgcttaactaatgaattaacctcgtcttatattaatttgcttaactaatactacgatgattacgttttgtttttttttactttacaagatgtctagtcgttagcctttcacagtctctcatttaatttgttatccttttcgcatagaataatattcaattgtgtgttctgaatagaaaatatgtgaacttgtaggataatcacttcggctcttcttcttgtttttgttttttggttttagggttatgattacgttagtgaataaacttttgtgctatgttcgatgaaattgttgaaatatgaatactttagggttttgtgtacatgacgcaggcatgggatcttccataaactaacggtttgggcagatggaccgagtatgataacgcagtgcccaatccagcctggccaaagatacgcttacagattcaacatcaccggccaagaaggcaccttgtggtggcatgcacacgcgtctttcctacgcgccaccgtatacggtgctctcgtcatccgccctaaatctggtcactcttacccgtttcccaaacctcacaaagaagttcccatcttatttggtacgtcaatatagtaaaatcttttaccaaacaaaatacacacaatttctgagtatatacatataattaaaaaaattgtatttcataattgatctgattttattttttaaattgttaatcagacgacacgttagtatttcagttggtgaatgatattgaaggataaggacgttggtccttgtcatttaaaattgaaacttctatatacttcagtagtaatattgaccaaattaagtcttctatgttttaaattattatatagtactgtgtaataatatattagtaaacaggtgaatggtggaacaccgatgtagtcgcgttagaggaggcagcaatcgccaccggagttcctccaaacaattccgacgcttatacgatcaatggccgtcccggaaacctatatccatgctccaaagacagtgagtccaaagaaacctaatctcatgatatttttttcttaagtataacatacatggcatttttttttttttttttttttctctaacttcgctgcatgaataaatattaagaattaaattcacattccaaacttattagtttgcaaattaacctttattttcttaatgaatgaaaataggaatgtttagcctaaacgtggtgaaaggaaagagatacttacttcgcatcataaacgcggccatgaacatccaactgtttttcaagatagccaatcacagactgacagttgtagccgccgacgcagtctacaccgcaccttacgtcaccgacgtcattgtcatcgcaccgggccaaaccatcgacgcccttctcttcgccgatcagtccgtcgatacctcctactacatggcagctcacccttacgccagcgctcccgccgtccctttcccaaacaccaccaccagaggcgtcattcactatggcggcgcgtcgaaaacagggcgatcaaagcccgtgttgatgccgaaactaccttccttcttcgacacgttaacggcttacagattctactccaacctcactgccttagtcaatggacctcactgggttccagttccacgctacgtggacgaagagatgctcgtaaccatcggtcttgggctagaggcatgcgcagataacaccacgtgtccaaaattctcagcttctatgagcaatcactctttcgtgttacccaagaagctatcgatcttggaagcagtgtttcacgacgttaaagggattttcaccgcggattttccagaccagcctccggttaagtttgattacacgaacccgaacgtaacccaaacaaacccgggacttttgttcactcaaaaatcaactagcgccaagattttgaaattcaatacgacggtggaggtagtgttacagaaccatgcgcttatagcggcggagagtcatcccatgcatctacatggatttaatttccatgtattggctcaagggtttggtaattatgacccgagccgtgaccggagcaagttaaatctcgttgacccgcaatcccgtaacactttggctgtccctgttggtggatgggctgtgatccgtttcactgctaataatccaggtataaactctctatccaattccttagttatactaaaaatgtaattatatagtttagagttttacaaaggctattattgttgtttatgcatgaaacctaaatattggctacattgtttcaggtgcgtggatttttcattgtcatatcgatgttcacttaccattcggactagggatgatatttgtggttaagaacggaccgaccaagtcgaccaccttgccaccgccaccaccagatcttcccaaatgttaagcaagataaaaaaaacatatttcatcgaaaacaataaaaagaagattatttagagcaaagaagacaaaaatttgtctctctgtctcacatttgttttgatgtagtcggtaaagaaattgtattgtagtccattcatatgttgttaccaattgtgtgtgctgtgagtaatttatatgatttattattatttttgtcacttttacaagttttaatttgatatttttgaaaagaacgtcacttgaaccaaaataaaagttctactaattaaaaacatttttatagaacaagaaaaaaacagtttttgataatttgcataagctaaaaacatttgtaatctagacattacccgaaaaatatttattcaaaattttaaaatacaaagttagtgccccatatctttgtaaagtactccaattttgtgatttgcagtttaattactacttcaatccggtaattttaatctgatttagtttcataccggcatttgggataaaccgggttcccggttaaacaaattccaaaacattatccaaaacaaacagagaattttatcaacggaattttcccaaaagaaaaacagagaatgatg

SEQ ID NO: 28324 - DNA, 3000 bp, Unknown; identical to SEQ ID NO: 5534
  misc_feature (1)..( 3000): 2750-1469P.txt file - cDNA_ID_2995133; gDNA_ID_1620800; Annot_ID_168621

SEQ ID NO: 28325 - DNA, 3000 bp, Unknown; identical to SEQ ID NO: 13150
  misc_feature (1)..( 3000): 2750-1469P.txt file - cDNA_ID_2995137; gDNA_ID_2214602; Annot_ID_135571

SEQ ID NO: 28326 - DNA, 3000 bp, Unknown; identical to SEQ ID NO: 13150
  misc_feature (1)..( 3000): 2750-1469P.txt file - cDNA_ID_2995137; gDNA_ID_2214602; Annot_ID_187082

SEQ ID NO: 28327 - DNA, 3000 bp, Unknown; identical to SEQ ID NO: 27374
  misc_feature (1)..( 3000): 2750-1469P.txt file - cDNA_ID_2995141; gDNA_ID_1621122; Annot_ID_172114

SEQ ID NO: 28328 - DNA, 3000 bp, Unknown
  misc_feature (1)..( 3000): 2750-1469P.txt file - cDNA_ID_2995145; gDNA_ID_1620352; Annot_ID_154362
gggtatgttcaacaagggctagttgaagatgctatctacatgtgtcaattaatgagactagagaagctgaaatatgattgtgtcactttagcgacattaatgtctgctgctgcacgtactgagaatctaaagctcgggaaagaggtgcagtgttattgcattagacatagttttgaatctgatatcgttttagccagcactgtgatggatatgtatgccaagtgtggcagcattgttgatgctaagaaagtgtttgattctacagtagagaaagacttgatactgtggaatacgttacttgcagcctatgcagaatctggtcttagtggagaggctttgagattgttctatgggatgcagctagaaggtgtacctccaaatgtgataacatggaatttgatcattctaagtcttctaaggaatggtcaggtagatgaggccaaggatatgttcttgcagatgcaatcctcagggataattccaaatcttatctcatggacgactatgatgaatggtatggttcaaaatggttgcagtgaggaggcaattctgtttcttagaaagatgcaagaatcgggcctgagaccaaatgcatttagcatcactgtcgctctctctgcttgcgcacatctagcatcattgcatatcggaagaacaatccacggatacatcataagaaatctacagcattcctctttggtttctattgaaacttctttggttgacatgtatgctaaatgtggagatataaacaaagcagagaaggttttcggaagtaagctatacagcgagttgcctctctccaatgccatgatctcggcgtatgcattatatggtaacttaaaagaagcaatcgctctatacagaagcttagaaggtgtaggtcttaaaccagacaacatcacaatcacaaatgtcttatcagcatgtaaccacgcaggggatattaaccaggctatcgagattttcactgatatcgtttcaaagcgtagtatgaaaccatgcttggaacattatggacttatggtagatcttcttgcatcagctggagaaacagaaaaagctttaaggttaatcgaggaaatgccattcaagccagatgcacgaatgatccaatctttggttgcttcttgcaacaaacagcgtaagactgagcttgtggactacttatcaaggaaattgcttgaatccgagcctgaaaactccggtaactatgtgacgatatcgaatgcttatgcggttgaaggaagttgggatgaagttgtgaagatgagagagatgatgaaagctaagggtttgaagaaaaaacctggatgtagttggatacagattacaggagaagaaggagtccatgtgtttgttgccaatgataagacacatactaggatcaatgagatacaaatgatgttagcattgttattatatgatatgggtacaggttccaaatgataattatgtgtatgaaatattataaatttgatcatgtatatttagactctcaagaattgagaagctttgtgattactgttgtttaattataaaacacaacaaccatcgtatcttaagtgacatgggacaacaaaccgttgcgtcagatcttcaaacaactagttttactcagtccagccagtacatggaccgaccgattgtcggtggagaatctgataacagatctcaaccatccacgtggttagtcggtaccttgagtcctgcgtcaccattttcagacaacataaattacacaagtacccctgaatttttgcatataaaccatgaaattgcttcatatatatatctccggttttacctgaccgtaacgatcacgcattcatgcactttaacttacgttttatcaccgacactgacactgatgacattgctacagtcaaagtctcgtagattcgggtctaatcaaactttaaggaacaaataaagatttgttttataaacgaagaagaagaagattctatgcttgtgaaatgagcttgaatttttattaataatggagtaatgggtttacgataccttaatttatgacgaagagatactcttccaactcccacgtgacatgtttgattatataataatatgaaaattttgtatgtttttgagtctaaaaaggtatttctatttttagctacacatacaaatcacatgatagttatgatccactataaatttctcaacaaaaaggagaacaaatcataaatattgctaagccaaaataaatttgacatttaaacactctgtagatgttaggttaagattagttggggacatgtgctacaattacaaatgaatttcgtaaggctgttgtaatctgctttaggctaaaatgcgttgtcgcaattcctattgtttttaatttccctcatacttttctataaacttacaattttttacctacacttagtctaccaaagtatcaatattatagggtaaaatccgaagcaataatgtctagtaaaggcaatcaaacatttgtagcggcgatgtggtcaaataatggtttcctcttgatgcttaatgtcgaaactagaccacaataatacaaatatgggcacaaatatatcaatttctgaatcataaactttttctctttagaaagattagcatgtctcacttgtttcatcctatatttaatttcgtctacatatatagatacctagttcataaaaacttccatttttctagaaagttcaacaatcgtttaataatttctaaaatagtagctaggtggaacccgtggaaggctggaaagaagagcatttgacatggtcacaaaacttgcaaaagcccataagcttaaattcgcaataaatacaataaataatgtcatcacaataaataaatacaatggcacaatcgtaattacaaccaaaaaccacgtccattaaaaactaaacaccaccttcttcttcatcccctcactttaagctcttcttcactcacactctctcaaaaatcaccaaaccaaactcttcactctctccaacaatg

SEQ ID NO: 28329 - DNA, 3003 bp, Unknown
  misc_feature (1)..( 3003): 2750-1469P.txt file - cDNA_ID_2995149; gDNA_ID_1620838; Annot_ID_50836
ttgctactgactaaacgaatttgattagtaagttgatttttgaggaattggttagttgatttttgaggaatttaaagatttcaaaagtttagagattttaaaagttttaaaaaatcttatggattcttctcaatgagttgtctaaactctagcaatgattttcatggatttttgtttacttttcctaaacgaagttttacaagacaatattttttccctcttatcatttcatttacttgttttattttactcttttttgtttattaacctaaactaaattatatatttcatatgatataaatccttggcatattttttgtattattatcaattatcactatcgttaatgtaaaatttatgaacttagaatttctactgttatttatgttaacagatgaaagattgatttttttgggttttttgagttttatttttaagagattttgaaagttgtgtcgaagagaattcatgtcccaataacatgagaatttaatagaattgtaaaatcagtgataactaaactttttgaataacaagaaattgtggatggagtttaaaagtcatcaaagcaataacactagaatatactaagaatataataatccattaacgaataaatgtggaatctgaaaaaattttaaattaaaaattcatcaaccaataacaccttcttagcagcaaaactcaaaagttaggcgatcgaatttgattttgtctcaacttagcctgtgaattcaaattatttttctatgattttgtcccttaaattataactgatctacttcatatagactattataactaaaatcatttctagtcaataatagaagatgctacgaacaaaagcacttaattttgaaaccttaaataaaatacatagtataacgatttttatatacttatctattagatcacaaaaactaaattcaatgttaaaaataaagtacataaatttatttgagatatggaagaggtaagaaaatattatttgataaatatatcacaacaattattttgttaaatattacataaataaaatgacacacgaatattatcgaaaatagtcaaatatccaaaatagataatagagatagatcttttcaacttcatttccttgcatgatggtcaaaattgatattttgttacatgtatcaagacttccagtttacaaaggtgaatttgaactaaaataaatatgaaaatcaaagaagaaataagtataatctagtaacacaatataaataaagggttttgtgcaaaaaaaactgaaattgtatattgttgcagctttacccttcacgttaaaaaaatgcaaataatcctataaattttaaaaataatgcgaaatatagccatttttttgcaaatttacatatattgtaaatattttcatgatcacatacatttgtttttgaattagactcttccaatatagcaatctattgaagaaataagtattatttatcaaaaaattgaatttttgacaatagcaaaaaagttaatttgcgtattattttgaaattcataagtattttgcatttttttatgtgaaagataaaattgcaaaaatagacgaatttgaaagttgtttttgcacaaaacccaaaaataaaatacaacaatataggatatatagatcatagcctctaaaaataaatttaaaattagactcttccaatgatgtttcaacccatataacaacagaaaagcaaaacaaaaatatttaaaatttgagataggttcgaagatgattatctttggaacttggttttcttgatgtatatgattaaatttggtgcatatgtaattaagtgtgcactggaccaataaaaaacattgaaaccttatataatatatcttcttatgacacattattatttaaataaacaaacaaacaaaactttaaaagcgtttgcgttcagcgttcagcgttcagcgtttgcgttcgacgtttagagttggcacaaaatccaccaaattaaaaccattcaggcggaggattcaatatatctcacagtttcactctcaacatttcaatatctctctctctctctgtgaagaacaaatacagcgtttcttctgcgattagatctatttcgatactcacgaggattgcctcctgaggagactacatatactaaacaaaatacaagctgaggagactaaatatatttagttaataccaataatatatgatatacaactacatatttacaaacaaagaaaatatagtagatttgtaatatatacataattgagatttgatgattgattaaaccaagaataccgtgcgtagcacgggtactgacatagtatgtgtattattctgaacttcataagattatttttcatttttgatgtgaaagataaagttgcaaaaatggtcgaatttgaaggttttttgcacaaacccagaaataaaataaaacaatataagatatgatcatagcctctgaaaataaatttagaactagactcttccattgatgtttcaacccatataacaacataaaagcaaagcaataagttgaaagatgataatcaaaattaaaaaatgagtatctttgcaacttggttttcttgatgtatataattaaatttgttacatatgtaattaagtgtaaactggacccataagacctttttcatccttgtaagcttaatgggctttatcaatataatgttggccgacaaaaaaaaaaaaaaaaagacccataagaaacattgaaaccagtctggcccatgacccatataatttatctttaaaagagtctgcgttccacgtttgcgttccgagtttgcgttccgtgtttgcgtttagagttggcacaaaatccaccaaatcaaaccagtcgggcggaggattcaatatctcagagtttcactctcaacatttcattctctctctctctctcaacaattagatctgtttcgataatcacgaggtttccctcacttcctttccattgctaaaccaggatttgcctcctgcatttggaaatg

SEQ ID NO: 28330 - DNA, 3003 bp, Unknown; identical to SEQ ID NO: 28329
  misc_feature (1)..( 3003): 2750-1469P.txt file - cDNA_ID_2995149; gDNA_ID_1620838; Annot_ID_169983

SEQ ID NO: 28331 - DNA, 3003 bp, Unknown; identical to SEQ ID NO: 28329
  misc_feature (1)..( 3003): 2750-1469P.txt file - cDNA_ID_2995149; gDNA_ID_1620559; Annot_ID_160563

SEQ ID NO: 28332 - DNA, 3003 bp, Unknown
  misc_feature (1)..( 3003): 2750-1469P.txt file - cDNA_ID_2995161; gDNA_ID_1971823; Annot_ID_176251
ctcctagtcttgcattggttacaaggtagacataagaaagaataatatcaagaccaacataaccaaccaaaaaaaaaaaacatgtagctctataaaattaagcaagagggataatacaatactaaaacatataaagataatgggactcatgtaagattcattagtcaatgctgattagaatactaaacaaagaagatcgaacaaaagtaaaaaaaaaaaaaaaaacctcttttacttcattctctgtgattctaccatctccatttttaaccctgcaagtttcaaaaagtgaaaaaacaaatcaagaactttagctacatgttgatcaatatgtttaacaagatttgatgataattgataacaatacatgttgaagaagatttgaagacgagaatcgaagctttcgtctgtaatttggtaccaaaactcgtataattcttgaagattgatcttatcaaccattattcttcttctcctacacaatgcgtcgaacaactcgtctgcaaactctttggaattttcattctccaaacctttcaaacacagaacaacaaaatttacaatctctatcgattctccagagtcaaactcaatttcaaaactgtgaaaatcattatgtcgaacctatgcaatgagcaaaatcacttttgaaaagataaccatctttagaaagatgagcgaaattgttttgaacatcgttccaatcaacgattccattttctttgctgcttatgaatttcaaaccatgaatcgctctctctgtacccgatccatcccgattaggtctagttggtcgctgagataaagctcgagggagattaaccgaatcggtaatttcgcctctgtgtggaaccaccggttccggtgcagaccgagacgaataaccgtaaccacgccgtgagatcttctggatctgctgctttgagttcgtccccgccgtcagtctctccgacgacgcgctccatcctaagctaagcgaccttgatcctgaaccggaatccgagcaagaggtgatctctagatcggtacctgaaatatcggtgccggttccggtaacggagtcgatgtttattattacgccgcttgggaattcgattgttacttctaggagctcttcgccggaggaggaggaggaggagggtgagggtgagtatgttgctggtaaggatggaaagctttgggtgaattctccggcggaagctaaatcggagccccaacgatcgttgtgagtcccgccggaaaatgacattgacattttgaatttgttgggaggagaggagagaagccaaggagggagaagactgaataaatacagtttttgaattttgtgtttattataaaatttgtcttttgtactaatcaaaggaacgaccagaggaaattaccaaagcagaacgaaaatataaaaataagtttggtttctaaaaatacggttttaaattatactatatttacgagttacgacacaaaaaattatactatatttttgtgcatgttttaggtacactttaattatacttaactcgctgttgttgtgaaattatatatttttttaaaaaaatttaatttgtttagcatattaaaaatatatatgatttaatgttttgaatttttatatattaattaatgtataattattatatttgatttttattctttaaaatataaaaacaataaaatacaattcatttggttaaaatctatatcacaactaaataatttgaatttgaattgtatttgttttgtttagtgtttaaaactagaggtatcaaaatgtctcaactcaactcaatccatgaaccctaatgagttgaaaattttgactcaaatgagttaatgggtcaaatgagttgatgagttaattggtttgatgagtaaaatgagttgggttgtaatggttaatggtttcaatggtttacccaattaacacatcaagttttgtaaaattgaattaaactaattaaaatctctaaaccaatgtcaatttaagtttaaccaacacatctaaaccaatttaataaatcattatttttccaaatttcttaaatatataagcgataaaattgagaaaaagtaaactcgtaaatttttttttaaaaaacataaacccgtgatttttccgccaaaaataaaaacatgtgattaaaactaataaccgaaacaaagtttggaagataaaccgacaataagtcggagatagatacgaacgaagacgaaaagctaaaacataaaacgaaatctaaagcccgatgttaatcggattagcaaaagatagtaacaagattcaaagttttttatctctaaaagatttgagagaattaagagagaaaaaaacttatatgacacaaatacatttaagattgtattttggtgagcaatttaaaccaaaataacataattctcataatacattcaacacatacattaaggagggtcaacattatcgaatcgagatccacccaaattaattttataacctaaccggtatagtaatttgccttgtatataaagtttttggaaccaacccatttaactaaattcacaaaatataataatttaaatttaagtatattaaaactataatatgaattaaaattagttagttatctttatttttattataagtttttgtccaaaaccgatcctaacctaaattgaaccaaatgaaaccacataactggatgcagactaatcaacaacaatcgcacgtgcgtctgagaacttgtcacgtgaccactccgctcctttctttggcttcgagttttggatgatgaaaaataattattaccgcgtttattataaaagtttctagggtttacgaaatttgggtctctctccctctctctacttaacgctctctgtatcttcttctccgtcaacgatacgaacccagagacgtcggcggttaaaacaatcgtcggatctctctggattcgttagacgagaagtttccggtatctaatttctgtgcgttagagagaaattagggttgttgctacgatg

SEQ ID NO: 28333 - DNA, 3003 bp, Unknown; identical to SEQ ID NO: 28332
  misc_feature (1)..( 3003): 2750-1469P.txt file - cDNA_ID_2995161; gDNA_ID_2926152; Annot_ID_198148

SEQ ID NO: 28334 - DNA, 3003 bp, Unknown
  misc_feature (1)..( 3003): 2750-1469P.txt file - cDNA_ID_2995163; gDNA_ID_2214482; Annot_ID_183394
aaatatgggaaagaaaacacaaaaacattctgtcagttggtgacaaaaggaacattctgtcggttatacagtctttaaccattcaccaaagcaagttgtttataaattaacatcgaaaactatgcatattttggcttactggcccgttaacaaagcataaaaaaagtatttatcgttctctgttttttactgcctaaaatctttccagatttggaattacattggcttataaatgtacgttaatgagtaaacactaaatcacagcatcccatatcgccaactaagaaactcaattatctcccaagtaaattttacttaccatcaccaatctatcatcacttgttacccattttaccaagaaaaaacgaaaagtttctttcccataatatatatgccgccgattgccaagaaaaacaagattttcattcctagattgtgtttgcgggtaaacaataaaaagaagaagaaaatggtcaattggttaagaaactctaataagtaaaaacaaaatggtttcgtgtaagatcaattcgaattcatttttattttggcaaaattgcaaaaattaataagagttgatagtagacgacaaacattttcttgtacactaattactgtaacagtcacattattataatgaaagagggattcagcaatcctaaaatatgatttgtaatttcataatcattaattaaatcgcccaattttgaactttttaatcttaaaacttcggaaaatgattggtctatatttgtgcccaatatatatatatatatatatatataagtataaataataagttctattcttaagaatcattagtatatcctaaaacctgcttttggcaatcaagaaaataacttgcaaaaaacccatggcgaacctaatcttcactaaaacagactccagaaaaagagtgttccaagcaaaatcttgatgatataagagactccagaaaacaatcgtctctctagtgagcttcacatatcaacagtgtataagtttttgactagcaaaaaacaaatatcgttcacatttgactgatacatcatacaccaaactgaaaagacagcattccccaaatcacgtatagaatcttaaatcatataaaatacattttgttctttgctttgaaatatcaaatgttagtgtgatttgtcgtcatgcaacgcatgcatataatattaatttattatttgatttggtaataagtctctttatacatgcattgaatccaccgaccaagtctactatatgctttgaaagtttgaattatataataatagaaaagattgttgtgaagagcaagctgaatcgatttggagaattggattccgatctggttttataattgttcgactacaataatgtcaaatgggatagcaagaaaataatgtataaaggttgaaattgcgcaacacctaacaaaagggagagaaagaaaacaccccaaaaacaaaaaggtagaggaagaaacacataaaagaggagtgaaagagaaagaagcataaaaagaaaggaatagaaatagagcaccaatcaatgacttcaaattcaattatttcgaaacaaatttttaaatttatagattactaaaaatcaacaaacttttatagaataaatttgtaaatctatgattcattagctaaacaactaatttttacacactaaaacaattcagagatgtgtacaaataaagacatgtgttaaataataataattatttgtaaaaaaatgagatataaaaaagtagatgcaaccaaattttttaaaaaaaacctttaaaatgccataaaaccattctaaaagtttataactgtatatatagatttgttattaattattttatatgttgctattcatttattaaatatcatctagttgttcaccataatccataatagggacaaaatcttaaatacatttcatatcaatttttttctttcttacaatctgccaagttaaagaaattcacaaattataaaagagaaataataaggtagtattaaaaatttaatactagtgactatcaatagatagtaacaaatactaatataagtatatattaattacgcgttatatataccttttaacaaaatatattattgttgttgactgatacagagagaaataaaaaaaaaaacagtttcgatttttgttattgcaacaaaaagtttcggaaaatagagagaaaagagagtgagtgaggttggtgatgaccagattttgaggcttatcaatagtacaaagcttgcaaaatcaatggcgcaaattctgttggtaagtataagaaaaaaaagaaaagctttttcctttagatgtcatgtaactgtcgggagagcactcacgtgtttctgtctcttcacctgtaaatattctcgccacgtttgctctctttctttttttccccgagaaaacgcaaagacaaagacgtttttttaatttggctatagcatgtggaggctatgggttcttatcttgtatcgtcgttctttgtcttcaatatctttaattcaatgataagcagatcatctctttcttcactcctacacatcgattcacgtcatccacccagaaaaattcatacttcaattaaaaattctgtaagtggaaaaaacacagttggcaaaatgggcaaaagctaataattgatttatctccatttatggctaaaagcctaacactaggctctacacttttcaagtcttttcattttctgggtaattgttgttcaattttagagatttagggtttttgattgttcttctttttctgggttttatctaaattcgtggatatgagaatggcatgtgcgtgaatgtggcctactttgttttcttccttctaatttgggaacagagtttggttgtcctatttattgttactttgtaggtttcactcttttcgacattacttttcaattgcttcagattcataaatctatcttcttctttctttggttgttcagctttagcgtgttaggctgaacatttaagaaccatg

SEQ ID NO: 28335 - DNA, 3003 bp, Unknown
  misc_feature (1)..( 3003): 2750-1469P.txt file - cDNA_ID_2995167; gDNA_ID_1620666; Annot_ID_163952
catcaatgcttcacaaagcattggaaggtgtaataatgatggagacgtttccaaaaacaaccgttgatgtttttgcattggttcttgaatctggaggaagtaagtcttaacaataactcgactgctatcaaaattattttaccagaatgtgattgcttattggttcgcttggacattcgtggagttgattatggaagcaacttattggattgttgtttggcattttctgattttctccaatggtattgtattgcaggtgacctctctgttttgatatcatgtgctagtcttgctttagctgatgccggaattatgatgtatgaccttatcacagctgtttcagtggtatgtgtatgttacaatagttgcattgattcctctgcgttatctcttatgtttattagcattaagtgaagaagaaagtaacacatacattgacatatacaagtgcaccatagtctgagacatgtaaaacgtatagatatctgttaattctttattttgatacactgaaattatgcctgcaattttcgaagtcttgcataggcaaaagccttatgatagacccggttacagaggaggaaggatgtgaagatggcagctttatgatgacgtgcatgccatctcgttatgaaatcactcagctaaccatcactggtgaatggacaacacctaatatcaacgaggtatgcctttcaataatatctcttgtccttaatttgccgatgacggttagagacaaaaggtctttcttttcttagtgttgaatattgatgttattcaactgctttgtttgtctaaatcacatggatattggttaattagactgttcttcattttctttttaagctgttcataccatagggtctatgttgttaacatataattgtgacataggagctgtgcagacatgttaccaaacatttgtatttcaaatattgcaggcaatgcagctttgcttggatgctagttcaaaacttggagagatcatgcgtgattgtctgaaacagtctgcctcagcttccgatgaatgagcataaataactatgattttggattgtagctcagacttggtatgaaaccggttttagctgttataggtaaacggatttagtctaaacctgtgtgtagtttaaaccgatgtatgttttcacataagatttgatggaactagatctttagctatgaaatggatcccaattgcgagtggtatcaaagacatacagaatttaaagtagggaatttcaacaaatcaatcacattgttctttacaatttcaaaaaacttgtggatgatattaatatcagattttctaaatttatacgaaaatggaatgatattaagaatagtatacagaaaaatgaagaaaagagtaactgatttttgcatcttaaaaaagaaaaagtcttctctggttcacacatcacacaagttgggggcggtgatgaaggagggtgtttaggtaatatcagctaacgtcggaacttcaactgatcatgtagtacgtacgatacgaagaagaagaatctaatccgcatgacatgtgattattttggtcagagagagaagagaagacgtgtgtcgcagcaaagtggacagttgtgcccttatagccaaagaagacttcacacgttttcaacaccacctaacaactgtttctttctatctcccacctcttccccatttttgtctttttatttcttcttctagtttctcccaattttctctttgatttttttttgttttttcttgtcttcttgttaagattgatacatgaactaatagagtaactagtaaattctaagacctttcagcattcttgaaatgacaattacaaacacacgataatttgcgggaacatgaatgatagaagacattagaaaaaaaaaactccaatgtataaaaagtttatgaaaaatataataacattttttacgaattattcagttttctgtaaatttttatttatttcgtaaatgcttgtatctaacatttcagctagattgttctactgattaatttctatctaacattttatgaactttatcatttcagtaaccgcaatgcccgtgaccactctgcatataaaagtgtatgtcttcttcacattcaatcacacgtactttcaaaattctactaaaaattaaatgttttttttttatataactaatcaaagatatctaaagtttttgagtcaaagttatgcgttactcaaatagaaaaaaacatttagaaacctaaaataatatctgctcctcctaaaacatttaataacattcaaaaacaagtcaataaaaaaaaaaaaatttacgaataaagcccttaattagtcaaaaatgaacgaacaaaacaaaggtaggagaaagtatgaatggcccaatcggggagattgcagtagattcatacaaatctgtaaatacaattttaccgggtttggtaaaaatcacaatagatcattttttattaataagaaagagaaaaagaatgcaaattcgtggggtttccaagaaatgcaagtgatatatttagagattgagatctgaccccattttttgcttaacacacaaaaaatccttgggcagaggaaaaagtttatagcgactcttttcctctaaaagggtctgtctcttccttcttctctcttcagatctccatttcacggtatccttctctcttccccttgtctctattgacttttatttgctttgatttttatcgatcgtctctgatcttttgctaatttaacttgtttccgtttgttttgaatttactctctcctgatctttggcatgtattttgaatctgctgttcttagttttttatttgatcttgttctcgtctgtcttaatattgaataattgactagttttatttacagatctttgcattatagatcccttcaagtgcgattttaatcgtagattagttttggatccgttatattggactgatgtttttgatgtattttttggtattaggatcaatcctgtgtttgaaacaatg

SEQ ID NO: 28336 - DNA, 3003 bp, Unknown; identical to SEQ ID NO: 28335
  misc_feature (1)..( 3003): 2750-1469P.txt file - cDNA_ID_2995167; gDNA_ID_2926191; Annot_ID_201036

SEQ ID NO: 28337 - DNA, 3003 bp, Unknown
  misc_feature (1)..( 3003): 2750-1469P.txt file - cDNA_ID_2995175; gDNA_ID_2684256; Annot_ID_193124
tattagcgacgagttcgttagccttatcggtgggatgatactcatcccaaaacacatacttacttctgtctttacacaatgtcgacgctggaatacacgttagcgcaggccggattctgtagaacgagcaacacggcgaatccgagttatcaaaccctataatcacacaaacatttaaacaagttaatccaatgatcaaagcgatataattaaaaatgcctttattaacaaaaactatccagcttaatttatgtgaggaaaatgaaacttctgattgtttaaaaaaaaaaaaaagatgccgtttgtgaatgcttcttttgattttatcaaagttttatattaccgtatttttttgggttagtgatgacgtcgttgacgaggtcataggcttcaccaaacctgtagcttgcgttagggagcttggtctcgagatctaggagcattgtggtggcagctttgttgaatctcttagcaagattactcgctttgttttgacaatttccatccaggcttagagctctttgcagtgggatacaacccattggtcctaaaccaaacaccattagcttcctcgctcctaaactatgtaacacctaaaacattacatgcatcacaaatttgtatcagttagatcattatatatatgaaagataaataggtacttgaagtgttgaattagtttagaaaataaaccttgagttgagattcaagtgtttccattaagtagtcgacgaaggtttgatcattgtatttccaagagtcgctatagacaggcatcaaatagttgttaatgaagtcattgctgcctaaagcgacgacgtatcgagcatcttgaaagaacttgtctgcttcttttttccctatctttgccacaactacatcttgtgtcccttggaataattctatttgcttccacagcgaaaatctttggatcttcacaaatacaatccccatgaaaaagaaataaacatttttagaaaatcattatcatttctttgatgaatcttattcatttatttttatgcaaataataatgaaaacttattatttcatgagacttacgaaataaccaccagtttcgttcaagattccaccacctcctgaagcatagttcactccattttcaagtattacatcttcattcattgatggatccaagaaggctactggtcttggcaatccaattttatcacctttaaatttcaacaaacccattataagcttgtactaaaacgtaattcacatgatatatatatcattgactaataattaattccatactcatgacttacctataatgtctgaaacagtgcggccattagtgaaccttccattaggcaaaccattgccaaaatcaataccgtaaaagggcagattcgccgtcgctaaactcctaggtagattcttattgttgcctacatcagacaatgaatctccaaatataaattggactatcttgcaatcgtagccgttgattgcaagaacgatgaataacacgaatatcgcgcagaacttcatgtcgccaaatttgaatgtgtgttgattgaaaaagatttgtttgggtggtttttaaaagggttttggaggtgaaaaaataaggactaagtaagaaaggtggaggagtagtgtgagaataaagtggtgaaggtagattttgagttgatgaaccaactgattttgtttttttctttttaattattgtttttggtttatgtttgattcaaacctacttcaactactctttcctcgtgttggtatcgtaagttgtaaccgtttcttgtccgtaaacttgaaattttggtaatattaaaccttgccgtttatgagctcatattatagcgtaaaaccaaaaaaataaactttacctcaatacggaatatttccttgtagtgaattaaataaatttagacctctatcaaacacttgtagtgattttcctcctgcatgtattcttcacttgctatttcgttactttggcttctcttactaaaaatatctaaaatcatatgtaaattgaaaaatactattcatgccgaaacaaaataaattaaaggaaatatttttgttttcttctaaaatttgcatgctcgtttgtaatttgttttttctcatgagctcagattgggtcaaatatgtttaattatgggccaatttcaagcccaatgcaccaaaggtggaattgctcggactggaagaaattcaggcagatgatcgagtggtatactggtaaatgaccaccaaaagtactgtttaagccgttggacactgaagagcagtttttgtaggtcagaggctttttctgactgaaacagagtaacgtgtctaaaacagaggtagttaatattttgatcaaaatgtgatttgaaatccacactaaatcggccggttatactggtaaacccacaatttgaagactaattcggtctgattataagccagtgtttttttttttacctgcttaaacccgatttagcggtttagcggatcaaattaattttggttgaaaacttcttctactttttattttattttttatacagtaaaaaagtaatagagtaaaataaactgaaatatcctttcttcaatcctttttttttttttttttgagcaaaaaaaaaaaatactgaactatccattgaaccatttttgtgtgaaccagaaattctacggatgttttgagcccataaaaaataatcaaaagacaacaaaatagttacataactaacctacgtggtcaaaaatcagccgattgctccaccaaatgggcgccacagataaataaatacccaaacccgtaactttatcctcatctcatcatcaccgtccatttctcaatccaacggtgtacatccctcggaaatctccaacaatatctaatccactaaatcaaaaacagatttaaacaaaagaagatttcacaaactcaaaacacagagaacagagagagagagagagactccattgttgaagtgtgttcactgaactcctcctcaaacaacaatg

SEQ ID NO: 28338 - DNA, 3003 bp, Unknown; identical to SEQ ID NO: 28337
  misc_feature (1)..( 3003): 2750-1469P.txt file - cDNA_ID_2995175; gDNA_ID_2684256; Annot_ID_138099

SEQ ID NO: 28339 - DNA, 3 bp, Unknown
  misc_feature (1)..( 3): 2750-1469P.txt file - cDNA_ID_2995175; gDNA_ID_811; Annot_ID_144527
aag

SEQ ID NO: 28340 - DNA, 3000 bp, Unknown; identical to SEQ ID NO: 14776
  misc_feature (1)..( 3000): 2750-1469P.txt file - cDNA_ID_2995189; gDNA_ID_2684224; Annot_ID_191886

SEQ ID NO: 28341 - DNA, 3000 bp, Unknown; identical to SEQ ID NO: 1975
  misc_feature (1)..( 3000): 2750-1469P.txt file - cDNA_ID_2995193; gDNA_ID_1620474; Annot_ID_158115

SEQ ID NO: 28342 - DNA, 3000 bp, Unknown; identical to SEQ ID NO: 14041
  misc_feature (1)..( 3000): 2750-1469P.txt file - cDNA_ID_2995201; gDNA_ID_2214694; Annot_ID_189471

SEQ ID NO: 28343 - DNA, 3000 bp, Unknown; identical to SEQ ID NO: 4065
  misc_feature (1)..( 3000): 2750-1469P.txt file - cDNA_ID_2995209; gDNA_ID_1620681; Annot_ID_164434

SEQ ID NO: 28344 - DNA, 3003 bp, Unknown; identical to SEQ ID NO: 17209
  misc_feature (1)..( 3003): 2750-1469P.txt file - cDNA_ID_2995209; gDNA_ID_1620653; Annot_ID_163531

SEQ ID NO: 28345 - DNA, 3000 bp, Unknown; identical to SEQ ID NO: 17210
  misc_feature (1)..( 3000): 2750-1469P.txt file - cDNA_ID_2995209; gDNA_ID_2926186; Annot_ID_200620

SEQ ID NO: 28346 - DNA, 3000 bp, Unknown; identical to SEQ ID NO: 11085
  misc_feature (1)..( 3000): 2750-1469P.txt file - cDNA_ID_2995213; gDNA_ID_2214478; Annot_ID_183214

SEQ ID NO: 28347 - DNA, 3003 bp, Unknown
  misc_feature (1)..( 3003): 2750-1469P.txt file - cDNA_ID_2995217; gDNA_ID_2926191; Annot_ID_201061
aaaaagaaaaaacaagacacacattgaactgatataagatgatgatgatgcaatagtacctacaaaatctagtggacgccgaacagtactttaattcggttttagaacattctgaattgaaggcctattaaaggcccttcttgacacaatctagttacacgacttacgacggtgcagctaaggctatttcggtaatttcagcttctcctttcctcgatctccaagtattcgagaaacccccaccaaggcaaaagctctgtcgtcgtccacaagaacaaccaaatttgtttccgtcttctgctaacatatcctctttttcatctgggaaccctaatttcttgactaacttagggttttatttatccatttgagatactctgtaattgaaaggttgaatttttagaagagacatgggaggttcgtcggagacaaagatcttacaagaactcatactttacgcggcgagcgctgctttcagctgcttggttctctttgcgggtcttcgtcatctcgatcctaatcgtgaggcttctaaaaaagctctcgagcataagaaggaaatctctaaacgtttgggtcgtcctcttgttcagaccaatccatacgaggtaatctactatgaattaagcatcttagaatcctcactggttggtagctacctgagaatgcgatatgtggtttcgataaccaatttgtattggtctctctgtttaatattgaaatttggatacttttgagttccaatcgtctttttgcgcaaactcatgaaatgagctcgagaaattgctcactagtttctaattttgtgaataggatgtaattgcatgtgatgtgataaatccagaccacattgatgtggagtttggttctattggagggttggagaccatcaagcaggctttgtatgagcttgtgattttaccactgaaaagacctgagctttttgcttacgggaagcttcttggacctcaaaaaggtgtcttgctctatggacctcctggtactggaaagactatgcttgctaaggctattgccaaagagtcaggagctgttttcattaatgttagggtttcaaacctgatgagcaagtggtttggagatgctcagaagcttggtaagtgcatattattattttgtgtgtgataaaggaacacactttgagtaggcctgtcttcatgctcgtcgtgttttcttcctgtgcttttatcagcttcacattgtgcaactttgttggcagttttttgttttttgtgtgtggttattatatcaattacactttttttggtctgttgatggtgtttctaatctatgagctgctctgttctgtttcgttctctcagtttctgctgtgtttagcttggcctacaaactccaacctgctatcatttttattgatgaggttgagagctttcttggtcagcgccgttcaacagatcatgaagctatggccaacatgaagactgagtttatggctttatgggatggattctctactgatcgtaagttgaattcttcactgttcggcttactttgccatgcagactagtgtaacctggagtatgtgggtttcttatgaatagaaatggttgcttttgtagcgcatgcaagggttatggttcttgctgcaactaacagaccgtcagagcttgatgaagcaatattaaggcgtcttcctcaggcctttgagattggaatacctgatcgccgggagagagctgagatattgaaagtgactctgaaaggagagagggtggaacctgatattgactttgatcacatagctcgcttatgcgaaggctataccggatcagacatttttgagctatgcaagaaagcagcttacttccctatcagagaaatcctagatgcagagagaaaggggaaaccatgtttggtaagtttaaaaagaaaacatggtccactgaaatgttcagtgttgcatccactagtttcaaggtactgatgttatgagtttgtcacgtttgcaggaccctaggccattatcacagttagatttggagaaggttcttgcaacgtcaaagaagacacaagttgcagcaggcgagtactcattgagctcgcagtcctcggcttggagaggctcaagggaaccagatgaggtccaggcagcgataagtgggatctcgaagcttctagtttctcagatcattaacctacagtcagaatctcaggattcatggcagcgggatcccgaagaagattcccgatgaaattccggatcacttttataaacgttctggtgttttcattggaagtttagaatttgtcacacacttcagtttattctgtaaaacttttcttttctttttggtaggatcatttgataacttatgactgtactaaaaagtctctcaagtttctacattactgaatctctcttgttcataatatggccactgttctcactcatgggttacttaagtgttaactctttcttcactttacttaatcgttaatggaaccttgatcaatgtgtgaagtgattattctgaatgtataagtttcatacatcaatataaaaatctcaactttgagattgttattagcgcacattgtgcaatggtcaatggtgtcatctgggctttgctttgctttgttttttttttgactgggcttgtatagctgattagagagattaaagctttgttttttttttgactgggcttgtatagctgattagagagatttaaagttcctcccttttctatttcccaatttcgtttgttacttttcttgccttttccgtcgatcttcttctccaacacaacaacaatcagatttgcttgattcaattacgctcttaacatcagcttggaaggtaactactggtctcgcaattgtgttgtagttctgggtctcagtttttctcactggctcgctcgtactcttgatttctatcgaaccgagtcctgttcttattcactgaagcattacgtctgattcagaaatttattagctttggatttggttatttgtttcatg

SEQ ID NO: 28348 - DNA, 3000 bp, Unknown; identical to SEQ ID NO: 7580
  misc_feature (1)..( 3000): 2750-1469P.txt file - cDNA_ID_2995898; gDNA_ID_1621153; Annot_ID_173320

SEQ ID NO: 28349 - DNA, 3000 bp, Unknown; identical to SEQ ID NO: 7027
  misc_feature (1)..( 3000): 2750-1469P.txt file - cDNA_ID_2995955; gDNA_ID_1621123; Annot_ID_172144

SEQ ID NO: 28350 - DNA, 3003 bp, Unknown
  misc_feature (1)..( 3003): 2750-1469P.txt file - cDNA_ID_2995970; gDNA_ID_2214543; Annot_ID_134512
tcacatgaattttataagcattatttagctgggaatagtatatactccatgatattatttattgcatatggttaggagagtttatatgtatgtctttcgcaacatttaacatttagagttcatgtttccatgcttttagaagaaaaaaatactatcgattaaattatttttagaagttaccactgaccagtgacaattgtcataataaaaccattaattaccttctgtgttcagaggattcttgtatcgactttttttgttaaagaacctgaaaaaagtctcctatgaattaattgagaattcagagaaatacatattaaaaacttatccatgtgctatcaatagaacgttcttaagaatgtttctaagcaacactttgtttttaaaacttatttacaactatgtcactagacatatgtttaaaatttgatcataataaatacatgaaatgtattaatatcaaagaaaattaactatttgtatataaaacaaaatcatcttattttatggagtacctactaatattagtgtttccacgttccactttccactgactccgatttgctatcataatatttgtctgtcatatcagttgatttttctgatattccatttccaccaaagtaataatgtgaagaactgaaccactattgtgaccgacgtaaaaacaacattactgttgcgtattatgaccaaatttgatacaaaggaaataattaaaaacgacaaattaccagatagtattagtttatactccttatcatgcattgatgatgcatatatcaaaagtagaaaagagaaaaaaagaagaagaagaagcagaatctagggaggctatttaaagtatagaagaaagaaaaatatgtagcagcttctgagtgtgaaatgctgtgagattgtgttgacttgagataacgattttaatgaaatgttaaaaaattgggagatttgtatcgcctcacatggaggggacacacaccaatagattttgggaatgagtcatccatatatactagaaaattaatcaaaataaatggcgttaaaatatacaattattttccacccattatattctggctctgagtactattgttcgttttaagattaggtggatacttaaatttcttgtagatttttccattcaaaatctattagttatacatgcatctcattgtattttacgatttttaataatatttgtgaaaatgcatctcatattaactcaatttacgtaacataattttgatctccgttttgcactactgaagctagaaaaacataaacataagacaaaaaccaaaaaaaaaaaatccttttacgaatgagtgagatcatccacacaaattttgatggaattcaaaagaagactaatgttaataaagattaaggaaaatacaaaatatatgaatctagctagtggacaaacaattgtatgtttcttatatctggggcacccaagcagctaactagtgtttcaaaataaaaacaaaagaatgtccacataatattaggatattaatacttaaatctagcaagaatacaacaattgtatgaatcttatgtttggatatgcaagccgccagctcatatctccatataaaaccaaaaaaaggtatttttggtaaatataaattagataatacaaaataagtagatgtggatatgtatgtataatgtttaataaatttggtccatgtagtgttaatatgtgatgttacatatattgataaataggttaggttatagcgcacttaatgattacataaattagtgagtgagagatttaatgtgaatgcgaagaaggtggaggagaagaatcaacaatttgattggggtttctgtaaatttgagttgtaagctatatattccccactaggccactaataacggttattttttcttcatcactattcttttgggtgaaaaaggtaacgattataaaagaataaacattatgatctttttttcctccccattttgactttcgagtatagagacattatagcattcataaagaaacacatttttcttttatctatatcgcatgccgcatgcgccatctatagcattcatacgaaacatatcgagttttatctttattccatgttctattgtatcaatttttgaagaggaaatgaaatggtggtaatggattatattaaccaaaggccattgttatagacttatagttttgaattaaactcacggtatattgttttagggtcatacactttaaaagcttacgaagcttttgactctacacgtgttaaacattaataattacagtatatcaaaaccaacaaacatttgaaattttgaaacagaacagaacagaaccatataacatttgtctaacctaataatttgtagctggcatgacggctaatctgttcgttttattgttgttacttgtcgtcgttgtcgatgccaaaatcatgttttttttgtgcgtagtcaatggttcaacgatatattttagtaatgaattcctataatttcttaaaattgcaaaccaataacgtcagtacacataaataccatgggcttttcggtgccttaatattagtgggcttatataggcagaaacatacacttttcccccaaaactagttttgataacatgggcttttcaatgtttaatattagtgggcttatatcaatctaatgaaatttgaagagaagagagagaggaacctgcgggtcgttgactcgttgtatgtttcggcccatataagcccagtattaactgaaaataaaattagtttttttcatattaccatgcatgtttttttcggcccatataagcccaatattaccgtgcaagttttttcttattttttaaattttatctgaaagtaaaattgaacagagtaccgatgacgtgtcctaactcccaagtagaagaagaagaagaagtaaaaaaaaaaaaaaaaagatctgaaagaaataaaaaacgaatcggaagagagagagagagagagagattggagctagttggagatg

SEQ ID NO: 28351 - DNA, 3003 bp, Unknown; identical to SEQ ID NO: 28350
  misc_feature (1)..( 3003): 2750-1469P.txt file - cDNA_ID_2995970; gDNA_ID_2214543; Annot_ID_185296

SEQ ID NO: 28352 - DNA, 3003 bp, Unknown
  misc_feature (1)..( 3003): 2750-1469P.txt file - cDNA_ID_2996012; gDNA_ID_1620555; Annot_ID_160427
accataacagaatcttaaaaccaagtcgaacccatctgacccacctggaaaatcttcaacctcgatgatgattctactgttcttgtgattctttttcttcttattgctctgttttatcatcttcctcaagaagcctgagtactctgagatcaaatcctaacccaagaaacagagaaacagagtttaattcagaaaatggaaacagaggaagttagggtttgaattagtgtggagatttgatttggtttattacctgattgacgaagaaagtaaattggttattgagattgatttgaagatcacagcaaagagacattgtatcaacttcttttgcatttggtgaagatgaaacttcttgtgagctttcttgttcttgttcttccttttggattggagagagagagagagagcaataatagttatcacatggaaacggctatttatatatctctttttcggcgtctttatttcaattatctaatgtacactttcttttatcatcctttataactcatataaatttatgcaaaaggaacttatatacaaacgtcatcgaaaaattgtataaactggtcgcatggaccaacttgtaaccctagtgtgtagaccatctaaaatagtgaaaatgtaataatttgttgccgtttgtaatgaaaaaattattgttcgttattgtttagtttttttggtattagataataagattcattgcttaatcgaaatgtactatatgatattaattttggagcaattagcttgacatgcatagtttacttctttacattagaaaaccttttttctaacatcgaacttaagaaaagttatataaactgcattaattgactgcatgtttattttgaaatccatataatcttgtgtgcagagcacaaatcaatatgacgaggcgttgttagttgttactaaaaataaccaggtgcaaagattgattccttaatgcttcattgatcaggatggccaaaaaataaaataaaaattggtgttagaggaagaaaaaaaaaatacagtaggtgggtaaacaaacagcagggaaatagcttacaatttgttgagaataattcataattatgaccaacattattcaggttatttggggtaaagtaaaaatgtattgcatcaaatcaaataagatttacattttagacagtgaactataggtcacgactaatatcaaatatatatttccagtagcacagaaaatgatgcttcatgaactctcacttatgacttgtcaatagctcaaggactatgctactcaagttgtaatatatatattctgtatttatatgctgttttatacacacgtaacgtatatatgaatgtgccccctttgtttttatgtgaattataaatattctccctttcttggcattacattataaattcgtaatactattattccacttccatgtaatttcaagagttttcttccctttttatttgtagaatatttatatatcagttgcttgtaaagttgggagtttcactttcattgcatgtgaatgggccgggtagggttttatgactctaacgtttgtgaataaagtcgactacttgcttttcatcattatccaaatccagccatgtaaaatatatgtaattgaaaacgatatatgtaacaaaaatgttataaaaaaaagatacaccaatgtcgatatacattacgactctttgagtacaaaataaaaaaatatgactaacttccgataatagtttttatttattattaaaaatgaagtttccaaataaaatatcattttaatatccatacaaattatgaatagtatgtgaggtttagggcaaagtcttctgagggttcatcaatgggatgggagtgggacgaagaaacgaaggcgacgagaggatttaggttttattgttttaaaatttttgtgctctagtatttaagccctttaacaggattttacagggaccaacaaaaatgtaaagccccaaaggaagaagcccacttaaaaaatactaaagtaaaaataaataattaacaggcccatttggcctcatcgactaaagctagcccaaaaagaggatacaataaaattacataaattttgtgtccttttcgatttaactttttcttttagaagaacaatcctttgtttttttgtgcaaatctttagaatctcgagaccaaaacttaagtaatcatcaaaaattttgtcaagtttacatttctatgccaaaaattatacaatatcataatgttcaagcagtgctctagagagcaagaaaaaaatggttaagacataaaaactagtcggctaacactgttcaagaaccatgatttatttgcttcatcaacgaactgattataattcaaatattacaacagagcggcaaatcattcgaaacgcggtacgaacattaaaatttgatgtgcattttggccaaaatatttgttgatggattcaattgggtagtggaagaagaaactgtcaaagtacacctactttgcagtcaagttgtaagaacataaagtacgtatttttttacaatttctaaatatactaaaagcttgcagaaagtatgtatatctagaagtacgtatctcttacgtttgtgaaaactatttttataatttgacaattttaaatgatttgattattacacaaaaatagtcgaggttatgtaaaaatattttttaaaattttcgatattttgtccggtacaattatgtcaccatctcgattcaagatataaaagagttaatttagtttcacaataaaaatctcgtacttacttttcaaactttataattgtgttggataaaaagtacaattgaatcttttaaaatcaacaatgagtgtctgttttgataaatgcataaattggagtgaaaagaaaaaaacaattccagcttttgcgaagttggacatattaaattctacacaattgtttttttttaaaaatacagaattgtagatagaatgaatattgttttttttaattaaaataattgaaaaaatg

SEQ ID NO: 28353 - DNA, 3003 bp, Unknown
  misc_feature (1)..( 3003): 2750-1469P.txt file - cDNA_ID_2996054; gDNA_ID_1620405; Annot_ID_156095
tcctaatgaaaggatatttacaaaaagtatacataaaagaacagaaaattaactgacacaatatattaatacttatgcagtacattagtaaaaaaaattacatcattattcttatgccttttcattttttatctttcatcttaaaattggttaacaattaaattaccgagttaaataaaactttatctagaggtagtgataatattaatcttattggaagagattcatattttgcacgttatagtaacttgttaatttttttatatgatataataaataagttaagacggtaactataaatatatcacataaattataacttatgacgatacaaaataacttagcatgatataattataaacttattgatataaatattttgttatcatgttaacctaataagtattaccgagatatttgttatcatgttattctgataatacgttatctgctaactattctgattcatgtattttttacatgattattaagtcgcaagtcaacttttttgctttatatgctaaatattttgttactttttaataataatgttatcgtcttcgcatatatatccgtataataaccatattgtaactatgacaattttgtaattaatccaaatatgaaagatacttttggtttatattttttttctctttcatatttacctaatttttaaattatctcttctacttttttaatttcaacttcttctaagtatataaatttaattcacccactagattttaacccgcggtataccgcagagacaatttattttttaaattagtatatataaaaatttacaaattaaatctatttatttttattttatagtttacaattgttattaaataacatcctgccaaacccgtctcgccaaatccgtcccgtaaaaaaaacccgccgtacaccactaatttaaatatataattaaaataaatattttatgggattgcaattgtattttagtttgtcaaacaaatatttgttttaaatagttgccaaaatctagttcaaattttggagaaaaaagatttattggatagataaagaatgtatttaggtgtgttttgttcattttaagggattgcaattatatttttgtttgtcaaatatttattgttttaaatagttgctgaatactatgtgcgtgacatatgagattggaatatatttggaatatttttagtttgttaatcaaattatttctggaaaaaaatcaataattaaaatggcagtcattgtaaataagtctaaacttcataatttatttaacaaaatagctgcattatatagacaataaaatgactttttttttcctttgtttctcatatattgatagatcacataatttattgaattaatatatacaaacaagagttccactaattcttatttgttatttcgattccactattcaacaaggtccacactattattagaaattcaaactatacttaccataaatatcgaaatcacaactagtcagtcacacacctattctaacattagaaaaacaccgacctcattgcaccactattatttgtagttgtacctcacaaagcacctccctcaaagtcttcgcaaaaacgtcacccaccaccacgaaaattcataaccaaataaaacgacaattttgtaattcttgatttaataaaaaaattaagtaaaaaacaatattcttaccattttgtcgccatataataagaagaagagagacacaacacaacacaagtagtagaagtggtgtagtgattacggtgtaacgcttattccaaaaaccccacgcgcgtagggcccacctctcccccgaatccccatgattttctttaacgtctctcgagtgctggtgggacccttgttttatggaaccctgatgtagttttatgtactttcatttgtgacccttatacttctgttaattacaatcttgccgctattttgttgcttccttcttgtttttgttaccttaaaacttttgtttgaatgccttcagaaaaagtttacttctctttagacggatgtgatcacttgttcaatgtaacaccaccgtaagttacagtggttaaaatgtctggtagaattatagctgtatatatttattgatctctaaaaaattagcttgtagaaattattgtctttaaattgttagtaggatccatccaactactacttaaaaaaatctgattagtataagatatatttatgattaatagaaaaataatttttgtacaagagattaataactaagatagtaaaattctatcatttcatttctaaaaccaaaatagatgaaattaataaataaataattattgatttcatgtgtgtttaaacaatttttttttgtatcacattatgtaaagtaacaagttatcaatttcataaaaaaatatttacgataattacattgttttcttaatttttttgtcgactatatatcttaaaaataatgttaaaaatgcaacaattttgacagtaattcctaatcatacgaaaattttcaaactttgcaacttcttcatgtattattgcattgacaatcagttaataattttactttaataatgttgtctaagtaaaaaagaaaattaaaagttaataattgaactaaaaagtgaatgtcgaaaaaaaacatttaacttttttacttagctctctcgaaagttcctcaaaaaccgaaggacgagtaagtcacgaaaaagaccattttgtaacgcctctctatcaattattcctctatgtgtcaataaagtatatttctcaaaaggaaaacaacaaaaatggttttcgatttcttgtactttcaaaaatagcataaaagccaatagattctcctctctcaaagtttcgccccttgtttttactttctctctcttaaaccccaaaaaaaaaaaaaagatcttttgctataaaatcccacttcacactttcttcacatcaacaacaaaacctctctctctttcactttctctctaaaaaccagaaaaaaaaaaaatg

SEQ ID NO: 28354 - DNA, 3003 bp, Unknown; identical to SEQ ID NO: 27149
  misc_feature (1)..( 3003): 2750-1469P.txt file - cDNA_ID_2996092; gDNA_ID_2096294; Annot_ID_195496

SEQ ID NO: 28355 - DNA, 3003 bp, Unknown; identical to SEQ ID NO: 27149
  misc_feature (1)..( 3003): 2750-1469P.txt file - cDNA_ID_2996092; gDNA_ID_2684204; Annot_ID_191338

SEQ ID NO: 28356 - DNA, 3003 bp, Unknown
  misc_feature (1)..( 3003): 2750-1469P.txt file - cDNA_ID_2996092; gDNA_ID_2684204; Annot_ID_137277
tttggtgtggttcaaatttctttcaagaaacctctgtctttctaattatattgatatcatttttgtggtgtttgtggccagtttcctcggtacttgagctttgttaaaggtgttgtggactcgcatgatctcccacttaatgtatcacgtgagattcttcaagaaagtcgcatagtaagcgctcatatccaattcgtatgcaaagcctttatgatatatgttttgttttaagtgcaatgctatgttaagcttacgattttgtattgtgtctccaaggtgcggatcatgaagaaacgtctagtgaggaaggcttttgatatgattttgggtatatccttgagtgaaaacagagaagtatgtttcataactcttgttcccctaagcttacagtttaaccttttttaattccctttagaaatcactgctacgttctggtgatgattttcctgacgaatgagaatggcattgttaacctatacaggactatgagaagttttgggataattttggcaaacacttgaaattagggtgcatcgaagaccgtgaaaaccacaagcgtatagctccactgcttcgatttttctcctcccagagtgagaatgacatgatcagcttggatgagtatgttgagaacatgaaacctgaacagaaagccatatacttcattgcttctgacagcattacaagtgctaagaatgcacctttcctcgaaaagatgctggagaaaggacttgaagtatgtgttgttcttctgaatggggcctcgttttgttcttccttgcaaatattcctattaactcagaggtgattgacatgtatttctttgtattgtgaacgtaggtactatatttggtagagcctattgatgaagttgccgtacagagtttaaaagcttataaggagaaggattttgtagatatcagcaaggaagacttggatctaggcaagtgcctgatgtaattccttgatttagcatgtcaggtaatcacttatgtataataacaaattctggctttgatctttgtattgacaggagacaagaacgaggagaaagaggcagcagtgaaaaaagagtttggacagacttgtgactggataaagaaacgattgggtgacaaggttgccagtgttcaaatttccaaccgtcttagttcttccccctgtgttcttgtatctggtaaatttggttggtcagccaatatggagaggtaagatctgacctttttcttaagcaaggatttccgttctccttttttgcccctggtgaactaacacagaatatgttatctggacaggctaatgaaggcacaatcaactggtgacacaataagcctcgactacatgaaagggagaagagtgtttgagatcaatcccgaccactcaattatcaagaacataaatgtgaagtcaccattcatcataacttgtacctggctattataattaaatctaggagccgctttttgagcttggcttgtttttttcttgcaccctgcaggctgcttacaatagtaacccaaatgacgaagatgcaatgagagccatagatcttatgtatgacgcagcactagtttctagtgggttcacggtgagtcctattctacattaacattcttaactttttgttgtctctagaattgaaataaagtaaatactggtaaaacttaattgttgtttctcaaaactacagcccgataatccagcagagctgggtgggaagatatatgagatgatggatgtagctctttccgggaaatggtcaagccctgaggtgcagccgcagcaacagcagatggcacattctcacgatgcagagacgtttgaagctgaagtggttgaaccagtcgaagtggatgggaagaaatgaacacaagcctaatgttttatgtccctgctacgattctcatcatattcttcttcttttattagtagtagcagtaaaagtagaaccccaaaactcagaacaataggcaatgagcgaatgataatctctatttatgttggagagattaataattgattgagcttgtttttgttccagtttgtgttgatcctcctcggtataattttaataaccgttaagaaaaattcagttggggtgtttttggaaagatttttcgagttttatctaacaaaactaaaattttgggacatatggtaatttttaattaaatagagggatgttgttatcgtacgaattgggttggtttaaaactttgtttggacagattcgactcaaacgttgaacgcgtttaaaaaagtcaacaaaagtcgaaggttaccggctggtcaggttaaccgttagagattaatgaactggcagctgtatgtcttttttatagttctgtcttaacaggcaaaaaagtgtttaatttatctttcctttgggtttctcacggagtcacggttcctcgttcgtcctctcccgtcgtctctccggtgagtccttaattttccggcggtctttttccctttctcgtctgtttggtgctttctttatgtctgaggcgaatacagcaaaacgtatctgttttggttgttgagttcgaggctggtcctgaaaattcggtgacaaaaagagtcaataactctcgtgatcgagttggatgcgttgttttgagggttgattcagtttatgactatgtattttggtacttgcaagattttctgattttatgaagattcgtgtttgacttttatagcgtataatctacggggcaaacagattcgagcaacttgtttttttctagcgcttgttttgtgtttactctgtcatgtgtttgtattttttgagcttccactagtgattaatcatctcagctcaatttgaacataggagatgtagtttttatctgtcggtggatttctagggattttgcaaaatgttttgggctttcctgaattagtatgtgatttggtcgtaaagtattttagggatttatgtgttccttggggtgaatctgacattgacattatcttggtgtctgcagcactaaattgatg

SEQ ID NO: 28357 - DNA, 3000 bp, Unknown
  misc_feature (1)..( 3000): 2750-1469P.txt file - cDNA_ID_2996123; gDNA_ID_2926234; Annot_ID_142721
tgggttgtttggtttaacaaagattaggagagtagttttaagtcaatttaagtttttgtgtagttaaactaattaatcaacgtgttttcttaataattcaatttattcaatataatcaatttaaagattttccctataattgtttttataaaatacctctttaagtaccattaatataaatgagaactttatacaaaattctgttaaagtaattatgcaacgtgtttttattactaattaaatttatttattagtatataataagatagctaatcagatatagtttaaagagtttccatattaatttgattataatacatttgcttataaacaaagtgaacataaaatttatgtgacattttcaaatcaaatctgttgtaagcaagttttcaattttttaattaaaaacaataatgagtttcttcaaactattttttgttgtattcttttaggttattcaagacgtaattggggtattttatataatgtagtactttcactaataacaattttccaattgtgaaaattgtaatacttttaaattgagtgtgatcaacattttaaaataaattataatttaagacagattttgttaaaaatcagaaaatgttgaggattatttgttttatttgcgtattattttatttatatgtttattgtagttttggtcataagacagatatggtgaaataaatacaataatgggaatgagtgccgacaaatccagctgttttaatggaaacgatacctgcttatctccttgtccctctataccactgttactaataataactataatgatttgatattattttattcttataaatgacgtggccgatccctcaacgtgactaaatcctttaaaagtctaacaaattatttaattgtataataaattaaagcttcaaatcagttttttctttttagattcttctcgaaatgcgatagaacattgtagatatgtcaatggtgattgaaacctaaagtttaggatgtgtttgggttttaaggccaaaaatcaaaatcatataaataggatatgttttttagattctgctcgaaatgtgatagatatgtcatatggtgattgaaacctaaattttaggatagggtcaagatatataggttttaaggtcaagtccatataggttttatagcttatgcatattgattcatgtgtttttgtagacttgtaggtttttagcattataggtcaactcatacatttatcatttttaaaatctcaaatattattatttagtattgaaagttctgttttttttttaaaatgtaaaatcaacgaaaaaagtaccataaattacgaaaaaacttagtttaagatataccattaaaagttttggaaacagaaaaaaggaaaaaaaaaacgaaaaaaaaaatgtaagcgttgagtaaaaggatacttaatcattcataccacttgctaaacttagagacacttcttatacatacatcttgtggtttaaaagttttcaagattttgaggtggtaaataattttggaaaacaaaagagagctagcaagtcattgccacctctacgaactatcaatctagaacagagaatcttaggtgttgtattttataacttgataaatttagtgtgttcgtttggtcgtcgtaagttgcagcggcagacacaaatggtgatgttcgtttggtggatgcatgccgatgcagtaaacgtaagtcgttgcggctaaaaattattatcgctaattaaaatcagcgttaaacgattaaaagctgcgttatatgtggtaaatgacaagactatccttactatgtttgggaaactacaaacaaacctaaccttattttttcttcttctttcatcatttctttcttatagtcatcgatctcaagttctttgaaactaatctctctccgccgtctcaatctcgctttttcggtgattttagctcaattagatctcccgtcgttagttacttctgatacgacgttaaatatctattccgaggtacttttgttattcactgattcaaatctcttgggaattttgagtttctttttgatttgtgtttttttagctactcttagtttggtgggtttattctaaatttccaaattctatgtctgtttctgtataatgggtctgaatgtttggaactaatacttacggtctttttcactatatggttctaaatcactaatgcttacttgctttaaatcatatgttgttctctactctttatataaccattggagttaattggatttagatttgcattgcccttaacataaacatctgcggcaacggcagagtcggcgtcagcatcatcaaacaaaaataaattatacgtcagcagcgacgaaacgaacaataatctgtggtaaaatttaccgttgtcgcatacggtgacgaaacaaacagactaattatagttgcaatggtaatttattggtttactataatattactaggtacgagtacgtttaaatgagaaatgtatgaattagttagaatattttgttaataattcgttgcaattatgatttgttggttttgttagatttttttttaatgggattgtcccctaaaaaaactgaaatccaatcacatttcttactttctcgtttcgatttggtttattcggtacggatacagttaaaccgggtaccttaacccaataatgggtagcaaacaatggcccgcttaaatttataccactaatgggcctctttcccaactttaaaggcccataatattttgaaaaagaataataatgagttggcttacctgagtaatgacgtaagatcacggaaccacgccaggatccttccgccgtcggcgacgtcgctcctgacgtcacctcaacacgtaaaccacacaattaagtttattcctctctctctccgtcaacttaaaccggtgtttgtatataaatctgattgatatagaaatcgaaactcaaattggagaacattcgagaagctttggatttttgaatcacgaagacatg

SEQ ID NO: 28358 - DNA, 3000 bp, Unknown; identical to SEQ ID NO: 28357
  misc_feature (1)..( 3000): 2750-1469P.txt file - cDNA_ID_2996123; gDNA_ID_2926234; Annot_ID_203805

SEQ ID NO: 28359 - DNA, 3000 bp, Unknown; identical to SEQ ID NO: 1367
  misc_feature (1)..( 3000): 2750-1469P.txt file - cDNA_ID_2996260; gDNA_ID_1620393; Annot_ID_155667

SEQ ID NO: 28360 - DNA, 3000 bp, Unknown; identical to SEQ ID NO: 11673
  misc_feature (1)..( 3000): 2750-1469P.txt file - cDNA_ID_2996267; gDNA_ID_2214509; Annot_ID_184207

SEQ ID NO: 28361 - DNA, 3003 bp, Unknown
  misc_feature (1)..( 3003): 2750-1469P.txt file - cDNA_ID_2996308; gDNA_ID_2936564; Annot_ID_194572
aagggtaagttaaactcttgagttctttgttaaactaagatagatctatgggggttggtctgacacaggataaaacctaatcccctgatccttgcgacattgcctaacgttgcgaagtgcatcatcaacaacttgcttatcctttttacgtttagagcattcaccaatctccattttcgcttttcctttgcccttgaagtcagaagaagagctagaaaagtgattctgaggtataggtcttggattaacaagtctggaagcctcagatccagcaactaagtgaggttcatgagaagctaaagatgctggaggaagaggctgtgatatcagtgatgcagaggagatgtctgaactgtctgagctagtcatatgagtttgatcagtgatagtgttagaagcagcaccttcctcccaaacaggtacatcaagtacctccacctcatcatcatgaatcacaggtgcattaagaaagggacagttgtttacgtgatgagtgatacgacaacaattagtacatatccttcgaagcttctcatactcaaacccaatcatagcaccttctctagattcaaaacgaactctccgaaaaaaccgaaggcggtcagtgaatacaagtctgatcttaacacggataaaggcaacataagtggaagtgtcttgattaaaatccagttcaagaacaggcccttattaacccttataaataaggaaaataataaagaatatcctagaaaggccgacggccctaatccgtaagaaccatgataatacaagctgtgacttgtgagtcgcaagaactgggtaatactatattctcaaaatcactcattagagggaggaaagacagaaaattgttaaaatattacttattttggtttatattagctgcaagcatatttttctctcttggttttgcacccataaaatctaagtaggcatttgtagtatagctagagttagctcacattaactcagttagagtcctcatgcaatatttgttatgttaaactatttctcataattattaaccaatagtagttcatcaaattttaaaattctcaattaatgattcttgaaattcataattttataacatttattataaaaaagtatacagaaaatcaatctttttgatagaaaaaaccccttagaaaatcaatctttttaatacgtagggaatatatatttacttcatttataaataagtaatttaaaataacatcacttagttttagtttaattcaactctttttttttatagttatgttatgacttatgtttcataaaagagaaaaaaaacttgtatgtggttactataaattaagctgattttgtagctttgaaatttgaatgtagccttatgatttgagtattgatttttggatatcaagttatgaaacttcaaaaaactttctttgtgtattagctgttaggtttgcacaaaaagaagaagctattaggtcatcaatttgttgagttcttattgtttgtcagctgactcagctccaaagatttttaaggatgtttgtatcatgagaaccgaggtatttaccattgtaagtgaagtgtaataagactaaagagttttcttagagcatcattatttgtgctatcttagccaaattcttagagcacctttaatggggggggggggggggggggggggtttaaacaagtttcttaacaaagaacaaaaaaattatatgatttaaatattcataagtctcttaactttgatgaaacctaggcaattgtctcttagttaagagataattggtcttggtttcaccaaatttaagagacccataattaaaaatattatttatctatacttatactttaattttgtttaagagacttaggcttaaaaactaccattgaagatgtttttaggttaagatttgtgaaaaagaactcttatataagagcttttaggcttatataaaaccttttttttcacaaatcttaccctaagatttgggtaagataccaccaataatgttggtcttatatgctaattcatattaatggatcccatgtattttttttttctagattttattctagcataaaaatagtttataacctcttgtatatgtaatgtcaaattgtcaattaaatctattgaagttttggaacctcataattaggataacgaaaagattcgtagtaacatcatttgtctaaatatcttggaatcttacaaaatgatatgttgtttcgaagtggatatatttatgaccattaacaatagactcatgtaacaatcaatcacaaaaacaattcattatgttgttcaaaatctcaacaattctgaaagtacaaaaagtttatggataaatgtaaaatctttaagaaaaataggggtcaaaagtgttataattttgaatattaaaataaaattaaaaagtgtattttgaccggaaaaaagtagaaaaatacaaaatacaaatagcataggaccggcacgtatattacctgaaattcatccctgagtctcgttcttcttctctcacttcgtttcgttttctcacaaaccgtctctatctctctctcgagtctcttgcttcttctctaatcctctctctctcgctagatcgattactgagattcgacgaacctttgtttgatttgtaattttgagatcgtggtgcttctctctctttaatgttgaatcggttcgtttctcggatctcgatgatcctcgattttctcaaccaaacttgaagaaaaacctttccatttttcgctccgagcttaatttcttgtttccgccatgtttgaagctcatgtaagcctttttctctttgttaattttggggattgtgatgtcttctttaccggttatttttttctggtgtttctagttttagaagttatgtgtttggtttagttcgatgttgtgattctgggtgattgattagcttgtctcgtcgtatgttggaatttatctatggattatgaaaatgggtttttagtttagcatctatgagagcagcaatg

SEQ ID NO: 28362 - DNA, 3000 bp, Unknown; identical to SEQ ID NO: 7629
  misc_feature (1)..( 3000): 2750-1469P.txt file - cDNA_ID_2996323; gDNA_ID_1621154; Annot_ID_56968

SEQ ID NO: 28363 - DNA, 1208 bp, Unknown; identical to SEQ ID NO: 15267
  misc_feature (1)..( 1208): 2750-1469P.txt file - cDNA_ID_2996367; gDNA_ID_2926108; Annot_ID_138554

SEQ ID NO: 28364 - DNA, 3000 bp, Unknown; identical to SEQ ID NO: 15282
  misc_feature (1)..( 3000): 2750-1469P.txt file - cDNA_ID_2996375; gDNA_ID_2926123; Annot_ID_196701

SEQ ID NO: 28365 - DNA, 3000 bp, Unknown; identical to SEQ ID NO: 15282
  misc_feature (1)..( 3000): 2750-1469P.txt file - cDNA_ID_2996375; gDNA_ID_2926123; Annot_ID_138625

SEQ ID NO: 28366 - DNA, 3000 bp, Unknown; identical to SEQ ID NO: 15290
  misc_feature (1)..( 3000): 2750-1469P.txt file - cDNA_ID_2996383; gDNA_ID_2926128; Annot_ID_138650

SEQ ID NO: 28367 - DNA, 3003 bp, Unknown
  misc_feature (1)..( 3003): 2750-1469P.txt file - cDNA_ID_2996387; gDNA_ID_2926128; Annot_ID_138653
tccagcatcaatttggctggggaaggtgttaaaatctctacgatcaggtacgtgtatttccattccttctctgccttgtctttaaacatctccgtgtacactttccctgctccttgaggcccacggatgtagaagtttacctgaagcatattcaattttgatcatgttaaacctgcaaaactctagacaatttatatagcaagaatgtgaatccaagcgcaatagaggttctacaatgaaatacctcaacatgctccactccgtcttcatctgtaaatactctgttgggtatacgttgacgagcagctcggtttctagtttcttgtccatagcctttgatgggggatccaatcctaaccctcacctagttaacaagacaatcacagtcacagaaattgtttcattttataaacagatgcttttgtttcatacaccacccctccgctatgatcaatctgtagagttagtttctaattacctgaccatcatcttgaattctcttcaaggctttgtcaaagaccttgtacctagaatacataatggtgtctttagattactcaaatccaagtgtctgagcagataaatcaaattagatttctgaagcctcactcttttggttgaaaaatgagctctttaaacacaccgtagccagcagctccagcgacaccaagcccagccagaataacaagactgtaggacgcaccttctgtaaaggtcaccggcttctccgggatgtggtatgtaggagaatcaaaaggatcctccacagtcgtcacctctttcttagcctgtaaaacaattggcaaagcaagcatcattattagatgacagaagctgtctgtcgcttttgacggcttgcgttgtgataaatggcaaacacataacgtagacattaagtagaaacttgtaggaagaaacaccttattctgctgattcccaggttcttttgaagttcttgatgcaaaagatctggtaaagtaagatgagttgatgttctttggacgagcttccgtacatatacttgcttgcgggtttcggaagcgaaacaatagtcctgtataacagacaattgtcagaacaacaaggtacacatcaacactaggatttgaagtttgattacacaattatcactgctgaccattagctccagtagagtcctgcataagaaaaacgatgagaggtatgagactaacatataagcccaaaagggtgtaaagagcaaagaaaatgttgtcgaagcaaatatttaacaagtaaagggaagaaaatacctttgaaagaaatgagttgctaaaaaccctcttggactgatatataacaaaagtaacactgtaagttttccccagatcaaggacactagagagattcaattcaaacaggactagagacactgaaaaaaacgacctcaattttcacaagatcctaaacaatccgtgtctatgtagtagaagaaccaatagcttttagccaatattatatagaaatgccggcagagtgagatggaatacgaaagccttaccgattttgggattccggaacaaggttgtgtagcggaggaaaacgacgccagtttcgattttgattggcggccgatggctatcgctgatctccttaaaagattcatcatcatcatctctgaaccaccaatattactgattgaaaaatcgaagtggagacgacgacgacgacgagcgaggttgaatgagcaaggcaaagccgctcgccgttgctggggttttatcgtagacacgtgacgcgcacgtgcaagctatttccttgggcttgggcttagactcatgagataaagcaaataaaacccaaatgggctttttagaaaagaaacccaaataacagagtatctcttcttcttcttcgtgcaacaacctaaccatggaaattgcaatttgcaaacatggcgctcgcgctctcgctgtcggcatgttctcctccactccgccgcactcgtcgtgccggttttcgaacaagctgctcgatcttcgcgaatccagcacagcgagccaagaggaagctgcttgagctgatctccgaggaggatcgaggtctgagaacccagaaagaccccaagaagcgagatgaaatcgtgaacgccatcgaatccatgacggttatcgggcgcagctccatcaccacagacgactctctatctgccacgtggcggctcttgtggacgacggagaaggaacagttgttcatcatagaaaaggcaggcttgtttgggacgaccgccggagacgttttgcaggtgatcgatgtgaataaacggatcctcaataacgtcatcactttcccgccggacggggttttcttcgtacgctccgatatcgatatcgcttccccgcagagagtcaatttcaggttccaaaaaccacttcttcttcgtacgctctgatatcgaaatgtgtagcatcatagcttagttgatagcgtttttgatattcagattcaatagtgcggtattgagagggaagaactgggagctcccactgccaccatttgggaagggctggtgagtgacttctctctgtttcctcttcggagctacttgtatagataaagagagtgagtttgggttttggttccacaggtttgagaatgtgtatatggacggtgagatcagagtggccaaggacatcagaggagactacttaattgttgatcgtgctccttataactggactgaatcatttgtataatttgtgatgctttttgcttcttgtataagttatacaccatttctgtctctctcctttatcattgggcctcaaatagatgatgcaggaatatagggaggaggaggaagaggaatttgaaggatcattcaaagtgtcatccttgagtttatttagggtttttgtctgtgtttgttacaaacacaccacccacattttctatgcccttttttaatgttattttcacaatccatgacttaaaaggccaacactaatcctttgtctcttatttcattgtgaactcacaaagatg

SEQ ID NO: 28368 - DNA, 3003 bp, Unknown; identical to SEQ ID NO: 28367
  misc_feature (1)..( 3003): 2750-1469P.txt file - cDNA_ID_2996387; gDNA_ID_1621147; Annot_ID_56774

SEQ ID NO: 28369 - DNA, 3003 bp, Unknown; identical to SEQ ID NO: 28367
  misc_feature (1)..( 3003): 2750-1469P.txt file - cDNA_ID_2996387; gDNA_ID_1621147; Annot_ID_173078

SEQ ID NO: 28370 - DNA, 3000 bp, Unknown; identical to SEQ ID NO: 9192
  misc_feature (1)..( 3000): 2750-1469P.txt file - cDNA_ID_2996391; gDNA_ID_2926128; Annot_ID_196775

SEQ ID NO: 28371 - DNA, 3000 bp, Unknown; identical to SEQ ID NO: 9192
  misc_feature (1)..( 3000): 2750-1469P.txt file - cDNA_ID_2996391; gDNA_ID_2926128; Annot_ID_138692

SEQ ID NO: 28372 - DNA, 3003 bp, Unknown
  misc_feature (1)..( 3003): 2750-1469P.txt file - cDNA_ID_2996391; gDNA_ID_1621157; Annot_ID_57044
aatgtgtgggtttaaaataaaaaatggcctataattaatctagtgtctgactttgttctatgtataactttttttacattcatagacccttgtttctattcttaaaaaactttatatgataaaacatgcaatgatcatatcatacgtcttatccaaccagaatacaagagtcttgacatcattctcaatggtttttctaagcgaacctgaagtacacacatcaatacacgcctcatatcacaaaaaaggatgttattttgacaattatatcgtaacacatgttaccatctatgcatgccttcaaacatcaaagtcaattgaaggaaacacacctctcagttgtcggtgacttcccggatcatgtaaagatgactttttgaaaaccaagaacatcattgcccactccaaagctgttacctctcattccaaactcgatcgtaatcgccatattcaagaaatacgtacttggagatcatgcacaaggctttttaaaaatagaccgaactttactagttactatctaccaatcaggttatgaaagtaggcaaaaggggaagggtcaaggcccatgagacatattttccaaatagacactaaaaatgagccagatttttcaacaacacatttggtttaagggctcaaaaaatatttgtcaacacccagttttaaaacaaaagaaaatagtaaattacaggcccaaatgtttttgttgccctatagatattagtatttcttaaccagtcgctgataattattgatgaatagttgagagacgataaagattgagctgtcaggaatacaaatcaaacatgatattgttcgtttacattattactcaacgaacattcacgtttccaaattctgatatcttttctaatatttctccacatgtagcatatcattagttactgtttaaaaatgagtaccaaaaacgtgaaattattacaataacgtataaatgttaaatatttcgagcaatcaatacttgtcaagactcattgttagtaatgcatcactataattcattctttttttgtcttggtcaaacatgtatgaagcgagcagagtctatgaatgtcatattatagacatacgtatgcggctttggtcgggaccggcccaataaaacaatacacatgttcaacgggttcttccacgtgtcaaacttatgttggctggacggtatgtgactgtgcattgtggttacgtttccaaaatgaatacgtaagaacttttcctaaattatgtcttttgcacaatactgtaagtctgtaactatggtactaaacattataatatcgaattggaaacatttacatttgagaattttagtgtttgttggcaacgaagcatgtgagatcacagagaagcaatactcatctctgagctgttcaaacagttttacatgtcagcacccaaatatagtcactatattcaaaaacaaaattatttacttgcattcaatgctagccttttttattcggtccacaacaaattataaatatttgtatataagaaaaatcagagacctgattttgtaatgcgtggcttgtcaatttcaagcaacacagaaaaaagctaactaagcaaaaaacaaaaaaaaataacaagtggctggttgatagaatgtatctttcatcagtacataacactgtttttttgtcaacgtaaaacagatttttataacttttgtttgccctcaacttttttcattacattttctggaatatcgcatggttgaataattaaaagttaaaaatgatttttatgaagcacggcattatactatatagtcagtcccaacgaaaatgactttacataaagctgtcaattttttctccaacggtcagataattgtttcgttgaatagtcagttttttttttactattttactattgggctttattgggctcttacaattttatcgatttttgtttaccgtccagaaagtggaccctgtgggaagaggaaaagaaaaaaaaagggtcaggttttttgtctttatacgagagcacatcggtacgttccagaacaaccctctctagtctcctccatcattatctttatttaatagtaaccctagtacaaattaccaaactattcaacattaacataattattcaacattcaccatcatgaataataactagttgagaaaaacgtaactagactagtttgatctgtcaacataaaaagagaaaaaagaatttcgtgactagtaaagtttaagaccattcacaaatgatcattgaaattattagttctaaactcttagtttggttatctatttggttttgattcgtatctatttggttattcggttttttggttttaaagtttagtattcattcgactattttgaaattttggttcgtttttttttttttttttgaaatttaatatccattcgattattttgcttttaatatttttaaatatttcaattattttttgatattttttgaatattgttactatttaatatatatttttaaatatttttaattactaagtatagaaataactaatatttttgaaaataaaattatattttggatattttagatcatctaaaatattttagttaggtactaattcatttttggttattttgattataaaatttaatatctattcaacaatttttaaattgttgattcaattcggttctgtttttttttttcatttaggtttagtacatttggttcagtttatttgactctcagtttatttgcctaagccttgaaattaggtgttaactattggttattctagttgaaatttgaaataaagaaaaaactatacgttatactattttattttcttagcaataactaaaaataaatgtttggaaacgttaggcaattttattatattctatcgttgttctctataaatgaagtctcgaccacacacttggtagctacacacgagaaagaaaaagctcacaactttaacctttctggagagagaagaacaaaagagggagagggagagaaatg

SEQ ID NO: 28373 - DNA, 3000 bp, Unknown
  misc_feature (1)..( 3000): 2750-1469P.txt file - cDNA_ID_2996395; gDNA_ID_2926129; Annot_ID_138696
aatattaagatttttttgatattttagttatttttgtgtatttttagatatattcgagcaaaactactcgtgttgttttgggagtttttgaaatttttaagtaatttaatagatttgcacacacaatttgatatttcaatatataaataaactcgaacccgaacccgaacccaaaccgaacccgacccgaaatcttaaattacccgaatgggtcctaaacttctaaactcgaaaacccaaacccgaaatacccgacccgaatacccaaacgcctaggactaataattaatagaaaaacagaaatccacaaaaatatttagaaaccaagcattgttgaaaatatatttctatatatgccgtaatcttgtaagttaattttaacatcatgcaaatattaaatgagttaaaattaataaatgaaaatcattgaaaagttaaatcctataatctaagctatttttctcaaaatgttctattttcacttatgattacatgagttaaagacaaatttgttaattttccttttattgaataaatgttaattgtttataaatatataaacatataaattagtatatgtaaatttgtttattttttaagattttctattctttttagaaaataaaaaagttaaattttaaatgacacatgtaaacatctgatcgtttgacttgacacgtggcacgatcgtatgagttagcaactttgaaaaccatactttatataataaaatatgttaatgattgaagaatgattttttttcaagaagtttaaaagcaaaaagagaaaaaagttactgaaagaaaagaagaaagaagaattagaaaatctagaacactcattcaaataacatttttacctcaatcctattgatctatcgtggctattctcgattttttgaatattacaatcccacgattttctaatctcaccaaacataacattgtccataattatcatgcaatttaaataagtttatataattgtatcattttataagtttttattacgctaaattagtttgatcttattagtcttttttctttttttgtaaaaatgtttttttattacttatgtttgtagtttctatcaggcccagtttaaggcatgtattcaagatgcaaaaacaccaattttttccttttctcaaattttctcaaaaggagtccatattttttaatttctatataaaatttgtttgttaaaaaatttgaacacaaagtcaaatataattttgaaacggcccgtttctactatatgaattcatatatttctattaaaaaactactttttcgaaatatctacatattagttttactaatttatcaccgatcgaaatcagtcgataaccttttttttatctccattttctatccccaaccgaattggctcaagctatacacaatgccacacatatatattttaagcatgaaatttccggtaaaacagttccatgtgtcgtgagtttacttaaaaagtagagacgtgttttgtctgtcatgaaattgaaatgtcaacacataaatgtaaggttttttagataacaaatcaatcattgtataaaccacgaaatgtggcatttttttgtcgtctaaactatttctcttataatagtggaggacacatgggggaccaaattttctataatagcatatacattattagtctgatggttgacaattcgtagatataaaattgatatcccatatgcgtttaaatccgatctacacatttagttggaaggtaaaaaaaaaaacagtttagtcatgtaatgcgtttaaaaaaaaaagatcacttgtgtttaatagaaaccataatcccaaaaatatttaacttttcatttatattagaaaaatcaatcatctgctacataagataagagatataataaatacatggtaacacataccaaataaaataaagaaaatcagctatctggcgtatataaattgcatgactacatatacgaaatgtatgacgttatgtaattaacatcataaacaaagaatttaaggttaaccgatcaactgattgtggcgttgaccaacaaaaatattcaaaaataaacttttaatttatttttaatatattaaaaactatgatatgtcttgtaactgttaatttagttttaatgttttaaaaactatgatgtggtctgctacacttcagatagctgacgaatttttttttatatatattacacctacaatattaacataattatatgtttagtccaaatagaccgaacaacaattcacaaaattgaaactgaaatcggatatgaattgggtaaaaaaaagattctaaataattttctgataaaaaacaaagaaactatatcactccaaatctcttgaccatagtgtttgttccattccatcgtcaccatagtttagactttaaattcagtttcactttgactaattttagataaattaacatattaaacggaatcaacaacttccctctctcccttggcgactacagaggcgaccaacaaaaccagtttcctgtttcattttttttaacaggctgccggcatttgccggtagtttttttgcttttctactcctttcttcttttgtttttaatattgtgatgggagatattccccttaattggatttctgctcgtcctatcttctcctttcgaatggtgacggtgtttattgtcatgtttagaacagagacatacaattaccagtttcatgtaaacccgttgctatattcgaaatcagaaaaaattcatcccaccaatgtctctttacccatgtcatgtcgattcatttgaatcatggtgtatttccttatctaaagtttgttttcggtggtttctctcaccgacgtgatctccggttttcaaccgatgaagtttcttcaaatctatggtttggagaagtcatttgggtatttgatccaggaatcaatagacaaattcttttgagtgaaggaattggcatcgacaataatttcctcttctcaaacacatggtccgatgatg

SEQ ID NO: 28374 - DNA, 3000 bp, Unknown
  misc_feature (1)..( 3000): 2750-1469P.txt file - cDNA_ID_2996419; gDNA_ID_2926258; Annot_ID_143164
tccagtgctagatacagttaaaacagcaaactttcgagctagggcaaatcgcataagaatcctctcctctggtaggccagtacattgaggacaatctgaagatttgtcccaaaagtctgaagctttcctgtggcaaccatgagctataaacagaactgcttttggtgaatttggtatcgtccatatcaattgagtctcgttctgaatctctaatgttggctgagattgcaattcgggcttgacattgttagagatctgtttcggtagttgcattttcgtgctctgattcttgccactgaaacaaaataacagaaccaccaccaggaagatcccaacaacgaaaacaagtccgaattgatggattcgagatccatgcgaagatttccatttgtcagtacgcttcaacatcactgcaaagatcaagttaaatctcaggatcaaacggaactctgagaacaattctaagttgtaattatcacattgtcggagaatcaaattcgtatatcaaccaaattctacagaaatttcactaatgaatcagatcaagcattgcccacaacgaatcacagggactaagactaacagtcaacacttaccggatgagacaagaggaatttgtaaaacctttattccgaccggcgagtggtttacccgtaagtaacccgtaaggttccgagagaactcacgttgctttgaacgacgactttaaactttgttccgtttgctcacgattgtgaataataacattcaactcccaaccgttttttcttttattattctggtgaaaagcgctccgttttgcatttataactcgcagttcctgccgttttaaaccaaggaaataatttaaagttatcatctctgttgcataaagtttgatgttttaagttttgcacataaattaagaaaaaagtaactttttgtactttttaattattattttgttagtttaataatattattgttatctctctcctttcactattggccacaaacaaaattaataatcatacttttacaaaacattaatttttatggaacaagtaaacatcaaataacttggtacaaagggagtattacaattggtacagacacgtaaaccgtgacttcaatgatccagtgacactatataaaatacgtttttgcatttctgtaggttacaaatattaaattagttaccctatacatactcttaataattcattcaagagcatacaatctcaaaattgataagactaactaaacaaaaaaaaaagggaatattcaaatcaaggctgagattgttaggagtttaatgagtacagtatgtaccacgattgagaagagaaaaccttggggtagaactagaatatctctaagaccaaagtatggagaaagaatttgacttaaaagctttaaacgactttcttaggtacgtaagagtatgggggaaaaaggttgtgacgctgtaaagttttaaggtaaggttttgaaaccgtttttttttatttaacattgcatgaaaaactgatgtaatcaacttgtgtaaggaacattgacaattgcactaccaatacatgcagaaacgacaaaacgcttgttgtcttcgaaattactattaaattgtacaactttctacattcaaacatatgatttatgttatccacagctgacaatgtttttgtatttattgatttttacggacttttgatctatctatgccagactaaataacacatatttgcttcataatgtagaaaatttcccaatatcgataaatatcagtagcactcatccaatatagtagcatatcatcagtgaccttccttccacacttcccataattatgatatggcttattcgtctccaaccattcaccagcatgatgaacaaaaacacaaaataatcaaggtaatgtttaaatgtcatacatttcacacctaggcacaatagcacgataactaacagtaacactcgtaaattctacgagtgcttataaaataagcagtgtaggtgttgtttacttttttaactagggtctgttagagttatttttttgtcggcaaacttcttttctcactagctgaagaataatatcttccaaaaaagtagagtacaactacaaactattataatgacgacgaggacacgctataagttacagagaaagacttgagaccaataagtttgtggaagtggtacattgattgctactaagattaattgattaattatagttaaaatcccaaaaacttggttaactaccaactccatagccataagagagcaattaatggacggtgatctccaggaataacgcaccattaattctccatgtgggctcccacactggaaccctccccctgctaatgtgtcggtgtgactccacaaaatacaaatcctcgtagagaaggacactcctgtaattgtctgcatcattcattactctttccatttaccagtaaaatatttattttagttatcgtaaagttttccataattcgttttaccctattaactacacatgattaatttatacatctatacatacatacacaaaacatttatagactatgtgctaaattcccgcggagatgaacgcggcattggttttggcttttttaaaagaatactaattattttcacaaactcgtgactattatgataggaataatattggtgaaatattatcttttacaaaaatgcatttattttggtaagcatatgtccgcttggcttctttagaaaaattcattcctctttgaatgttgttttttattcccgtcgtacagatcaaaaaccaaacagtccctctcgacctactggattcgcgttttgcttttgatcacatcttcgtcattgagcttcttcttcttctcgatccctgttggttttggttgttgtttttgatgaactgatagtggagatcagagatctggaaaacagagccgtgtgttactgttttggattgatggaactgaagaaacgttgtgagaaagttagggaaactgtgaagaaatg

SEQ ID NO: 28375 - DNA, 3003 bp, Unknown
  misc_feature (1)..( 3003): 2750-1469P.txt file - cDNA_ID_2996442; gDNA_ID_2926258; Annot_ID_143175
ctcgagataagggacaaaagcaatgagatagcgccacctcttggagagaatagaagtcaaagcagcctcctttgtggtaagtaaggacaatatatgaccaaggagatcatctggtagactgctaacaagatccaccatctctgcagtagaaagtacatttaacacaaactcctaagcaatccgaacatgaacataaattacaaaaaagaagttgcacttggggatcttatacagacgaagatctgtaaacactgatgcttaaactttgagtcaaattatagatccccaaggaaaattagaaaatatgaattcgcttaggcatttaccgctgtacattcgcggagtcctacacatatttaacttgtagagacaggggtcaaaggttgggagggaagcaaagaaggcgaaaaagtagatttagggtttgcccaaagtgaaggagtcacggagaaaaggttttaattttccttttacgtgcccctacatagcgttttataaagttttaagttataataaaattcgtttagaagtttagatgagataataagatatatcatgattgatgatgattaaaaaatcaaagctaaacacaaaaattagcacaaatgacccaattataaatgatacttctatagaaattatttttaaaaaattattatgcagattgaaattgtaacctctgatttcagttgtataacttgtgttgttttttgggctccctaaagttagatcaagttggtatctctgatatgttgtcattatagtcaagatctaggtagtttttttcttgctaattaacctttaaattaattagtcagtttgagtaaagcattgttaaagacatcaacaagaataaatcaaagcaaattacttgtgagaatattatcaaaacaatccaattgctagaaattcaagagtgtacacaacaacaaaaactatctttattagcgaaaacaagctgcagttgactccttttagcttatacaacaagaattcaatgcaactttggcataacaatgcaaaccctcttcctagttccagcacaacaattggtcttgcaacttgcaagtgaagacagctaaaggcaagtgattacttggtttaaaaacccggtccaaatcagtctcgattccgattcctattctgatgatcatgatgatgactatcatctgcctcaaaagttgtttgtcagtagcactttagtcaagatgatattaagaagtaaatttggtattggcctctaggtggaggcactttcttaccaatgcttaaaactctcattatcaaggctaagtggattggttctggtatgcttgcgacgcttcttccttgtttccccgtacttgaggaattaagcattgctattactgagtagctagaatgggatgaaaccgtgtcaagtgcaagcctcaggaagctagttatctattgccaaggtggttgtgcagacttgctgaattcaaagagtatttctttcgatactccaagtcttctttaccttgtgtattctgtttttgttgcggaggactatccaaaagtcaacttgacaaatttggttgaagctaaattcaaccttatgttacttgacgaacaaatcgagcaaataagagagccgaatgatgaggatgatgtttttctccgtcttggaaatgtgttgaagctctttgctggcataagaaatgttcagaaactttacttatctgcaaatattcttgaggtcagttgctattttgtttactattgtagtacatttcttgctagtctcaaggaataccaattaatcagacagccttgtctaactttctgaagcatgagaacaaattcattgttagtccgagtgttatgctgagtcactacacagattgtaacgccagctgcaatattacaaatgttgcacccgaatagcgttgagttgagctttgtcttgttgcaggtcctttctctatgctgtgaatcatttccggtgttcaacaacctcaaaattttacgaataaggagtgccgaggatcgaggatggcaagcaatgccggttctcttaaggaactgtccacatttagaaactctagtccttgaggtatggacagaactcatatgtctaactttaaccaagacaaggatcagtatttgtagtccctttatttgtctggtttcagggtcttatacactatgtgacaggtgaatgtgggaatgcttgtgactgcaaatctcgggagggaatagttagttcgctcttatcatgtccagtgaagaaggtgcagattaaagggtttaaaggaacgatgagagagtcgtcaatgatatggcatttcatgacgtctttcccgtgtttaaaggttgtttatgccgaagagaatgattttacaacaatctttgaaatcctgggacgatgaaacttgtcgtgcatatgctctacaaagagttctttagttctgatgtcgagttcttggtgtacactcccatggataagaagtggattttcggagtggctttttcgaatgtaagagttttcataatcgacattgtcatgattattatcttcctcagttaaaccttagtctgctaatatgtatttcttatgaagaccaattactcagtcatcattttctgctctgtacttttctcaaaacctttacgttgtctaaatcatgcgatttgattgtgttttacgtctggtttatttgctttaataaccggtccaaaccaaaccattataatttactaaattttttcggtttgcgtttatcaagattgaattccggttcaaagattcttcctgtaaaatggatctttcatatattcccttgtctctcgaaatccaaaacaatctaccatcgatttcggtcttaggtaggtgctgaagctaactattcccttctgttcttatacttctttgaacgtatcttagatcattttgcttttggttgcgttgttaaatttcgatcaatcgcttctctgtttatgtatggttagatgttccaatagctttgtgtagttcagaggatg

SEQ ID NO: 28376 - DNA, 3000 bp, Unknown
  misc_feature (1)..( 3000): 2750-1469P.txt file - cDNA_ID_2996452; gDNA_ID_2926258; Annot_ID_143179
tgtttttatagatttgtcatgagacctttgtttgtttgtagggtcatagaaaccaatgtttcaccacttcgcctctcttttatcactgtcatcgtacgcctttgttgaggagttgacctaatttcaagtgttactgctgcgaattttgcttagtttccttttccctaaggcttaagagtcgaaagtattggactttgtctctgtatcaaggtagctgctgaagttacctcatatcttcttcttctactagttgtattctcatttgggcattctttttcgttcacagtctcaaaatctttttgctttgggtggtttcctatttgggaattgttgatagtttaatttcttcctttgtatccgtgcagagaagatggatctcttcagcagtctaccagatgaggttctctgtcatatattatccttccttaccacaaaagaggctgctttggcatctgttgtctccaagaggtggcgaaatcagtttgcacttgtccctaatcttgacattgatgaagaggggaagagggaaagagaagaaattctgctgagcttcatggattttgtggataatgtattggcattgcaggctgattctcccattaagaagttttccctcaagtgtaaaactggtgttcatccacgtcgacttgatggttggatatgtaacgtgctgcagcgtggtgttttggacatggatctttacatcgattttgacgaagaatcttttttgcctcgaaaactgttcttcagtgagtcactagtcgagctgaaactaagatgttcattaggtgttaattagtgggtagcgtgggctagactaggtcctgtcttaccaatgctcaaaactctcattattgactcagcttggattcgttgtgatacgattgagacgtttcttcctactttccctgttcttgaggaattatccatgtctattaatgagtggccggattgggatgaaaccgtgacaagtgcaagcctcaggaagctaagtatctttaccattggctgtgaaaacttttcaaatccaaagagcatctcttttgatatcccaagtctggtttactttgagtattatgatatggttgcggaggattatccaaaagttaacttgacaagcgtagttgaggctcgaatcagccttttattagatcaagatcaaatcaagcgaggaagagcgccaaataacgatgaggacgacgttcttctgcgtcttcgaaatgggtggaagcttatgagtggcataagaaatgttcagaaactttacatatctttagatactctccaggtctgtttttattttgttttgatagtatttttttcactgcactcaagtaaacccatctaaattgtggaagtatgagattcaaatttatgttattccgagtgtacaattcttaagccctttcacaggttctaatgcacacttcattgttgttctaaggctcctgcttttatatatcgaaacaatcctggacatattgcagttgtaatgttgagtttggctttgccttgtttcaggtgctttctttatgctgtaaatcgatgccggtgttcaacaacctcaaattgttaagtgttaagactgccgagaatgaaggatgggagggaatgccggttctcttaaggaactgcccacatttagaaacactggtctttgaggtattaacacagatcatttgtcaaacattaacaatgacagagaccattctttgaattcccttactctatacttatctgctttcagggtctaagacattttgtgaccaataaatgtggggatgcttgtgactacgtgtctagggaagacaaaggccgttcgctcgtgtcttgtccggtgaagaagttacagatcaaagggtttcgaggaacaattagagagttagagatgataaagcatttcttgtactcttttaggtgtttggagaaggtagagatttatgctgaagagaagggtcgcactcgcacagaccttgaagtccctgggatgtttgaacttattgcgcggatgctcagactctacaacgagttctatagttgcgatgttcagttcctggtgcgtagttccttggataagaagtggactgcacagtgattgaagtcttcttgggaaaaacttagctcatagtttgatgtcaaaggctctttttgattcttgttagaagctaaattaaaacgacaccatttcattcagatatttgatatatatctgggacatcttctgcttttctttcgacaagtttgctttcttctccctctatggctctttatatagatagacttctctgcaattttaaacccaacgtttaagaagaagaggaaggagactttgttttaaataccaccacttgcaacaaccagccacaggccaggttttaccagtttgctactgggcttttacttgggcttgacttgttccaccatactttcgccgtttcgtagcccaaattcaaactgccccggtttgtttacccgtttacccaataaaccgaaaccggagcctaaactcgactgggtcacctcactggtgtagtgtagtggactagtggtgtccgctttcaatgcaaaatcctcaatttggtttcggcttctccgatgcattagcatgtcttctcgaactgaaagtctgggactttcccctctaccttccgctaaatgtttgcgttgacttcatatctttgcgtctacggccatatgaactagcgattaagcaatctattctcgctctctctcttcccactggacgcattcactgaaatccccaacatttggatactagattaagcgtttgtaacgaggtaaatgctgaagtttaatcatcttctctgtttctactgattctgtgaactgggtttatctctgttcccacttctcctcttttgggggaaagctgtttgatttcatgttttagattcctgattgcttaatgttaccttactgttaaagctgtctctagttgtagatgaagtaatgtacttttaatctcgtgtacagaagatg

SEQ ID NO: 28377 - DNA, 3000 bp, Unknown
  misc_feature (1)..( 3000): 2750-1469P.txt file - cDNA_ID_2996460; gDNA_ID_2926259; Annot_ID_143181
gtgactccaacagtggatctgcagaagagcggtttgagaaatactgcagagaagtcgagtcaaccgctgcttggggcagtcaattggagcttggagcattaacacattgcttgaggaaacacataaaggtgtattcgggatcgtttccggatgttgagatgggcaaagagtatagatccggcgatgactcgagcctcatgttatcgtatcacaggcatgcttttgggctcggggagcattataactcagtggtgctcgtcaacaacatcaccggatgatggatgatggactttatctaaagctttaagaaaagtgcttttgtatcaaaagtttactgaaattctttcttctttaatgtttgttggatttgagagaaccaatgtgtaacttcaatttttcatttggttacaaggcgaagcataatctattgctacacagttccaggtttttcattacagaacaagaatgtagcagcaatttgtacggagaacatgacacgaagaaacatatgacctttgaacaatttcgcgagccaatttggcagagacagttctagagatctgaaagggaatataacaaacacaagttgttcctcccgaatcttgagattttagcaccaaaagaagaaaatgatgacgaatctatgcttattatcacccataaattttgctaattcaattgacacatggccttatcacgaatctgccaaagattcttcatttctgtagatttccaaatctggtgtcagaatcatgctttcctgtttaaatctgctaaaattttgtatttttggaaagttgaaaatgcaatgaacatggattctctttctcgtgttcaatgcaacaacaactacaaagactcttaagagtcaagaccaacaactctcacatttagataaaaaaacttgaaaatggttttgacaaagtgtaaaagctaaagtaagaactgtgttggatcacttacttgctctctagactccaggtcacacaagcagaaaagtatctcaaagacgatcctctttttgtttgtttttcttgctttccgtttctttagagcctgaaacttgtggggaatctattgttgcttgaaaagataagcatctaactggataaaccataatccaatctccacctcagtggatgcatcaaaagcaaaagattttgccaaaaaaagaaaagcaccatagagtagacatgatcacactgttgcatacctccctggatccgtggatcattacaaaccatatgacaaggatatttccgtaattagaaaagaaaagtttacatgaactgtatatgcaacttggttctgatgttcatgcagtttttagagaacgccaaagggcacatcactagtatggaagtaaagtagtgacaaagatctgatttatgcaacgttaccatcctccacgtatccaactctataaataggcctactttgtaatttgtatagcatcaaagcaaaaacaaacataaagatccttgagttcccactcacatagtcacactacatttgtatcacatttatatacatagaaatggaaagcgttagaagtttagttgaagacaaaccagtggtgatattcagcaaaagctcttgctgcatgagccactcaattcaaacactgatctcagggtttggggcaaagatgacggtctacgagctagaccaattctcaaacggtcaggagatcgagaaggcattggtacagatggggtgtaaacccagtgtaccagctgtgttcatagggcaacaattcatcggtggtgctaaccaagtaatgactcttcaggtcaagaaccagctagccgcaatgctaagaagagccggagccatatgggtgtaacagaagacaagagagtcaaatgcaaactaggatagaataagatgagaatgatacatatcgttgttttgcttcttctttaattttcggggtttcgagtatctaccatgcacggatatgttttcaacaagtgcaacactatagtttacacaactctagagctaattaagatcaagaactttgtattctcagttaccatacttgttaaatcaaccaatataagctaagaagactaataagcaataaaagagaaagatttgcttttccattgatacctaaagattgttcaacaaaatgaaaggccttttatttatcatcagccatgagaaaagaagaaacaaacaaaagtagagattttcactaacttcttcacttgtaaatgtaatcttttaaaaggccatttgcatgctcgacctcagaatgtcttcgccaactatcaacagctctagaaactgtagcttttgcttcccgaatctcttgagccgagaacttgtgctctatgattcccaaaggtccaggttgcagaacattgatcacagtttcagcttctttctcaagctgcctgtacaaaatgaaaccttagaatttcaacataaacacacacacaaaaaacaaatcttttattgtgtaatctcttgtcatacggagaaatacgatgcaagcattaaccaacctaaaaagctctagattggatacaaattgaattctttttatcagtcaattcttcaatagtaacgcagtaatacaatgaagagaagaaaacaatggagaaaccttaagatcccggagaagggtaaagctctagcgatcctgtaaatcgacatcgtcgccggaggaagagaagaaattgagtaccgcgattcaattgatttattatttaacaaaaactcaacttcgcgacgaatcagttttgacttcacatatattgggccataggcccatagagttactagcaggtgtaagttacaccgtgtaaccgagaatgtaaattagtatgggctaaaggcccaataaataaaagggtttcttctataattggcgaggatagttttgtcctaatagccaaacacgtctcatcatctaaactaggcttccttatccagcaactcccgcgccactcgtcttcttccacctctctctctagagtctagacaatg

SEQ ID NO: 28378 - DNA, 3000 bp, Unknown
  misc_feature (1)..( 3000): 2750-1469P.txt file - cDNA_ID_2996464; gDNA_ID_2926259; Annot_ID_143184
cgtacgtgtatcattcgttcttgataaacatcatttgtcttgtcacgtcgtcgatctgttaaatcatcatccccatactttgcttttaactctatattcattcgttagtataatattactaatctcctctaagtttttttttattaaaaaaaaatattctcctctaagtttaagctgctccaaatgatatatgtctttgtaagagaacataaaagttaagaggaatgaatacattactagtcaaacggaaaagaaaaacacacactaaactcaattcatgatcagtattgtattctagcgaatgacgattttaagatttgagtttactctttacgtggaattcgaacagtaatgttatacaacagtgcttaaaggtacacttgtcttttcatccgtacaatgtacgtaagtcaacatacatatatacatctatacatgtatataaattattatccaataactacgatccatccgaagaaagcaaagcattttaatacatctatgctccctcccgattatatttatcatctatgcgctcttagcacatcgattattgacacaattacatgtgcatacatatatatatatatatatagatatatacacatacatgtacgatgatcggacgctataaccaaatggccttagcgtctttaagcatctgcttgagtgacccgtccacgtggaatgagatgatgtctttggctgatccgatgtaccttcctccaacgaaaacagctggaaccgccgggttcgatgagccgagggcacgtagggcccgttccatttcacggccttcagggtctttgtcgagctcatggatcgccggactagcgcctagttcgtagaatagcgtcttgatgctatggcacatacaacatgagctctttgtgaatatcaccgccgctttcttcgacgacaaatctcttattctctccatttgcgatggtcaagaaagttagtgatcaataagtgttgttttttttgtaatgagcaaggcttaggttgtattgaacatatgcttggataagctgttatttataatggttattgtgaaagattttggattattttattttagccttttctttctacaaatatattatggataaatatataaatgatataccccacactaaatttatattgttatatattgaagtaccccacgaacaaaatttcctagaaagaagctaagttctttgtgatataaatttggataagaaaaaaatgcttatagcctgatgatttcgtgtgatggagacacttgctcttatttatttatttttggtaattgttttttttatatatagtttatacttagatttcagttatatatatgtatactatagatgggattaagtgtaatattattacaacatatattatatcaaaaacgaatagagagatgagttacatcactttcggtccgtggctggcatctgcatcacgtacccaaaacattaatttttataaatttataaaattttccattttttctatagtggaaacgtggaaggttaataatttgctgtaatgtggcataaacaaaaaggggatcgttgatgcgttttgctgttaataaatatatttcggacataatgtagttgacattattgtatctatattataaagtctaattacctgaaaaggataaaagccatttctagacaaaatcatctcgtatatgttggcaaatctggacgacaaaaaatctacagatgcatgaatttcgttatatgatcaaatgtgtatgattaatgattaataactaaacaattaataaaaggtctatgcattaatgtttcatatatagttgttacacttaaaataaactaaaaatcaaaaaatagtttttcaatgtcaaaagttaagtgtatgcaaagagaaaaaaaaaagagagcagagatttggtggtggtggctagtgactgttgcgtcatctttgacatggaaaaaaaaaatctgagataagaagtttatccatatctgaccccactccacaaatcgatgtttagacaaaacatatgaatattattttcgtattttattgttcgtttacttgatttatattcttagaaatatcttcacctatataggctagataagttcttaagccattgtcgaaaccacgtggcggtacctcctcatgtaagcatagacctatgtacttttacatattatcatacataagtttctgatatttatttttgtaggtcacaatatcgaccgtccatagattcattttatcgattagattcttttttactttttaatgaccaaagcgttgacagaataatatatcgtctctacttgcccaagatttaggttcctcactgattcttcgacaagttaaatcacagtaacgaataacgatgattgcgataatatacaaaccctctaactgacatagagggtccgatggattattttgaaagcccaaaagattcgctttgataaggccttttggcccaataattccaatttacttccattctttcatgacattagcccatttccttcttttcaattttattattggttttgtcgagtgaagcgtaaaccctaaatcactaatcatcgattcttctccgttggatcaaaggtatcatgaactcggaacttttctctcgcgttttttttcttcattatttgataatcgaatccgtaaattcaacttgagttgtggcgctgtagatttctcttatagattttagaacgaagaaagaaaatcgtatgtcatctgctttctcaattttttttggttgtgggtttcttttagtgatacgtatcagtgaatttggtggaatactggattggaaaattgggggtttggtcttgtttctagagttgttatgtcctttgtatttatgtcaagtgttgctgtcttaaagcccaacttaaacttgaatgtgtctgaagtctaaaccaaattacgtgttagataattgtgtttgtggtattctcttgtcttgacacatttctttagcttcatttaatg

SEQ ID NO: 28379 - DNA, 3000 bp, Unknown; identical to SEQ ID NO: 28378
  misc_feature (1)..( 3000): 2750-1469P.txt file - cDNA_ID_2996464; gDNA_ID_2926259; Annot_ID_204661

SEQ ID NO: 28380 - DNA, 3000 bp, Unknown
  misc_feature (1)..( 3000): 2750-1469P.txt file - cDNA_ID_2996472; gDNA_ID_2926259; Annot_ID_143188
tcgaacgttcacacactattagagttagaccatagaataattttatttgataaagcagacaaaagatgtgattgggcaaaacatgaacggcaatatagaagactcgacgtccaccccacctactcacccccaccctactttcatggctcccactagctcggcccattgggcctttctaactaatgagaacatataattaccgtacattctctttaattcggcttctttttatcagtttgtcgataatttttcaaagtttttccatttatcattctaacttttaactaaataaattatactcataataataatgcgttgaccaaagtattacctacttagaatgatgtggttttcatgcgtaaccatgaaccatccaatatcaattaaaaaagctaataatgaaaaaggtatagttgcgtgacgtatatttgcaatatgggattggagaataaaataacataggaaaatggctaaaaataaatgcggaaaaaagttactagtaaaatcgtgattgggagggacacgaaataagaaagcgaagatataagaaatataattggtcagaatttgacaaatcatataacgatatagagaagagaacaatatgaataaaaatggaaaaaaggatggcttccactaatggggaaggtcattataatcaagacataatccaaattagctttataaatcacgtgccactttacttgtacttgtacaccacctcttcatcaatcgcattatatatatcactcatcatctatcttatatataaacagtagtattatgtaaatactatagtactatgttattcttttatatatgtccgtccacacatgcgtacacatatttctatctcacataaacagtagtagtataatgcagtctgtaatattctcggcttttaggtacacaatttataattcattcagagttggatctaatatcgctgaagagataattaaaaaaataattagggagataattaagggataatagacagcaaagagcaagctagttttgagtacgaaacccgagactaggagaaagaaataagagagattcgcgggggagccatgcgtgggattattattctaatcatttccttaaaaaattcataatcaatgacctcttattatatcagtgtaagttaatccctttttctgacgacattaaaacttataattttaaaaaaacttaagcgtattacgtgcaagacaactcagctccacacttctcccatctgactatactcagccctctctttgttttttcctaattatctctttcttcgttactacctcaatttctgagcacttgcttgctacattttttttttttaaaatcttcgtatttgtatgtatgtcattataatttttagattttatttttggtttaagaactaatcaacagtacattcaaaaagaaaactagaaaggtgcgatattttaaatagtagtttaagtggataaacggtcaggatggtatgtaatacgaagatgatatagaacagtttgataatgtgacaagtttttttagttagggcaggacagacctatcaactccatgctcagactctgcaaagcccatcatacactgtttcgagaagaagggcattctcgtcaattcaatacccatttattttcctctaagccgttgtacttgcgacagagcccgaaataattgtagtttttatacgtttattacacccagacgaggtaaattaattaagaagtaattattaattttaaaagtcacgattgtgtatgtatgtatgtccgtacactgttaaaaaggggtcccagatctgacggtcgtgattaaaatgcgacgctgcactttctttctttctttcttctctactttattcaaatttttcagtatccattctttctctctctttttttctttctctactcataaaagttgttcactttaaattattggatacttccctcacatttactcttttttgtgcaatcctttcaattttaatttaaattattcagcaatcttcaaaaacatacaaataatgttttaatccaatctcacacgaaaacactgattcttgttatgttaattcatcattcaactctatttacttcactttaatgctatgagaaaggatacactttagttaatcaaatttatcaatactatatattactagaaaatagaaaatgaaactgtgattagtcttgatggtttatttatgaatccaagtggtgggtaaataaatgaacatgcaaaactaataataggaggagatagatgctcagattccacatcaaaacatgattggacggttgtgatgtcatcataaataacagtaatagcttctttttttattgttttgttaccgtcagatcattagtagtctagtattttttttaacattctgttgtggtccccgcaatttacggggcttcccctcatatccagccgtgcatcgcgtatcattagattccctcttctcctacaccttaccacaccctatcattgatctccttctcgcgctattttgatagaagccgcgataagccgaccccccctctccaatatctcgtcccgttttctgcggctgcccttctctgcacagtcgataagataatctcccgctttcattcaatcggacggctggtatttgaagcttataagacacgtgtcatcatcagaatcgacaatcacaatcaccgaaaaggctcacatggatatgtttgaccacggttaacttttaacccaaccatggttggcttttttaacttgacctccttctccttccccctatccttttctcttctcttcccactctctctctctctctatctatcttcttcatctttgtttcagcttctcctttgaaactagattatctccgttaatggcgcctcagatctaaccttgggagttatatatatatacttgttcaactcttcttcgaacgctgtccaacttcttcctctggttcgatcatcgagatctcgaggttatttggccgcaatg

SEQ ID NO: 28381 - DNA, 3000 bp, Unknown; identical to SEQ ID NO: 28380
  misc_feature (1)..( 3000): 2750-1469P.txt file - cDNA_ID_2996472; gDNA_ID_2926259; Annot_ID_204666

SEQ ID NO: 28382 - DNA, 3003 bp, Unknown
  misc_feature (1)..( 3003): 2750-1469P.txt file - cDNA_ID_2996492; gDNA_ID_2926259; Annot_ID_143197
tgcaacaaatagctcaacacttaatttggaatgactatctatttgcaagtatatggctttggttaatatatgacattaccttttccgtaacaatcgcccccgccttctctctacaatatactgaatcacatgcttggaaatcagaatcacaccaacaacagttaaacctatggagacatatttgaacctcctgccaaagagatccttttagactttttcaatctcagttttcgaggaagacaatagccatactgagaagagaaacaaccttgaccacttttccaacggaaagatgatcttatcgagcggtacaggtgagacaaagaaaagtccattctcggggttttgaatcctgaaaccacggacaccgtccttaacaacctgatgacatggtaagaaacaatacaaatgagatgtagaacgtatattggtagtaatataagaagattttggaaccggtgacagataaaaggcgtacctcaccaacaactgtaaccggtgtgccaattgagaggacaagctcacctcactatatatgaaattttatgtatggattatggaactcatttgctgtttgcaacatatcgccattgttatagtcatagaaacagaggggaagatgtaataaaaccaaatgttattgtttcaatttctttttatacttcaccaaattaatggccaacatttcgcaataaaacaaaccagatacaataaaattctaatgatctatgactatgagtgtgtagtgtaccaaaattatctatgagtgtgtagtgtaccaaaattatctaaacccaaactagacaaatcggtgatagatagaaagatcttctcacgatccacaatcagcctgcaactactactagtgagctccacatctcataggagaaatctaactgagattttcctcttgtggtttgcatatggcccaagagacctaattccacgtggacatcgccaccaccattggattagatcacacttccgtcactgttgtcgtcgtcttctccattgtcttcttcctccgatgaaagcggaatcagccagcaagtgccgtgcaagtgaccgttcacgcacacgaagaactctaacccaccttcacgtgatcccagccgccgcgccgcactcttcgggacgagacgcgccgccgtcatgctccacacgcgccctccgcaatacggacacctaaccttctcctccagcgccgcttgtcttctcacgagacactccctcgtctttgacctcataaattcccgaaatacccctctgaaaacccctaaatgctcatctccacccaccgcctgatgctcgcacggatcgctcatgtataggagatcacggcggcaattctttggcaggaagaatctcccggatgtcttggagaatctggactcgcaggcgaagtgacccgacgtcggttgactcagattgaaataccgagtcgactcacccccgccgcagaagaacatgagtttcgctaacgcgtgccagccgccgtcgattcgaccgctgggatcttcgccggacaatgccgccaccatccctggcgcacggttcacacagagccgccgccacagaattcgtctggcgattgcgcagaatctgcggctgagggaggcgattgtgcatagcgtgtggatgtcccagctaatggactcgaagacaagaaccaggactcgctcattctctatacctgacttacccgagttgggtaatcgactcggttggttaaatttgagccgtctattcgtgttcatctggacgacggagaatcttccctctagaagcatttgagtttttgcggtctaaacacgcgcgtcgtgatctatcgtatttatatcagttggtccggtgctcgagaataacacacgtggctttatgctagaataaaagatccatggagctccccgacgctaaatgtgtcgagctatcattggtagttgtgacgcgtgtccattggtgattgcgtgcgctgcaacagagaatcggaggtataaactgacgtctcgattggtattaaaggaaaaaattaaggaatgggagtgccacgtgtcgagcgagagacggaaacgcgaatccgaaacgtacttttctggaaccaaaaatatctcccggaacacgtgtcacgttcaattgcagtcgagaaacgtggcaaatacgaagtaatcttccaaactaagaagagccacaaagcagtcgcatgaaaggcagcataagctcccaaaaggtccgtccaacaggaagatttttttagtggtcaacgtcttggtcgagtttttcaagatcgggaactgatgctttttgctttttgtagtggtcaacacatgacaactacaaactactacgaaaatgtttgatggattggataacgaggttaagctaataatgggctgaatggactttattaaagcccatacattccgtttcaaatagaatgggcttagaggagtggttgaatcacgtggatttgttttttcttttttttaactctgatcgacgttttgtacataccagtcagattcgctcttttaaccttttaaaggaaataaagttaacctacgcgtgtaaggcgcacgttagacatcgcctttggaaattggcaaaccctacaccgaccgaacaaacgattaacaaaaatatacatactcctcatatcgagagcagcttccttttcattttcttctccctctcctgggtttcgtgtgtgaatgtttctcttccacaaaagcgatagaatccaccagaaatcttcgattgtctctctccctcatctcaattagggtttacgggaccgattttcttctgtcttgcgtgcctacatccgtcgattgggttgggaattttcaatgcctgcgagttctttagcggaatctgtctccgaaaaccctaggcactgccgagctgctaattttcgcctgtggttctggcttaacttcgagagttagaatccttaccttttccttttctgattttcgttgtttttttttcttctgaattccgatg

SEQ ID NO: 28383 - DNA, 3003 bp, Unknown
  misc_feature (1)..( 3003): 2750-1469P.txt file - cDNA_ID_2996496; gDNA_ID_2926259; Annot_ID_143198
acattgtacctggatctgtcccatgctatatacctatttgcatttatcaaatagttaattgcgagaacatgtcaaattgtcaataccaactttatgtattactacgaattagagaaacaccttatatatattgttttgtctactgattttaggatgctgtaggcatccagccactcttttcaagcaaaggactagggcaatccttattatcttatcttaccgttttaatgtggaaagggactttttgcacggtgcttttgtgtaatttataaaacactattttgcagacttttgtctaatgttgttaatgatgctctaagaatctctatgtctaaaattaggcgatggaaattctggcccacactttggaaagtgagtcaaatttacaaaggagggtggatttatttttccttgtggattctattgctcagtgctccaaaggtttgaatggtgagtatgctgtttttgcttagttgcatcattgatgttctcaatggcgagttaactttgtgaatactacctttctattcaggtgatgctggtggtgtttatctttcatccattcaggctatgctacctcgcctattaactgctgctgtcccagctggagctaccacacaagaaaaccgaaaacagtgcttgaaggtatgcgattttagttagatattctttttcttatgaatactaactctcaccctttctgctcttatataggttttgaggctttggcttgaaagacggatccttcctgaatctatagttcgtcaccatataagagaacttgattcgcttagtaatgttcctgcttgcctctattctcggcgatccgctcgaacagaaagggcgctggatgaccctgttagagatatggagggtatactggtggatgaatatggaaggtgagagttgagtctaatcagttttgggatcttgatttctttatctctagggtcataacttttttcacctttttgtttcagtaattcaactctccagcttcatggattctgcatacctccaatacttagggatgaagacgaaggaagtgactcggatgggggtgattttgagtctgtcacccctgaacacgagtcaagaagccttgaagaacatgtcacaccgtccattaccgaaaggcatacccgtatactggaagatgttgatggtgagcttgaaatggaagacgtggctccaccttgggaaggtggaagcagtgctagtgcgatcacagatcaagctgataatagagagtctgcaaattgtctgcttgtccctggaacttcacatcagaatgttacctcgtcatctccaccagctcgcccttcgcagaatgctcagttggcaatgtctaattcctactcaaatggctttgactaccgcagaaatcccagcatgcaggtgcgtcctttttcttcttttagaatcttttgcagttaacaaagtgaggattcagacatagttaataacttaatttgtggttaatattcaagggcgactatcatgccggtcctccaaggatgaatcccccaatgcattacggaagtcctgaaccatcttatagttcccgagtatctttgtcaaaaagcatgccacgtggggagggttctaacttccagcataggccatatccatcttctcatcccccacctcctccgccatcacatcattattcatatatggagccggaccaccatataaagtcgcggagagaaggtctatcataccctcacagatctcattacacactggaatttgacgaaaggaattatcaagacagctatgagagaatgaggcctgaaccatgcgagaatcgagacaattggagatatcatccgccctcttctcatggtggactccgataccttttttttttttttccttataattctcatgcatgctaataggcatatatgaatgcatatatgaatgcatatctgcgcacacaagcacttgctcatggatgctaataggcgtgaatgcttttcttttttttatattgcaggtccacgatatcatgacagacacaaaggacctcatcaatcgagctcatacagtgggcatcaccgtgactcaggaaggttgcagaacaataggtggagtgattctccgcgtgcatataacaatagacactcttatcactataagcagcattcggaaggtcctgttccagtaggaatgagaggtaatatggaaattcatacttgttccacgtcatgaatcagagccttttcttatactggaattgtttcctaggtttagaaactctgacattttcttttgactggggattttatatcattaggtctctgagattcgagattgttttgcttgtcctgtgggtatatcttgaatataaaaatgaacttggagtatgtttgtggatatgcagatccagggacgtggcatcaaaggtgagtgggagacaagagatgaagaagggcaaaggtgcagtctgctctaaatgaaagacatttgggctatagtcatggaaaagaagaaatagggagaaacaagtgtaggttggaaagacctgggccacttgagagagatgttaatatacaaaagaaaaaaggcacagttggtgtgtgtacatatgaccaaaaacgtcgtggagaaggctaaagaaacagtcgtgaaaagccatttgttgtagtagagagagagagatttgagttaggcaatactgtcactgatttaggcatttgatattttgtaaacaaaattttttggtttatttttggggagtggtggtaatacacactaatatgcatttctgtcacctggagagatgagatgtctctaaaaaatggtcaaagaggcgattaattagttaaatagcaaatggaaaaaacaattagggatgggtttgtttgttaccaaggaattaacataacagctgtaatgctgctgcgagataaaatgaacaatgaagaagcggagacctgttgacttcaaataattttaattagtttcttctgtgcgatagagatcgatcgagagatg

SEQ ID NO: 28384 - DNA, 3003 bp, Unknown; identical to SEQ ID NO: 28383
  misc_feature (1)..( 3003): 2750-1469P.txt file - cDNA_ID_2996496; gDNA_ID_2926259; Annot_ID_204676

SEQ ID NO: 28385 - DNA, 3000 bp, Unknown
  misc_feature (1)..( 3000): 2750-1469P.txt file - cDNA_ID_2996506; gDNA_ID_2926259; Annot_ID_143202
tattcataaccaaaagaccaacaacaattctggtttacacgaagataacaatttcgcttcaaggaaataaatctgaagacaatcttagatccttagatacctacttaactatgtttaccgaatccagaaagagagataacactgaacctacctacatagcaacaaaagcatcacatcattcctccccttgcttgattttcagacttccaagctttgattccaattcattgccatcttcgccttcctcctcttcgtcttcatcttcaaaatcttctccttcagggtcattgtcgtccaaaggaacaagcttgtccagacagtccttaaacatgtcatttacctcgtcaataccttcctcagatatgaagtttccattgatgttcagaagcttgaaagtatttttcttcacaacagtttgtgccaaggcccttgccccagctcttctgatcatgttggtgctcaggtcaacttcaactaactgatcatgaccttcaactgcctttgcaattaagatagtcccttcgtctttgagttcattctcagataaattcagctttgcaagagactgtttggaggcgatgcaagctgccaaatttccagtggattttacagtaatgtcgttaccagccaattctagaacttcaagagaaggggcggacttaagtagagcttcagaaagtgcctctgttccctcatcctccaagttcaggtaactcatatagatctcggttaaatgagtcaagactgataaagtcttggccagggcaattccaccttcgactccaaacatgttgtcacgaagatcaagtttcttcaagtggctacagtgttcaagtgcttcagctagtgcaacaccaccttctgaaccaatccttgtagatgaacaccggaaatcttccaaagatggacactccctgacaatctctgcaatggcagttgctccttcatctcctgtcatgttgttatgaaactgaagaaccctgattttgtcagtagaagggagaagctcacgaactgcacgtgcagcatcctcggaaatgccatcattcatcagatagagctcctccaagtcatgctgagaattgatgagagaagcaaatgccctaattcccttttctcccaaagcattgtccgagagattcagatacctaagcttagaaccctctaaagcagatgaaaacatattcatgacttcaagcgcttcagcctctggtcttcctgcaacaaaatccgagagatccacttccgtcagctgatccttgatggaagacaaaacgctcgcagcaaatttggctgcttcagacccaaaactcctgttgctaaaacggattttggtataggagttacgcgggtcagccagaggcctcaaaaggtcgcgtgcctcctcttcttcaataaaagctctgctcccaccagatatatcaaaaaagacatcaccatccttgctcacctcaacctcggattcttcctgtggaccacgtttgatgacatcaagcatgagcttgctggattctttagcatagacgtgaacagcagaagtgccatcaccatcaggctcgttctggaagtgtttgttggcagtagcaaaggccaaatcttcaatgcgcttggcgtcttgctcagcctcttcaacagacaaaagaccgtacttcctggagaagatggaaggggtggtaatgttcttggtcatccgctcaacaagcatgagacgggtactcttactcggtggccacatcttcactgacaaaacacggttctgtgtggttttcgctgaatgatccattctactactgcttggttttcttctgtaattcaatacaaggacaaccattactcaatctgacatagtattccaaggaaaaagagagagcataacatgtagatccaatcgaaaacgaagatggtgtcgaagaatctaactacatttctattgtaaatccattaattaaaaactgcattttttagacaaggaaaccctcaaaatcacactgcaaacgagaagaatatatttcgaaacaaaaagaaacccagaaacatgagagaacaatacgacggtaccttttttttctcagcggatggatcgaagaaatgggtctctctatactctctcggacggagaaaaagaaaggaatagaaaagtgaattcaaagaagaagcgtgaatgagaagcagagtgagagaatcattgatctgcgtgcgtgacgataatgggaggcaatgatgctttagtttatttttgaaaatcaaatttcaaaaatcaaaaagacaaacatcggagagcccatccatggagattagggtttattctatctccgaaatgacgattaagcccctacacaaccctaaccacgaaagcccaaagcccattaataactaatttagaaagcccagtcttcttcttgctaaaaattaataatggaaaaaagacagggcagcgcagcgatgattaaggtgacacggtgggctcccaccaccgccagctggactcgccgacggtgaactgtctctctctaccacacatcactccttccttctgtcctttcttttttgtatttattattattattcattttaaaatcaaaaacccttaaattattaaataaaataaaataaaaggcaataatggaaactttccttcttcttcacaattcttcgcggcttcttttagcttctaagcttcagagcagcaaaaaaaaaacaatggagaagcgccggagatagatctgctttcttccattctccggaccttctctagttcacgaaccaacttcttccactttattctcgtaagcttcttccactttattcctaattcttgactctcaagattcttggtacttggtaggtagggagacatatagagagggtttaggttcttgattaggaattagttcacctgcttgaaatttactctacatacgtcttctatttcaaaaccctattcaaagttaccatttttatgcacatcatcatcttcattgcagattcgttggagaaatg

SEQ ID NO: 28386 - DNA, 3000 bp, Unknown; identical to SEQ ID NO: 28385
  misc_feature (1)..( 3000): 2750-1469P.txt file - cDNA_ID_2996506; gDNA_ID_2926259; Annot_ID_204682

SEQ ID NO: 28387 - DNA, 3000 bp, Unknown
  misc_feature (1)..( 3000): 2750-1469P.txt file - cDNA_ID_2996508; gDNA_ID_2926259; Annot_ID_143205
tgaagaggctagtgaagctgcaagtgatatcaaagtaaacttattaagcagccaaatacagaatcagatgtgaagtccaacgatcaagccgaagctgaaatgtaagtgagtacctttgaagcaactcgtcattgtctgagccaccgaacttcttgagtctgtttccaacagactcttggaaagcattacgcacggatcggatgttgagtttgccgtagacaatctgtagccttatcgtcatcttaatatcggcttccatgagatcatccatgaatgacttgtttcccctgatctctgaagctggaagatttgcgtacttgtctcccacaagtttcttcacatcatcacaatcagcatacacgcctggccaatgccagaaaagctgaatcaatcaattgaatggttccaaagcataacttttttctattgctaaaatatcaaaaccaactactttttcactccagtcctatcctttaatgccgtaaactgttgatagcacttcgtaatgacaaaaagtgagatctgttacttagacttccgacaactaaaaatctattcaccaattccaattaaagaccaaccaatccgacaatttgcaagcttatgacggacaaggacaattcaactaacatgagtttcggaaatggattaaaaagttaccgaaggcgtagacatcgatgttcttcaatcccagtaagctcttcttcctcaggccgacgccgagtaatcgccgggaatctccgattgaagcgggaaacgagaaaccggtcttaggttcgacaacggattcgtctgctagagttatagatccccatggtgaaagagacgaacggtgagaggagaaggcccactctagaatcggatggctgggattccgggacgccgcgatcgcagctccggcggctgcggcgccaacggtgacggagacagcgacagcggaaatggagaatccggagaatgacgtggtggcacgcgggggctgagaaaacgagaaagggaagcgaaacgaaaccatcgtcgtctttttggtgtgagtgttgtttagtagttcactaacttttttgtttgtttgttacactctttcttcttcctaggcatattgataaacacttcacacgccattgatatgattcagcgacaataactcctgctttaattgacacgtgtattgcacgtgacctcgattcttccggacatgctatgtttgggctttcctcgttttactattccggacaggatctatttgggctttcttttgctcattttatagaaaggcccccgttgcttttttttttctggaaaaatattggggagatgaatgaatagaatattttaatcaaaatccaattaaaggatgtgtgtgtcatgatgagaggtccactatatttgcgtcttatcttccttggtcgattgagattcatttagatattagaaggaatcatccaaacttgtcttattcacgacaccaagatttgttttctagtaagaaacccaattcagcccatattaggcccaaatttaggaaaggttctcaccaaaatttgaccgtcaattattccatcgacggtctataacgtgaccagtcgagatattttgaaatgtatcgctgtttttagtttcttttaaagtagttgaagataattcagtctgaagacaaacggtgtgtaagtgaagaagaaaaataaggaagaagaagaagcagcagcaatggtggagaagtcaggaggagaagtcaatttcccaaaattggagaaaccaacaggcaagaaacagacagcgacggttgttgtgggagtgttggcggtgggatggctggcgatagagctcgtgtttaagccattgttcaagaagctgagctcctccaaggacaaatccgattccgacgatgccaccgtccctcccccgtcgggcgcctgaatatggtgagtgagaatttaacaaagcctctgcgggagacacgtgtgttgaagctcattttattagcaaatcttgtgtttctttttgtaatatcgttcggacttttacgtactgctttgatgatgtccttttttaatttatcccccctttcaaataaaatcccgacaaggataataaaatcaatgagagatacgatgtaattggtttttattttcttgtttgtcttgggttttgttggtaataaataaatcttgattaaaaaaaattcttcttttatgagtcatttcgtgttagttgttgttggtcgtatcagtttaatattcgatcttattattaaaagtttctaacctgtaacagtaaatcattttctatagaatgttatatactgattggcacttgtttaatttatgtggtaattataagaaaatatataaataatattgtgtgtaaagaataaaaagtaaattattgaccacaagaaagatgaaaagaaaacgaaaatttaaaaaataataaggaaacataaatttggctggctaattcccaagcgcaaagaataaacaaagtcgttgaaggaagtttaaatgaagttaccagtttagtaacacaggccaaattgagctccattgtttatgctctgcttaattatttatgttcctcaatatctacaagccagtgtgtaatctatcaatataaaatatggagataaatggcaataaaagatcatattagcataatgagaaaactgatttttttaaaaatggtaaggaaaattgtcattcatctattaaaattctaaaactaaaaacgacggcgtagaatgaaaagctactgagctacataatcacttgtggtgggttctagaaactgaaaataggaaggcccaattatgagaaatccgtgatggcgaagatagagatactacagtaataataagagctttgcggatcacgtgtcgggtcaacccggttagatatatggagcatccatcctcggccggcaagttacatcgttggtagatcgatcaatctcatctccgaaacaataaccgccaatttccttcctctctaaatctctccgatg

SEQ ID NO: 28388 - DNA, 3000 bp, Unknown
  misc_feature (1)..( 3000): 2750-1469P.txt file - cDNA_ID_2996512; gDNA_ID_2926260; Annot_ID_143207
ctttttgggagtgggaacaaatgaattggtcttaaacgtattaatttacttcttatgttcatttgttactaaatatacaatagaagataagaaaaaaaaagaacaagtcgtcagatttgtggcaacttttgttcttttcagtcgccaactagtagtatatgaccacgacatttttaagcctaacctgattattaggctaagcttgaagattcattatttttcacgcaagtcttttttcctttattttcatgtgtacctttttttttttttttgctttttgttttgaatgagtagagaatttttgaaaggttagttctacttgatcatggaagatatttagattactttgcatgtattattcttaaaaaaaaaaaaaaaatcgatagaaattagcttcaatcaattagatcagtctcacattcaatataaatccgccgacacttattgcactttctttatttccattttagtattgtatgtgtgatcattttaactctcaccatctgttttagaggtgttcttatatatatagagatgtgatctctcattagatcgacacaaaaagacaaggatgactgaatgagtataagcatctcaaccgggtcatgtctttgatcacgttgaagctctttgttagtcgttcaaacttctgtccacgaaataaaaactgtaaaacaattcttagattttttttcattatgtttgcaatatagaaagaacacatgagacaagaaaacatttttttttaaattaatttattgagtgaggtgtacatattttgaaatatggcttatgctttatcgatggtgcaaattactcttacaaaaaataaggtcaagtgcttagggatgtcagttaggttgtccacgtctaattcgtttttctggaaattaatgattaaagttttattgaaaattctatgtaaactgattgttttatcaatatcataaattaataattataaaagttcatcgtcaatcaacatttctataaattataaactaatttttatctaacaaatgatccattttaatttcatatactctatttttttgtttaggaaaaacacacatattaaagtaaatttaaaaatgacaattttaattaatcttgaattattaaaattttatttaataaaattataaatctgataaacatacgcaaaaaagaagaaaggcaggtatgggttatttttgtatttatgtatccatttcccatgtgtaagatccccatgcatttacaacaattattcttgtcaacatcgtcagcattattaacaaattctacacacttctacgttggttcaattactcacgtaaacttttttaaaaaactaaaatttggagccaaattttttagaaatctactccaattttgtttaccggcaaaactagtatgttttgtttaatcaaatggctatatatattctcaataattgaattgagtttggaagcttgttcaagtcgaattgatgatttactttagaatgatctccatgaattggttgaacaatttccaccatttctatgtcgtcgttaatctcatgaaacttgttcaaatcgaattcatgtttaactttgaaattgttaacatgaaaaccttcttccgtcttcatcttgttttgaaaatatttttttttttctaacatcaacatgaagctttattagagtgatgatgtgtaatcctcatggaggatttgtacaagaaaagttggtacataagaatgagatacataagaaacattgccattataatgagctttagctaggcgatcggctgccttattgcttgttctggttgaccattgaatgttttgaccattgccattattgcttgttttgaaaatattttatgaatttgaaaaaaacagatcaaaaagaattttgagtcaaagagaggaaaataagaaaaaacaatcaatagctggaataataagatgaagaaacgttaatcatggaagcaaagagaataaacgtaacaagaggaagatgatgaaaaaaaaacttgtgatgatcaaaatagcattcgtttttccacatatactctataaaacaatcaagataatagttatgtgaattaacattttgtttcatttagtgctgatttcgcgtaaacctaagcatcaaaataaaattcttcatattcttaatttattttattctaataaatttgaaaacaaatacaaagaataaagaaagatataataggaaatataaaggtatttatgcatagaaattaggaaaagatcaatctttttgaagcaaatttttttcctagaaaatcaaataaaaaggaacagagagaatagaatttttctaattttgttatgaaatcaagttaaatacaaaatagaaatgatatgttaaattctaattggatagactatgtcatactttccctttacatgatatactttccttttcattatataaccgaacttaaaccgaacaaataacatgagaaccggactaaaattaaccaaaaaagtagacgagcgtccggttctattataaccggatctatatcaagtgtctcgggttcgatgcaacgcaccgttaccagtttcaattaaaacgcgacagtattatatagcttcaaagggccctcatagcttcttctccttcctcactcatcgatactcaaagctcgtaatctccttctactctccaggttcgtgatcttcgttgcatttgctcttattcatcaccaaattgcgattactctcttgatctctcttaaaccttaatcgtttcaattcgaattcatcagatctgatcctatttcctctcattgtcacagatccgaggattctcttcgtttacaggtatttcgatttcttcaattttcgatttctgtatcactgatcgcttacggttatggaatttgatcttgttgttttgatgcatttgttgatgattgatgatcatgatttttcgattttcgtagatttgtaaacgttcgtgaaattggatttgttgatctctttggtaaacaagcatg

SEQ ID NO: 28389 - DNA, 3003 bp, Unknown
  misc_feature (1)..( 3003): 2750-1469P.txt file - cDNA_ID_2996542; gDNA_ID_2926261; Annot_ID_143221
aagaaactttgtttggtgtcaactgaatccgtaatgcttaacttgcttccgcggccctgtcggaaactcatcctcaatttccggctcacgaactttttgccacatgacaccttttatctgcacagagagagagagagatgggtcagatccaatccactgcagccagcgcaaaggtttcttctctcactcttttgtaagcaatttcgtgatccacaagtgactagacttgacctaaaccgtaagtgttttgctttttgtttttgttgttgcagacaatagaaaagcagcaatcatgttgccaaagttcgatccaacaaacccattagctaccatgtctgttcttgaggatgtgacgaccaacgtaaagaaaattcaagattccctcttggaagcaatactttcacgtaatagtcagaccgagtaccttagaggtttcctcaccggtcaactcgataagcagagcttcaagaagaacgtacccattgtgacctacgaagatattaagcctcatatcgatcgcatcgctaatggagagccgtctgatctcatttgtgatcgacccatcagtcttctcttggccacgtaacttcaaaaaaatactcttaattcctcttttttacaaaaggaagtttgtgaaattgaagtgtaaagaccttaggaagtgattgtttgtgcagcacgggaacttcaggaggtattccaaagttgattcctctgacagcagaggaattggaacagaggatattgtttgggtttctctatgtacctctagtcttcaagtaaagatttccaaactccaagttgtgtctcatttgttgataccatgaagagtaagtagtaaaacccaagtcactttgttattactgtttgcagacacatcgaagggctaacccaaggcaaatctctcatgttttattttgtgacccgagaaagcgagactgtctctggactgatggtcaggtttatgatcacttgtgttttgaaaagcgtgaacccaaccaactcatttctttggtacatcaataaaactgttgctttcacattacactacctagttccactgcaagtgtttcttcattgtgtttgtaatctgatttacagggatcgagtacaaataagcccgcatgcaattgcgatttgtgaagacactaatcagggcatgtactgccaattgctttgtggacttctccaacgagaacatgtagctcgcctaggtgcgccttatgcttcttccttcctcaaagtaataaagtttttggaagatcattggcctgagttatgctctaacataaggactggccgtctcagcgactggatcacagacgcccaatgtgtttcagggatcggtaacttcctcaccgctccagatccggacctagcaaacctgatcgaacaagaatgcagtaaaacctcatgggaggcaatattgagtagaatttggccaaaagcaaaatgtatagaagccgtcattaccggcaccatggcacagtacataccattgctggaattctatggcggtggtcttcctttggtttcatcatggtatggcagctccgaatgtttcatcggtatcaatctcaatcctctgtctaagcctagtgatgtgtcgtacaccatcattccaagtatggggtactttgagttcattgaggtcgtgaaagaccgtcaagaagctggccatgttcccgcagaccctgtggtggtcgacctcgtcgatgttaaaattggccatgattatgaacttcttgtcacaacgttttctggtaagtttcttgtactctacgtttcaaaataaatgtagttttagggttttgttttaaaaagtctttatattgcttgcttgagaaaactataaatgatagaattaaatattttcactcttttgttttcttaatgtatatgatatactaaaaatctatatgttggttttctcacaagatgcatgcgtgaattacaggtctgtataggtaccgtttaggggatgttttacgagtgactggtttccacaacaatgcgccacaattttacttcgtggggagacagaatgtagttctgagcatcgacttgagcaagacctacgaagaagaccttctcaaggcagtgaaaaacgcgagtctcctgcttgagccacatgacctgatgctcatggatttcactagccgtgtagatctatcctcgttgccaggacactacgtgctctattgggaacttggtaacaaattcaagaacgccaagctcgatcccaaatctaatgtcttggaggaatgttgcttaaccgttgaggagtctctcgactctatctacagagaaggacgaaaaaatgataagatcattggaccacttgagattaaggtagttaaacctggcgcttttgatgagctcatgaatttcttcttgtctcgaggctcttctgtgagtcagtacaagactccaaggtcagtgacgcatgaagaagccttgaatatattggagtcgaacgttgtttccgagtttcttagccggaaaactccgtcgtgggagctacatgagctacattccagccgttaaaaccaccgttacataagaataacaaagcccgtaacaaataaacacaaactaatgacactttaacatacacaatgtatttcctgatttatcatacaagttatcgaaatatcataagtgataagtccatggattatcgagtttttttgttggtccgacaatattctagctaggcacgaaaagtcgcgtttaaaatagtgacactcaaatgacgaaacgacagtaccactcgtcactccttccatacgacagcgtttggctagcttgagctactattcagtggacacagacctacgagagctaataagattagagggccccacaagaaagatccaagggctatcgctcatccggacacgtcactgtttccgcgaaatcaacacgcagatcctttcttcatcagtaaacggcgagattcgccatcaatctgaattccaaacaaaaattccggcgaccatg

SEQ ID NO: 28390 - DNA, 3000 bp, Unknown
  misc_feature (1)..( 3000): 2750-1469P.txt file - cDNA_ID_2996546; gDNA_ID_2926261; Annot_ID_143222
aatgagtcatcattatgtttttggttacgctaaaataaaaagaagaacctttggcttttgttcttcaatccttatgcatgctttctaaagtggttatgatggattttgcttgatgttccacattatgggttattctattttctttgttcttgtaagatgatgcttcagaagagtttgttactttttaccgtatttgtaatttacattttcactgaaaacaattggcgagtaaaaaagtgtccttgtcttcttctttgttcggattatatgaacaattgttcctagaagcctctctacataaaaagctgagactttatctctcatctctctttagacgtacaaaaaaatcagttttttaagtttcactctaatggcgtcaatttcgtcctttggctgcttccctcaatccacagcgctcgccggaacttcctccaccaccgtacgacgccgcaccatctctctgtttcttcttcttcttcctttttattcactgaatctctcattttgattctcagagatgccggacgactgtggctgctcgattagctgaccaatcagatgacttcgctcctcttcgttcttctggttggcttgcttctacagttttacttttctgtttcctcctcaacagtgaattgaattataacttcagttttgaaaacaggtgggaattgtggatgtgttaataattctggagagtttgatcgcagaaagttgttggtttcttctgttggtttgttgattggagcattgtcatacgattctaaagatggagactttgcatcagcttctcaatttgctgacagtaagaattttcaatttctttttggagggcagagaatctttctcagggttacatttcgattaagttgttgctttgtgccttattaagtaaagttattggcatttgtaatttggaacattgtttgattgtccactgttaagagtttggttgtgagagaaagatgtgttctttaggtgaagttaatttatccgtgcgtgattgttgaaatcatcgatatagcctcttttttttctaaagccacattcttttcttggtatattacttgcattcacagtgccagcgcttaaagggaaggattatggcaaaacaaaaatgaagtatccagattatacagaaacacagtctggtcttcagtataaggtcacccctcattagtcccatatcttatatctaatatagtttagactatgcggtgatcattaacttgaagatttgagatgctgcaggatttgcgagtaggaactgggcctatagcaaaaaagggagacaaagttgtggtaaggaaatttctgcatatctatggttttgtatccttggtctcaagtttatctagaagtttgctctggttagagagtttggagtttgctttgcttgtatctatgttagcaaattaatgtttcaaagaccataggttttgctagtagttataaataattgaagctgggtatgttaggttgactgggacggttacacaatagggtactatggacgcatatttgaagctcgcaataaaacaaaagggggttcttttgaggtataaacacgttttggctctttttttttttgtttcattagctacaatgatacagtccttaatctttgttttctttttgtgaatctgtagggcgatgataaggaatttttcaaatttaccttaggatccaatgaggtgggcgaaattccaagtccttctagttgctatatgggttttaccggtttaaagaatggattttgttactgattgtatgaattgtttctttctggatgctgcatgattttggtgttccaggtgatacctgcttttgaggaggctgtctctgggatggctctcggtggtatcagaaggttcaacatctttctaatatttctaactctacacatcctccatatgtttttcatatagaactcactcttcacacaaatggtagacggtagaatgaatcagtgtaaataattagcttggtattgcaggataattgtaccgccagaactaggatacccggataatgactacaacaagagtgggccgaggccgatgactttctctgtgagccttatgtttgttttatgtaaacatgtataagaaagacataagttttaaatgttgtctctttatgtttgcgcagggacaacgtgcattagattttgtgctgaggaaccaagggctcatagacaagacacttctctttgatgttgaactcctcaaaattgtacccaattgatgtaacatcgacagtcttaactcacgtacatatatatttatttatgatgtgtatactacattggcacatttgtgtaaattgagctcagtttatatcatataatgttagctctttttaggagtgttaaaaaaaaaaatagccatgcatcaccaactaactgttcatcatgttaattctgcttcctctttttagttatattatcccttatagtgaggtaagttattataacatttcatagaaagtttagaataaaatgaaatgtgaacacaaaaaccagtgtaagcagcttctgttgttttgactttattgagtagccaatgttggttcaatgtcagagtcatcattaatggagactgcaaaaataaaagaacaagttgcagtgacgcattgtagaagtccttcaatgagtttatgtctttcaaggacaaaacatatcaaatgaatccacatttctctaaataagtcctttcttgaacgttgaaactgtggacatcatgggagtccacgtgcaataaatgccagtcctatatctaccacttaccagctaagctccgtctatttaattccatcttcccattttaagctactgcatttatacatttctctaaccaatcctcatacatccttttctgcttacagattttgtttggctggattaattatttcatttattaacttaagctctcttgctgtttttggtcactctgatgctttcagtttccatggttttatgagaaaatatcattgattatg

SEQ ID NO: 28391 - DNA, 3000 bp, Unknown; identical to SEQ ID NO: 28390
  misc_feature (1)..( 3000): 2750-1469P.txt file - cDNA_ID_2996546; gDNA_ID_2926261; Annot_ID_204740

SEQ ID NO: 28392 - DNA, 3000 bp, Unknown
  misc_feature (1)..( 3000): 2750-1469P.txt file - cDNA_ID_2996550; gDNA_ID_2926261; Annot_ID_143225
aagtagcttattcatactcacgaatgaacattaagatgccacgaagctacataattatcatgttagaacaccgtcattgttctcttcagtattaatagtaaaaaaaccaaattgacgatttctcgaagactattaaaggaatatccgcaaagaagaaaaaaaaacatttttttggtaaaggactaatctttttgtttgcatcggccatctctaaccttacgattgtgtgttcttgctttgagcgaaaccctagaatcggtcttaacccatttgagcagagatgctgcgagtagcaggaaggaggcttttttctgtttcgcagagatcatcgacggcgacctccttcgtcctttcccgtgaccataccctttccgatggaggcaactcctcttccgcttctagatctgtcccctctgcagatctctcatctttcaattcttaccaccggagcgttataagaggtctgccgatctacaactctttctgtctctcgattgattttcatttctggtgttatccattgaatgattcataaatttttaaaagtcacctcttttgggcttgtataagtccggaaatgattgagattcctagtttcgtatctgcgagatgatctatgggaattaagtcatctgttttgaattcttatgatgtgtattagagcttgatgtaccatttcgtctcattcttctccttgctggaatagtgattgatcggatatgaattgaccagctttgagataatccttttttgatgagataatcgattttgacatgtagtttattcattattatggaaatggatgttttatcgtctttgggcacatcatataagatacttgcatcagtaaacgaatctggaattccatatctttaaccaaaagggctatgtttgcaatcttatcttaggagttttcttatgttttaagcatttatgatcattgaagttccttccttggatcttgcgttagatagattagtttagttttcactgaatttgatatcatggtagaaaattgtttggatgacaccttctgttatctcttggaatccgtttttataatcttatgttattctatgcattaatgttaaatgtttgctagtgttattcctttcttctgtgttatctcttgaaaatatttttgcttaatacttggtgttgttgaacacttgaccaagtataaagtttgcccttgatgtgaaatattaatgtttcatgctattttcaggttttgcttctcaagtcattactcagggaaatgagataggttttggttcggaagtcccagccacagtcgaagctgtcaaaacacctaactcaaagattgtctatgacgaccataaccatgagcgttacccacctggtgaccctagcaagcgggcattcgcctattttgtcttgtcgggtggaaggtttgtttatgcctctgttctccgcctgcttgttctgaagcttattgtgagcatgtctgcaagtaaagatgtccttgcccttgcatccctcgaggttgacctagggagcatagaaccaggaactaccgtgacagtcaagtggcgtggaaagcccgtcttcatcaggcgaagaacagaagatgacatcaagctggccaatagtgtggatgttggatccctgagggacccacaagaagactcggttagagtcaagaatccagaatggttgatcgtggttggagtatgcactcatttggggtgcatccccttgcctaatgctggtgattatggtggttggttttgtccgtgtcacggatcacattacgatatatctggaagaattaggaaaggtcctgcaccatacaacctggaagtaccgacctacagcttcttggaagagaataaattactcattggttaatgaataaagcacaacagtccgagtgtcatggtctggatgatcttaaatctgtttttgtttttatattttccggcattttagcgtgcaagttcgctttcctcacactttgggctcagcaaaaattggcttgttttgctgaataatacaaacttgtcattgtatgacttagtatctgtctcatctggtgaaaatacattgttcatacttcatagtctctgtttattatttgaaaagagttttgaatagtatcatccctatttttcttatgtttgtaattttgtaacatatcgtttgtaagagagtttcctttccttaaagtctgtagccattatcacaattgagacaaaaacttggtaaggttcaaggtgtgttataaaactttcgtgttcttactggagacgacatttcgaagaccttcaattctcaactaagccataaaccttctcttccatagtgagaaatccaattgtgaacctcgagactactactttgatgaaagatgtcatattctggttgtggatcttagcctaattttcttgttcagattgttttcatcgatgactacttctttgatgatgtccttctagctctttcttctagtattgaaaagttcacacagatgtaaaacagtctttttgttggaaatcttgtttaaacattacaacaacaaaatatatcctttaccaagtatagaccccctattattattattaaaaattacgatttttatacaaataaaataatttatcttacaaatacacacacacaaaaaaattatatcgtaaaaccaaaagattttattaattaaaattagaaaaaaaaccatgccatcaaaatcctgaagtaaaaaaatatcaagtaatacgcaaaaaccaaaaaaaacaaaacaaattgaccttttctcaaagacaatttttaagggacttactagtaagtagtctcttatgttttgttttgcatcggccgtcccaaacctgaggatttctctgttcagctagagcgaaaccctagattcacatttgagctgagagatgctgcgtgtagcagggaggaggcttttctctgtctcgcagagatcttcgactgcgacctccttcgtcgtctcccgtgaccataccctttccgatg

SEQ ID NO: 28393 - DNA, 3000 bp, Unknown
  misc_feature (1)..( 3000): 2750-1469P.txt file - cDNA_ID_2996554; gDNA_ID_2926261; Annot_ID_143226
gaacagtttatattcgtttttaaaaattcaaattatgacatatgcgaaaaaactctaattattttttttataatgatgatattatttttcggcaaaaatagaatcatataaagatgagaagtgaactataataattaataaaaaattaatatgataatttagatatcaaatctaatttgttgattttaattggttatttttttggaaattaataatgcattttatttttctaattaaattaaattaattaaaatttagatatcaaatcttatatgttgattttgattggttattatttttggaaattaataatgcattttatttttctaattaaattaaattaattaaaatttagatatcaaatcttatatgttgattttgattggttattatttttggaaattaataatatattccgtttttaaattaaatttaattaattaaattagtatttaactttttaatccttaaagagataaattaatttattctttaaaattttatttttaatggcatacctatgtaattacttacaaaaattaaggttacatttaaaaagtacttcccaaataatatagtaggatagaaaattgagaacaacatcttaattcgtaagaaaaatagtatttttttagaacatcaattattttgaaatagagaaaaatacattattgtagagttcaaatacacattaaaaatgatatttttcatatacacatatatacagttaaatttgaatatatatatatatatatatatcaacaataatacaaaataataatctacaagatcttgtttacaacaaaaaaacgagttaagttgtgtattacataacctcactataacatttgaaacttggtaaaacactaaaaacctgagcaaaacaaattaactatcataaatttgccactatctacaggtagtaataagcccaataaaataagtatgagcccagtgaagcccaatgcactaagttattttcttcctctgaccagtttcatctctttgctctcgacaaagcagctgagcgacttttgcacatttctagggttccaatcaaaatctatctgcaacaaaaatggctaatcgtttcagatcagggatctccttcttcaagaccatcgccgtaacagattctgtctcctccgttagatccaagtcgcttttcccagcggtaattcgcattcttaaaaatcgaatcttttcagtccaattttttgttcggagtcgattcttacgagatcagtcgatccaatcgcctaattggattgataacagtatagaatggggattatcgtgttttctcgcttacattgctcggctttagatgttttggaagtcttttaactctatctctgttattttcctgagaatgctatcaatcaatctttaaagtttgtatatttctatcgcagttgagaacttatgcaactgcttctgctcaaacaaccgctaatgttaaggtacacccttttatcaccatcgtattattttgtagatgcgagaatcgcgacaatggcttgaattgtttgattggcataaatgatgaaccgcggatagctggattttgtataatatgtaatggaagtgtatctagatttatacttgttgttgtttcaggtgcctattgctttagttggtgaaaatgggaactttgcttcatggctatacattgcagctgtgaaaatgaattccttggaaaagattgagacggatctttctgagatgattgaggcaatgaagacagctcctatttttgctcagtttacaaaggatccctctgttcctagagggacaagattggctgctattagggatgcttgtgatcaagcaaagtttgccgaacccactaagaacttcctctgtatgtaattcaagtttgaaactgtcttgtttttatgattttgattgaccttgttgtgctgatattaaaagttgtttgctttctgtaacagctttgttagctgagaatggaaagctgaagaacctagatgccattgtgaagaaatttatgcagctgacaaacgcacataggggagatgtcaaagttttggttaccacagtcattgtaagctttagtctcaatacttgttatctcttaaataaccataaactcagtattgtggatttaatcatatggtttggacagccgcttccccctgctgaggagaaagaactgactgagacgcttcaggagatcattggagcagggaagaaaatcactgtggaacaaaaggtatgtaatcagatatgcatcaaaggcttgtgattttctagtaacccataaaatggatataagcatctatgtcaatggtggtaatgtgtgtttgtagattgatccaagtatctacggtggactaatcgtagagttccaacaaaaggtgttggacatgtcaatcaggacaagggcacaacagatggagaggctcctccgtgaacctgttgacttcaacaacctctgaaaatcttgagagaaatttcccccaagaaaacatgcttgtgatgaatgccaccaattgacaaataaatatggaccctcctgggaaacaatataatagctggccacttctctccctttgaattttgtcatttgctttttacatattgttgtttgcttcgaaataaagcttttcgagacatcaaatttcaatgagattgtttttgtttagatttgaatcgttgggctaatttggtaaataaatctacaaactatgcccaagtagcttattcatactcacgaatgaacattaagatgccacgaagctacataattatcatgttagaacaccgtcattgttctcttcagtattaatagtaaaaaaaccaaattgacgatttctcgaagactattaaaggaatatccgcaaagaagaaaaaaaaacatttttttggtaaaggactaatctttttgtttgcatcggccatctctaaccttacgattgtgtgttcttgctttgagcgaaaccctagaatcggtcttaacccatttgagcagagatg

SEQ ID NO: 28394 - DNA, 3000 bp, Unknown; identical to SEQ ID NO: 28393
  misc_feature (1)..( 3000): 2750-1469P.txt file - cDNA_ID_2996554; gDNA_ID_2926261; Annot_ID_204744

SEQ ID NO: 28395 - DNA, 3003 bp, Unknown
  misc_feature (1)..( 3003): 2750-1469P.txt file - cDNA_ID_2996568; gDNA_ID_2926262; Annot_ID_143240
agaagacctgaagaactgggaaatccaggtataccatattcgcccatgtatgcaatatgctctaaacagaaaacttgcatactaaaacttgaatgattgaaacactacgaaaaatgaagtcttttaactcttaatccatccaaaaccacattgtcaaaatacattgattactcatctactggcgaaacatcacgacctatagaatgctaaagacatattgattccaacacatttataagttttttttttgtagaaactaacaaagatgaaacctcattctcattcgaatttaggctctgccaccacgaaatggtatgcaatgaccattatgaagatgaaaatccccagaaaattggcaaagaagccgaggtcttggtcgtcaaacatctgtaacaccacacacaattaacaatatgagaagcttggtatcagacttagacaaaacttgttaaaaatcacccaccaatctacactttcaacatcattttctatgaagatggagcacatagtccaacacaattaggttcatacgtcaggaacaagtttctttaccaaaatcactaaaagaaaataactttgacgaaatccagacatgagtataacatcaaaaacatggaatacacaaaaataaaaataaaaaattgattgaatctcatagcagtaaataaagaaagagttgcatcatcatcacatctataagtaattgatcatatgaaatagattcaagccttaagatctacaaattcgctaccatctgagaatgacgtatccaaggtaaagaccgaaaaaaacaaatcaaatctctgagtgtttttacctttggagagctcaaaagatacagacttccttctttgattcttccctctatcgactctacgaagcagatcgaaaaagaagaagaactgaagaatgactctggttaaagaggtggttgactcaaaaacaaatcgtttggtaatatggtaaacgacgtcgttttacttctcaaaaaaggaaaaaagaaagtgtggctgctgggattcgagcccaggtctccacggccacaacgtggaattcttaccactaaactacagccactttgttgtacagtctataatattaataattatattacaatatgtttaattgctcgtcgttgtctcttcctttcttcttcactgcaattgctcgacgttgtcgcttcctttcttcttcatcatccccgacgaataagagaaccaaatggtcaagctttggatcgccgattcgttcatctgaaaccgggtctggatccgatgacccggttgcatctttgatccatgtgttccctaccatggatcctgaggttcgttagatattgtgtcgtaaagtttccatttttgactgatgaacaatgctactacagtaattgctcttttcatatactttaagttcatcaatcttccatttaaaaagtgctaagttatattgatgtagttccttcatgaaatgaactaggtaacagttttgtgtagctattgattgatatgtcttcatctacagattaacattgtgataaccaaagccaaagccctgcattgcagagaaactttgatgcaacattagcctttgttacttctgtgttgtgaaaaactgaaaattggcgacagttttgtgtagccattgattgcatagaaacttgatgcaacattagtctttgttactttgtgacttgtgttatgaaaattggtgatcttggctgttatgttttgctacaaaagtctttgggagtttattgctaatgtagtctttgttttttggtgggatcttgaattagtttgtcagagaggttatgagcaacaagaattacgtgtttgaagaggcaaaagagagtttaagctcaattttgttcaatggggattctgatagaacagaagctggcttttttgatggatctgtggaaagttggaacgatgaggatatgatcgatggagctaaatgggttgatagacttgtatccgagatgacaaaagcgataaacattgatgacatgaggcgacgtgttgcagtgatcttagaagctttagagagtatcataaagaagaacaccaacgcctcgaagaaggtataaattgatgacattgataatgctcaggttttcttgggcctagataatataacaaatagagagctcccaattcattgcagcttgaatatgcgtcgatgaaggagagtctacagagtttgatcaatgataaccaaatattgaagcgggtcattgcgaatcaacatcagcgtagctctgaaaacgaagagaaggccaaacaagtactgcatttgagaggcgtggtggggcagtaccaagaacaagttcataagctagaggtataactaacttgcctactagaaattctcggaattatcaatcttataaatcagcggattactgattttcccttcgttttcgtttgtggatatcattcatcagcttagcaactacgccatgaaactccatcttcaaaggtcacaacaacaacagacttctttctcagggaatttgcctccagacatctactaaaactatatgattgtttactacatagtcatttatagtcattaggaccttaagaagtattattagtcaactgaatttcaagtcatgcaaattttaatactaaagactttacttgtatggtttgtttgcaaattgttttagggcaattctcattaataaaacaaaaataatttctgtttacaaatttataaccgaagaaaccgcacaaggattaaaccaaacctgttatttaaaccggagaatgtagaaaaccaggaaacgagaaccaaaatacacaagctttaaaccaaactggttatctaaaccggatcaagttttccccgccaaagcaattttcattcccattgttccaaacagtttaaaccctaaacttttccccaattttgctcactaaatctcacgaatctctcctctcgagaatctcctagggttccgattatttctcaattaagatagtatccagctcgatg

SEQ ID NO: 28396 - DNA, 3003 bp, Unknown
  misc_feature (1)..( 3003): 2750-1469P.txt file - cDNA_ID_2996575; gDNA_ID_2926262; Annot_ID_143242
ggctcctacgcggttagcaaaccgacgagacggaccggaattagaaccggaaccaccgcgaccaccggtgttattgccacctccaatgcctcctcggccgcgagatccagtaggttttcgattagatttgatgatatcatcaagtgacatatctaagccacctgacatcttcgccggatcttttctccgatatcgagaaatgtagctagggttttgttgctctgagatttcaaagatggaattacgcaccgcgagagtgagagagagagaaacagatattatcttctcggagaattacgataaacacctcagctttaatcaatattgttttgttgcccttaaactcttacgttttactaaatagacccctgagttcttaatgggccttttggactcataaaaatccagtggcccatcctcattgtccacttcaacttattatatttttttccctccggccattgtcataatcaaagatgtggacaagtacatgtgaagcacacgcattgcctgtatgggcacagtatgtgactgtatcacaacgtacatacacattcacgtattaatattagtaagtcaacccttttttttctttgtttatctcaatttggaaaacaaatcttgccttgctatttaacaaattacttgtaccatgagtgttaaagacatctttataacctgaccagaagattttatgtagaattctagacgaattatgaaatttttaatggttaagtggacttttttattatatgatatacagatttgtattcaaatgatgacacattaattactatacaaaatatttaaatatgttgataaaaacaaaatgtggttaacaaaaaattattgatatctttgatccatggaataataaccgttgcacaatagtattttttgagctgccttttttggcagtaatataatataaggaaataaatagtcaatatcgttagacgttatagtctcacatggtcacatcacttccccatacaaatgagccaatgagccggatgtcatgtgccagtcgccgctaaaaacatgatagatagagtaaatgccttcattattctacttacataattcgactatcctaatatataggtgctagatctagcaatataatctcttctgtttcttcttttttttttttttttttttactgaagcagttacaaatgtaggttggtccattctatttagatttgtttcgttgcatgccaaacaaaataatgttaaccggttatagagtactaaacaaacaaaataatcgctaaatataagttcagctttgaaaagaatatactctcagctaccacgacaagtttgttcaactatcagttttacatcataaagcattataggttttgattgtttaaatcacgaattagtatgttgaaacaataataacaataataaatatggcattaatctcgatagtggtgtgtgtgtgtacctttgtgtaaatctaccacctaacaatgtcattatgaggctctctcagcaatcaattttgcaaggcaaaaaaaagaaagatccaaatctcgtagttggattctctgaacttggaaacgggatgtgaaaggaacatcgatatctatgagcacgggctatgaattaattttatacattctgtattgtttctttatccaaataagtatatatctttctttatctgccggtcaaaaactctgtaaacgaccgatgaagtattcttgagtagagttttaatgattttctttagtataagatttatgctcttcagttgtttaaaatttgtacgagaccttgtttagttatgttaggttttcttctttattttctatcaagaacatccaatgcaggtttgaatatggatgacaaagtcaagtattttcgtctctacatgaaagaaacaaacccacaccactttgattttgttggtttagactatagtcatcggtttagttgcataataacctccctaagttttggggaaaaaatgaaactaattagatggttaattaaatgaaactcgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaaatg

SEQ ID NO: 28397 - DNA, 3003 bp, Unknown
  misc_feature (1)..( 3003): 2750-1469P.txt file - cDNA_ID_2996582; gDNA_ID_2926262; Annot_ID_143246
acttctgggcaatgaaagatgatttttgagggtttcggttttgaatttatacgtttcgtgtaatgatgtataattggatcctgaaatatgacatagatcgatgacgtgtcgttagatgaggaattgttgtcagactaatcaacggttaacgctaaagtcggcggttaatgtgggctttaatgggccttgactaatatatttacataaaataggtgaaaatattttaggcccgttgagaaagtcgccacgtgaatttggagtgttttcttcggaatttaattgattttggtgtttggaacattttaaactaaatacaattattttcttaattaattattcttggtatttaacgctttacgaaattccagtagtcttttccttttttttttttagataaaagttttattttgtcgttttccttttttacaaataactttctaccgtttaattaaccttttgaatatatattatcattatgtttaacataataacaagagtttaccaatcaattcctatgatcacttagcaaataaacttcgatgagtttttcttaggtatatatatgcatgaacaacaatgtaaaaaaaataaaatagaggaccagtaattcagtaccatatagttaatcaaatattttaaaagttaactttattcacatgcaaaagatacgttgaaagtggtaccagctgatggataagttttgtaagaagtataatgtatatttgacattatggtataagtgattttatgaacttttgatgatgtaaactttgtaccagctaatgtgtttccaagaaacacttctttcgacacatacagttaccaaacttggtggtccctaaaaatgttcgagaatccaaccaaagccttcccaaggatgtggggaaactcttaagtacatcgaactcattcctgccttacaaagtatatcaaaatgttaaatgttgttgaactcatattggctggttttggtttacttattctgattggtgatgtactaatgcaaagaaatagtaggatatatattgatagaatggaatggaacaacaggtttgagaaagaaatcatttgtagatatgggggctgaattccatttcatatacagtattaatgattcgattcacgctaggtcgctagctacatgcatggataaactattcgagcataattgttttacgacagtttttctgtctaaacgtcatttgacatatatatttttctccattaactgtttagtgctataaataagcggccatgatatatttttttccatcttcaacgcgattttcttatggcagtattccaattttaaatactgatttgttttgttttccatggataatgatttatttattttgtaggtcatggataatgattctatatgctatactaattacatttagagacaacaatatacattcaaatgtatatgaatagcctaatactgaaattatttgattcatatattcaaacggaaaaggttaaaaaaaaactctgaaggcctgaattggttagtggttacattacccgtccatatgcctggaaatattcgagatacccacacttactcgctcactcatgtgcataattgctctatctcccatgcatctgtgtgtcctcacttgttgtttacgggtggcttttgatataataatattagtataatctcgactaatattgttataactcgatatcattgatggtaatacattatctagccaaacaagttgtttaattgctcttgtaaataaactctcacaaaattttatttgttttgacattgtcactggctatttttggcgggatcactcgtttatttatattaaaaaacgaatgaaaaacattcacatattttgtaaattaagattattattaaagcatatacaggtcaattcttggtaggtggaagtaggtggcattactgaaaggaaaatacaagtaaaattatactactatctaacaattaataactgcattagtaaaaaatgctaaacgatgatgattattgatgatgacccatatgggtcattattacattactatacagattttaactacgtagtgtgggtcctacttcacgtgataaacgacccaaccgccacgtaagcaattgaaggatgcgttcccgtttcgtaaaatctattgcaatctcctctcagccaatcataagcatatgcccacgtgggataatgggccctatcacgagcccattgtacaagtcagcaactgatactagcagtagcacgccgtttagattaaagataacatattttaattattaaagtatttataaatttatcatattgatttaattattttttctcaaaaaaatatacacttttacattatttttttctctctttttggacaaaattaatgctctttttcttattctacttacttctaaatatcatttctcatggtattagcacaattaggcgattcctttgaatacagaaacacgtcaattttaacaaaaagcaaaaagtagcattcgtaaattgattcgattatttgaattattctgtaatcaactacacaaataaaacaaaccctgtccattttaggtcattccgtgactatagcatctatcatccttcaaagaaaaatatcatttccttgtgtttttcttttagatatttttttacttataaatattttaatacccctcttcctatttttcgggtcttgtagcgttttatatatattttcacctgcctttcttctcccatccatcatcatatctctctctaatttctctccgtataacacaaactactctttaataagtatttatgggtgatcataatagctcgcaagcttcttacatccatttggtacgactttatcaaactctttttttttttttccgtttcttgtcaaatcaatctctgatcttgatcgatattttatcacttaaccgatgctgatcatatcataatcatgtgtatatattggttgcaggtgcatcatttgatagaagaatgtatagtattcaacatg

SEQ ID NO: 28398 - DNA, 86 bp, Unknown; identical to SEQ ID NO: 207
  misc_feature (1)..( 86): 2750-1469P.txt file - cDNA_ID_2996582; gDNA_ID_28593; Annot_ID_146709

SEQ ID NO: 28399 - DNA, 3003 bp, Unknown
  misc_feature (1)..( 3003): 2750-1469P.txt file - cDNA_ID_2996582; gDNA_ID_2926262; Annot_ID_204783
tctggatgaacctgtttcaataccttgaaaatgtagatcttgtacgtctctgtgctcttcttcgtcttcttcttcttcttgacaatctcgctcgttcctccttctttcgcgatcttcttctccgcctttggtgctggtgctttctccgccggtttcttctctgccttcggcgccattaatccacgatacagcgattgtgatgaatacttctgggcaatgaaagatgatttttgagggtttcggttttgaatttatacgtttcgtgtaatgatgtataattggatcctgaaatatgacatagatcgatgacgtgtcgttagatgaggaattgttgtcagactaatcaacggttaacgctaaagtcggcggttaatgtgggctttaatgggccttgactaatatatttacataaaataggtgaaaatattttaggcccgttgagaaagtcgccacgtgaatttggagtgttttcttcggaatttaattgattttggtgtttggaacattttaaactaaatacaattattttcttaattaattattcttggtatttaacgctttacgaaattccagtagtcttttccttttttttttttagataaaagttttattttgtcgttttccttttttacaaataactttctaccgtttaattaaccttttgaatatatattatcattatgtttaacataataacaagagtttaccaatcaattcctatgatcacttagcaaataaacttcgatgagtttttcttaggtatatatatgcatgaacaacaatgtaaaaaaaataaaatagaggaccagtaattcagtaccatatagttaatcaaatattttaaaagttaactttattcacatgcaaaagatacgttgaaagtggtaccagctgatggataagttttgtaagaagtataatgtatatttgacattatggtataagtgattttatgaacttttgatgatgtaaactttgtaccagctaatgtgtttccaagaaacacttctttcgacacatacagttaccaaacttggtggtccctaaaaatgttcgagaatccaaccaaagccttcccaaggatgtggggaaactcttaagtacatcgaactcattcctgccttacaaagtatatcaaaatgttaaatgttgttgaactcatattggctggttttggtttacttattctgattggtgatgtactaatgcaaagaaatagtaggatatatattgatagaatggaatggaacaacaggtttgagaaagaaatcatttgtagatatgggggctgaattccatttcatatacagtattaatgattcgattcacgctaggtcgctagctacatgcatggataaactattcgagcataattgttttacgacagtttttctgtctaaacgtcatttgacatatatatttttctccattaactgtttagtgctataaataagcggccatgatatatttttttccatcttcaacgcgattttcttatggcagtattccaattttaaatactgatttgttttgttttccatggataatgatttatttattttgtaggtcatggataatgattctatatgctatactaattacatttagagacaacaatatacattcaaatgtatatgaatagcctaatactgaaattatttgattcatatattcaaacggaaaaggttaaaaaaaaactctgaaggcctgaattggttagtggttacattacccgtccatatgcctggaaatattcgagatacccacacttactcgctcactcatgtgcataattgctctatctcccatgcatctgtgtgtcctcacttgttgtttacgggtggcttttgatataataatattagtataatctcgactaatattgttataactcgatatcattgatggtaatacattatctagccaaacaagttgtttaattgctcttgtaaataaactctcacaaaattttatttgttttgacattgtcactggctatttttggcgggatcactcgtttatttatattaaaaaacgaatgaaaaacattcacatattttgtaaattaagattattattaaagcatatacaggtcaattcttggtaggtggaagtaggtggcattactgaaaggaaaatacaagtaaaattatactactatctaacaattaataactgcattagtaaaaaatgctaaacgatgatgattattgatgatgacccatatgggtcattattacattactatacagattttaactacgtagtgtgggtcctacttcacgtgataaacgacccaaccgccacgtaagcaattgaaggatgcgttcccgtttcgtaaaatctattgcaatctcctctcagccaatcataagcatatgcccacgtgggataatgggccctatcacgagcccattgtacaagtcagcaactgatactagcagtagcacgccgtttagattaaagataacatattttaattattaaagtatttataaatttatcatattgatttaattattttttctcaaaaaaatatacacttttacattatttttttctctctttttggacaaaattaatgctctttttcttattctacttacttctaaatatcatttctcatggtattagcacaattaggcgattcctttgaatacagaaacacgtcaattttaacaaaaagcaaaaagtagcattcgtaaattgattcgattatttgaattattctgtaatcaactacacaaataaaacaaaccctgtccattttaggtcattccgtgactatagcatctatcatccttcaaagaaaaatatcatttccttgtgtttttcttttagatatttttttacttataaatattttaatacccctcttcctatttttcgggtcttgtagcgttttatatatattttcacctgcctttcttctcccatccatcatcatatctctctctaatttctctccgtataacacaaactactctttaataagtatttatg

SEQ ID NO: 28400 - DNA, 3003 bp, Unknown
  misc_feature (1)..( 3003): 2750-1469P.txt file - cDNA_ID_2996586; gDNA_ID_2926262; Annot_ID_143247
gtatatattggttgcaggtgcatcatttgatagaagaatgtatagtattcaacatgggcaaagaagagtgtatggatgctctgttcaagcatgctaatattaagcctatcatcacttccacaggtacacatattatagatagatatatggtagtatggtacaatagtaatttatgaaagataagggttggagaattgattaaatttgcagtgtggaaagagctagcgaaagagaacaaagagttcttcgaggcatacgagagaagacgagaagaaataccgaccgagaaagagacagctcgaagaatccgtgatttgctttcacgaactacaatctaagatcatgacacctacttttacttacatatacatacactcatctatattaccataggcatgtgtgtgtatatgtatgatccgacgattctatatatactctttagacaatttgtattataatcttcattaggaaatgaataattcacctttggggaaatctctttttcagcttagtttaaaatcgttatgatttatttgctctttttcacgttatgatttatttgcgtattacttttctttacgttatgatttatttgtaagttaccaattggatcttaaccattttcaatgtctaaacaatgttattggagcataatatacctgtctttgtgttcatggttttatgtattcataattgagtaaatatttcagttgtctctttaattttgctctttgtactgaaaactaaaatgtagccaagaataactaatatagtttttcttttaggtcaatcaagcatctgtatctatctccatttatgaataactttagtattcaaattaaaataatgatcaaaactaaaacaaaattaagtttaaatatggctctctgtacacatattgagtagttattcatatacttaaaccctttagaatttaaatacataaattgttatcatatgaatataatccatcaacaattaattgtcattgaatatgacgattaccagtttaccaccatcattaagattagcggtagatcatttttactttaattagtatgagtcgtgttttaaaaaaatccaatgctggaaaacaaaagcgtaggacagagatcgaatggtgaagatgccacgtggaaggcacgtggaagcacgtggaaatgttggcgtcactacataggattgcgtgttacgatttggtgatgaccgctaaactgtggtggctatttttgttttcttatctttttcgatttttttggtcagtgttggagccaaagtttggtctgtttggtgaagacactcttcttctttagtaccgcattttcagttcttgattggaccgaccttaatggtccacttgtttttaggatatgtatagtggttttttaataattaggtagaagtgatcatgtactttttataagtattaaaaaaccatttactagaatgcatgattaagagttaaattcttataatcaaacatttatttgggtttcatatagataaaaaattataactaaaagtgaatcaacaaccactttgtaaatctctagttcaatttgttgatctcggacaactgcttgcaagacacctttggaataaaggatgccaaaaagatttcatttaaaccgctttgccaaattttaaggacaaacaagtacttatatgtgaaagccaatcaatcttgtttcttcaaaatatatagattggaatttggtggcttcttttatttcccaacgttgcaaaacgaacaaaaaagtaagaaaagagaagaaaaggaatgataaatgtcaacaacacgaatgaaaaaagagcaaacaagaaaacgaaatgtataaaacgacaatgtactttggaaataccaatgaaaacgtaatgtcatgcatgtagttccaagctctttggcattccgtttcaattctattattattttttgtttgttatacgaagaaaaaagagtttcgacggtccagtttatttgcgtaaccttcacatatacttctttgaacgttaacatctcaatttggtcaatcagactgtattcattagtgtagagggaatcaaaattttatagccacaagttcacgagtataagacgaagaagagtttcaatgaacaaatcaacaaatgatggaagggcttttgtattttagtttaatcaataatgacttttcttttgtatttgataaatgctgatatctaaaaagaaattgcattgtataaccaagaaaaaactatataattcatcaactaaaattttgtagccacaacgaagatgcgtttcaataaacaaatcaacaaatgatgggagaggttttggtcctgaatggatgctgattttctattcagtttttggatttagattttaatttttatattttatattttagtttaaatttttgataaatgctgatatcttaagagaaattgcgttgtataaccaacaaaaactataattcattaactaactatactaacctaaaattttgtagccacaagtttagagtataagactaagatgagtttcaatgaacaaaaatcaacagatgatgggagaagttttgtattttagttttatcactaaggacttttcttttgtatttgagaaatgcttatacagtatcttaaatcataaggaggaataactttttatacgtcacgacaattattattattagagtcgaaattaaaaagtatatgcagtttttttttaagatggattttgacatcataatgttttctttaaaagtttgacttgtatttaacattttataaacttaaaacagtcataattaaactcaataatctttaaaactattttatttaagtgtgtaacaaattatacaaagagcccagcccattaagcttacaaaacaacctctaagcccaataaataatacgacgacgtttaattctgtaaaaataaaattttcctcttcttcttcccttcttctatctatctcaatctcatcgccggcgttagggttgtttttctcaacaatg

SEQ ID NO: 28401 - DNA, 3000 bp, Unknown
  misc_feature (1)..( 3000): 2750-1469P.txt file - cDNA_ID_2996590; gDNA_ID_2926262; Annot_ID_143248
actctttcagctccacgccgtcgtgttctccgatcatctccaaaagaaggtccgttttgccttctctaaccgccgtgtgtaacggcgtgtcgtcacgtcttgccgtcatctgcttcgtcatcgtcttcttgatctctttcatgattgatgatgattctgtttaaagaatctttgggattaaaaaaagtttggcggaaatttagatcgagatagggaggtctacatgagtagatttgaggaagattcagacaagagtaacatgaattctctggacaagaaacaacaaaatatattattacctcttaactatgctcgtggttttggctgcttgtgttatatcacatagacatatcttaaaactatcttaatacaacaaacaacacatgatcaaaccttagtgtccactcgaagcattatttttgtttgtttttctatttgaaaacaaaaaacaatcagatttaggtcaacaaacaaatcatgagtatatttgaataaaatgtttatcaaaaccaacagaatcaactttaaatgttctccgtgccactaattcactaaaatgaaatttgcgatggatttagtcatttagacattttttcaaagaaaaccaaaaaacaattggcgatagaaagtgacatatgaagaaaataataaatgagtctccattattggggttttctgtgtgaacgtggtaaaatatccgacgattatgaatttatgataccaaccaaccatgaaaataacactggtccaaagtgaaaatagatttcacattcacaagctccaagtctcgaaatccaaatatgaatcaacaaatagtgtttgagacttgcatattcgtcttgaccgcatagcgcagtggattagcgcgtttgacttcggatcaaaaggtcgtgggttcgactcccactgtggtcgtttaagactttaagtacttgttcttttctttttcctgattttatctattttggccgatacgtatcagaaattctccgtataaatcaaccatgttcgtttacaatccttcattcaatcgtcccttaactctaaacaaccgaaaaatcaaaatttaccaaagagacaacaaaacccagaataaattcaatatttatgaaatactaatgattttagagaggttgtgtgataacaaaacttcagtacaactaaaattaataaggttggacaaaaagagaggagataacataagccgataatcaaaggctgaatcattcatttctagaagctagagctgggagaatgaaactacactttgatagcgtacttcctcactgggaaatacatctccttcttcttctcacgctctgtcttcaacgaagcctgttaccacaaacaccataagttattatgattgctaatttgctatccaattcaaaagaacattatataattggaaatggtaattcgggtaaagacctgatgcttggtgagacgtctacggatagctcgtgttttcttgggacggagatcaagaggcaagagcttcttgttcttgtatgcctctcttaaagcagatttctgcttctgggagatcactgtcaacacctgagcaatggatttcctcacaaccttgctggatatcaataacacacaactttcaatcaatgacttgtcaaaccgaatccgactaaaccaaaataaggtgttcatcaactacatacaaggcccaaatttgattgatctaagatacatattcgagtcataagctaaatccacatccattctactgatgatatcccaaatgatgatacaaatgcaaattccaaaacagagcaccatatgttctcttactccaaattcttcaattactctaaatctaagtgaaatgtctccaaattggaaagtaacactaaatcctaacaaatgaggatatatatacacacatttcatatatacgtataagtagatatataaaagacatacattttggagagcttgttgggagcgcctccggtgactttagcgacacggaggagagcgagttcagccttgaattccttcaactgattctgaagatcggtctttgatttatctctaagctcatgaaccttaattctcgctatacaacaaaatcaaaccaaaacaaaaacaaatccaatcagaatcacgcaattgaagaatcaaaagaaacgaacacgaattagattaaggattataaggatctgttcttcgtcatacccatcgtgagtgttgagaactgatgtgccgcctatttgctcttttctggctccaaaccctaattttgttgaagaagaaaatttatacgatgcctttgtgaaatcgatttgagttagaaaaccctcgtgattctcttggcaaatataatgggccgtgtaatagcccaatagttatttccacaaaacatgggctttttattaaagaacatttaattgggtcgtcgtatgccgaaaagagaaaaggtgtgaatagtgaaagctaatacgaataaattcgtcaataaaacccataagcatcagattctgattattttttgtttgtgagaatgagattcggaactatcattaagggttggcaaaaagaattggcctttctattttctttttggtgttttaaaaaaatatgattttctaacaaaatgattttttttttcttcttcttctatctaaaagagagtaaactacactgtatttatttgtagtagatggtccaaaaatcgtcagttcaatcgaatcaaaataatttcacacggtttctaggtctactagcaatcaatctctcacacattggtttgataagaatacgaataaacttacttttttctaaagtcgattccatcacccaaaaaaatatctttaactcgaacctaaaaatatgtacatttttaattgattttatatgtgactatagaaatctctccacattttcattgcaaacactaaagactttttcttaaatttcttgtaaaccatacaaaacatgttgtgtgcttctcaagcatcaacaacaaccctttgctcaaccatg

SEQ ID NO: 28402 - DNA, 3003 bp, Unknown
  misc_feature (1)..( 3003): 2750-1469P.txt file - cDNA_ID_2996594; gDNA_ID_2926262; Annot_ID_143250
ttggggaaggtggaggagtgagtctccgaccgtcacgtatgattgggttatgacggtcaatggctcgaccaccgagccggatcgtggctgaagaagaagaagaaggttgtgaggtttgatccatggttgagcaaagggttgttgttgatgcttgagaagcacacaacatgttttgtatggtttacaagaaatttaagaaaaagtctttagtgtttgcaatgaaaatgtggagagatttctatagtcacatataaaatcaattaaaaatgtacatatttttaggttcgagttaaagatatttttttgggtgatggaatcgactttagaaaaaagtaagtttattcgtattcttatcaaaccaatgtgtgagagattgattgctagtagacctagaaaccgtgtgaaattattttgattcgattgaactgacgatttttggaccatctactacaaataaatacagtgtagtttactctcttttagatagaagaagaagaaaaaaaaaatcattttgttagaaaatcatatttttttaaaacaccaaaaagaaaatagaaaggccaattctttttgccaacccttaatgatagttccgaatctcattctcacaaacaaaaaataatcagaatctgatgcttatgggttttattgacgaatttattcgtattagctttcactattcacaccttttctcttttcggcatacgacgacccaattaaatgttctttaataaaaagcccatgttttgtggaaataactattgggctattacacggcccattatatttgccaagagaatcacgagggttttctaactcaaatcgatttcacaaaggcatcgtataaattttcttcttcaacaaaattagggtttggagccagaaaagagcaaataggcggcacatcagttctcaacactcacgatgggtatgacgaagaacagatccttataatccttaatctaattcgtgttcgtttcttttgattcttcaattgcgtgattctgattggatttgtttttgttttggtttgattttgttgtatagcgagaattaaggttcatgagcttagagataaatcaaagaccgatcttcagaatcagttgaaggaattcaaggctgaactcgctctcctccgtgtcgctaaagtcaccggaggcgctcccaacaagctctccaaaatgtatgtcttttatatatctacttatacgtatatatgaaatgtgtgtatatatatcctcatttgttaggatttagtgttactttccaatttggagacatttcacttagatttagagtaattgaagaatttggagtaagagaacatatggtgctctgttttggaatttgcatttgtatcatcatttgggatatcatcagtagaatggatgtggatttagcttatgactcgaatatgtatcttagatcaatcaaatttgggccttgtatgtagttgatgaacaccttattttggtttagtcggattcggtttgacaagtcattgattgaaagttgtgtgttattgatatccagcaaggttgtgaggaaatccattgctcaggtgttgacagtgatctcccagaagcagaaatctgctttaagagaggcatacaagaacaagaagctcttgcctcttgatctccgtcccaagaaaacacgagctatccgtagacgtctcaccaagcatcaggtctttacccgaattaccatttccaattatataatgttcttttgaattggatagcaaattagcaatcataataacttatggtgtttgtggtaacaggcttcgttgaagacagagcgtgagaagaagaaggagatgtatttcccagtgaggaagtacgctatcaaagtgtagtttcattctcccagctctagcttctagaaatgaatgattcagcctttgattatcggcttatgttatctcctctctttttgtccaaccttattaattttagttgtactgaagttttgttatcacacaacctctctaaaatcattagtatttcataaatattgaatttattctgggttttgttgtctctttggtaaattttgatttttcggttgtttagagttaagggacgattgaatgaaggattgtaaacgaacatggttgatttatacggagaatttctgatacgtatcggccaaaatagataaaatcaggaaaaagaaaagaacaagtacttaaagtcttaaacgaccacagtgggagtcgaacccacgaccttttgatccgaagtcaaacgcgctaatccactgcgctatgcggtcaagacgaatatgcaagtctcaaacactatttgttgattcatatttggatttcgagacttggagcttgtgaatgtgaaatctattttcactttggaccagtgttattttcatggttggttggtatcataaattcataatcgtcggatattttaccacgttcacacagaaaaccccaataatggagactcatttattattttcttcatatgtcactttctatcgccaattgttttttggttttctttgaaaaaatgtctaaatgactaaatccatcgcaaatttcattttagtgaattagtggcacggagaacatttaaagttgattctgttggttttgataaacattttattcaaatatactcatgatttgtttgttgacctaaatctgattgttttttgttttcaaatagaaaaacaaacaaaaataatgcttcgagtggacactaaggtttgatcatgtgttgtttgttgtattaagatagttttaagatatgtctatgtgatataacacaagcagccaaaaccacgagcatagttaagaggtaataatatattttgttgtttcttgtccagagaattcatgttactcttgtctgaatcttcctcaaatctactcatgtagacctccctatctcgatctaaatttccgccaaactttttttaatcccaaagattctttaaacagaatcatcatcaatcatgaaagagatcaagaagacgatg

SEQ ID NO: 28403 - DNA, 3003 bp, Unknown
  misc_feature (1)..( 3003): 2750-1469P.txt file - cDNA_ID_2996601; gDNA_ID_2926262; Annot_ID_143253
aactatcattactactaacagggccggtccaaaatgttttgatccctaaagcccaataaaaattgcttgctttaacacaacctaacattaaaccccatacaacataacttggcaaatgctgctctgatgaagatattaatttctctcgtttaggaataagcgaatcctgaccgttttgtatgaaacaaaatatttgtgtcaaaatgacgaagatgaaaaagataaacggaattctggaaaataataaaatattgattatcattgagaatttcgtatcaccggtcaaaaaaagagtttagtttctaactaaaaccctttttaaaatttacaaaatatgtagtagaattgattattttcttaactctttgagtacattattttgtcgtagaactgtactgattgtgaacattattcttaactctctgagaactctatgttgggttttgtttttcttagaaaaaattggcaatggattgggcctccacttgaaactacaaatcagtcgtttcaagacaaagagatctttatcgtataagtgtatcatatgtataaccaaacaagaatcaacaataaaataaagatcaaactgttgctacatataaaattgtaaaatacacatcttattgcatcatctggttcttatttcaatatttcatatccaatgaacaccattccgtatcagatgtttttttcacaattttgtgactgaacccaataaagaaaggtttgcgtctgaaccataagcatctttagaatttgcggttgaaccggcttacgcaatttgggttgtaatcttatcttgagaacatttcttggatataatttgcggcaaaagaaaaaatggatatttcgttcgcattatcgacaacacaaatgagtaggacgttatcgacggcatcaataagcgttgaacatcttttctgacaagttgtagacaaaatgaaggctaagattatgagaacattttttctagaaagaatattaacatttttcgtaagatttttacggataacattaatttgttttataatcaaagcaatatatgtaattaatgagtatgagtttttatgatatattaagatttaaatgtttctggctgttcttgttcctacaaaagccttagtcaagtgtatagatatgttaataaaaggaatagcataaccgaagtgtgccttagtcaagtggttgtttccgatctgcaagataatgtctggtctcaggtttgatgattcaaaattgatatttagcataaatgaacttttttttactttagataataaaatctattgggccggccctggactcaggctctaataatcaaccaggctataaaacgctttacatgtcattttattgctcttattgtgagagccgtgtctgaagacagtgtgagacaccttacgtgtcagcactgtattggtcggtgtgataatgtaaaagctaaaccttcgatgaatccgaatatcttcctgtcgccgatgaagctgaatcgatctcgatgtatctactgctgacgagctacttcgtctagaatcgagtcttcgacgagtctctcttgctacggctaacagacctgtcgctgcttctcttttcggagaactacacaggcgagcttctctcatttcatcctcttgtctctggttgatactgagattataatgattatactattgaagcaaattgtttctccagtgaagtctttgttgagttataaacgaaagatgtgaagtgtgtcaattataatggcggattgtttttgtttctctgttatgttacttcgattagttgatcgttttttttttttttcggatattacacaacaggtgtctcaaattggtgtcaatcttcaaaagcgtggtgtttggacaagtagtaataggtcctcctggatcgggcaagaccacttactgcaatggcatgtctcagtgtcagtgcatctctctaatgggcaggtttcatcttctttctctttttggatcaaagaaagaagcttgcttacttgtgtacctgtgaatctctttgtattgattgttttgctgtcccttgctttgtaaagtttaaaaagttgcaagttcagttaaaaattagttgtgaaatgtttgttgccttgtctttatttttgctagagatatttgcagattcgtgagaacttctctgtaagtataatctcgttgtgttactttttgttgttgttgttgcaggagatcctgcaaatgatgcattaccgtatccatttttaagccaactcttacaaaatggtaaaaagaaatcaggtgtatattgtttcttgacattgatcttagtttgtcttggtttgtctcatcttatgactatgatgtggtagcttgcatgttgtatacggttgatacacacaagcttgatttctctatgtgcacttcttgtagttgcgtatgaagaagaacagtgctatctatctagattctagagtaatttgtatataataatagagtactaccaattgatactgagccttaatgggagcatctacttgtcttgtgttgttttctttttctcttcaatcattgttctgttatcgtcattagtgtaccttccttgttaaagccggattgtagatatcactgaatccatgtttcttatatatatggctttattgctgcagtgtcttttattatgataataatcacttgatacgtggtaatatctatctataggatgttttcacttcttgtctaatgtctacttactatttattacgtggggttttcttgcaggaacttgcggctacttgtgccactgcggttaagtcaagtaagcatgtagatggaagaatagtgaccagccgttgagtcaagagtgcagacaggtagatccttgcgctctcttggtcaactgcagctacttactatcttggatccttgccctccaaaactgctctgctaaaacgttggtagctctctgggaagatgaggaactaaagtcattggctcctctggctccctcagctatacatggaagaccatg

SEQ ID NO: 28404 - DNA, 3003 bp, Unknown
  misc_feature (1)..( 3003): 2750-1469P.txt file - cDNA_ID_2996616; gDNA_ID_2926263; Annot_ID_143259
atggggatatttcttgcggatttgaggaatctttggttgaagaggatgcagagaacttgcagtttcattgcttcttctacgttgtccagaagcttctattttgtgagaatcattcagaaacttgtgctcagaactcttcaatacctctgtagttctgttatacggtttaagcccggtggatgcttcttgagatgcaagaaacgtttcattttcagcacttttagtcgtatcattggattttctgaattcagaaatagtgctgtttccaggtgaaacaatagatagtagtactggagagagctcaaaatactgaaggcctgaaacgaaggcaacaaccagaaccatgagaagaacaactctacaggtttccacttggcctataaaccgcaaaacccgactttgatccatcaaaacctggaaacaaattattaccttagatttccagtgatataaatgtatctcttcttcctgaaataagttgcagaaacagaacttgatcacttacagagatatcaggtaagagcttgagatgatgtttgttgatatatagaactgtcgaatctgagcgtttctttgaagttacttggagtgatcatcaggagaggaagattcagacaaataattaacaggcaaagagacaagacaaggcaatcgatggctttaaattttgttcaatcaaagtcttgactaattatgtatttttgtagatattttgtattggactgataagccaacaaggtatgataataacttttctcaaattatcagaagacaccccttaattatctatgtttgatcaattatgacccatagttttatttttttaagagcagcctctgttttttttttcctactattatttttgcaacatttaaaccatacctatgaacctataataatatatatattaagagcatctccatcgggagtttctggatcagaatgtctattaaaacagaataaaaaattcgaaaaaggtggagagagagtaaaaacgtttctcatttgagaaactcaaagaaacctatttttgcttttgttttgttttgattggttcaaaaaataataaaaaaattaaataataaaataataataaaatttatattattttataaaattgggtttctcaccgatggagatggtctaaccactctgttaacaaagtactaaactttgttagtggttaagttgacctgattagtatacattatatctgaatgtagtaactacacaatccaagaaaaacaatgaatgtataatttaacgttcgatatgtatatatgaatttcagtgtcagcgtttgcgtcccgcactctcctctgcaacgtgatccaagcatcggaagttgcgaatttctgtgtttcccacaagagaaattaaatcctcagcatcatggtttttttttttgtaaatttaatattcttgtattagtataaaaatattgttgttgttaaatgtacagtaccttgtttaaaattatagtattaacaattaatcaatcacataacaatcaatcctttaattaacatcctcaacatggccgttggctcgtgccaaccccatcctccacttcctcatcaacgtaaggagctaaattcaaataacaattaccgtggcagttctcgttattatcaccaacattaggattcttactcgatctatttgctggccaccgtgcacggcataccacacagatggccggccgccgtccacgactctttctccacgccagcatgcattcatcatgaaccttgttcttgcatactctgcacttcaccaccgcggtttccttctccttccctccaccatttccaccgtctacgttttctattgcgataatatcgtctagacatattggacatgttgccggctcttcatccacctcattttcctattcaatataacaaatgatatatgcatgtaagatctatttatatcccctaaaagtaaagtaaaattttatttaaaacattggttatttaggagtatttgtttagcggtgtaaaacaatacatgtagtttagatatatttttatgtaaaacgacgtaataaatttttttaacaaccatttcccattacaacgacgacaattatattcgtacagggtaaaagaagattaccattttactggtggaggaggatgagttagtagtatagccgggttgagaagtggtggctgggaaaagctgaagaaaccgttgttggaggcggaaactggcgaggcagtcaggccgtgtcggggcagagaagaggtggaagaggaggcatgtccggagtctccgttgcctgagacacttatcgtcgagaggaattccaagaactcggattaagacaaacaagatgtgtttgcacggcttcttacggtcgggacaagtgcaagtaggtgtggccattagcgtcactgtgtagacgttacacgttgcaccaagaacgtgaaaagttcctgcattaggacggtggagaagacggatccggtgacggagagctcgaagtatcctatctgccaccggttgagccaagaaatgccgttggtcacggttacttacgtacggggatatttgattggatccgacagattccatgatttttgagaattccgttacggcagttggagaatttatgcgagatatatatattcgtgttaagtatataggtacagttacttatacatacacgtcatgtaatctgtgcggagattctttgtatgaaacgttggcacacgtgtggaataacggcgacgtgtaggagatcacaaagacggcgttacacggaaggtaaagtttacttggtttactggatcgaaaattaaacaattttagacgtcgtgtggtttttggtatgactgtgggacatcatgccgtttgtctgtcattgactttttgtttgataacgtcgtcgtttttggttaaacctcgaaaaacccctctctctctttcttgctcttgttaacctagaaatcaaaatctcagcttcaccattcgtttcgtttttccggcaaaatg

SEQ ID NO: 28405 - DNA, 3003 bp, Unknown
  misc_feature (1)..( 3003): 2750-1469P.txt file - cDNA_ID_2996619; gDNA_ID_2926263; Annot_ID_143261
acttcctccatttcatggcctttttctcttacctcccgattcgtagctccgccgcaccgtacacttctcatcgactcttcgacagagaaatccaagcatttctagcgtttcttatgttttccgccattaaggtttgaattttgcttaaatctctaacttcattgtttcctgtttcaccgatttcgtttttgtagatggtgagggaggaaacatgggaagctttcgttgctgatagtttactctatgctaaggtaactctagctgatttcagattctttgtcagtcacttttatgattcatgtgaaatctactgattacacattttctttgcctagatctttcttattgcggtttcgttgattatggattatcgagtggcggtctggtttagtatcatattttcaggtcagctcaatttctatatcttgattaaatatatctgaaaatatatgggagatgcagatttgaagtttgattgatttgaatgtttccttttgcagttatatatctattagctcaacaaccagcatttagtaaactaggtatgggaagattcttcaagttcttgctttaagttgtgtttttgtaaaatgcttaaacgttttgcaggaactgcgaagaagctaacacctatgcagttggaggatttgttatcagatggtaacacaacaaaatactggttggtatgtggctacttggctttattcttctacttgataatgttgttgatcttttcaagttagtgagcttgtgatagcagatgatacagttgataaaccaaggactagtttttttggtagctaaaatgatttgattatgtttagcagtgcttacactcagattctagtaaagcataaggtctatgaagctagatttatatagcctccccttactattttgacatcaaattttgtcccttttttttggttaggtgtcaaaccaattaagaaacagaactgatctgcaacatcttaattagtgaaagctcaaaagggtactgttgtaactattatttatgatgatgtgctttcacaccttttgcagatagaattctttgcatgtagttcatccaagtgtgttcgttctagccgttgctttcctgagctctccatcacgtaagctttgtgtaaagaaaaaatatcccaatttcactgtttgtctaaagatacacgctcactcaccttccatttcttcaggtactcgaataatcttttgtcttttggaactgtcgatcttggacttttccctaatactgcggcaaagtttggaatatctcttgctggtaacagtccttggcgaactcaattatttgcacaaatttagaacacattgagtctttgttatgggaagcaactgatatcagtgttgtgtaacatatgtaggtggaatgtctcagcttcccacatacatattgtttgaaaagggtgtcgaagtttctcggttcccagacttttatgttgacgctgcaccttctttacccataaccaaggtttgcttcgacccacttgccaagaaatcaaatttgcaacggctgcaaggctttaatgtaatcccttaatgttgatattgcagaaacttttgtgtcaacattttgagcttgatcggcttctgctcgactatataaacggaacatagctggagaaaacgagtaaacggatatacgactatctggcttctcctgcaagagcagtatgaacacatcaacacaccattggactaccacattcgtatgtttattctcttttagtggggatatttggtgaggctctgccagagaaaaaaggacagattatattttagtgctatagagagatagaaagattctgttgaaattttatggggattgagtttcgacaaagaattcttgaatacgatggtaaaatgaaatctcaatttctgactttgaaatttaatgcctttcgttttcatgacttttaagacttgtcggcactcccacgtctctaatgtacttcctatatatccatgtgtggactaaaactaacatcaatcaaatgagaaaaaatcgaacacaaaaaaaaagttattttgatgataggaattaatgatggatcgtgcggcgacaacgttttccaaacattgtgtgtatacctaccatttattttcgtaaaacattccaaaattgttatgcagtgaaaggaacaataaacaagtagtatgtgataaaaagcatcgttatctttaaaagacgtgtgattaagagttgatgaacaagaaaattatacacttggtaaaggtgttgcctagtggcagagtctggtcaacatgttccaatgcttacaaattcccagttaagccattaattaatgattgattaaaaatcccttggctctgcttatttctacactttctcgtctctatcgttttatttacatatataagcatataataaatacaccatcatatgaagatttgtataataaatatgagattagtacaattcattaaaaaatataagaatgtgtcaaaatcttactaatcaaatcatcatataaggcatacaagtctccatttaaggaaataatataatttttgttataaagaaaatcagtttctcaaaacgcggtttttgagccgagtcgcaagtaaattaatttaaatcattaaatgttggaagtaacggaccatatatccaacttaccaacggttcccgaccgaactcacgcagaaacaccgtatctgcaccgtccaaatctctgacttaatcgctcaacaacattactacatgatctcgttagttcaacaaccaatgagatatagccacgtagtcactcacacgatcatccgccactgcatcagattaatgaaaacttctgatttttgtcgtctttcttctaactcattgaagtattcacccctataaattgagtcccaccatttcccccaaatttctgacatttttctctgttacacgctttccttcttcttctctttctccgatttttattttttttactatttgtgattttgaattttccggcgatg

SEQ ID NO: 28406 - DNA, 3003 bp, Unknown; identical to SEQ ID NO: 28405
  misc_feature (1)..( 3003): 2750-1469P.txt file - cDNA_ID_2996619; gDNA_ID_2926263; Annot_ID_204822

SEQ ID NO: 28407 - DNA, 3003 bp, Unknown
  misc_feature (1)..( 3003): 2750-1469P.txt file - cDNA_ID_2996623; gDNA_ID_2926263; Annot_ID_143263
aaaaacatgcgtcaatttaaaaggaatttattgggaggaaatcttcccaaaagagcgatgatcgcctaaaaactgatgcgattttggtttggatacgtagttggcacgagcatacgatccaagacgagtctcaataacttacatcacgcgaagtcactgaaaccgttcaaagcagtgatcgctgtggaacttgttttaatttgtatttaccatcatgccgctatcaaacttgtgcaccattctagagaagataatgagtaatgacaaacaagtagagtattgttacatgaatgttgtttgatttccagtacagaaatcatggcgtttatttaggttcaattgttataggttttgctcacaaattgcttgaaagtatcacatgaacttgtcctcctcctttgatcataactttgttgtaaagtctaagtttgatagcgggccatgccattaaatacacggacgcaggggtttggtgtcattaaagtaaatcctcgtattgttttatgtcttgttcgtttaagtttctaatttgtgatcagaagaaaaaataaaaactcataacagggaactataattaaaactaaagaagatttaacgtacattgattttacacagtagatttagttttcttttgtaaatacacattatatatttttattcaacgaaaacaatatcaattgtctctacaaaaaccaacggccagtactcttttgccctaaaaagaccgtaaccctaattttcacacagagaatctaacgattcaaaacaggaaaaagagttagtgatcacgaaatggagagagagagagatatatagtcagacatgttttatttaactgtgttttagagctgaactggatctcagctaaacacaaaaaatttcaagaaagtttaatcttaatcgtataatcgaaacaaattcctttccggtattaccgaaacaaagaagccatcatagcactcaacttgacaacatatcgcttacgaaatcttcccatggtctcaaacacatcctcggaagcatacgctaaatctctagattcacttgacaacaaagacggcaaaagcttcatcgcaatggctatggatcttcttcctcagtttctgcatactgacatgtcatgcatcggtatgtgaggatttctcatgagggactctttcattggttggtgataggctgatagctagggtcgattctagatgatggatttattattagtaatataggttttatttaattgtgtcttctttaccaaactcgaaatttaaaaaaatctcagataagagctaagctgaactggatctcagctaaacacaaaaatcttcaagaaccttttgtctaagtacagttctagatatgtagatttatgatttacaatttctagattcataaattaagcttctacaaaacgggcgcttgtacattttctaactatttttcttataacttgcttatgttttccatatattttgcatagtttttttcaacttgttttcttttaatcttatttcaaaaaattaaacatatcattagatataagctttttccacttagaatgtcgcataactacttactttttagaaatatttctactaaacccaaatagggtaaaaggggataacgctgataccactttaaatttctaatctaaaggtgacgttttattatgacagagaaaatacgaaatagacgatattatgttatatagcaagccttttgactttatagaagtgagaagcgaggattaaggggtcaaaaaaatgaaacatatatagaaagtaaactttgaaaaatataggagttggtgaagaaaatgaacatgttggagtcgaggattccctaatatgttctagaaaatatgagcttttagcaactataaacgcgtcttggtccatcttagcttactttttgtatgaacgcaagacaaatattggaatgactgcaaaataaaaaaaaagcgaaaaccaaatattggtcaatcgaaaagtaagtggagacaataaaaggcgagcaagaaaacctcaatgctttcttattttaaaactattgaaattcactgcaaaacaaaaacaaaaaaaatgcttatttcaaatcggacatatgtgcttacgactaatgaataattaattcaatccatgcactagcagcaatccttatccatgatcgttaaattaaattattactaatagactttaagcattccttacactaataatgacagtttggtacctatttgaggtgggtttttactattacatacactaaaaatgacagttcggtacctatttgaggtgggtttattctctgtaatagtttatttgaaaatttcactcttcttaaattagtattaaaaaaaatcttgttgacttatataaattcaagttggggggtccaatatggctgccaagtttgatcctccgacaacattcccgcagcctcaaatacaattatttgttttttttttccctttgatttgtgacattgtacaattattatgatttgtttctattatcatcgtatattcgtacatttaaaaaaataaaaaaaaggggaaaagaatcatttacataaataacaattcataatgtaatatcgcaccgagttttatagaagtctacacatatctaatctcaaaatgaaagtggcttacatgtttcttaaacttttattaaatttgttatatgtttggtgggaaaaaataaccaataatgaaaaagtgaaagttgtctacacgaggtaatggatgaagagagggacctacgacgaaggatgactccgtccacgttcttcttcactgtttgacaataagctccaattttcagacttttcatttcaaacttgtgggtctcattttcctctggcctatataaatccactatcctccacttctgtctttcatcatcattccacataaacaaaatatcttcttgctcattattcatcatcaatctactactccgtaaactttgcttcctctgtttgtattagctcagaagagatatg

SEQ ID NO: 28408 - DNA, 3000 bp, Unknown
  misc_feature (1)..( 3000): 2750-1469P.txt file - cDNA_ID_2996634; gDNA_ID_2926263; Annot_ID_143266
ctttctcacgttgattcccacatctttcccatttggttcaacatactcaaaacttgtgagtgactacatggatgacaaagatctagtcagtaaaaaaaacacaatcttagagagaactgcatatcaatatgtaaagagaaataaactgacagatatttggtaagtatgctcaataatctcatcaaccgctcgttctgatccattcgaaatcagataatcaataacagccaatgcctggcaggaaatgaaatagaaaaacctcaggacacaacaaaactataaacttccaaatacagtaggaaaacgtcaagaagatactcaccttgtagacatatcgccaatcttttcctgtctcacttagtctagtccacaaaacactcataaccatctggcactccgagctaaacatatggcaagtgcacatgttaagcaatagcaaatcaaaaaaatatttccaagtagaatcacgaaaatgaagccagagattacaatttcttcgtggcctgagctatctctgccaatgcagtaccatggggaccccaaggctcattatctgtagcatccaatacctgtactaaacatagccatatataattatgaaagggtatcacataatactgaatttgaagagatgatcaaactcaaaatccatgaaacattgccgccaatttaagtttacatgacggctcaagcttatcttctatagaaatatgaactcgatatttgtgagtcccaaagatggatctaatctctaggaaatagcaactgtgaagaaactcagcatccgaacacagaaacataacaaatccagctcaaatattcaggattagtgtcgattttcgatctagcaatttttattttcgtgcaatagctaaatctatagaaagttttcgatcattttgcctagtaatcatggatacaatttgcacatatggatacgaatcaaataaattcaccttttgctccatctcagggaccttcaaaactttcagattcacctccctttttctgtaattgaaaacgaatcgagatcaatcgaaaaaatatataaaaccaaagatctacggatttggatcgatagagaaaacggaaaacccacatctctcgaacagtttgatcgaagaccttcatgaaatccatttggaatccgcgaaaatgttatgaacaaaggaacgaaaactggcaaaattttggtgcgaggagaagtgtagatctaatcagagatggctcgtctttgtattatgagttttttttttttcaatgaaaggcaacaacaaataaaaagttagcagctagaaccgattttctcgcgtaattagtttttaaaggcgtcaaatgactgtaaattcgacctgaccgtagcctgatccgcagtctccgatagtcacggctattggtgggttgttcaataacctacatgtatacaacaaaaaaaaattgaatccatttcgtttcagtaaataacacaacgagttttaagacctaaggtaaattcttcgaaatattatccaaatataatttatccgaaccacttcacgaaataatttagttgaatactttaaagcacttcaacgaaatggctccgaatggattatatatataatttttccagtaatgaatgttgttagtgaagatcatattactctcttctataccttactttgtaaacgttttaagtttaatgcaataaaatccttttctgggggaaaaaatataatccagttgaatattgttggtcagataagattaagtttataacattatatacccatttttctatattaaatatatctactacaattgtcttattgaagaagtcagcatgatgagtcatatacgagtcaaattgcatttgtttttaactctggtaccaaccaataaaccacgtaatatcagattatacatcacgtatcccactagtttaaattagtttttgctgaccatgcacaatctcttactttgaacatagagtgtccccaatacatgtagtctaatcactaaaatctaattttggatttcatatgctttgaagctataaagttgtttagaaattagcatacacaacagtaccttatcattttgggtgaaccatacattgacattagaaaaaaaataccattttgcatttagaacgtgaaaatcgaagtgattgaaagattggtgtgatggattaaaatgttggtgttgataatgctgctagttttctattgggccagccagatttgtttaatttttgtttttacttcgtccaggtcacacgcattctgtttctcaatatcaaacaaaaaacactcacgctcaaatcttggcgcgtccatatcaaactccttcacaaacagggcccatcaaagcccaattcttaacacctttcaatgtccgaacgtaactcctgacgttttaaaaattttaaaaaccaagtcattaaccccttaatatccaacagcaaagcgagtaattaaacgtagttagacacgtgtcctaatttaattcgatgtcaaaataaattaggataccgctgccacatccagttccatgtgaaccacgatgcacagtagtatttccttttagagcaatctaaagaatgacgtggcgtagtatgatttgttaagatttacctgattacggtgaacttgcacgtaccagatcgtaactactctccgttccaacctgtgttttcttttcttcttggaagctcccttccctctctttctctctcctccgagaaaggaaaagcaccacttctctctctaagaccccatttttcggtgaaggtttatgcgcttttcttcttcaacgagacgactaaaatacgtatacatgcgtatgttgatgtatgcataagtgttgttgtgtgttggagatttagaagagaaggtttgtttgtgaatttgtgtctctgaggttggtttttccagtttattcttctcaatgatccgaattggggttgaatcgaaaaccttagtagacttcgtctgtgatgactcttgatactagtggatg

SEQ ID NO: 28409 - DNA, 3003 bp, Unknown
  misc_feature (1)..( 3003): 2750-1469P.txt file - cDNA_ID_2996638; gDNA_ID_2926263; Annot_ID_143267
caagatctaaattctttcgaaatatatattgtcataaataagattcatgcttaatcacatacttccaattgagaacagaaactcacatttctagaatattattatgaaacgaaagtgcaattttgtatcatttctagaaactcaacttgtcctaaggtaagattatgatcttaagaaaatatcaggaccaagcaagtactgtaaattttgcattccctgctgactataagtaatttaaaatatatgcatttaatctaattaacagctagtgaaagagagcatagaaacgaaagttgattacatcttgtatgccttgatgtagatgctgccaccagatccaccaccgcctttggctcctccatagcctccgtttgccaaaaggcttccgttaacatccagaagctgcagaatatccatcttcactttcccacctcctcctcctccataatcaatctctctactagttgaccctcctttactaccatagctccacggcttctgcagagtcgaccaagagtatgcatcacctccccacacatcttcaggtagcttcttagtgtcagtcaaacaacaagcgcctctaccaccatgtccaccaccagcaccatcaatcccctgcggtgtcccactggtctgtggcggagggctcccagctaaccccgtcgtgttcaccgccgacccattagcaaagctagcattaccagctgtaagctccaatgtcccagcgacaattgtagattccgctcccaaagagaagtttccagaaacattgatagctatagaacaaccagggatcgggcagtgaaacctaacaccaggcaggatgataaaattccccttcccagctatatacacatcgtgcgtaaggttcaaatcggcgacaatcttacaagtagtatccaaaaacccaacgccgccgagatcctcgctacaagataccgacggtccatgcggtggtggcggtggcggagcaggcggagagtagtcctgatggaaaagtaacgactctgaatctgagtccaaatcggaatcagaacccgatttcggttccacaatggtaaatcgatagcttgaactagggtttacggccaaaaccgcaagagcgaccaagacgaagacgcagcaaaattgaaatcgagccatccactagtatcaagagtcatcacagacgaagtctactaaggttttcgattcaaccccaattcggatcattgagaagaataaactggaaaaaccaacctcagagacacaaattcacaaacaaaccttctcttctaaatctccaacacacaacaacacttatgcatacatcaacatacgcatgtatacgtattttagtcgtctcgttgaagaagaaaagcgcataaaccttcaccgaaaaatggggtcttagagagagaagtggtgcttttcctttctcggaggagagagaaagagagggaagggagcttccaagaagaaaagaaaacacaggttggaacggagagtagttacgatctggtacgtgcaagttcaccgtaatcaggtaaatcttaacaaatcatactacgccacgtcattctttagattgctctaaaaggaaatactactgtgcatcgtggttcacatggaactggatgtggcagcggtatcctaatttattttgacatcgaattaaattaggacacgtgtctaactacgtttaattactcgctttgctgttggatattaaggggttaatgacttggtttttaaaatttttaaaacgtcaggagttacgttcggacattgaaaggtgttaagaattgggctttgatgggccctgtttgtgaaggagtttgatatggacgcgccaagatttgagcgtgagtgttttttgtttgatattgagaaacagaatgcgtgtgacctggacgaagtaaaaacaaaaattaaacaaatctggctggcccaatagaaaactagcagcattatcaacaccaacattttaatccatcacaccaatctttcaatcacttcgattttcacgttctaaatgcaaaatggtattttttttctaatgtcaatgtatggttcacccaaaatgataaggtactgttgtgtatgctaatttctaaacaactttatagcttcaaagcatatgaaatccaaaattagattttagtgattagactacatgtattggggacactctatgttcaaagtaagagattgtgcatggtcagcaaaaactaatttaaactagtgggatacgtgatgtataatctgatattacgtggtttattggttggtaccagagttaaaaacaaatgcaatttgactcgtatatgactcatcatgctgacttcttcaataagacaattgtagtagatatatttaatatagaaaaatgggtatataatgttataaacttaatcttatctgaccaacaatattcaactggattatattttttcccccagaaaaggattttattgcattaaacttaaaacgtttacaaagtaaggtatagaagagagtaatatgatcttcactaacaacattcattactggaaaaattatatatataatccattcggagccatttcgttgaagtgctttaaagtattcaactaaattatttcgtgaagtggttcggataaattatatttggataatatttcgaagaatttaccttaggtcttaaaactcgttgtgttatttactgaaacgaaatggattcaatttttttttgttgtatacatgtaggttattgaacaacccaccaatagccgtgactatcggagactgcggatcaggctacggtcaggtcgaatttacagtcatttgacgcctttaaaaactaattacgcgagaaaatcggttctagctgctaactttttatttgttgttgcctttcattgaaaaaaaaaaaactcataatacaaagacgagccatctctgattagatctacacttctcctcgcaccaaaattttgccagttttcgttcctttgttcataacattttcgcggattccaaatg

SEQ ID NO: 28410 - DNA, 3003 bp, Unknown
  misc_feature (1)..( 3003): 2750-1469P.txt file - cDNA_ID_2996642; gDNA_ID_2926263; Annot_ID_143269
agatcatatacttgtttgtgtgaactgagatgtgtgttttgctttgattttgtgaaggatttcaccaatgtagatatgggtacaagaatgtatcagaccttgaatatgtagttgatggatatgcaaaagctggaatacctcttgaggtgatgtggactgacattgattacatggatgggtacaaagacttcactttggatcctgtaaatttcccggaggacaagatgcaatcatttgtcgatacacttcacaagaatggtcagaaatacgtgctgatcttggatcccggtaaacattcgtatactatctctagtctctagtgtcttcatcaatttgattcaagccattaattctataggtattggtgtggatagctcttatgggacatataatagaggaatggaagctgatgttttcataaaaagaaatggtgagccttatcttggtgaggtttggcccggaaaagtatacttccccgacttcttgaatccagctgctgcaactttctggagcaacgaaatcaagatgttccaggagattctccctttggatggtctgtggattgacatgaatgagttatcaaatttcataacttcgcctctatcctctggatcttcactcgatgatcctccttacaagatcaacaattcaggggataaaaggccgataaacaataagacagtacccgcaacatctatccattttggaaacattagtgaatacgatgcgcataacttgtatgggctcttggaagctaaagccactcaccaagctgtggtggatataacgggaaagagaccgtttattttgtcaagatccacgtttgtaagctcggggaaatacacggctcactggactggtgataatgctgcaaaatgggaggatttggcttactcaatccccggaatcctcaactttggcctgtttgggattccaatggttggagctgatatttgcggtttctcacatgataccaccgaggaattatgccgtcgatggatccaggtagagtgattaattctcagacataacctgtagatttcttcatgagttcatgatctaactctggatcttagattatcagcttggagctttttacccttttgcaagagaccattcgtcccttggtaccgccagacaagaactatacctctgggattcagttgcttcttctgcaagaaaggttctcggcctcagaatgagactgctcccacatctctacacattgatgtatgaggctcatgtcagcggcaacccaatcgcgcgcccgctcttcttctcatttcctcaagacactaaaacctatgagattgattcccagttcttgattggtaaaagcataatggtttctccagcgctgaagcaaggggcggtagcagtggatgcatatttccctgctggaaattggttcgatctttttaactattcctttgccgttggtggagattctggcaagcacgttagacttgatactcccgctgatcacgtcaacgttcatgttcgagaaggtaaatagtatattctttgatagccagtttttaatagccagagttgagcttgaaccgcgtgattttggtttaacattgtgaataggtagcattgtggctatgcaaggagaggcattgacgactagggacgccagaaagacaccgtatcagcttctagttgtagccagccggcttgagaacatctccggcgaactgtttcttgatgacggagaaaatttacggatgggagctggaggaggaaaccgtgattggacccttgttaagttccggtgctatgtgaccggaaaatccgttgtactgagatcagaagtggtgaacccagagtatgcgtcgaaaatgaaatggagcatcgggaaagtgacgtttgttgggttcgagaacgtggagaacgtgaaaacgtacgaggttaggacaagtgagagattgaggagtcctagaatctctcttataaagacggtttcggacaatgatgatccgaggtttctaagtgtggaggtttctaaactgtcgttacttgttgggaagaagttcgaaatgagactgagattgacttgaagaagtatataaagtataaaacaatattgatgggaaattgtggatgcttaatgaataaggagtgaagaagaacatttagtaaagaaaagatttcatgatttttataaactccaaatcacatagatttgattttttttttttctatttttgagaaacaaatgtgacacaattaatactagtggattaaatttctaaattatggtcaaatcctttatcaatgtaataaaattttaaaggaaaccaaatcagaaagaaaaaaatgaacgtcagatatgattccgatataacccaaaaagtctacgctacaacagagcagcggtctagtctaacgcaaaatccgtttcgtcgtcttcctcgctttacttttcaatctcctccttctccattaatcatctctttctctctctcacggattcgtaagttaatctcagtgcttctccgtcatcttcgcattattggttcttcctttttccctgtaagctcgacacgtggattattcctctgctttttttgttttcccttttcgtgaagattcgtttcctgtatctccgtgaagacttgatggagttagtttcttaaagtagctccttcttagatccgagtttcgatttgcttcactggtgaagaattagtgattgattcaactagatactatcgatttcgttggatttgtactgaaaacttggctgattttgttgattctgtcttgctggtgaagtctcaagctacttcgtgattagaggaggagatctggatttctagttttagcaattcatttgacttccgagttttccagaatcattgaagtgttaggcttacttgattcagattcagaacatagctttagataacgttagaagcagaatcagaatctgcaaatcggctctttagattgctgctactagaaatttgaaattagcttttggtagtgttaaggatg

SEQ ID NO: 28411 - DNA, 3003 bp, Unknown; identical to SEQ ID NO: 28410
  misc_feature (1)..( 3003): 2750-1469P.txt file - cDNA_ID_2996642; gDNA_ID_2926263; Annot_ID_204831

SEQ ID NO: 28412 - DNA, 3003 bp, Unknown
  misc_feature (1)..( 3003): 2750-1469P.txt file - cDNA_ID_2996646; gDNA_ID_2926263; Annot_ID_143271
ttgttctcatgatggtgattatctccgtcgttgcatcggcacaatctgaggcaccagcaccaagtcctacttctggatctagtgcgatctcagcgtctttcgtgtcagctggagttgcagcagtcgcggctcttgtttttggctcagctcttcggatctaagttactgtgatggtgatttcgtacagagattgtttttgcggtataggccattcatcattattcgtcgtctcgtgtgtattccgaagcagcttatagatctcattttctatttgtccctcttcttcttcgttttctatcttaatcttcatatctgtatgaggatattactatttctttttagagtatttgtggttttgtgattttctagacgatttcttagttatgcgatatggtttttgatatgatatgaatcttattctatttatttatatggatttctcttgagatttctcttttttccttatgctaaatcatttctcaagcatctggttctgctacgattcatagttcctggagaatcagaataaattccaaccgatctaaatcgaatgaatccaactaaaattgaactgtaatccaaaagcgaactttaaatttattcaaaacaattatatttgagaaccattctaaacaaattgatccaaattagaaattacacaatcggcactaagtttcgaaatttgttcaaccagtgcgtggttcaatttcactttccagctacattttgattttcttggtatgaactatgaagataatgatctgcatcgtttgagagtttcaaaattgatcagtaaaatcagagtcccaagtgtgaatttctcttgctatgttaaagctcaagtgaaactcatatccaatgtagaccttgacgttcgttgttttggatgattgcggtcagacttgtagaatcagctgaagaattagagaaccggtacaaaaagcttgagctttcgttatcaggtaaggaagaataaatatgatgctattaagtcgtcgtaccttgaataaaggaattaagttttcttacggacgccaattcttggtcaagattgataaaaaagttggggacttatttcgatgacttttgttggcagaaattacaagttgtggaagcttttttagacgttgaagaataatcaacggttgattattatgatagtatcgacatatgtaacgtgttgtgagatacgtgtagctacctttgattttcatagctcaactaatcctactttagaagtgacttttgattaggtttaggtcatttatgtgtttacttccatcaatgcatcattatcaaaacactctaatcaattttgcactatggggcacccaaattctacaaacctggctaagtacgatttcaacttctcggatcttaaaagctaataagtacaaatttagatgcaatcattctatgttcacatgattcacagtttggttttgaggtttctatgtatttggcttatcatggtttctttactttgtggaccaccttttatatttgtaaaatgtaaaataaagttatatttttaaataaaaccagaaaagatttgggctttatcagccgtttattgagacccattgggtatatactataatctaactcaattacccaatgttatatcaaccatagatattaattaaataaaattcgttggttatatatctcaacacatctctatacaataacggtttttctttctgaacaaacatataataacggttttagaaattgcatctggcagagaatagaaagaaaaaagtaaaggaatcgccatgaaaatggttggttaagcaggagagcaatacacagatataagaatcaattaatcttcctcaagatctaatcatagagattctcgcgaagttgccgtcgaaatccctagccaaactcatcgtcgtctcgaatctatggtcttctacattccgcagcaaatatttcatcgatctgtacttgaaacgatctctgactcgtccatgttttcttttctcaataattcaaagcaacatctggttctttcactcaatctctcaagaggcaatttttgaggaagcatcactgttttcttacacaactacatcaagctttcctcttagtcttgatatacggacctttccactaagttacaatgtttgcccaccggtactcggctttatttgctgcaagatttagataaggtggtggttatgaatccaagcataggccaattcttttttactaaaactcaaaactaagagaaaacgaatatcaagattcttaggatacgatcccattaaagataaatgcaaagtcttgtgcatgacggtattgcaagttccttccaagaaagagatcgccagaagagttgaggttaaagagatcccgttctatgagagttttcttgaatcatgttgagtgtccaatatttctctaaaggaagtcttatagtatgttctgtttttataagatctgtctttcgaattgaaacttctcctctcccatttgcgtgtagtctctttgatctaatacaatgattctagttaaattagacaacactcagtttctttcatggtcgctttttcattatcgacaaggttaccaaattggtatattgattacccttggcacataatttgatattagctccttttgttaatattgtcagcgagtttctcagaagatatgacaaatactagaatctatttcattactcctgactcttgggtcttgattgtttaatcaaaagagaaagggtatgttttgatataaccataaaaaggaagggtatgtatggaattatgaaagaagaaaaaagaggatgtatttgatgtaagcataaaacatcaggggtttatatgcaattaccaggaagaaaagaaaaaaagaatccttcaacgagggttttgtaggagagttcacattttttttttttttgtctcagactccgccaattctctggaaacttaatttggatattgttaatttgttctcgcatagatcgattcctcttacggagaaatg

SEQ ID NO: 28413 - DNA, 3000 bp, Unknown
  misc_feature (1)..( 3000): 2750-1469P.txt file - cDNA_ID_2996653; gDNA_ID_2926263; Annot_ID_143273
gacaaaaggttgaaacttggagttctcttgaaggttgctatgtctatgtttgaagagcttcactttcgtttctccctccttattatgcctctcttctttacgctttcttgtgtttctgctgagaattgagatagatgacacattttgttcatcagccatgtctgtatcttgatcaaactcctcttcttgtttctgcaatgtggtcccgatactgagatctggtcttgacctgtgaatcacagatttggcgtagtttttggaatggtcacagttaaacacccttggtccttgctcttccagtgatacaagccattctggagatcagattttgtacaatgggttagtcaagtgatcataacagctccagagaacagatgggaacaaatcactcacgaaaacaatcatcatgacctatatattaacgatagggaagcaatttaccaatgaaggatgcgggggtcaaatttcttagtgtgtctgcatctctaatcacttcaccttgactgattacccaattgatcaaatgataaggaataagtgaattggagaacatgttcgtgtacatgctgattttttcttgatctttgtttctcctgtgtaatcgtttggagtatcaagcaaaacaatcaagcaaatgaagcaattaattctatagaacttataggcataccttagagaagccatagtcttgtcaaaaagaaacaaccagttgatagcaatgttcttcaagtgtaaacttctttgtgaagttccatttccagggttgaggaatagcttctccactgacttaatcaccgcttctgttatgatttccgttaaaaatgcttcatcttctggaacctgaaagattaaacagccatgaaaaacaactcaattccatgttacatacaatgtgattcggttaagaaaccacagactttattggacttccgactgaatacacatatagaaagcacaggccactagtttcaaactttcaagtcacccagagagaaaagactaaatagattatacatagtttagtcaaagaaccaaccactcccattaatgaagttagatgcagatatggctccagcagcatcttgagaatgacatctgtcacaagaacaagaacacatgattgaaaacaaaaccaattgagacatctggaagcttatgaaaaaggagtcactagtcacataatgcttctctatttcccacagaatgcaaagtagctaaagaaaaagtaacactcaccaaaaaagaagcaactgtggaacccagatatcatctgaagcacagattcctgcagatctttatctagctcggatctacctaagtccaaatcaaacctcgagcacaaactgagcaagaaaacctgagaagctacgattccagctaagtaaccaacgccacaggactcagaatcgatctctttacgcaaaatttcactagcaaatggcatgaacacctccaaacaatcctcaactctacaattatcttccacttcatccacaacccaaactcgactcaaatcagcaaaactaaacccagagaccatcaacacatcatcatcttcatttccaggttcatcgacacagtacatgctaatatagctcacaatcccttctaacaagctcaaagcatctctcctcctagaaataactaaacgactcaactggtaaacaacgggagataacagcgataccttcttaacaccggaaaacgaatcggaaaacgaaactatcagctggaagaaacacgaagttaacctaacggaatcatcccggaaagctaacttggaagagtagaatctgatggcggagtagaaccagacgagctcgagaggtggtggttcgggaagatcgttaagaatacgagtgaaaatggagtcgaaatcggagaaattggttcgtccgcctcggtactgtaacaagagctgcttgatcgagtcattgagaagcggtttcagaaattcgaggtgactctgaggtctgggtttacaaatcggaggttgcattttgggaattttccggtgacagagaagggattttgaattttgggaagttggaaggaaacagagaaaccctattgaaattcaaagaaaagggaacgaataaagagagggaatcccaatgttaaacataaaaaaaaaatgtgtacattacattttcaaattgagttcactccaaaaacgtacaagactactagtatatttgttttattttcattatggcaaatacgataaatgatttataagtgtggattaacgaaaattgctagttactaaatgatttatgaagtaaggataaatgcaaatttcgaaaattggctaatcagctaatttgcctaaaagaaataaagagaaaatgctatgacttgatccatttttagcctttctacttcttttctttttggtcatatgaaactttatcaatacaacttatgtagaatcatcttaaaatacaacttctaatcaagagaaacttaaaccgacagacaaaataaagttttcgtaattacgaaaaagtgatttctccagaatctaaaccctatgaacaaaagacttaaaacgtcgtaaatacgaacatgaatttttaaaacaaatagaaagatttttcctaattatactgttatacatcatgtgatttctccaattcatatcaaaatacaattggctctacacattccatataaattttctatctatttttttttcttccttttcttgatatcacgagtcatacaaccacaatcaaaaacttaatacttttaaagatttgataaattttctgtctaaatagtttttgtaatgagaaagttacaagagtaaattattattgccaagtcattgttttatgaaataaatgaaatactgtacaaaaggtgaaaaaaaatgatacgattacgagtcatataaatacttcgccacctgcgtttagtaaatggttagagactcgtttggttatcacaactccacgacgagaggaaaaaaaaaactcagagagacaaatctaaatg

SEQ ID NO: 28414 - DNA, 3000 bp, Unknown; identical to SEQ ID NO: 28413
  misc_feature (1)..( 3000): 2750-1469P.txt file - cDNA_ID_2996653; gDNA_ID_2926263; Annot_ID_204834

SEQ ID NO: 28415 - DNA, 3003 bp, Unknown
  misc_feature (1)..( 3003): 2750-1469P.txt file - cDNA_ID_2996657; gDNA_ID_2926263; Annot_ID_143274
ggtagagagagatatataataaaagagcccataaaagaactcagacaacaaacatcttaagtttattaagtttccacaacaaacttagaaacacactcctttacatggcatctccaccacaaagaaatatgcaatgaaacgtccacgatttattatccccaaactttggtaaaaatgtctgaaaaaagtccctttcacgattggaggacgggttcgaagctcacttgttccaccaatgcaagaaatccttgcgcctgttgattttcttctgaagctggagtagtccatagagcaaagcctcagcggttggtgggcaccccgggacgtatatgtcgactgggacaattctgtcacatcctcgaaccaccgagtaggagtagtgatagtatccacctccattggcacaacttcccattgaaatcacccaccttggctcaggcatctggtcataaaccctgtgattgtattcaaacattagaagttggaatttcacacaggataaagaagaacagaaccataaatcatttgagttgatccgcatatacaacttctctcaatcttaccagatcaagactgatttctgcacatatctctatatactagtttctgactaatagttaaattcagtataagaactaatctaaaccaacttagaaagcagttaatcatctcccgaatgcatctaaaatgtgctcgtcttattggttgatgtttacacaacctctagctattaagattgacttgggatattttctaagtgtctgggcctaaagttatcattaatataagcacagcagccattggcatacgtttcttaacaacaggattctcatctaaagaacataagttctacacttgaatgaagacttcatacatcaaacaaaaaaaagaggaatctcttaagtgtgccggatatcaatttcctataaaacacacaccaagcagaaaatatgtgcatcaagtctcagattctaactaagcaaaatcatcacgcaagattctaatcagtcaacagacggaactacaaaacaagataatgaaaacatcataacaatgaacctccaacctcttactagtaagacactaacacatgtttccctaatgaacaccaagctagaaaatctgaaattcctaactcccctcaaaagacgggcacagagctcacataaaaagagatataactccaccatatttgttcatcccttaattaaaacgctcccaatttcatgaaattcgaacaaaaaacttgacgaaacactagttaaatctgcgctagacaatgaatacgaactgtatagcttcccaagtcattcttatatccatacagcaattctcaatttgtcacagacctagcaatacaatcagaatacatgaaccctaaaatcgccggaaaagaataaattccaatagaaacccccaaattatatcctccgaaaacctaattcagaggcctctaaagcagaaaacgcacaaagtgaaattagaagaaatcttcccacgacaaaactatatccgagatccaaagatataaatcagccgttaattccatgaataagggagatagagaaagataagcgtacttgcgaagagccggagccatcttattggtaagagtaccggcgacaatcatacaatcagactggcgaggactaggcctgaagatgataccgaatcgatcgagatcgtagcgagcagcaccggtatgcatcatttcgacggcgcagcaagcgagaccaaaggtcataggccagatcgatccggtacgagcccagttcatgagatcatcgaccttggagatcacaaattcggccgctttagagagaccaggaggaggaggggaggtcgaaggaggaccaggtctggtgtaggaagtcggtgatgtggagggagagagagcgggaagggatgtgtggaggtgagagaccgaggcagcggcgacggcgcgttgagattggaggaggagagggaggcgcgtggcggtgttgcgcgtaatcatcgccatttagatttgtctctctgagttttttttttcctctcgtcgtggagttgtgataaccaaacgagtctctaaccatttactaaacgcaggtggcgaagtatttatatgactcgtaatcgtatcattttttttcaccttttgtacagtatttcatttatttcataaaacaatgacttggcaataataatttactcttgtaactttctcattacaaaaactatttagacagaaaatttatcaaatctttaaaagtattaagtttttgattgtggttgtatgactcgtgatatcaagaaaaggaagaaaaaaaaatagatagaaaatttatatggaatgtgtagagccaattgtattttgatatgaattggagaaatcacatgatgtataacagtataattaggaaaaatctttctatttgttttaaaaattcatgttcgtatttacgacgttttaagtcttttgttcatagggtttagattctggagaaatcactttttcgtaattacgaaaactttattttgtctgtcggtttaagtttctcttgattagaagttgtattttaagatgattctacataagttgtattgataaagtttcatatgaccaaaaagaaaagaagtagaaaggctaaaaatggatcaagtcatagcattttctctttatttcttttaggcaaattagctgattagccaattttcgaaatttgcatttatccttacttcataaatcatttagtaactagcaattttcgttaatccacacttataaatcatttatcgtatttgccataatgaaaataaaacaaatatactagtagtcttgtacgtttttggagtgaactcaatttgaaaatgtaatgtacacattttttttttatgtttaacattgggattccctctctttattcgttcccttttctttgaatttcaatagggtttctctgtttccttccaacttcccaaaattcaaaatcccttctctgtcaccggaaaattcccaaaatg

SEQ ID NO: 28416 - DNA, 3003 bp, Unknown
  misc_feature (1)..( 3003): 2750-1469P.txt file - cDNA_ID_2996661; gDNA_ID_2926263; Annot_ID_143275
aaagccttaacccaagcttcttttgcttaagactttatttgaaatgaatttgaacttttagatggttttaatgacttgggtgaattgagagaagctgctacaatttgtatttttgaaaaactcccaaataaaacttaaaaccatgaaatttaacttaaaaatcaccttaaacagtaaacacacacaaaacagaaaataattagactaactctttgtttacgtcttaaagaaaaaagtctaccccaagaatgttctaaaattagaatcgttggattcaatttgaactagctagagtaggaatgtttataaacttcattttctttagccttgaagtaatggaagtttctgcaaacggacacgtagttattaatatgtgcaacaacttccatataagccaagagccatgatctcatgaattggattaaaagcaaagaaatgtctctctagctagctagataatgcaagcaacaaaactaatgtaactttaaaatatatttgtatactttttttgatgctacataattacaaaattacgaagtatgattctttcaacgtgtgggacgtatctatattacataccagtactaaatattgtcggcggagattaaaccgttttaacaaaaaaatattgtcggcgaagattcgtgtatagtcatttctatataaaatgtgagattgattcttagattagatttgatgagtgatggtggcgagatggagacagcaactaataaattagtgttactcatctttttagattaaccaaatggtaagctttaatgttgagtaatggcgtcacacgtgcctttccttttatcagaaattagggaaacatttactgttttcacgtacatttgagcaaacaaccactgcatgctttcacttacaaaactacacatagtcttaaaatagttaaatgggagtaaatatctgaattttttcattattcgctcatatcattccatgaaagcctttaattcgtaagtataaacggttgttccatttttatatattatattacttctcataaatatacttattgataatggaatggatggacctttaaatataaaagatcagtattttgtttcgaaaaaaaaatcattatttccacaagaccaggttcagttgatattttaaaatcatttataaataacaatatagtattataaaaggtgaaaatgtactggaaaatacaaaattgcaaagtctgctaagggtcactattatttgattgatatgaacaaaagtttataaaacaaattccgaaaatcaagaggcatacaatattgaaactatggtatcctaaatgtaaagattaagaaacgtggttggtgggttaatcattaaaaaaacttccatgaaaaacataggataaaaaagaactagatataaaaacaaaagctggtgacaagagctaagaatgtaatggtactaatatgtaatcattactttgtgaattagtactcaaaaacaaatttgtaggtacatttattcggtgagttgtttgagcattccttttgattaattcagccccttttaagtgtcactatgttgttgcattgcgatcaatcaataatgagaaaggaagatatatcaaatgtaataagcactattgctcatctaattgggaatattccatcgtgtttgttctatattaccattcaagttaattcagagctgttaccatgattatataaagttgaaatattatttactgtatataatagcatgttatgatatatatatatatatatatatatattttatattcgtcgaacgaagctaatatacatgtttaaaagctggaaaccataagattaaaagtttaaacaggtacgataattaaaaacctgatataaatgtctttgtttgttttgatatttttttttgtcacggtcaacttattaatatttttttgtcatatggtagaaatggttatcaatttatttatgatgctcagatatcgagcaaataataaacatttggtttaaataaaaaatgaaattcgaaagatttggacggattaataattaagcaaaagggacttacggtttaacgctcttgttgggtgccaatgacacataccaactcgacaagaaaacgacatgtgtgttctcactctcacgcaatgggccctgtttttcgccattgaaaaccacagggtgttcatattttaaaacgggagaagactaatcataaaaggcaaataacgacaaaaataagttaaaatccaacggctgaggatcctccatctccgcccaggattcaccgtggcccgtctcaccaatcggtcaaaaagtcaacagtacgtggacctttttatttcaatgaaaaagaaaattctttgttttggcccctgtacttttatatgtatcactattccccctctatttatttcagatttaaattggatcctcaggatataaacgagtagtatgaatttgtattcacattttaatcaggaaataattgtttcaggtttaggataatgtttttggtagaaaattaaaataaatttatttgaaaaatgaagaaattttgatttatttggtcagcataaaaaagaaaagaaaagtgggaatttatggtgccgacacgttatggggacgaaattgataattaagaaaataaaggggtgagaatgtaaaggttaggaaaataaaaagctgtcggtcccttaaccaaggttaggtatttgatcagggtatatagttaagccctgtgattttatttttatgcaaggtcctacattaaaccgagtcgaccgtcggtgactcagttacgagtctcgcgttaacgagttcttctctccctggttttttgtttttatattttattttagtctcacaagtcttctctatttataaacacaaaaaaacgaagatagccatcgttttggtgagagaagagagaagagagaagaagaaggccatggaaagataatactctgctttttttttagaaatatacagaggaaataaagagagagagaaggagatg

SEQ ID NO: 28417 - DNA, 3000 bp, Unknown
  misc_feature (1)..( 3000): 2750-1469P.txt file - cDNA_ID_2996665; gDNA_ID_2926263; Annot_ID_143276
cgaggtaagaaacgagatctccatatacccaggacggaatcgtagcctcgcgattaactgttggtcgtcgaataacaaattgggcacgcatgctctcaaaccaggccaatccaaaagctggtcgttcaagccaatatttattaagataccgtttttctacacatactttgagtgcacgttcttcaccgcgtttggctcgccatttggtcagacagcaacggtttttgccggggagagattattcaggtggcaatgtgataatccggatgaggaagagtgcatttgggtggttaagagagacgggctatatctaaggaggatcaaaagagacaataaaggccaaaggctctatggagatgaattgagaatggtttggatcggcggtactaattaccaccctgtaaaagaggatccataatctttacacttccatgaccacttcaggatatatgttatatctctatttttgtgtgtatgaaatggataacacgatacataatctagaagaaacagaacagcttttgtgtctttcctttatgtaaaggtagcaaatttgagatcaatccacaaacaacttcaacagcggaaagagaatgaattcatccggactagatgattacttttgcttaagctccatattttggggctttccaaagtttgaaagcaacttcgtggatgaaccgatcagccggtataacaagatttccacagagctatgatgaaaagagagaaacaacaaaaaaattaaccttgagacaagaagccgtgacgtttattatagcagaacttgcattaaacagaaaccatacctttttgagagcttcaaatgataaggtatcaactaagtctttccgggtcaccccatgctgccactgagctaccaacataggacagtagtgcctgtaggttgcaagaatgaccaaacccgtcaagaacgaaatgatgatttcagaaaagttcaaatcaaattcttttggttttgacaaaaattcatcgaatctcttaccgaacatcatcccgtgtcttttcacctcgcatggtgtagctctgacgcgggacaagtcctataaatgccgggttaatgtcttcttgtggagtcttgattggaaaaactgaaacatctttgtctgtgacagaaccatagctaagaacgacagacagatgcaaccgcgatagaatctctgaacctggttgagccattcccataatactgccaatcaaagagtcgagaattcccatgttgttcccgttattatattcatcaaccccgaaatgaacaaaaaccaagtcatataggttcacatccaagcactttcctccttcaaatccaagcagctttagtagtttagatgatgtggcatcagaaggaaaggaatcactctcttggcatatttcactaagctgtaatacatctaagccaatcagttttccgaaagaagtcagagtagaactgtccgtaactaaagcagctttgagtcccataaacctggcattaaagtaaatactagcatcaacatatggatataccagctattgattatcaaagagagtataaaactatagagataagtgaaaagtataacctttcagccaaagttgagatatcatttccatttccctttggttttagtccactctattaagaaatcagatcatggttcgttaatctctaattcgtgaataactatgtaaacacactgagattgttaaatattttgccacaaaactcggctcacatagaaattaatatagtagagagtaaagtatctcacagctatggaataagcttcggatgcatccagcaagtgggagaattctcgaactattctttcattctcagtttctgcaatattgaaacagcagagtgagttagatcaatagcaaaatgtcaaagcaagggcaatgtaacacaagtgatctcaaatctttgtttcttaagcaattgggtcaattgacactgaacaagaactctaagttggccagttagatcaattgtatactggagtttcatattggactattaaaaaagtcacaatcgaatccaaacgatatggttcaattctgatcaacactaagaaatcctaacaagtgaaaacccttaaagtagcgattttgactgaaattcaagacgaatcaaacgaaagtaaccaaatttatgaagagatagcgagggagagagaaagagagacctggaggtgcattaggaaggctcaagaagccacaagtagcgacggaagcaagagaatggatgttggtatttgacggatcgacaaatcgagccaagccgtctccgtacaatatcagtgatctgcttgatttgtccgccattgttgtcaaaagacgaattgtccgagaagaaaaaaacagaagcgaatatatatatttttttgtcgtgaggggaatatatatatatatatatataatataatttttctttttttttgtttttaattttttaattgacagcgattttttggataatttttggggaccatgaactaaaaaaacacgtttacaaatttcacagaattataaatacagtgaaatctatttttattggatttaaatgattacatgaaaaagagtcgcattgagtaataataagtatggcgtagacattgagctaaagttttatagaaatggaagatgttttgtcctaatcgaaaatcaaataaccaagaaagacccattccattcattaatctaccacatggacatggtgcagttgctgtatattacaaagaaacaacacaacattaaaaagaaaaaaatccgataattaattttaatacagatatgtcgtaaattgtacagtatagtcttgttatatgtagagagcctatgtatggactgtttgttgaccattgcaacaatctcactttccctctctccccacttgcccactcctcgtcctcgatcgagagactcgcgacggttccggttcttctgctagaccgttgctccagtccggtttaatccagaaccagttgttctgccatg

SEQ ID NO: 28418 - DNA, 3000 bp, Unknown
  misc_feature (1)..( 3000): 2750-1469P.txt file - cDNA_ID_2996672; gDNA_ID_2926264; Annot_ID_143286
gcttcagcggcttcttgaagagcggaaacagcaccggtctggaaccttagatctgccttgagactctgagctatctctttcaccagtctttggaaagggagttttcttataactaagtctgtggtcttctggtacttcctgatctccctgagtgccactgttcctggcttgtatctatatggtttcttaagcggcggagttgagtgttgccatactctcatggcgaagtgtggagccttacctcctgttgccttacgagctgtctggttcgaacgagccatagtgagcaaatcaactttgatatgtaaaaaagttttgatggtgaaagatatgtattgagagtttgtgggtggagacatttatttatttgtggagaatctaaatgaaaattaggaagaaactatgattaaaaggaattttaagattttcttatccgcatgaataatgatttaacaactatatatagaccataggtttgctgtcatctttcaaaactaagataaccgtctataagtttgagcaccaacgctcgataaatatagatcattgatttgctttcacctttcaaaactaaaacaaccgtcgattagtctcaaaatcaacgcttgagatctttttttccgttgcgactgtgtcaactgaccttgaaaatatatgggctacaataaataaaacatattgggcctatgaaataatcaactaattaaaaattcagacgttaaaaaaaaaaaaaaaaaatcgactaaaagacaaaagtaagaaatgaggtaaatgtgagattccaacactagagtactttcacgtatacaattatgtacactatcttacctaaaggatattttgtgaaaaatggaccgagaacttacttatactacagaggcaaacacatgctttatttgcttgccctcaagacgggctctgtaagactataactaccaatcaaaatgcaaactactttgatagaattactaaaactaacccatcgtcagtttgcaccaataagcattcataaatacttaccaataaagtttctatcttttgtccaaaagaaaaagtttctatatatctaggttttgaaaaaacctatcctcgaaactataatgcttcaatagatctttaatagcatgtatggcccggtagatagaacaatgatgtaaaagcccatagtataataggtctatactagtgctggatctcaatggaagtgaaacaggtgattcttaagtagagattatacaaatctttttcagtaatcgtatatttaaaaaattattttggtttaaacgtgcttaacacctgaaacaacccaattatgtgttggaaatatagtagctatatcaattcttataaatttttgtacttgtaacatcatctataagaatctagaatactatggataagaagtcaaaacccaactgattacattttgagactgttgaaagaaatatgtttaaaaacgatcaaccttatagaaatggtaacaaagaagtgtagtaaaaaacaaatgcccggttcattcgcaagaaaaggcaaaaaggctataaggcattacatactttaacgcatgtggaagttttttttcaaaacgctttattaggtttaggctatttgtactttatatatgggtttggtgggtttggttttgaaagttaagcacaattacttaacaatgattttctcatcattaaataaataaaacagtgtaatccttttttcttagtttcttgacttcttcttctcttgctgatgtaaacaactcgactttacaacattattgtaaaacaactcttaagacatggtcagtcccacacggaattctatcttctactaaacaaaattcattttgtcagaaagtcatcctagctttttttaactaaggtatggcctatttctttttgtaatttacccattcttctaagatatatatgacctactaatattatcaaattgatgttgacttgaatatacaccataatcatttaattttgcttgaggtctctaagtggttgctatagattttgaaacagttgagttgatccttgttatattttccaatgacatgtgtgttacactgttactattgaaagacattttaatcatttatataaaattcattttagactatgacttttcttttgtcaacaaactacagtatatgattctttgaagtatacagattttgaaaatctttataatatacaaatttacaatgtataacgggatagcatttctctttgtttttgtgttcctacataataatatcaatgctgacttgtatatatttatcataaatagatattatccctagttttagtttttcctattttcttagtataataatctttgattttctagagcttttaaatgaataacacatatctctttagtaatagaattccctagaacaaaccacatactcttgtttttcttttaataatagatgtttggatggaaaaaaatccagtaatctatatccaacaattgtcttacccatttatccgaaagatacaacaaagcttatagaaaatcatgtctcagataaacattttgatttacaattaataacatcataaaacagtggaaatgtgtttagcagtagataagataacaattatgtaaaaaaactggaattagcttttgtaaactgttcaataattctgatatgttaccatattaaccaaaaaacaaaatgagaaaagtgagaaaaaaaatgaaaagaaacaaaaaaggagggtattatcgtaaacataaaaaatggtctctgcccttcacatgcgttctttctatcagtccttttaagagaagggagacagaacattctttggattttctatctctctctctctctctctctctctcttcttcacacacacagagacatcatcctcttcacacccttttcttttgcacaatcgcattcactatctcttctctctcttttgtgtcacatccttctcttctcttctaagttctaatcttgtactatcttgttctaccatg

SEQ ID NO: 28419 - DNA, 3000 bp, Unknown
  misc_feature (1)..( 3000): 2750-1469P.txt file - cDNA_ID_2996684; gDNA_ID_2926264; Annot_ID_143294
aaaatcccttgtcaactcaggtttatggagtatcatggctggtgattttcttgatattgtttgtgatgaaggtgggtttacttgatacatcaatctctttttaattccccagaacgtcatggtcaataaccaagttttttgttgtttgtttgtctcagactgtttcggttggaaggcggagattcagcgcgagttttcagctgatgttccggttgataaaggggctgatattcatgacgtttatcgcaattattgtgatattgatcacactggctcacatgacgatacaagacataattgtgtgtatccttgcctttatgcccacaggttgggggatgctcttggtaagtaaaaaaaaaagcttttcactggagtcctattaaaatggaaatgttgtgcgtgtgtggataaaaacaagactaacacttggtgtgtgtttgcagattgcgcaagcgtgtaagccggtggttcatagagcaggattctggggatcagtgaggaccctagctcgtggatacgagatagtaatgggactgttgctgttcacgccagtggcgttcttggcatggtttccatttgtgtcagagttccaaacgcgtatgctctttaatcaagctttcagtagaggtcttcagatctctcgtatccttggaggtcatcgtaaggatcgctcttctcgaaacaaggaatgattcatctcttcattgtaatgacagggaagggatcttaatttatcccttttttatcttcatggatgattagggttaatgtaatttagttttcaatatatcgcttaggtaaaaacattgtagtattcatctataaattagacgttatctatcatttaatgactgtttaattatttagttgaagacctccattggtccatgtcgaggaagataaggaacttactaacaacttttgcttggcctataagatacagcgacaacaaagctttcaaaaattccctagttaccaactgggttcattaatgggccgataaggaaagcccacgatcttctaagaaggattagccctagtttcctctgcttcgttgaaagacaacttaaaaaatggcgggaagttgtgacaatgtttggttcgacaaataagcggagacgtggcggcgatacgtggcaccacgacatttgtacgagaatgataatttgtcttggttcgagccagcctgtaaacggtaatctgtgtccgtacagcttaaatctcatcccaaaaagaacaaccaaaatgacggatttggccccaacaaagctgtaaaacgaggttaaaacccggaactttcaccttattagacgacgacacacctctcgtcactcttgtcgagactcttaccacaaagaggtttttgaaatggcggcgatgaaatacaaaggaagcgtttttatcatattagtcatccttcttctttcgtcctcactacttgctcactcttcttctacaaaatgtaagtgtcatgtgatatgtttaataatattctcatctttattcatcgtttgggttcaaaacatgatgaatcaatcctctttgttctttttgtttctagccttcttttggttaggagaaacacaagatacgaaagccatgaaaaaggtaagaaaatctcttcctagaaacacaacgcgactgttttgaaggaaatgaacaattcgtttcttatttttacaataaaaagtatgaaactttttgttttctagctagctctttgcatttgatattcgtttgtatttttctatatgattttgatgcaaagatgattaattttttgttttggtactgaaaacaggagaagaagattgatggaggaacagctaatgaagttgaagaaagacaagttccaactggatccgaccctcttcatcataaacacattccttttactccatagattcattccttatatcttttttctgtatcttctgtttcccattgttgacatattagtttgtaatgcttttcacattctagttttgagttttgtttatccgaatgttaaatttctatttcaggttgaaaatgattaacttcgttatttactatagagtatttcaattacttcagccaagattttgtggatgctttggaaagatgccaaagcgtaacaacttccaattcaatttttgtgatgagttagttctcaagatgaagtcggaagcattcgtgacatcaattgtatatataaattttgggtttagagtgttttaagttggtatcaaatcacaattaattattctgtgacatttgtttctagaagaaacttgggaaaaccgatcttttggatgtgaagtggtagattggttgtctaaggttttgtactagaattttgtctgattttagttttaaaacggtaagatatattttctttataaggacaatatggtgtatctagttctaattttgtgactgtatatagatttgttgatgctagattgtttgtcaataaaattattgcattgaccttaattagtttcggtagccaatcgaccactacttgttgagttttggagccacatattccccttgcatgttacaccgagtgacacgacaaattcatgttaaacaaaaataaaaggatatacggttaaactatttattgtaccgcaataaataaagatattaaatcagtttattttggcgccacaaacaaagtagatatagtgtgtgtttttttggcttgttgatatcaaaatacctatgtttttttattgtcttctacattagctaagtcataatgtgaatcatgtaaatcttataatctatctttcagaatcttaagttgtgtgaggcacgggagagtcacgtgagagtttttttttttttttcacaagtcacgtgagatttagatttgaacaaatcccgtaacggagcaagcgaggcacgtgacatacacgccccccttaggtcctataaatacatctcctcctttcactgtcacaagtagcgattctctctgcggcgcgtgtaaacggtgacggggctctaatg

SEQ ID NO: 28420 - DNA, 3000 bp, Unknown
  misc_feature (1)..( 3000): 2750-1469P.txt file - cDNA_ID_2996688; gDNA_ID_2926264; Annot_ID_143296
aatattaaaattaaaacacaacatactagttgaacgtggtgtatccagccacggggaggctaaacgagcatcaggtgaagctgcagctaacatgggtgatggagaaggttgaggtcgcctgctgtaactagagcctctgtctccgtgaggactacgttcccattcgtcctgtccatcatcccagtctgacctacctacactccatcaaaaaggccaaataagtgttgtgtttgcaacactcatcacacttatgggaacaaaaaattgaaaatagacaaaattgtatagagataaatgtagtgacatttatgtcaataagctcataaattgatagctttatgagcttcaacaatctttagcatacctggagtcctccaatcgctattgtatctcctacgcttttctccgtgatagtctcggtcagattggcgataagattccctccgtcggtagtgatccatctcatcataagtgtttctctgtcttgaccgcggagtttcacttctgtcacgcctatgttcttctcgatgcctattgctaccacctctttcataactagatgtgcaagataaagtccttggagttatggagatcttcattccaacaggtgaaaaatatgtcagaatactaaaagtcaagttgcatgtactcttaaaaatcagttaagtaagtagaaaagatagataacccagggcaaaataatgatttcattattaggatggaattgacttacatctgaagttccagcattctctgtagtcacggtactttctgcaatacaaaaaaataaataaatcacaaatgtcataagtcataagcacaggagttcagaaaaacgaatgaaggtggtatttcaacatcgtacttatgctcacaaagaaggatcaaagtctagggctgaaaactacatattgatgagaaaaaaataccttgtgcagactgagatcttgaagacttctctctatatcgcctgctggaatggacaggtcgagtgttttctgttccaaaatctaatcctgatacatcagatttatcttcttcatccaacgatgatgtaacagatattgctgacttcttcggaaccttaaactcgccctcagtcttggcattatcctttttctcaattgcccttgcatccaaacctacaaatgtattatccccatgggttcaatacggttccaaaacaagtaatcaaaatgcaaaagctcacaaatcccaactcatacctaaacgggactttctctcaggagctttaaaagtcaatttatccttcacagggacaccaccattggtttccttgtcggcttctaacgtttccgtagttttgaatggatcaacctatatcataaacaatacaattattgcttgtacacataatcaagttcctcaagcgcaaaacaacttaaaaaatccgaaaatttggcaaaatcagcaaatcggaacttacccccattactcagtcgacgatttgagctcaaaaccgaatcttcaatcccggaaatcgaagacagcttcgtccttcgttccttatcggcgagacaacgactccggcgaggatagattactttccctagtttattagggctttggttccttcaactcctcttgagtgattgattccaggtgcttttttctgaattatccaatttcaacaacgtgaaacaccttctttggatcaacctttgatatctcctcagagagagagatatctggaagctgagaaagttagcaacacgatcggaacaaaggatcaccgccggttaggttacacacgctttaacgcgattcagtatgtgcgtgggattattttttataagttttgaatcagaaaaaaagttttacatatgggccgatttattttacatatgggccttttagcattaacgcattgttatgttttttacgccgacgtatgcttttttgtttgggctcaacataactttattgataaagagtatgaccggcctatgtatgaggctgctacttatcgacagcaacatgacttgagtgaaagtgaaagtgaaagtgatgctatcggagttgttgttgttgttcaggactaggactggtatatctttgataaatggttggccagcaggccatgcttgcacttgcatcaaagcttgaataacatctttggtatcctgactcataaattacatgtttaaagcccatgtttaggataaaaacttacatcaaattaaacacttgaaacatataatttggaataagatctaacgaaaacttattggttataaaacaatcaaaggttattagttatctaattactttaaacactgcgccaaatcctctaatcttgttggacaaacgcaacggtaaaaacaacgtcaaacaaaacggtaaaaaaatattgaaaaaagtaatgacgagtcatatgaggtcaaagaagccattcaagtttttaaaaaaccgctaacactttttttattggaatcttcgacttttttgaaattccaaatccccttacaaaaataccctttcggttcataagtattacgttatttgtctcagtgaatagattggaggtacctttttttgcttgctccaagacaaaaccgacattgccacagtttaaacttggtggtgttactgtaattaaatggaaggtagagcctttttctggacacgaccttcgaaagtgtcctttttaaaatttctttttatttttgtgtctattaaagcggtgcttaaaaaaggaagataaatacaaaaaaacattcatttcagactgctctctctctctccctttcactttgcgtacttagcagctaagtagcttaaaaagttgtggctcctttgctccgccattgttagggtttctggatctccgtttctctgtatgttcttctcaatgttgcatctctgttcgtcactgttgatttttaaccatcttcgtctaatgacttttgtttgttttcagggaggctgaggaaaccttaaaacgatttaaaacctggaggttatagggtagacaaaatg

SEQ ID NO: 28421 - DNA, 3003 bp, Unknown
  misc_feature (1)..( 3003): 2750-1469P.txt file - cDNA_ID_2996692; gDNA_ID_2926264; Annot_ID_143297
tgtcttatatgcacattagcaagtaataagatcagatgctccctttgattagccacattgtctttctgcagaaccatagcataaacaagaaaaattgcatgttagcaagtaataagattaagtgctcctaagattagctgcattgtctttccgccaaaccattaaagaatttatagattactctcaacaaaagcttaatgacaattggcaagcatcacgaactagaaaaattacctgaaatccaaacatttcttgaagccaatcaagcatgtcttcatctttctttttcttgtgaccttctggccaaggaagacctctagtattgcggagagcaagaacagcagcttggatctgcagtaaggattacatcacccgctgataacatattacaaataataacaatgcccaacaagaagaggactaacctcaggatatctcataatcgcttgattggcactatcaggatcgagaggtaggatattataggggacatacaactgtgtcttttctgcaaccttatcttgagcttccagaatctggaaccattcaacttcattgtaaagttgcacaagagatggaaaaaaaaaagagacaggactagaaggtcacaatgccttacctcccggtcaacctcaatggactgtgtcagattaacagccttcaacacctcaaacaaaacattggcagtttggtatgcctttgtcagctgggcactgaaaattaacagcacttcaaagtatcattaagagaatttagtgctctcaaacactggcaaaacacaaattagcatcttaaaaagacaatttaagtaagttagacataccggtcagccttatcagcagcattgtgcaaagcttgaatatacttcttatagtagtgttgataaaagctttgcatttcacgggcatcacttttcttaaccctgcccatcagtgttggatcatgttcctgcaaaaaaatcaaagcaacagtagaccacatttgtcaaagaaaagtactaaaaccaagattccttctaatagctatccaaatctgccacatgcaagaatcaagcagagtataaagaatgctcactctttcaagacgctgtagaagtgcagtcttaaactgccgaacacctcttccactggaggtaggatccaatctatgtgctttctcaaatgcataaaaccgacctaagggagaaagcagaaccaaaaaccagataaacaaccaaatgacagagaaccaaattaagaaataagttttagaagaacttacagagatacgcaaccctaggattactagattcaacttcattagcaacccgaagaatgggggcaatctcaacaagagatgatggaacaacttcactatcgaatgactctccaagattaccagcagtctgagttcgtataatccgccgctgctgaggctgagacggcccttgatcaggacctcctctcgtagcagacattttgtctaccctataacctccaggttttaaatcgttttaaggtttcctcagcctccctgaaaacaaacaaaagtcattagacgaagatggttaaaaatcaacagtgacgaacagagatgcaacattgagaagaacatacagagaaacggagatccagaaaccctaacaatggcggagcaaaggagccacaactttttaagctacttagctgctaagtacgcaaagtgaaagggagagagagagagcagtctgaaatgaatgtttttttgtatttatcttccttttttaagcaccgctttaatagacacaaaaataaaaagaaattttaaaaaggacactttcgaaggtcgtgtccagaaaaaggctctaccttccatttaattacagtaacaccaccaagtttaaactgtggcaatgtcggttttgtcttggagcaagcaaaaaaaggtacctccaatctattcactgagacaaataacgtaatacttatgaaccgaaagggtatttttgtaaggggatttggaatttcaaaaaagtcgaagattccaataaaaaaagtgttagcggttttttaaaaacttgaatggcttctttgacctcatatgactcgtcattacttttttcaatatttttttaccgttttgtttgacgttgtttttaccgttgcgtttgtccaacaagattagaggatttggcgcagtgtttaaagtaattagataactaataacctttgattgttttataaccaataagttttcgttagatcttattccaaattatatgtttcaagtgtttaatttgatgtaagtttttatcctaaacatgggctttaaacatgtaatttatgagtcaggataccaaagatgttattcaagctttgatgcaagtgcaagcatggcctgctggccaaccatttatcaaagatataccagtcctagtcctgaacaacaacaacaactccgatagcatcactttcactttcactttcactcaagtcatgttgctgtcgataagtagcagcctcatacataggccggtcatactctttatcaataaagttatgttgagcccaaacaaaaaagcatacgtcggcgtaaaaaacataacaatgcgttaatgctaaaaggcccatatgtaaaataaatcggcccatatgtaaaactttttttctgattcaaaacttataaaaaataatcccacgcacatactgaatcgcgttaaagcgtgtgtaacctaaccggcggtgatcctttgttccgatcgtgttgctaactttctcagcttccagatatctctctctctgaggagatatcaaaggttgatccaaagaaggtgtttcacgttgttgaaattggataattcagaaaaaagcacctggaatcaatcactcaagaggagttgaaggaaccaaagccctaataaactagggaaagtaatctatcctcgccggagtcgttgtctcgccgataaggaacgaaggacgaagctgtcttcgatttccgggattgaagattcggttttgagctcaaatcgtcgactgagtaatg

SEQ ID NO: 28422 - DNA, 3000 bp, Unknown
  misc_feature (1)..( 3000): 2750-1469P.txt file - cDNA_ID_2996713; gDNA_ID_2926266; Annot_ID_143318
tgggtgagaaagacgctaattctggacttttgatctaaaaaaacgttataggagtggtccacgatcatttcatctagacatggacattgacgggccagctaagaactccgttaagattcatctagagaagcagagacttccacctggaaaatcaaggagaaagagttacttgaaggtcaagaaatatgtagcctgcaggactgataaagatgctcagataaagttgagcctgtacgacccttacgagttccatcttgtgaaccctaaccggcagtcttagttaaggaacttggccggttacaagctcttacctagtggtaatgctgcaagtttactcgataatgatgatccgccacatattagaggggctttcacaaacaatcaggaactcggtttaagctcggttggtttgacaggttcaacaaacttgatgtataatcgatgaaagtttttggtttaaatataggtgactcggtataaccggtcagagaaatgggctggagggcttttgatgtaccagaaccgtggtgaagatacgccacaggtttggtcagacaggtacccacttaagtagtaaattgctactgaattggttaattgactaaaagcttttacaagtcatgttactttgtatacttaaacaagctaaaattaaatttctttttcatccttctggaaccaccataaggtcattatggccagaaatgtatgatctttggtgatttttatttatccagcgttataaattatccacccattaagaaagaacaaattgattcacatgaaatcgttagacaataataaggatagatcaaagccatccttcgactaaaaaaccctttataccttcaacatacctataacgaagggaagtcaatcataacaaaaagaacagaatgatccataccaaaaagaagctctatgatataatactaagaaaaagcaaacaccttaacctcaacgcaataatctaccatcaaaacaataacgggaacaaacaatagatcaaagctatatatccggcaagtcaaaattcctctgcatttctcgcatttcacacatacctattcaaaaagagctaccatcacaaacataaaaaaaagtcagagaagcctccaacaataagaagtcagaatacaaagggaaacatataactgcactgtttattaacaattgtcttgtgaattcgtgttataccgttacttaataacaattataaactataaaatataatttttctttaaatagatacaagttgtaaaccttaatatatactaacgttaaaatcgcctagaccaacgtttggacatcaatatagaatatcaggttacatcaatgtatcaaattcaatatgaaatatcaagataccataacaataatacagaaatatcaaattcaatatgaaaatctgatttttgctttactattagcagaaaattcatgatctggacataagtagttagtagattagcctaagttagtaaaaattaagttacaaacctaaaaaacaaatttgtcacaaaactagaatttttttattttttggaatacgggttaaatctttaatttattatttttagcaccacttatcaaatcagtctgattagaaaagattatataaaatcaaaaaatattttgtggtatagtgctacttaataataattgtaaactataaaaataattgatgacaattatataaattttttaaaaatcgtaaaatcaacgcaattggcgggaaatttttctacaaaaattttctactaaattacggaaaaaccgtaaaatcattctcaatcgtctactaatatttattgtctaaccattttctttcttgtgttataattttgaaatgtgataaaataaagagaatttataataaatgattatagatttgaaaagaatgtacaaactaaccttgagtcacagtagcttgtcggaaacatattggagaacacatgtaattacataaatatcctttgtaacatgttttttttccgaaatacatgcgataacataatatctctttttatcttgttattttctcttattacatagtatttataaaaagcacatggtattttatggaaaaaacattctattcagtttaatatctctttttatcatgatattttgtagtaatacacattttttattaagatcacacgtgatttctttaaaaatatattcttattttttagtaatacacggttttattaaaatcacatataaattttttttaaggattatgttcatgtaagaaaatttcataataatgttttttcttaaaaattcatgacgtttttttaaatagcatgttttaaaactaaatataacatgtgaaattttaatgttacatgttattttgaaaaattacacgaatgtgtttcgtttacagttcatcttacaacaaatgaaaggtagctttgttatttcatttcttccgacaacatgggtccatggttattttgtaacaaaaaactttctctctactagtttcttaatttgtatgttttatttggttatctaatattaccctaaaataaacttagcaaatagaaaatgaattttatcaaattgcctacaccaatgtttggatatcaatgtataatatcaggttacatcaatatatatcataccaagataccataacaataatacaaaaatatcaaattcaaaactattagcagaaagttcatgatctggacataagtagttagtagattagcctaaaatagtaaaaactaagttgcaaacctaaaaaacaaatttctcccaaaactagaatttcttaattttttggtctgagaaattaaaagagaaagacgtttaggagggcaaaatcgtcaattcaaaaatacctcattttacctgtagctggtgagatctcattttataaaggagaaggaacattcactctcacgcgcttcaactttctccagaaacaagaaaatatcacagcaaaaattttctcgagaaaatccgaagaagacaaaaaaaatg

SEQ ID NO: 28423 - DNA, 3000 bp, Unknown; identical to SEQ ID NO: 28422
  misc_feature (1)..( 3000): 2750-1469P.txt file - cDNA_ID_2996713; gDNA_ID_2926266; Annot_ID_204932

SEQ ID NO: 28424 - DNA, 3000 bp, Unknown
  misc_feature (1)..( 3000): 2750-1469P.txt file - cDNA_ID_2996723; gDNA_ID_2926267; Annot_ID_143329
tgtctgtatttgggttgaagttaccaacacctgtcccaactacgtagaactcgtagccatggagatgcattgggtgattctcagtggtcacgatgctcgtgtcttgcaatataatctgcacttgcgaattgaactttagtttgtaggcctttgttccgcgagtaggctgccatagccctctgctcacgtttcctgtatagtcaaatgtgacaggaggcgttggagggaagtctgtggtgaaaacacctgtgggagtgccttggtaataggcttgcattatggagttttgtttggggaagacgaaagagacattgttgatgcttgcggtgaagcgtgttccgttagggccttgacacctttgtgtgttgggggttgggcagttgaatagtcccaatcccactgtgaaaaacaagttctcatcaatctccaggggcacttttactttcgaaggactcttcatctgcgctgtgaaggctgctgctgttgctgtgtcgttgaatcctggtagttgtgcgggtattgcccgtgcctgtgatttagcttgaagagtaacacaggaggcgtctttgtacttgaggattgcggtggttgtggtgttgtcaaaggcagcattggcactgttgtaggcatgtgctgccatgtagtagtgtgctggcggttggtctgcagttagaagcacatcagttgtctgaccaggacctaacattatgacattggtcgagaatggtttggtgtaggaggcatccgccgcaaccactgtgagtttgtgattcgcgacaccaaagaagagttcttggttcaaagcagagttgatgaccctgaggaggactatctctcctgaccccactagaaatcttaaagtttctgcaacatgacaagcacataatattaaccaactaagatgtagctgcttgtggcgcatgggaaacataaactaaatctgtaccttggctggagcatctgtagagatcaccaggctgaccattgatggtaaaggcgtctgagatgtttggtgctgctccagtgaactgggctaagttgaggacatccatgggatttctgtcccaccactctcctaagaggagggtaatctctctcttgggaataactggaaaagggtaatgaggagaagagagcggagggcggataatgagagcaccatacacggtggctcgcagccatctactgtgggcatgccaccacaatgtaccttcttggtcttccatggtaaacctgtaggtgtaactccctcctggttggattgggcactgggttatgtattctggtccatccgcccatggattcctcatctgccgtatcccatgcctgcacatggtctgattagcagactatctagcgataaaacattgattgatttgatgcaaggaaagagtgagtttaccagtgaaggctgatgttgtaccgagctttgtttatggctgtaatgacaagggaatcgccgttcctcacctccaaggttggccctggaaactgtccattcaccgtgatcgagttatggactctgcacagcctcttcaccggcgtttcttggatctaaccaaacacaaaaagaataaactaagttgagcatcttttgtaagtaacaaggaagaaaacaaaaaagatttcgaagtagtaaacacacaacaaactcatgaaagtgaacttctgcattgacaagtgaagctacaaaaatagccaacaacagaaagaagggtcgaagttgctccattgcgctcacttactcgaagagaaagagaaagttgatactttttataggcaggagacagagagcttatagtctaaccagcacacaccatttggtgtaacaactaaacaacaaaacaaacagtttctactttctagttttaaatatgattcttgttccagaagatgtaggtgaacccctaccagcctactttagtaccttttctttgattttttctcatcctcggacaccaaatctctaaaagcttttggatcctctccttaaaccagaatctttactatttcccaattaagattactgcatcagaaatcttaataaactatcccaaaatctataaaccgaatctattgctgcgtgcgtcatcaatcatcatcaacttgtccccaagttgagtttgattttctcagtcatcaatgtgttttaaaaaacgaagaataagaatgaaaacagctaccttttttagacatgagacatctgctgcctcagcttctccagaaatttcagtgactttgagtgcttcaaagacattactgaaagtgataaaaattctctaaaacctcgagaactgtttactcttctctcatatgacgaaagaagtgtctccgtatcataatcatgcgttttgctcttctccaatagaaaacagagctttaagcttctcgccattggaaactccatgagactactacattctcatttccgaagaatacagaagagcataaggtgaagatagaatcgatagtttcccaaatggctcggacccggtaaccccaatttcgagtccctgagttcatcggaaatcttattacagtagttgactcgatacggtcgtggaagaaagaaccaagtagacctatagtcaggtcgtttggatgcagagatatctctaccacatttaagtataagaataatttgcatattgggctgggctgggctgctacgggtcgggtcaaaacccagctaaacactttaacgtgacccgaaagatattactctttccatctcatcttccccaattagttattgacgagacttgacgctactacattcaatatctggagccaacaccgccgtgacttagccactccgcttatttattgcagttcacgaccaccgtatcctcgtaatctccgttatctcgaaccgaatcgaaaaatccctaaattcctgtgaatttattactaaaattagctcaccttatagatttaccagagatgatgggctcagagaatgacgaagagtcccatctccactcatccaaagaagagatg

SEQ ID NO: 28425 - DNA, 3000 bp, Unknown
  misc_feature (1)..( 3000): 2750-1469P.txt file - cDNA_ID_2996723; gDNA_ID_2926267; Annot_ID_204956
gaggtgttccgattgtgtttcttcgtggtgggtcgatgaggttaaaggaggatgtgtctgtatttgggttgaagttaccaacacctgtcccaactacgtagaactcgtagccatggagatgcattgggtgattctcagtggtcacgatgctcgtgtcttgcaatataatctgcacttgcgaattgaactttagtttgtaggcctttgttccgcgagtaggctgccatagccctctgctcacgtttcctgtatagtcaaatgtgacaggaggcgttggagggaagtctgtggtgaaaacacctgtgggagtgccttggtaataggcttgcattatggagttttgtttggggaagacgaaagagacattgttgatgcttgcggtgaagcgtgttccgttagggccttgacacctttgtgtgttgggggttgggcagttgaatagtcccaatcccactgtgaaaaacaagttctcatcaatctccaggggcacttttactttcgaaggactcttcatctgcgctgtgaaggctgctgctgttgctgtgtcgttgaatcctggtagttgtgcgggtattgcccgtgcctgtgatttagcttgaagagtaacacaggaggcgtctttgtacttgaggattgcggtggttgtggtgttgtcaaaggcagcattggcactgttgtaggcatgtgctgccatgtagtagtgtgctggcggttggtctgcagttagaagcacatcagttgtctgaccaggacctaacattatgacattggtcgagaatggtttggtgtaggaggcatccgccgcaaccactgtgagtttgtgattcgcgacaccaaagaagagttcttggttcaaagcagagttgatgaccctgaggaggactatctctcctgaccccactagaaatcttaaagtttctgcaacatgacaagcacataatattaaccaactaagatgtagctgcttgtggcgcatgggaaacataaactaaatctgtaccttggctggagcatctgtagagatcaccaggctgaccattgatggtaaaggcgtctgagatgtttggtgctgctccagtgaactgggctaagttgaggacatccatgggatttctgtcccaccactctcctaagaggagggtaatctctctcttgggaataactggaaaagggtaatgaggagaagagagcggagggcggataatgagagcaccatacacggtggctcgcagccatctactgtgggcatgccaccacaatgtaccttcttggtcttccatggtaaacctgtaggtgtaactccctcctggttggattgggcactgggttatgtattctggtccatccgcccatggattcctcatctgccgtatcccatgcctgcacatggtctgattagcagactatctagcgataaaacattgattgatttgatgcaaggaaagagtgagtttaccagtgaaggctgatgttgtaccgagctttgtttatggctgtaatgacaagggaatcgccgttcctcacctccaaggttggccctggaaactgtccattcaccgtgatcgagttatggactctgcacagcctcttcaccggcgtttcttggatctaaccaaacacaaaaagaataaactaagttgagcatcttttgtaagtaacaaggaagaaaacaaaaaagatttcgaagtagtaaacacacaacaaactcatgaaagtgaacttctgcattgacaagtgaagctacaaaaatagccaacaacagaaagaagggtcgaagttgctccattgcgctcacttactcgaagagaaagagaaagttgatactttttataggcaggagacagagagcttatagtctaaccagcacacaccatttggtgtaacaactaaacaacaaaacaaacagtttctactttctagttttaaatatgattcttgttccagaagatgtaggtgaacccctaccagcctactttagtaccttttctttgattttttctcatcctcggacaccaaatctctaaaagcttttggatcctctccttaaaccagaatctttactatttcccaattaagattactgcatcagaaatcttaataaactatcccaaaatctataaaccgaatctattgctgcgtgcgtcatcaatcatcatcaacttgtccccaagttgagtttgattttctcagtcatcaatgtgttttaaaaaacgaagaataagaatgaaaacagctaccttttttagacatgagacatctgctgcctcagcttctccagaaatttcagtgactttgagtgcttcaaagacattactgaaagtgataaaaattctctaaaacctcgagaactgtttactcttctctcatatgacgaaagaagtgtctccgtatcataatcatgcgttttgctcttctccaatagaaaacagagctttaagcttctcgccattggaaactccatgagactactacattctcatttccgaagaatacagaagagcataaggtgaagatagaatcgatagtttcccaaatggctcggacccggtaaccccaatttcgagtccctgagttcatcggaaatcttattacagtagttgactcgatacggtcgtggaagaaagaaccaagtagacctatagtcaggtcgtttggatgcagagatatctctaccacatttaagtataagaataatttgcatattgggctgggctgggctgctacgggtcgggtcaaaacccagctaaacactttaacgtgacccgaaagatattactctttccatctcatcttccccaattagttattgacgagacttgacgctactacattcaatatctggagccaacaccgccgtgacttagccactccgcttatttattgcagttcacgaccaccgtatcctcgtaatctccgttatctcgaaccgaatcgaaaaatccctaaattcctgtgaatttattactaaaattagctcaccttatagatttaccagagatg

SEQ ID NO: 28426 - DNA, 3000 bp, Unknown
  misc_feature (1)..( 3000): 2750-1469P.txt file - cDNA_ID_2996742; gDNA_ID_2926267; Annot_ID_143339
ctcttaccagttaataaacctttaatatacgtttgcagaacacttggaagatgaatcaaaccaacattcactcgatgtaaggaatatccaaaacgatcataatatttttcaagtatcattttctcgcctgaaattttaatattaactctcaccgttatgtctagaccgaaactggtccaatatttattttactatatatatatattattcttattgtatcacaggaaataatagagcggatagaagagcgtgaaagaggaaacacaagtgtaggtgaaggattaacagagggacaaatttctcaattacctaccatcaagtttaaaccttctctagaagataaaatgtaagtacatgactatctttatatatctcccttccttacataaatgtttttctgattttacaattacaaagtatagacttcacccatattaaatctaaaattaattgaaagaaagaaaaaaagtgtacatgacgtagaaaatagatagaaccagtgaataacatatacaattaaatttatatatgctgctaaattttttttttttttttttgtgcgaaatgctgctaaaatttaataacaataaaaatggggaaaacaggtgtatgatatgccattcagattatgttcgcggagataaattaacaattttaccctgtactcacaaataccacaaagattgcattagtcattggctccaaaacagtaaggttagtatcgtcttcttgcgattttcttcttctattactgacatgatcaacatatgctaaatagattattattatttttggacgaaaacatgttggtttttcaagttcttacatttattctagaaaaggaaagcaaataaattcgatatgaagacgtatgattgaacaatatattgtttggtaaaatatcagttgtcttagtactacccaaagctataccatatcaatatatcatcagtaatttcgtgaaatgttattctttagatgctatataaattttagtgatactaacgctatccccttttatcccccttactatttttcagctttgctgcgtttgccaaagagaagtgattgtataacattagctttgatcaacagaagaatcagcaaaatattgaaattaagttactcgattttattgaaacattcaaacgtttttcaaatttaatcaaacgaatatgtaaaaaaggaaagaaagctaaaataatgaaaaaaatagttatcgtttggtattttatctggattattcaaacgacggcgggatctgttaacaaaaatagtatcctaagattagttttcatatcaatttgttaaatttagtatatatattgatgatatttgtggatgagaatccgcttcagcttgagccttgaggggtgcatgcaactcccaagaagagtagtgacttgcttacaatgatgttggtttttccagtgtcgatttgtccccatcttgcttgttaactggttagcttctagtaagaagaatatgagtttgtcagattgatgacatacatgaaaacacacacatggttggtattgctagctactctgttctatttcaaagacttctgaaggagttttaactttaaaaatcagatattaaaaaccaaaaatgtgagactaatcgtattaagtatgatgaatggagagaattaaacaattatctgagaacttgagttgaaaacaagagaggagtcatggcaatatggcatattaaaggcaaagaagccattgtcattgaaatgaacatttctctggctttgtgattcaaaagaatcaaaaccactgttgtcttaaacaaaacaaaaaaaaacattgcccttgaattatgtatagccagagtgggttaggtagaggtgtccagacctcagaggcccagacccatatgatccaactaaaaagttctctccaaaagaaaatttcccatgaaaaataaatattgggccggacctgtattgaaatgtttgttggatgtcttgtccgtaagctgttgttctgagtctgacactgaaactcatgcggtcaccagaaagtgacacttgttatgaatttgcctagtggctagtggtttagatactgaaatttgccattttgtcgctacatagtctgttttcacaaaataagaggaagatacagagagttccatcgtacttggtacattctgtttcattagcaataagatttgccaactgaaccaattctcacgacaccaaattctagtaaacacgaaatttgtactttggttgtgtgtgaaatcagtaagtgggccaaaaaaacttgtcagaattttcatgattctgttaacctgagaaatctataacaattaaagtaagagaaccaatgaattacaaaactaaatctaacaaaacttccccaaaaacataagtagttgagtaaacgccaaatttactatatttttttgaatctatacgcaaaatatgaccatgatacattgtctagtagtagtgtaagaaaaaccattataatcacccagattacttactatcagttgtttgagcataactattttggaatttctcagaaagaaataatcagtaacaacaataggtttgatttttccccattgacattgacacagatggattatctgtatctagaatagagacaaccaaactgataaagaacaaagaaaaaaatacaaagaaaatgtgggaatcatataataaaatatatatgtgtgattactgatgatgagacataacaacaataccattagctgtcactctttttatttatttatttcataatattaaaatttagagttgcagaaaaaataacaatttacttccctttgttcagacgtttctttattcttcttccttccttcttctccttcttcttgatcgtgttcagaaatcatattcatcacctctctctctctatgtctctatatttggattctttataacatgtgagatcgatctatttttgatcagagacagagagaagactagaagaagcaaagaatatttcaagaatg

SEQ ID NO: 28427 - DNA, 3000 bp, Unknown; identical to SEQ ID NO: 28426
  misc_feature (1)..( 3000): 2750-1469P.txt file - cDNA_ID_2996742; gDNA_ID_2926267; Annot_ID_204968

SEQ ID NO: 28428 - DNA, 3003 bp, Unknown
  misc_feature (1)..( 3003): 2750-1469P.txt file - cDNA_ID_2996746; gDNA_ID_2926267; Annot_ID_143340
tattgccatgactcctctcttgttttcaactcaagttctcagataattgtttaattctctccattcatcatacttaatacgattagtctcacatttttggtttttaatatctgatttttaaagttaaaactccttcagaagtctttgaaatagaacagagtagctagcaataccaaccatgtgtgtgttttcatgtatgtcatcaatctgacaaactcatattcttcttactagaagctaaccagttaacaagcaagatggggacaaatcgacactggaaaaaccaacatcattgtaagcaagtcactactcttcttgggagttgcatgcacccctcaaggctcaagctgaagcggattctcatccacaaatatcatcaatatatatactaaatttaacaaattgatatgaaaactaatcttaggatactatttttgttaacagatcccgccgtcgtttgaataatccagataaaataccaaacgataactatttttttcattattttagctttctttccttttttacatattcgtttgattaaatttgaaaaacgtttgaatgtttcaataaaatcgagtaacttaatttcaatattttgctgattcttctgttgatcaaagctaatgttatacaatcacttctctttggcaaacgcagcaaagctgaaaaatagtaagggggataaaaggggatagcgttagtatcactaaaatttatatagcatctaaagaataacatttcacgaaattactgatgatatattgatatggtatagctttgggtagtactaagacaactgatattttaccaaacaatatattgttcaatcatacgtcttcatatcgaatttatttgctttccttttctagaataaatgtaagaacttgaaaaaccaacatgttttcgtccaaaaataataataatctatttagcatatgttgatcatgtcagtaatagaagaagaaaatcgcaagaagacgatactaaccttactgttttggagccaatgactaatgcaatctttgtggtatttgtgagtacagggtaaaattgttaatttatctccgcgaacataatctgaatggcatatcatacacctgttttccccatttttattgttattaaattttagcagcatttcgcacaaaaaaaaaaaaaaaaaatttagcagcatatataaatttaattgtatatgttattcactggttctatctattttctacgtcatgtacactttttttctttctttcaattaattttagatttaatatgggtgaagtctatactttgtaattgtaaaatcagaaaaacatttatgtaaggaagggagatatataaagatagtcatgtacttacattttatcttctagagaaggtttaaacttgatggtaggtaattgagaaatttgtccctctgttaatccttcacctacacttgtgtttcctctttcacgctcttctatccgctctattatttcctgtgatacaataagaataatatatatatatagtaaaataaatattggaccagtttcggtctagacataacggtgagagttaatattaaaatttcaggcgagaaaatgatacttgaaaaatattatgatcgttttggatattccttacatcgagtgaatgttggtttgattcatcttccaagtgttctgcaaacgtatattaaaggtttattaactggtaagagattaaccgggttttggttcagcatataccatgattgactaactgatcaaatagtctttacttattatataaagacgatactattggtcatgctacaaaatcaagtcataccatatcctgagaatgaatgtggagaatcgttataaggcataagtgtgggtattgatcgtggtacgaacaaccgccttggcatcaacattagccacgatatccaacatttgaagcattgcctatggcgagtgtttggttggttttgaaactgatgatgataaccagaacgagaaatgtcttgtgaagtataatgttccgatgaattgggattataataatgtgtagacattgtaggttggttttgatgatgataagtaatcattggagaattgtctaacacatgcactggagaattattgactctaccacgttctctttgatattcctcgattttcctcgtgatttcatcagcctctccgaaaaagtaattgtatccactagaactttgggaatctcccatctaatttatgtattagagaagttataatattttggggaaatagattttctctactgattttgttgtgtgacattatatttttataagtacatgtttctgtttcgttatattgttgtcgtggttgagtctttattagagcatgtaaatatgtttatgaaataagcgagaaaggaattaattaaacgtatcgagtgataaatgctttaatggattcgagatttagtattcttaaatttttgtttcattatcattgattataaaactaagttatgttgatctcaaatccttaattatgttctcctaagaagagtacaagtggtgggaacgaaagatgagtaaaatactaaaaatcttttctcaaaagtcaaatcgcattagttaacaaaaacaaaccatgtgttaccgtcaaatcaatgtgtttaaaagatgttaaccactaatcaagcatttacgtgtaaccggatcaaccggatttgggttttgaatatgttgtggagatgtatataaatgataaattaattgaatatcttaattaatctgtgaaagaaactacatcacacactttgttatttcccctagcttttagttttttttatcatgcaaaacttatgaagtaactagatcaagatcataaaaaaaaagcatcacttcacttcatgacctaattattctcgaagcccaaaactatttacttacacttctattctataaatatagatgatggaattcaccaatccaaaagtgaataaaaaacagaagtacaaacaatatagtatctaattagaatg

SEQ ID NO: 28429 - DNA, 3003 bp, Unknown; identical to SEQ ID NO: 28428
  misc_feature (1)..( 3003): 2750-1469P.txt file - cDNA_ID_2996746; gDNA_ID_2926267; Annot_ID_204970

SEQ ID NO: 28430 - DNA, 3003 bp, Unknown
  misc_feature (1)..( 3003): 2750-1469P.txt file - cDNA_ID_2996750; gDNA_ID_2926267; Annot_ID_143341
aatgcaatctttgtggtatttgtgagtacagggtaaaattgttaatttatctccgcgaacataatctgaatggcatatcatacacctgttttccccatttttattgttattaaattttagcagcatttcgcacaaaaaaaaaaaaaaaaaatttagcagcatatataaatttaattgtatatgttattcactggttctatctattttctacgtcatgtacactttttttctttctttcaattaattttagatttaatatgggtgaagtctatactttgtaattgtaaaatcagaaaaacatttatgtaaggaagggagatatataaagatagtcatgtacttacattttatcttctagagaaggtttaaacttgatggtaggtaattgagaaatttgtccctctgttaatccttcacctacacttgtgtttcctctttcacgctcttctatccgctctattatttcctgtgatacaataagaataatatatatatatagtaaaataaatattggaccagtttcggtctagacataacggtgagagttaatattaaaatttcaggcgagaaaatgatacttgaaaaatattatgatcgttttggatattccttacatcgagtgaatgttggtttgattcatcttccaagtgttctgcaaacgtatattaaaggtttattaactggtaagagattaaccgggttttggttcagcatataccatgattgactaactgatcaaatagtctttacttattatataaagacgatactattggtcatgctacaaaatcaagtcataccatatcctgagaatgaatgtggagaatcgttataaggcataagtgtgggtattgatcgtggtacgaacaaccgccttggcatcaacattagccacgatatccaacatttgaagcattgcctatggcgagtgtttggttggttttgaaactgatgatgataaccagaacgagaaatgtcttgtgaagtataatgttccgatgaattgggattataataatgtgtagacattgtaggttggttttgatgatgataagtaatcattggagaattgtctaacacatgcactggagaattattgactctaccacgttctctttgatattcctcgattttcctcgtgatttcatcagcctctccgaaaaagtaattgtatccactagaactttgggaatctcccatctaatttatgtattagagaagttataatattttggggaaatagattttctctactgattttgttgtgtgacattatatttttataagtacatgtttctgtttcgttatattgttgtcgtggttgagtctttattagagcatgtaaatatgtttatgaaataagcgagaaaggaattaattaaacgtatcgagtgataaatgctttaatggattcgagatttagtattcttaaatttttgtttcattatcattgattataaaactaagttatgttgatctcaaatccttaattatgttctcctaagaagagtacaagtggtgggaacgaaagatgagtaaaatactaaaaatcttttctcaaaagtcaaatcgcattagttaacaaaaacaaaccatgtgttaccgtcaaatcaatgtgtttaaaagatgttaaccactaatcaagcatttacgtgtaaccggatcaaccggatttgggttttgaatatgttgtggagatgtatataaatgataaattaattgaatatcttaattaatctgtgaaagaaactacatcacacactttgttatttcccctagcttttagttttttttatcatgcaaaacttatgaagtaactagatcaagatcataaaaaaaaagcatcacttcacttcatgacctaattattctcgaagcccaaaactatttacttacacttctattctataaatatagatgatggaattcaccaatccaaaagtgaataaaaaacagaagtacaaacaatatagtatctaattagaatggtatctctaaagtcccttgctgctattctcgttgccatgtttcttgccaccggacctacggttctagcccagcagtgcagagacgaactgagcaatgtgcaggtgtgcgcgccgctgcttctgcccggtgcggtcaatcctgccgcgaactcaaattgctgcgctgccctccaagcaactaacaaagattgtctatgtaacgctcttcgagcagccaccacacttacctctctttgtaacctcccctcttttgattgtggtaagatgatccatcgattaaaaccttttttactagatttttataaattattccatcaatagtgtttgttttatatttgttctcatgattttttggacttatgttttgtgaactgtgcaggcataagtgcctagttgaacaacattcagttccgaggatttggggagtttggtctgcaaacgacaagacgaataaaataaaataatgagaaatacactatttagtgttttgttttgaatttggtttgttcaatacttatgacagatctattgaatatcgttttcaccattattacggaatattttctataattggcatcattgtagtcttgcttttacaataggcgtgttaggttaacatatgcaacttcaggcaaaactcaattcaaattttaaaccaggtttcaaaagtaaaaactaccagagagattcacattgacaaaatcaaatgatgtaaaaaggaatcgttggtttgaagtttgaaccaaaccagagatttggtttggagtagaccggaaccactgacctattgactaaaagagtcaaaggatgcaatcttgtgacgcgtgtaatcaacgcgcatgacctatggtccgtattaaaaaggttactctatatgtatcacactttagcttctccattcccaattgtctcttcttttctttttgtacttgtcaaaaacaaaaagaacaacaaaaaaaatctcaaccgtagaaaattccgacaagagttcagttcatacaatgaactaagtatg

SEQ ID NO: 28431 - DNA, 3003 bp, Unknown; identical to SEQ ID NO: 28430
  misc_feature (1)..( 3003): 2750-1469P.txt file - cDNA_ID_2996750; gDNA_ID_2926267; Annot_ID_204971

SEQ ID NO: 28432 - DNA, 3003 bp, Unknown
  misc_feature (1)..( 3003): 2750-1469P.txt file - cDNA_ID_2996754; gDNA_ID_2926267; Annot_ID_143343
caaaattatcaacgtgaggcagaatcccaattgccaagtttatcaagatgacaaacaaaagcgtcaggagtgcagcaatctggtacatatgctcagatcagaaacatgagccaacatgatggagtgatttgtatgtttgaaatgaaaagcagattggtattaaccttgttagagtagattgtccagttggtgaaaagttcagagagcattgagccaaggaggccaaaaagagcaccagaagctccaacagagatactgtttctgataaacaacgacgacaatacactccctccaattcctgataataggtatataactccgattctaactgaaaatttcaagaaaccaagattcagatttctagcaacagaataacacaactagaagaatgaagactaaatccacccaaattgcataccaaaaccaaattgctgctcgagacgaataccaatgaaaacaaggcttaacatattggctccgagatgaataacacccgcgtgtaaccatatacatgtcaagagacgccaaccttccttcttctccacaactttgctccactcaagtgctcctaacttctccaatcttcaagtatatatcaaccaaaacacaatcatatcaaaatcttgtatctcaaactctcaatcacataacttcatcatttcaacatctcaagatccagtaaatttcgatttagtaaccgacaaacttgagaaacagaaccaaaacgtgattctctagtatttagaaccctaaatcaacatcgatacaaaatttagaaaacgtacgtgtgagaagatggaccaaagagaggattagttcggagaggctcaaaggagagtctaccgagaaacttggcgacacagtgacctctgagacggtgagactcgaaatgattcggacagttattaacgaacatcgccacgacgaaaaccgcaacgttagccacaacgaacatcggaacaagccacgacgtccaccgcgacgacaacgcgttatcgccaaattcagtagacgacgacaaggctaccggcagaggcggtggtccgattcgattccgatcaccgcctctgcttccgattcctcgatctttcgccgacattctgttctccagatcatcatctccgacagccatagtgatctctctcttctctgtctgtaatttgtttattgttttttttgttttggttggtttttttttttttttggattgaaggcggtaagaagagttaaaccttgagagtgggtgagaaagtgggtttctgttaaccaattaaatctttccacgtgtaaatgtataataccggtttttgtggtacgtgttacggtgtaccgtggtctattgcacactgtatcgtaacggagctaacgtgcgctggatttccaaatttgctttaagagcatctccatcggcaaaagtggtagagagtatctcaaaaaataaataattaatattttaattaaattaatatattttaattagtttaaagtaaatgaaccattaattgaatgacaattctgaataaatgctcagaatcttctttcttgccagaaacatttctccacttttctctcttctttcatattttttctctttttaattattatttaattgatgagtatctcaatcagatactccgatagtataaagctgtgatgtatgatactttgctcttgtttcctttgtctttgggggttcttaagaaagtttcgttggctcgtgtaaatgtctaaacttctggacttgataccctatcaattaataatatcggaaaaacaacatatatttgttatgttgaggactctctaacgtttaaattaatatgaacaacattattaaatgaataatcgggttccgaaaatatagtaatgagtaaagttttaggtcttagtcgaaaatcgttgaagacctaatatgatatttggtggaatgatatcaaagagatttttttccggaagagatgattataatgttttattcgaatgtgtggaccattaggaatattagtttagagatatagaatgttatttgtgggagatgggtaaaatccctcttagaaaaaggatcataataaccatgccggtaatatgtgtcttattgatcgtggaataaatgtatggaattgcatggtggatcaagatgtggtcaccgcgtaccaagcgcatcttgatatttgttttaaaagattttcgtcgcttcttcttaaggtatatattgaacgttaaagttaaacttaggatgctagtcgagatgaccataatgaaatctctagacttatttaatccagttgaaaactcatcacataatagttgtcgtatgacattttcgaaacattgttcctttgggtttagtgttgatgtagcagctagaggtgtgccattactctttgaatgcctacggaacactcatacgatgttatatggtctgtggtcacacagagtagatggaaactatcttatgtgtgatgtgccgtcttaatctattaaagggcctttggtaaaaccaaaataaattaacctttttactaaaaaactttttttttctaaaatttgggatcattttctttactaatatttttttagaatgactttgcacccttggcaaatatctatgttgtctaaaggtagagacggataaatggacacgaggaccggaaaagatggcttaatctttcggaagtttagagctacatctttaactttgttttggtttcatgtcaacgtatcatacatagataggttgtaaaaaagcgttacgagaataagtattttctgaataaccgtaacgcctttttatatatctttaagaataaaaaagtcattaactacaaaataagaaggaaatttattggcagagaatccactttgaattacaataaataatgatgaacatttgtctcattttagtcaaaaaaatatgaatctcgtgagcctttcatttattaacctacacataatagtttttcttgtttatatatatatatggttaatggttttcagagaatg

SEQ ID NO: 28433 - DNA, 3003 bp, Unknown
  misc_feature (1)..( 3003): 2750-1469P.txt file - cDNA_ID_2996758; gDNA_ID_2926267; Annot_ID_143344
cataactagcagaagttttttctctacagattcatcgtttgaggagttctgtgagtttatcaaggtaggtatggtttcttaaatcttcgactaaagtttcaattcttttcaatttaggttttctgttaaacaaacgaggttttattttttaaacaacatatcacaaattcacaatagttgtttaacttttttgttttttgtttttttctatgactataacacatgaaaaggtcagatatgtatcatcatcttcaaacgaggatttttctccaccaacaaaatgatttgctgagagcagaaaacagagctaggattcatgctatgacctctccatcaatctgcagatcttgtgaggagcccatcatttcaaccgaagagagggagctatggttggagaatgctcgtcttcggtccgagattgatacattgacttgtttcatatggagattaaattcgttcaggaacctatatcccgcatttgctacgtctttgactgaagtgggttacggagtggcggttatgacgtcactttcgctgaaagaagttgtttttcttgcgaggcaaagaactccgatgtggacaagtaacgggagattgaatctcgacgaatactactctaaattatttccttggtacgcaagaaacgcacccgggtttgtacatgaggtatcaagagcttctgcttttgtcccatgtgatgcttcatcgctcgtggcaaatcttatgaatcatgtaagtgtgtgacaaactacatgaaatcataataatatacacatttatccttttttcttatattgtttatctattcaggtaagttggcaaaaaatctttccgtcaatcatcgcggatgtgtctgtggaatcacaacaacggggattgcaaaaggtaccaaacatttatttattttccgtacaaaaattagaactagtgataattttatatctttataattgtagattaatgtgaattttatgccacaaatctctcctctcattcaaactcggaatgtgaaacttcttcgacgctcgaggcatatagaggatgatacatgggctattgcagaaatttctatgtatttcagctcatatgcgcaacatttacgtcctgaatatatgagatttccttctggatatcttatccaacatatagccaatggtatctctaaggtatatttcaatttcaatagagtttaaatatatataatggtagctttgttctgattttgttattatttgtaggtaaccattctcgaccattgggtttacaaggaagaagaaggcatgaacactttcaattcaaactctgaatttggtgcacagagatggctcactgctctccaaaagcattactacaacacctgccccgtttctattccttcaattggtcacaatattcaaagtagtgaaaattctgttttttaaagtttttattgttctattcatcaattttagtttgattttacactaaccatgttttttaacgtttgtacttgtttagtattcgaccagatctgtcgcaagaacttgcttaacctatcttcatttatggttaacgtattttgttcgggagtttgcgggataactggacaaaggtggaatcggttgaatacagttggagtttcggctaataacattagaatgttcacgcaagaaagtcgaggcatgagtgggatcccttgcgttttggttagcgctaccggtttagctagaatgcacactaaaccagaagtaatgtttggattaatcaacggtgcagaaaaacaagaaatatggagttatttagagtctgctaaagatatgaaagaactaattcgtatcggaagacatcctaattcatggaatgaagtctctgttttcagcattgaggtacgtaaaaaaattcatttggtttagtaataccaatcgattattgagcatttgatttatgaatagagaacaattaaatatattgcagtggaagggttcgaaggagtggtatctgattcaagaaacatactacgatgaatcaggagcaatgataatccacacttgcgtagaagcgccatattttgcagctgcaataaacggtggggatttgtctggcgtcgaactgttacccagtggattcaccataataccatgcgaatcacaagaatgtttcgtgacagctagttgttatgttaaggctgaccaaactatggtcacgagtccaaatgagctggggagttatatggagaacatggtcactaacattctaggaaatgtccaaaatgctcttccagtccaccgttgaagttttatggcttatgaagtttttaccgttcttgttgtcgtcgtcgtcgttattgctattgctgcatgttgttgttgttgttgttgttgtcgttgtcgttgtatgagagtttgaatttggaactttatttctatgaactttattatacacctatcattaagaaataacaaataaatggtgattatggttttatctaagtttttgaaatatttcatatgttggtaatggatttgggatagtaaaccaactaaccataataaattagatcatataacagttttttatatggtgattaagaagaacaagcaaccttatgttttaatcaaaaataaaaatatgaatcaagcaagcaaactcgaagatgaactacaaagacgccacgtggacgagtggggcaagtgaaagtggaagccgacgaatcaaaatggcaaagacgaattagatgtaggggcaaaataggaaaatcaggtttatgtttcgcctgcatcttcctctggtctttctttttgtctcagacggacaaaaccagagagagagagagagaaagagaaaagagagttcgcgtgctgtttgagtatcatatctaatcccagattctttcttccttctctgtatatttccacgacggttgacctaattttcgtcaccatccaattggatttgagaagagagaaaagtattctcatcatctgaagaagaagaaagatagattgatagatagagagagaaatg

SEQ ID NO: 28434 - DNA, 3000 bp, Unknown
  misc_feature (1)..( 3000): 2750-1469P.txt file - cDNA_ID_2996766; gDNA_ID_2926268; Annot_ID_143349
gcatttctatgattctatatatataagatgcctaggtcaactggtcaagtagtatttgatgcaatggcgtagagtgggaacatgcggtggatcgcaatacccgttgattcagcgacctcggtctgatcttctgtagattcgactgataatctccaatcaaaccgatgcactaagttagccaaaacaacctcattcaacaccacagcgaatgatattgctggacaaatccttcttcctgatccgaatggaatcagttcaaaagcctgaccccggtaatcaacagacgaatctaaatgcctctctggtctaaactcctccacgtctggtccccacgtcgcagcctctctcccgattgcccatgcattgatcaatacctgtgtaccggctggtatgtggtgatctcctaatctgacatcttgtgttgattcgtgaggaaccatcaatggaagtggaggatggagcctgagtgcctctttgattacagcttttaagtagctcatgttttgaatttcttcttctgacacacttgatttatccttgcaaatcgtgcggacttcttcttggagtcttttcagacactttggatgacgtagaagctctgtcattgcccattccataagtgtagacgatgtatccgtaccacccacaaaaacattctgaaaagttaaaaccaaaacaagaactactgttatatacttactaacacatcatgttgtaaaaaaaaaaaaacattacacaataaaacatcataaatctgaattggtatcattcaaaagtgtgtttcctcaccatgacaattgcctttatgctaacacggttgatttcaaacccgacggtcttatctctttgaatagcgagcaatacatccacaaaatcagtcatatctctgtttccatcgacatgatcttgcacaactctctcaaagaacttatcaacatcgtttgccgtcttttctagttgacagtctaaaccgcggatccaatcaatccacgcaagccaaggtacataactccccacactaaacgtccccaatagtttatttagtctctccattaactccttaaaatccgtttcaccaccgtatttccgtcccaaagcaactttacatatcacatcgttagttaaactcaccaagatcttgcttagatttaccggcaaagaaatcgatttcctgatcttttccatcatcagactgatctcttcttctctcacttctcgaaaggatcgtaccattttgttgctgaatagatggaggacgcacacacttttcatttgcctccagtactctccataaggagctgaggccacatcatgcttatcgtaaagaagtttctcgaagatttttgaccgtggccggcttgcgaaaacacggtcatgcgtcttcaaaacgtctctagccaattcagctgaagatactacaagaacggggacacggccaaagtgaagaagcataagaggaccgtaccggtggctgagagagcatagtgatcggtgagggtggcggccgagttgatgaaggtttccgatcaacggtagtcccggtggtgacggaagtgtgtttcttttcttccctctcttctgttttctgaaaattatgatggtaactacaaagattattgagcataacagaaagaacatgatcatcatgtctggattcttcaagtacatcaaaacgtgttcttgtgaagagtttttatttgtggtttttttggacttacatatacaagccaagtttcttcacggtagtactagtacgtaattactgtccactcaatcttttggacttatgtatttatgcatgcaccagtcttttaatgtttagttcttcgagatttttccttgtgaaagtcatttggtgcgtttacgatttatgtcttattttggtcgtgtcaccgttctagtctttcggtgcttccacgatgtgtcttaccaccatacaatacaagtgcctaggataatggtctcaggctgccgtcagctctaaggatttatatactctgggcccaatgggccttacaaaaatttgatgatcattgtatataatcggtttttaaacggctgaaccgccaattcatactcatcaaaaatacaacgacaacattgttcaacaaacaattctccatgaaaatttaaatgtcctaattcgtctcaaacattctgtctccaatatgtaaaacatttatattttgagatataagtagaagtaatagattataacaaatgatcataacattagtgtagtgatttgtgtcagtacaagtttctatttaaagtgtaacaacattgaatatttatgtttcaccaaaaactatgactattattctattaatcctgagagagagagcaaaaccctttagtgaaaagtttccttaagtttaaaagaactgaagctgaagtccaaattgttgtttacacacagtaaaatcgaattcgttaccatgacaagcgggttcaatggctaaacattttgtaatttaccaaacccattattcgatttgtaggatagtcaattatagggttcttagtcagctaaaacagtgacttaagagttaagaaggggaaaaaaaaagtccgaatattttatattcacaacaccatgaagttgactgaataagcaaaataattgattagagtaacatgacaataaatgagaagaaaatcaaataaaaaaccagatccatggcgcgaaaaaagcaacgacccacacctttgccacgtggtcttgtccagtggatctgagtgtcctaaattcgaagatgagaaagagagagagtgtacaacattctacagtcgacaccattatgatcagcagctggaaaagcttaagcttggttttaatggcacaaaatctaaataatcgatttatacacaaaaagacagctaagtaatgattattattattatcagaaactgcttcaaaacttgttcttccttgactaaatttctctcttctctcaagaactcctatcatctgttttgaattgcaagtaaccaagaatg

SEQ ID NO: 28435 - DNA, 3003 bp, Unknown
  misc_feature (1)..( 3003): 2750-1469P.txt file - cDNA_ID_2996770; gDNA_ID_2926268; Annot_ID_143354
cttgtagctgtctaaaatctagcaaaataggtattaaaaaaagtaaaagatttcttttttgtttggtcaacttacttgtattgtggagagattttttacctttactatataggatttgagagaatatatatttaatgcaaatttactttcctactatacttgggcaaaacagaagaaaatttgagtggaccctcgttacgtaacgcatagaagaaacttggcttatatataacgcaagtggcgaagtccacaagaagaacacaaaaaacttaagaaactcttcacgagaaaaacttgaagaacttaagaatccaagtttacaaaatatgatcatgatacttttcttatgcttaataatattgttcatcataaccattctcttcttcaaaaaacataagacagtgaacaaaatcatcaactttccatccccaccgagacttccgttgatcggaaatcttcatcagcttagccaacatcctcaccgatcactctgctatctcagccaccgttacggtccactcatgctcctccacttcggaagtgtccccgttattgtagcctctacagcagaagcagctcgagacgttttaaagacgcatgatcgcgtttttgctagccgtccacggtcaaaaatcttcgaaaagcttctttacaagagccgtaatatggcctcagctccttatggagagtattggcgacaaatgaagagtgttagtgttctccatctcctcagcaacaaaatggtacggtcctttcaagacgtgagacaagaagagatcactctgatgatggaaacgatccgtaaatcgagttctaaaccggtaaatcttagcaagatcttgtcgagtttaactaacgatgttatatgtagagtagctttgggacggaaatatggtgttggaacagattttaaagagttaatagacaggctcatgaggcaacttggtacgtttactatcgggagttatgtaccgtggcttgcgtggactgattgggtcagcggtttggaggctcgactggaaaagaccgctaatgattttgataagctattggagagaattgtgcaggatcatgaagatggagacggcgacaagactgattttgtggatgtattgctcgcagctcagagagacaagagtttcgggttcgatattgaccggttaagcataaaagcaatcgtcttggtaagggaaaaaatatatatcaaattcaaatccaatgttttagactattagtgtagaaccatgcattaattgtttatgtctataaccattatttgtttaagtatataaccattaattgttttggtcttgatttcacttttcaggatgcttttgtgggtggtacagacacatcctccacgcttgtggaatgggaaatgacagagcttctacgacacccaacgtgtctaaaaaaacttcaagaggaagtccgtacgatttgtaagggaaaatcaagtgtgtctgaagatgacattcaaggaatggaatacttaaaagctgtggtcaaagaggcactcaggctacatccaccagttccattgatggttcctcatcaatcaacacaagatgttaggttaagagataaccatatacctgccggtacgcaggttatagtcaatctttgggccgtcgggagagaggctgcgacgtggggaccagatgcgaatgagtttagaccggagaggcatttagagtcgccttctgatttccggggtcaggattttgagctgattccttttggagcagggagaaggatgtgtccaggaatatcatttgctgtggtgctgaatgaggtagtcttggctaacttagtgcatgggtttgattggcaatctatagacgatgagaccgatgttgctgaatcaatcggtagtgtgattcgccgcatgcaccctctttacgtcattccatcatctactacttgattaaggcttattattatgttatgtctacaataaacctgttcatttgaaaatgttgtaagctaagatatgtttgagattttaaagtttcgagttcctaattaaaccaatttagaaagcaaggtgagcttacttgattcattattctgtacaacaagcatcattttttttttagattttagattttataacgtttatatttttttatattttaactttaaaatataaataaatttgattacagaaaactgattagagagctctgatttggattagtcgtgaaagaggtgaaagtatacatcaaaatttgtttaaagtaaaaatctaatgatttgttaaaaaatttgaataacaggtgattttgttgtatttaaaacctcatggtacaaatgcttaatccaataagaattaatttatcgcatttgactttaatatacgttcaattccattagttcagtagttttgcttgactctgctatttgttactttgacgtgattgcatgactctctacctcacagcttgaattaatgtaagtggaaatattcttagtcttacttggttgcatttgttctctctctctccattgttttgttgatgaaattcttaaatctcatgattttgccggggttagggctttaccttgcacctatcaagaaattattaacgtgaaacgcctcttctttgcacatatctaaaaagagcaatccaaatagtaaaaagattagatgagaaatcctagtcctcaaagagaacttgtgcactaagacaatttgaaagattcaacgttttttttttgtcaaacgttaaataaatgaattttgagaagaatgataattatccatatgggggagagaaataagaaaatttgagtggacagtagttttggtcccaagagaaacttggcttctatacataagtccaaaagaggtacacgaaattctggcttactagaggtattttgtggttcgttcactctatttccatatgactcagatcatctaagttcaaaaagaagaccacaaattcttagaaactctttactagaaaatcttgacgaaacttgaagaatacaagcatg

SEQ ID NO: 28436 - DNA, 3003 bp, Unknown; identical to SEQ ID NO: 28435
  misc_feature (1)..( 3003): 2750-1469P.txt file - cDNA_ID_2996770; gDNA_ID_2926268; Annot_ID_204996

SEQ ID NO: 28437 - DNA, 3000 bp, Unknown
  misc_feature (1)..( 3000): 2750-1469P.txt file - cDNA_ID_2996774; gDNA_ID_2926268; Annot_ID_143356
aatttggatcacacacgtgattatgtaagactccaccatttctaagatttttgtaaagatagcttttgtatccccaagctatttgcattttcgaagcttaaactatgaactttatgattttttgattagccactacgcatccaaaacttttaattccacaccacatgaaagcatcattattaattggagtagcttttaagaacacacgtcttaaaccatgcaccgagcaattacgtacaaaaataatttactaatatcgaccatttaatgagtaatgtactgatcttaagaaaacatgtttctccatgtatcccggtaataccatgtggatctacgaaaggatctcgtggcgatttttgtacatttccataccttaatctctaattagttgttattcaaaattctcaaggcaagatgcgtgaacatttggcgcagcccatttgttgaaacgtggtttcatactacatatattaaaaacaaaagagaaaaaaaactcaggccacaagataacaacgggcaagtagtttttcaaaaacacaataaaaaacaattatggcggttttatttaagttgttaggcataacattggtgtttaacaacaaatgtaatatttaaatatgaacaccgatcgtgggttaagactttctttataaaaagctaatgtcgttttaggtagtagatatgaatgaataattggaatggatcttggcttaatacccggcgtcgtggttggataatgatgcttcctaatgcaaggaaacatattttttatttttgttatttaaataatttacgttgatctcgtaatcctaggccaattgatgaatattcataatttcatatgttcgaaagagatttcacttttctgaaaaaaaaatacatatatatgtaataatttttttaattttttttttgtatgactcccacggataattgatggagttgagaaaatattgtagcttttatgattgatgtatgagtttcgaattgataattgtctcacctctattaggagattgaataattttcattttcaacatgtaccgatcttatcttggttttaagcctatgtaattacgaattaatatacgttcatttttttataatatttttttttgtataagcttgtgtatttcataagatccccaaaatgcaacgacgtggtttgatgtttcctagtttcttggaagtgactctactattttattggttatgaatattatacgttcgaaacccaaaaattttaatttacaatgacgtgttctttttctagggatcgtggaccgatccaaacagctggcgtgtctgaactgtccttaaaagcctatccaattttaaatccaaaacgttagaagattcccaaatcttttgaaagattcaaataattgaagtctgaagaggattccaatcaaaaagtccgatagaaacatttttggctacaagagttttttcccacctctaaagtcaatacttttgtgtcattttaatatatagttatttatgaaacaatctatctatataatttaccatcttaatttttatatatcgtacagttgcaaaatcattttaaaaagttttatgttgttaacatatctcaaaattagttatattcgcaaacactgtgtgtggggtgaatgtcctggtaatcaaatcggaacaaaacaaacgtattaaaacaaactttgagaaagctgaagaatcataagtcgcaagaaacaatggtctaaggatgattcttgaaattaggtctgattaccctcgggttaatacccactcaagagatttggaacaacaagtaatctcaatggtagaagcaagaaactctacgtgtcaatcttatatctagacgatcactgcctaagcaacccaattgtgtgattgactgatttcctccattaaaattttgttgatgaatgctaatcctcatttctggctaaagaaactactcaataatcagcttgtgtcgatctatatcaagtcagttacagcagaaacaaaaatgacacaaacccgccatcggatggcaaaaccaagttcttaaagaatctaatgatactaccttgatctcatccagtgactagaaaacaaccagactttaacctacaatatctcaggatctaggtctccctaaagagcttagaagagtaagtaatttcatgtaacacacttagctttagatatcaagttatatgacactatccttggtggattaatttaccaggatcaagacacttgcatgaactagcggatcaaagccttgggattgctcttaaacatgattggttcctgagaaatctgtgcataagattcgccatactcagattaaccctaaagcgaagcctacgacggtcgtgctcgtgtgttctctcgtaatcattgaggtttttgtggagtctgaatcttcaaaacgacgttttgtgtttttacgttataaacttctaaacgactacatttcaggttccattttggtgatgagaaattaaaaaaaggtgccctcacgcaggatcgaactacggaccttcagtttacaagactgacgctctaccactgagctataagggcaactttgctcagttatctgtgatgtgcaaaaaaattcaaaacctcaaagaacagacattttgggccatatatacaaaaggtaaaaaatatgggataaatgctaaaataagatagagaaatgttgcaaacaaaaagaccataaagtagcaaaaacaaacattttgggccaaactgataaagaaaaatagtttggggatacaaataagaaatactaaaatataaaaaagctgtggggaacgttgcaaaataaaattccccaaaaacacgcgcacgataatgattccctttactcttgttgcgtgcaatttccgctattatgcgcattcgtcatcactttcccattcctctccgatcagttcttctctctctcacactgcttttgcctccattgaacccttcttctctctgctcaccggaatatttctctcacaaaagatg

SEQ ID NO: 28438 - DNA, 3003 bp, Unknown
  misc_feature (1)..( 3003): 2750-1469P.txt file - cDNA_ID_2996778; gDNA_ID_2926268; Annot_ID_143358
agtcatcagctttccagtcttcaatgccttcgtaagtatatgttgcctaataatttatattgaaatcagccttctacattgtcttcttgcagactctaagtgggtattgatgaaaggtgtgatataaatatgatagtcctctctgcagtttctcctttgacttcatttggtatgtcttcaaaatttctgtgatattttttgtttcttacctcaggtaatttgaagtccttatctctcttcctcaacaagtcacaagtgagtacctactccttatactttctagatctcatggagtgctttcttaatggtattattgctggttaattcatttaaactgcatggcgaaatatattatgtcaaattattaactttccaaatagttaaggtgtattgttataacagatgcggcgaacgttgttgttccaaaggcatagtccactaacgcccaatgtgctagtaaagggtaaatgtgaaacggcgacaatcgttcctcttacagaatcgtgtcaataacaacaaatctttgacaaatatctttgctgttttaacaggatgtgtgccaatcaatttttgacccgtgattctgatttattgattacttgcgttcatggaatccttcgagacgtgtttggactttggagtactcttaatgggaagaatttaatgcttgtttgcttagtttgttgtatgtaccatgggaaaatactctgatgaaaaaaatatttaatttgcaggtctactctacaaatctagttgatgaccgatatctgaactattatgtgctgacccaattacaaaaaggagttactatgtaagttagctagcactctatcacttaaaccattcacaaagaactttgttcgatccttgatatatctttgtctatgatatgtttcagaataacgttaggttatgagctaaatgatcacttgccgatctttttagtataattatggaaaacagctatccatcttttttttacggtcttgcctatcttaaggtaattcttcaccaatatagtaatttcaactcatcatttcttaagagttcattatttactgcatattgttgtctgaatgcatagtaatatttgatttcagaatgaggcttctagatctaggtcacaaaacagaggagactgaaagactgattttattaagtctgtacggtactcagaaaacagaggatctagtttcttgccatataagttatctattctagtactttttcttttaatcttatataaatatcgaaagccatgaaatcatacattcgaaagatctattaaaggcttctttttaacttgggtggtcttttttttttttgggtggtctttgtttttcaagatatgttcgtcaatctctctccacaaaaatgttaagctctttttttctatctttgttgttttcagattttagattcttcaaatcgaaaccttctccgaaggtatgtgtcctcaatctttttcttatgtttgatcttctgatttatttttttaataatatgatggtcttttcattataaatttgctcttataattttgacctttcatcttatgtagttgcagattttacagtctattgatatgtggtccaatctcattaaccaaagaactcttcgtgggatcttccaaatcacttaaagaggccggagacaacgcatgcaaaatcacacacatacacacgtacataacatacatacaaatacacacacgaatacaaacatacatgcatgcatacaaacttacatacatacatacaaatatacatacatgcattcatacattcatacatgcatacatgcatacatgcatttatacattcaaacatacatacatatatacatgcattcatacatacatacatgcagtcatacattcatacatgcattcatgcattcatacattcagtcatacattcatacatgcattcatgcattcatacattcatacatacatacatgcattcatgcattcatacattcatacatacatgcattcatgcattcaaacatacatgtatgcatacatacatacgtacaatattgttaagtcttaactcaaacaatttatgtatagaataaataaataaaaatgtataaaagaccatttttgtatagaaacattgttggccgcgcactagttcacggacataggaagggaaatgataaaactcgattagataaggtggttttcttgtcttgaactcgattaaataacatgaattattgacttattgtcgtatagcctaaggtacgtatagagtcaccagctcgagcttatttgcttttgcattactttgagtaaaataatttccattgaaatatctataatttaatttaatgaagaggacccaacccatcttcatcttatctttaccatttatataaatccactgaaaatgggaatggacgtacgtgttctattgtgtttctaccaaatatttttgcgttttaatatctttcaactgtctctaccaaatctaaattggttagacttcaatatatattattcataaagttttgtcgtgtttcacgtgtttatgaaacgtacccgttcttgcatttagtcccacgcactatctttttttatccatacttgattactttctcaattcgtcgatctcacacatattatatccggccaagcggctaagtccaccataaaaacgaattatatcgataaccggaatgttatcagaaatttacaatgtaatatttctggaatgactattaactttgacgttgttacgagtttaataatttttgaaaagactatataactctcaaaacgtacatgtaatttttagcaatgtccttggagaaaacaagtgtaacaattacatgtacgtgtaaattaaaaataatgcaaatgtcagtcaatatttcgaggaaacaatatatttctgttcccatctctaatcatttcctcaatcatataccataaaaggcataaacagaaccaaccaaccaaccaaccaacaagaagaagaatccaaagacatg

SEQ ID NO: 28439 - DNA, 3003 bp, Unknown; identical to SEQ ID NO: 28438
  misc_feature (1)..( 3003): 2750-1469P.txt file - cDNA_ID_2996778; gDNA_ID_2926268; Annot_ID_205002

SEQ ID NO: 28440 - DNA, 3000 bp, Unknown
  misc_feature (1)..( 3000): 2750-1469P.txt file - cDNA_ID_2996782; gDNA_ID_2926268; Annot_ID_143359
ttgatacacacgattatatatatacatatatatatatatatatatatttgttttatttttagtatattattatattagtatgttcccgatagaaattttgctattatagcaatacataggtcttatcatcaataacccacttctgatgtcccactaataattaacaactagtataagttatcgtgtgtaaaatattttctttcggtttttgtatacgagtaaaccctaaagcaatcgatctagttaaataaattataatataatttagataaaatctccaagaaaccatttctgttgtttaatctcccaactactgaataatataattaaggtcgaatcccatgaaaataagttatgacggaagaacatattgtaaatgtaagtttggttaacttgaactcaaactatgtgacatccaaatcttttgtctcctcgatcgtatttactttttgttgccaaggtttcaaatccacaggctcctacttttgtaaagtcaaaccttttcatttctaatgatactaacattcatagcaaaaaaaaacacattgtaaatttattatttatatatctcataaggacgagtattaggatccaaatgagaccttttggtcctccacatatcatgcggacaggatcatcaatcatcactgattagtattaatgaagttggcttttagataaagtattcaaccaataatatggggaatggacatctccgagactccgaccaataatgagaaagttaatcaaatctatttatgggtcggaccgatcactatttttctgatgcggaaacttatcaacaaactttgaattttttagctttttgttttacaatgaatctatttgcattaattttaaaactgtgtttataattaaacaagaaaaatggtttgaaatgatgaattcattggcctaggacgtgagatcaaaacgccaactccaaatccaaccaagccaatgttcatttctccacgtggcgtttttaatggatcaaaatcattgcaccaaacctaatttccaacaaatcaacatttatgcggcgaacttactccccaaatccaacgtaacaatcgcactatacactttttttttttaattccataaatttcatagttcttttttctccaaatttataattatagacagggtccaaaatgtttcatgaaaattaagtaaaaaagtaattaatattaaaaatgataaaatataggtcaattacctaaaaacagagtttttctttgctataaatggtaggttaatttttctaccaacattaaaaaaaaaaaaacactattatttagtagtaaattgtagtcttacctagattgattgaggaatttaatgaaatacttttacaaaaaaaaataccatgaaacaatatatgtgattacaaaagttaatgatctatgcgattaggaagaaaatgttcgaaattcaaagctattactaagatagttaaaaatatatccaaaacggataagaacgttcgatttaaaagtcatgtattcatttatcttatggaaaatattttaatcgaacacaaaattccgttgacacagattgagtcacacaatggataaacaaaaggatcacaattggcaatacaagagggcgtgtaagattggatgagaacaaaatgccacgagggatgaggagaggtggctcttgggaagaggcaaaggtcggtttattgcaataaccggcttttctagtttttttttaataaacagctctttgacgcaaagccaaaaacaatattggtcccggatttgttcactttccacattggattgataagaaaacataaatctgcctacatggaacaaaaaggtcgtcttgtttttcggatcacaaacaaaagcaaccttataatagtcactttttttcaggaacgtaaattatgcaaatattttcattttttgttttcatcttattttcctaatgttgggaatataatacggacagtgttacacggtgtaacttacaccgttggtccagctcaatacacaaatcaaatagaacattatctatgttaaattcttatgcatgttacaccaagtcggtaatatatattaaaaggtttaaaacaaatataagcaattgaaattaaatacaaaattgagcttgttagtgggacattgtttaactaacttctcatggaaattaaactcatcactcttgctatggttgagacattgtttaactaagttctcatggaaaaaatggggcgccacttaaggtataaaccaaaatatttgcgttaaaccctagataagctaagatgccatggaaacaaaacactgggcgagttttcttctcgtgacaattatcatcaaaaattatggaacaagttgatcctaatcctaatcctcttatcaatatctttgattgtcttaaagtttttatttattttatttcgtgataattgcattgtcttaaagttcatagttgcataataactttatccccaaactttcatgatctccacggaccaaaaaaaaaaaaacttaggaattagtttaccaaaaactccaactacttaaaatttcagatatttgttgtcagtattcaaatactacactcggaagtttcgttcgactatgatacatattctcagttcttttttgatgattcatggaagataaatttgaatatgaattctcctgttcgttataaattattgtaataaagacttaaagagtgatccagcttcatctctttatccacaaatgctattcccgtcacataaaaatgccaaaaaaagaaaaaaaagagtgataatctaagtgaaaacagatcacgagcgtgttagataagaatagagagacgcaaaaataaaatagatatttgcgagacgccacgtaagcaaccaaaaggttacggtaggacccacctcgctaatgtctatataaccagaaatgtgccaaagcctttcttcttcaaactaccaaacctacagaaatctctcttcttcttcttctctacaaaatttcaatg

SEQ ID NO: 28441 - DNA, 3003 bp, Unknown
  misc_feature (1)..( 3003): 2750-1469P.txt file - cDNA_ID_2996786; gDNA_ID_2926268; Annot_ID_143361
atatgtcattagattgcaataggaagttaatatgagaaatctgtttggttcaattgtgacggtatctaccaatttgcactaaaatatttatagccaatatcagcgaatattttcatggacaaagtatatatgctagtctagttatcatgatttgctttcacttaatttatcaccaatataagcaaattttccaggatttatctattaccaattaataacgttaggtttataaatagtctagcgataccaatattcttttttatcaagtttgatgaggaagaacagttgtatatatgatgattgtggttattagttttgttctacaatgtccatattcttaggttctaaaaatgaatttgtatatatgtattattctattcaaattaaggttgcattgtcgagaattcggaattgagtcttacactcttaaattttgaccaaatctagctaatatatcaaactttatttctgaccaaatcctatatggtttgccgtttacgttttctcccatggtctacggagtaagtgacgctcacataggcaacttcgatcatcagaataatttctttactcatgatcgtaatatataatactaatcactaggttctttccacctagattttattggcttatgagataacattctttattttgctatggtgttagtgaatagagaagaagagtgtttgagagagacggatttagaattcttattgaataaatctgtacaaggtaaagtatatatacaattgataccaaaccagctaaaccggactaaacctatgaatacataattacataatccaatagtcctccacaagatgaggcatatatgttaataagactcatcttggattgtagatgtgcaaattggtgaggaaagagtggtttagtcaggatgtctgcgatctgatcttcagagttcacatgtaacattttgagtgaaccatcatcaagcttctcccgaacggtatgacaatctatttcgacgtgtttggtccgctcgtggaagacatgattctttgcgatgtatatggcagctgtgctatctgagaagagaactggaactgaaggaagaccaatccgcaaaccagttagcaagataaccaactggttttattggcttatgagataacattctttattttgctatggacacacaaaataattagcatgtattttagaacgttctttattttaagctaaaaattatcatgcatatattataatatttatcttaaaactatgattatagtaaaaagatatcggtgtatagtcaactacaccttctgcttcacaccaaagttccaataacaaattatagaattcctgtttcacattaaacaagatcgactcgtaaatataaaagataacaccaaattactgtttggagattaaaaccaaatgtctgaagaattacagataaagtttagctcacaacaaggaattttacaaattctgatgccctcaaaactattgatatattttgatttttaaaacccttgcttattgggtctctacccatggtcggccatgtccaaactaatctctcaattaaataatgtagtcgtgtaaatgcaccaatcaataaaactctcaataaaaaaataaaacaatatgtcttccttaagtacgaatcattattctttttttttgggcaaagaatacgaatcattattcatttttagttttcagtgaacacttcgtcgagaatagcgaaggcaaataccgatgatttcttaaaacaattcaattggttgtattatatatctaaggagtggacattctataaaagacaatacttaaaagaattcaaatgaataatttgaaataaaagatttgtttttaatgaattctgtccaaatgaccggttaaatgctcgtaattgattcttcacatttgttaaaggagatttctattaaattcctttacatgacatgatcatcatacaaatgtctatgttcataaatcattgttattgcatgtataaaatattggataatcatacgaatgtcaaaatgtaaccaatttggattggggaaaaccatataatagagaataatgtcaaaatggtctccgttcataaaagtaaaaaataaaaactatgagaatagatggaactatattttcacagtttttcagcgtgaatggaacttgtttgtacaatacaaccattgtaacccaaaagaaatttggctcggattaggttaacaccgttaattggattgagttgggagttagtttgtacaatacaaccattgtaacccaacaatgtcttgttgaacccaacaatctccgacgtccgacgagtttatatgaggcatatgaccactatggtatactatttttcttttagtttattttttgttatgtaatatcttaattgttttgaaattttaattgttttgtatatcgtatgtatattttacaatatctttttgtttcatggatagatgaggaagtgacaaagtagaagaagtgagcaaagagaacacccgtggcaaagcgttaaaagactgaaaaatgaaattttgtagaagaagaaataatataacatcgagacacgatgagactaacttttgaatcaacttcattgtagtaaaacttttgtggctacgaccttagaaatgaatctattttatttatttattaatcattgaatatgtgtagtatttttatttttttacagcctaagcctttgtatttgtattatctaaaatagttctgttaattttggaagactgttaatttggtgttcatttcattcaactactgtcctctcacaatatcaaatgacaaaactaaatcatcaaatacatgaaacatgttaatattgttttcataaaggataataaaccacttatatgggcttatatgactctatattgggctaggcccatataatggtcgccacatagtcaaataagtctcacgaacacgagtagtcatcgaacggaaagttaacaaaactgattttgcctgtttggttttggatccgagatg

SEQ ID NO: 28442 - DNA, 3003 bp, Unknown
  misc_feature (1)..( 3003): 2750-1469P.txt file - cDNA_ID_2996794; gDNA_ID_2926268; Annot_ID_143366
aagaattttcaaagctctgtatcttgatgcatttgcaattagtaggagattttggtgtatgagttagaatcaacattgcagtggcatggttatagacagattttaaaagaatgcgggagccacttatggagtaacaaactctcttgttgtttggataacattcaagcttgatattagttctgggaaacttaacttgcagattttgacacgggctctctcaagtccaccatttggaaattatggggtttggtggtctctcgcggactcgaagtatgcagggacagctttgttagtgaaaaaatgtttcaagcctcgaaaagtttactttaacttggacaaattaggtatttttatagccttgttgcttgttccttatcatcacataaatctcttgcacactagcaatttgaagccatgtttcttttatctgtcttgttatggttctgccatttccttgatctcaaagttgatgtacttgggagaaatatatcatagctagatcattgatgactaacttatatacttgtcgctctcatgcagcatctaaacatgaacctgatggtcgtgttatcttagctgaatttgagacatttcgtcttttgaatacgtattcgcctaacaatggttggaaagatgaagagaatgcgtttcagaggagaagaaaatgggacaagaggattgttgaattcctcaacaaaacatctgataaaccgctaatatggtgtggcgacttaaatgtcaggtaatgaggaagttttttctatatcttctcttgctatactcttttccttaagcccttacagaataaaagttgatgttatttcctcgattcgatttttgtaatacgcagtcatgaggagatagatgttagccacccagaattttttgctacagcaaagcttaatggttatgttcctccaaacaaagaggtaaggaataccatattttgtacgatttattcattatcattatagcttttatctaaaaacagagctggctctcaataatgttattttccgtcggccttttatatctcttcctatcttgtctcttcatctgcattgtgaccctgctattgttgatgactttactacgcctgtatttctcttcctatcttgtctcttcatctgcattgtgaccctgctattgttgatgactttactacgcctgaaccgaaaggttctccgtgagatggacctttaaatcatacaatgactacagtggttttgagttttttgattatgcaggactgcggacagcctggatttacaccatctgagagaggacgcttcggggcaactataaaagagtatgcgtaatatgtctttgcactgcgaagtcttagtagtagtactttctagaatacagattagagttactaaacatgtgattataaattatatttatgggaactgttacagaggaaggcttgttgatgcataccggtatctacacaaggagcaagaaatggaaagtggcttctcatggtcggggaatcccattggaaagtgagtggatactacacattttagttttatggcttggagtccagaacctccgcatgtttctaaagctatatattgattttttgttttggttgccataggtaccggggaaagaggatgaggatcgactattttctggtctctgaacaactcaaagaccgtatagtttcttgtaagatgcacggtcgtgggatagaacttgaaggtgccatagataaacctgttcatcacacagattcatagaagattattattagctctttttgcaacaatttggttcttgatttgtttcaggtttccatgggagtgatcattgtccggttacactcgagctttcgaagccatcttcagaaatggaacagaaccaggtgtcaaactaaaatcatcttcttctgtattagaacataaggccttcttaggaacaagccaaagcttattttatcagagaatttaatttttactttgccgagagatgcattgaagatttgattgaggttattgagacacttatttagccttgttactctgatgaactctcaaatgtacttataattattgttgtgcttatcttaatatgttttattttcctaagaaatgttgatatttttaattgtgaatcttcttcatttaattatttttatttattaacttttgagtcatttctaaagatttagagcttttgttggtgtattttaagcatattataccctttgctttattgtcttagtcagtaggtagaggcaacattcgttaaaccaatggctcattcaaattcttttttttgggctcattcatattcataaaaatcaaatttggattcagcataacaaacacaataatatatgtagacatttatatcatacattaatttctactaatttcatgaactaccaaagactaaaaatgtttaatgagaaatatcttttttaaaaccatcaaaaattttactcttaaaattgggatttatgtttggttttaaaaaggagtttttgaatgtgcaaacggatttacagagaggacaacaacaaatgtgtgttagaaatggcagaatcgtaaataataagaaaatcatacccttttaaaaaccatttctctctctaactaagtgttctttacttgttttaatacagagatatcacaatctcttgctctgcccaaacccatcccaaccccctaaaaaaaatacaattttttcctctgtttctttaatccaataaaaacagagagacctaagaaacgagatcaacaaagcccgtcgtttttttcgaggaaaagtgaatgaccctttaagaaaataactctattggccggagaaatggtggagactcgtcgattctcttaaagtttgtttttttttcctctcttcaaaatttttgttctgtttatactctgtaatggcgttttaatttgatacctagaagttaaagtgaacaaattttgagagaaagtctcttttttttgttcttccctgtgtgtgtgagagagagagagagatatg

SEQ ID NO: 28443 - DNA, 3003 bp, Unknown
  misc_feature (1)..( 3003): 2750-1469P.txt file - cDNA_ID_2996801; gDNA_ID_2926268; Annot_ID_143370
aaatattttgattatcttgttaaatattatttacaaattacaagtgtaaacaaatttttatatttgtttacatttagttttggtgcaaatgtttgttctgttttattccagtgatttattcatctaatgaatccagtatattcctataagtagttaccatttgtacattttgtaaattgaaaaaaaaaactaaaatattaaggttttaaaatacaatttaacatatatatatataaataagaacaaaaaaaactttaaaatcaatcatattaaaaaggtatacatgtacacaccacataaaataattatcctcagcaccacaaaaatacaatcattcaattctcaaatatttgtggggtttaggcttacacatgttagctaaaaataaattaaaaacttatacaatttttttttttttttttacaaatccattaaccacaattttcatctaaaaggctctaaatggttagtggttactctgggatttagcggggccaataaaacttaccaaaaacgacaatatatttctttttcctttttatttttggacaaaaacgacaatatattctggtactaatattttgtggtacgaaataaactatttaaagcttaaattattcttcacgacaataaataaaattttatctaaacttaaatctcatctgccaaaattcgattatagtttatgtatatatataataatataataaaaaaaagaatgtatatagtttattctcaccactacatgtatataacacaaccattttcattagaagctcaaatttcaaatctcacttccttatcacaatgtcttcctctatctctcccctcctcacaaccgccatctccgtcgcaatcctcctcttctccaccatctccacagcggcgacaattccaaacatccaccgtccattcaacaaaatctacgccttcggagattctttcaccgacaccggaaactcacgctccggcgaaggaccagccggattcggacacttgtcaagtcctccatacggcatgactttcttccgacgaccaacaaaccgttactccgacggtcgtctaaccatcgacttcgtggcagagtcaatgaatttaccgtttctgccaccgtatctcagcctcaaaaccactaacgctaacggcacagcaacggatactcacggcgttaatttcgctgtctctggatcaacggtgattaaacacgcgtttttcgtcaagaacaatctgtcgcttgatatgactcctcagtctatagaaacagagcttgcttggtttgagaagtacttggagacacttggaacgaatcagaaggtttcgttgtttaaagattctctcttttggattggagaaattggagtgaatgattatgcgtatacccttggatctactgtgtcaagtgacaccattagagaacttagtatctcaacttttacaaggtttttggaggtaattaattataaattaagcgcataattaacatatatgaaatattatgattttagatctacaaaatattactaacaaccaaatcaagattgacatgtttctttttgtttttgtgtttttggctctccaaccaaatgtcttcttttttcattacaaaaatgtgttcaatcttgacaaattatgtttttttgttttcgttacaataacaaaataggcatttgatgataaagcagtctggcttagaagttaaccggatcatggcagaaataattctggtggtcatggatctaactgaccggtttgtgttgaattcattgtagtatgtttagttaataacatttttcttaaatcataactgcagacattgttgaacaaaggtgtgaaatatatgttggtgcaaggacatccagcaactggatgcttaacgttagcaatgtcgttggccgcagaagatgatcgggacagtctaggatgtgtgcagagtgccaataaccaaagttacactcacaatcttgcccttcaatccaaacttaaacaacttaggtcagttgtgtaaagataactaataatttgatgttatatagtagtagactatatattttaaacatatttaataaatgcaggatcaagtatccgagtgccacaatagtctacgcagattactggaacgcgtaccgtgcggtgattaaacaccctagcaagtacggtatcaccgagaagttcaaggcgtgttgtggaattggagagccgtacaacttccaagtgttccaaacgtgtgggacggatgcagctacagtgtgtaaggacccgaatcaatacatcaattgggacggagtccacttgaccgaggctatgtataaggttatggccgatatgttccttgacggcactttcactcgtcctagatttagtgacttgttgatcaagaaactaaactatttatgaatgaattgttttactgattttttatataagatttaatggttttggagtttttttttaataaacattattggatttttttatctgaagcctaagaaattttatgttcggcgcttaaatcacacaagtcataataatttaactaaggtctgagatccttggattatcaaacaatatatttcatttcaaagtgaaagaaagaaaattaaatattattcaatatagttgtgctcaggatcttgttttcaagataatgcggacatagctacagttcctatatagctcgcattgatactcctggccaaggccaagtttgcagagccagtatggtataggcttcccatcccaaaaacatttaaaaaatcctcgactttttttttgtaaaataggctctttgtaataacaaatggtcaaactacaaagagcctattggacctagaaagattcatttattagaggcccaaaatgattagtttttattgggcctaaagaatttagaaatatgtatgaagtggatctaaaagaggtaaacgacgacgttttactcttcttcttaaaaattagtctacagacaaattcttctaattttcgctctctccaaacttttccatg

SEQ ID NO: 28444 - DNA, 3003 bp, Unknown
  misc_feature (1)..( 3003): 2750-1469P.txt file - cDNA_ID_2996807; gDNA_ID_2926268; Annot_ID_143372
tgtgctgtgttatgttgtattagatggctttgtcatgtctccaactccatgccgagatggctcttcaaacttcccgagctttagaatcaactggtggaagtagcagcagcagtagcattagaccgatgaacataagtctaccttcgggtatctctaaactgacatcaatcaaacttccttcttcaaatgttcatctctagaaacgccattcccattaattcgggtctagtcacttctgtatagtagcatttcttcactaaagaattcatgtgttcatcgatttttgatatctattacaaagttttgagattagtgattacagagccagataccaaattgatttctctatttatgagtgaaaaacagcttaacaaatttgattcagcagctgacgattactcaactttagatacgattacagttgctaaaaatagatacttttcatcttccgaatgttcagaaatttcccattcagatttctaaactagtcaatgatgcaagcgaaaaaccaatgggttgccactaaacatgattaacaacaggcaacccccgagaaaaaccagaacaacagttcgatagataaatcaaagaacccgtaaaaagaaagaaatctacgcatagaagaagaaaactcttagagattccataccaactactaacttaatcagagtctcttcacccttttcaatctttccaagttcatcttccaagctggacctaatcttctgcgctacgctgatgtgttaaagtcattagaagttatcactttagtcaatgaatagttcccaaagaatgaagctcgtcacagaacttttccaagtctttatgactaaaccagtcctctttcagctgcaaattttaagcgaaacccgggcgggcatttcaagatacacgaaaaacaaaaaagccacttatcgtgaacaaggataaaatgtttattgaatgataaacttacaaaatacggcatatcttcgacgttgaagttctcaggagcgtcttctatgaaccgatgaatgtagtagaggacaaagcttccacattccacatcatttgtttgctgtggaacctgaaattataataagccaaaccaatagtgagatgtaagaatcaagaaacataaacaacttggtagatgcactcaattaccattggcacataaaacgggatttcatcaaccagacttgagtcttcagttcttccctcagctctgtatatgtccaacacaaacctgaaatcaaagaagaagcacaaagatatatcacacaagcttttaaacaaaaatatcattcttcgatacagataattgaaaaagaacaagagagagtacttgctttcttatatctggttcaagccgctgcgaagagtcagttgtttgtagtgagtcaagaaacaacatgcatgttttatcagaatcaagatcctccccaaaattgcaaaagatcaacaaagtccaatggctcctggaggaattaaacaaaaaaatagacaaatatagttacatttgaaaccattttcaagaacacatatggcaaaattaactaaccagtagacgataggaagaaaaacgtatttcttcgagaagatctgctttgtctttacggaatcgaaaacactacttctaatgttatggttttcacttttgtacatactgaaccaaagacaatctaagtagacaaaagagttctttttctcatccgagaagcccctccatacatccctattcacattagacaaaaatgtaagtaaatagacacaattccttgttattttgagtaaaaagagatattgcttacgtactctaggtaacctacaaatgctttggaattcagttttttccgtagcttggagtctaaatacttgcacttgattcttctttctgacctcccacggcgtgtgcattcgtcatagaaacaaggagcagtcaatttgaatatctccaactccttggttcgcttcggtttcgaaccacacttactcaaggcagcagcaatatgcttccaacacgtcctgtggtgtaaatactcatcttcctcacaatctgtaaaattatagacacatgttgatcaaacttgaaagttagcctcttccagagccagaaccaaaactttcacaaactacaaaaccagaactaaatatatatacattttcaagaaccatagatttcattgtcataaaaatccaaaatctaagccaattactagagagaatttcaaaattacacatggtaagatagtaagcatcaccacgacacaggaatagaaacaatctcgtcactttgaaaattccagaaagaaaaaaaacacaaactttcatcgaatcttcaaaaccctaactcccaaaattgcgttaaaccaagaaattaaaaatctttcaaaaacccccagaaaaaaaaatgaataaaaatcgagaaggaaattggaatttaccatcaataatagtaacacgagcaggactgctgacgtatttactattagtatttcgaacacgattacttcgtcttcttgacattgaaatttggtacagagagctctgagtgttttgtcttgccttgctttttattttccctcttctcttgtaaactttttgtttcgcttaatattagcagacgaattacgtaaagactcttttggccgttgattttacttactttttaatagacaacgattcaacggtcaagatgatttagtgtctctttggtttctgtgatatataatttattgaaccctttataaattttgttttgaattttttctcttaagaaaatatttctgtgtaggtgctttgggaaaatatagaatcaaacacttatttgtaattttttttttttttttttaaatttattaggtatattttgttttgccctataaacattttcttaacactcaaaagtaaaccaagctacatcttcttcctcttttcataagaaagtaacagtaataatgataaaaataaacaagtcaagtattgtaaatattacatatctaaactcatgttgtcatcatg

SEQ ID NO: 28445 - DNA, 3003 bp, Unknown
  misc_feature (1)..( 3003): 2750-1469P.txt file - cDNA_ID_2996813; gDNA_ID_2926269; Annot_ID_143378
atatatagtgtcaaaaaaaaaacatgctatttatttttgacttctgcatgactattagcacacacaagaatatatattatatagaaatgtcgtcattccactagctataatatatacatttttgatttttttactaaatagatcatatattttcgtaaaatactaattttctaaggagctgatctagtttagtggtcatacgaggaccacttacctcatcagctcaacccactaatattgagtttgtaccagtttgacaaaaaaaatacttaacttttcagaaaataaaatggaattagttattttcataattacattttcagttaataaaactaggataacaaaaacttgagttttctttttcttcttctgaaagttatgacctacgtagctaggttttagtttacagtcgtggttaacttagagactctttgatcatcaatcagttaagaccaatgcttctttaagccatttagtttattcttgatgataaaagtacgtaacatcatttttaaaaaattgtggtgagtgagtaaaagtcacgatacaaagaaaaatattcatagtttgaaaagaacgtaaagtagagatgaaatgtgaatacgattatatatattgtttacatagttaatgtataggcctttctttctttatataggattgtaaagctctttacaccgctttatttataacaaaaatagaaatgagcaaataattacgtcgaataagcactaattccattaaagtgggagctagtaagcaccaagcacactagttcaactcgtatcaatttattgtatttaaatcagtagttaaaacttgtttaatttcctcattgagaaagatttgcccactttagttaagtcttatcccaaatagcactttagttaagtctttatcccaaataacttgtttacttttacttttctattaaaattatgaatagtactgaattcactatttaaataaaggcactatgaaataaaaagaactccataaaaaatgcattaattattttatatttcttaaatatagacaaactttatagaattaatggctacaataaatattacgttgaaaatgtcgttttaatatttctccatcttttttacataatatttatatgaatttaaatttgaatgtcgatacaacgataacacgaagacgagaaaatataactattttcattagaattgacaccaaacatatttaatctcttcatttttgtcttaaaaacaaaagaacatactttcgtgacataggttcatttagtacttgatggattttcgtgccattggttcatttactcgatgcaaggcacggttccatcgacacagcagcaatgtgattgtcacatgtcgcgtggtaagacgagggttgctagagcttaccagtaaaagaagatacacaaattttggtcttatccattaggcatacaaatttaaaatataattaatatctcatatttttaattttgacagaaccaatgaaataaaacacgcgcattactgcagtgaatcccaattataaggaatctgatttgacgtggatcttcaagacacttccacgaattaaactgcatgttcttaaatgcttacacgtattacttctacaactctcttctctactccagatgtctccatcttccttttatatccgatatctaaaacgctctcaagtatagcacaatccacaacaacaaaaagtacaaatcttactcttcttttcagctagattttactaatcactcgccaagaacaaccaatggccgttcgatcaaccgtaagtaacctaagacgtcgtcgtttctctatgattcatttggtcttcacgatttgacttttatcattttgtgtttgaagggtcacttgaaaaacgtagtgcagaggttaagaacttacacgaaggcgacaaccgtaccaagatccaaagcgtattctacggcggcaacagagtatggtggccagagaaccgccaccacagcggcagcaacaaaaggtgacttcacaccagtttacgtctccataggattgatttcattgtcagtaacatttggtgtctacactgcgtatcttcatctacatgaaaaccctggcgtacgtgtcaacaagaagatgagagagaccgttcccgagatcgaagatccagatagagttctaaacgaagcggaccggttcgctaacaggtcttggtttaggaaaatagctcacgttcaagagtttgacaagcaggatgtgatctctgacccaatcaggaaagaccagtttgctcataaacctcgtgccttgacgcttaaggatgttggcgttgatcctaagatatcggctgctgcagctcactaagtttttatgaaggctggtttatgtgttttgttttccatgtttctgtcgataaataaaacatctgaaggagatcaaagagttttcaaatgggtcggttaaggttttatcctgtttcctcttggatgtattacagtgatcaagcaacttttgagtgtatttgtgttgtttcaacagcatgtaaattatctaatgaaatttcggtcgaagtaataatacaacttcgttttgcttctattttcttctggattaacgattttagtaaaaatactcatttgggagaaaccaatttcttgggtctaggtttgaatgagataaaatggttaacttcctaaccttctaagagtgtccgaggattcattcgcattctaattgggcccaggtcaaggcccaggaccaggccctagtggggtaaaattttgcacgcgtcggtgctttgttttggatgacttggcgagaggtgatagggtagtgtcacgttggcgagcgatattcattggaagataacaatcaaaatgacgttcgtaggtctaagaaatacgaggactaaagagtaaagaatatctctctctctgatctacttagtacttacttagtagttacttctctgtcttatttgattttgagtctctgttttgtctcttctcttgagattgcgataatg

SEQ ID NO: 28446 - DNA, 3003 bp, Unknown; identical to SEQ ID NO: 28445
  misc_feature (1)..( 3003): 2750-1469P.txt file - cDNA_ID_2996813; gDNA_ID_2926269; Annot_ID_205037

SEQ ID NO: 28447 - DNA, 3000 bp, Unknown
  misc_feature (1)..( 3000): 2750-1469P.txt file - cDNA_ID_2996817; gDNA_ID_2926269; Annot_ID_143379
ttcttgacgctatcaaaggaaaagatcccgatgatctctcatctagagagatcgcgtttgaagatcccttctccgttgatatcacaaaactcacagttgggtatacaaaagatgctgatatgaaggtaaacaagctgctaaatactttttccaatcacagtaatgaactagtttgtgttgattcaacatttgacttcttcaggtggtggaagttcttggttccaaaggtgtcaatatggttccttttgagctaaattatactgtggaatcggttcaagggatattgaacttcacaatggatgtagatatgttggctcattttgatgaatggcaaagaaccggtcaagaagatctctatgaagctcaagatcaatggccggttgagttacgccgtgctcgtgtagttacagcagtagattacattcaggtttttgtccatttcaacttctcattttggtttataggttggttttgtgatagttatgtccgatttatttatctatctaatttaccggcttaggctcagagagctcgtggtaagttgattcgggaagtggagaagagctttacagtcgatgcgtttattggaaatgtgaccgattgggagaaagtctgtatgggaaacctagtcggtttgccggttctagtgattccgaccggtttcaagaacataacggatccaccaaccaacagttgccggagacggacaacgatcaatgccggaatttatgcccctccagaacgtgatcacattgtaagtaaaaccaatagaatatatatcttatatgtcgttcagtgaactgaaatttaggaaaattgtgtggtaggctttggcattgggtatggcgtaccaatcggttaccgatgcacataggaagcgaccacctattgatgatcttggaccggatgactcgataccaaatcctcctcgggctttaatccctccccgtaggttacacatttgagctttcttcaatctttttttttacattgggaaatgtagtcaaatcaatgttgtgtgttttgtttaaaaagaagttatgttataagtagcatattgttctgtctcaatgagtgatcaagtcaatgttatgaaatgaacatatggttgggaccgtttttgacgatcatgctttgtagtgcgcgactctggatataaattaatctattgggattttgtctaatgattaatccgtgaaagggttttgtttccatatcgaacgtgactgacggtgattggaattttggaactagtgctgatataaaagtggaaatatacacgtgttttttattcgttttttatgtagctgtcgtgtatgtgtttgaaattgcattttttgctttactagaagaggaaatgggaattgcgtgggtatagaattttaattataataaattgtgttcggcgagttttgtgggtgggaatttattgtactacctttgactttacgaccttcgcgttctattttcgatctcaacttcttcactgtaaagctttttttcgtcggaaacaaaatattatggtgcataatcccagccctgcatagtccaaacctgaaataaataaaatcaaacgtctatattttttattcattaaagatgaattagctaaatctgaaaaagttttgattttaccataaaaagaagttttgagtcaatgaaaacatttctggcagatcccattatttattaccaataaatagtgacatttgacttgatacatattgtagttttttcttatttaaccccaaagcaaaagttgacttgatatttattttggggttttacaaattttgctcttatctataatcacaggcaattaatttgctcgccggtcttacagagtaattgccctcaattgtaaccttcaaatgcaacacttcataacaaaagtatacaagaaacaaacaatcaaaatgttaaatatgttttaagtatctatctaaatatctctaatcgatgtgagccaaagaacggaaacacaaaagagtaatttgttttaagtatttatctaatcgatagccaatcaaagagcggaaaccagataaaccagcacacgtaatggattaacttgaatagctagtggttttttttatatcatctatctctaatctttgtatataaatgaatccaaatttttttaaagactatctatgtgactatgtctatctagttataaaagaaattaatcgctaggactatatatgcaaaaaaaaatggtaagtagacttttagttttagggttgatttttctgtaaacttctaaagtgaaacagacaagtggatattcactttccacggtacgaccttaaaaccaactcttttccgtaaaaacaaaatctaacaaaatggcacctacacgtaatttattcgaaatagcgagggtaaaagagacaaatactagtcatcttccctctttcctctggtttatatttctttctttcttttagctcctctgcacaaatcccctgagctctcttcccatctcgagatccgccgttaaactctttttgcccaaactctgagcttctctctctgtcttcttcttcttcatctcctcttttgtattcaatcacagagagactctcttctccagatctatcatttggtttaatcaaggtatgttcgtcggaattatcgaagaattctcgtagatctatccattcattgattcaatttgatcttttccgattagttccgatctgatcgagcgatatagagtctcgtctgattggtttggttagctcaaagttatagtgcagatcgagacaaatgtacatttttgtgattcgttgatgatgaatattgtagtctttatgtatcgatgcatgtagcttaatctcgttagtggtttcgattatctaatcagaccaaattgatgtttgatcatatattttaccaatgcactgtgttatagtgcggccaaatgatgagtcttttgaatgatttactctgatttttgccgaaatggctttggtctaaggttagctagtgaacatg

SEQ ID NO: 28448 - DNA, 3000 bp, Unknown
  misc_feature (1)..( 3000): 2750-1469P.txt file - cDNA_ID_2996821; gDNA_ID_2926269; Annot_ID_143380
gtaaaaaaaacatgaaaaccacacacaaaccaccgaaaatagaaggaaacaacgattgatgacgaatataacctgatcgtttccagaaattcgatctttcaagatataacacaaaccgatccgatcagtgagagaatctaccggagacgaaattgcgtgtaagttgctgagcttcagaaacgactacaaccaaattcgcaagcaacaatcaaattcaatattcataaacgaagacgaaattcgcagcaacaatcaaatcctagattcagaaatgaagatgaaattcgtagtagtaacaatcaaattcgagcttcagagagacgaaattcgcagcaacaatcaaattcgatcaacagatagattcaacgatatacgagcaaaaattcctactgagaatggaaatagagagagacctgctttagatctccgatcagagaaggcgagatattccgcagatccacgacgaaacaaagtagcaccattctcagtcaatcgtcgtcgtcttcttcttcttcaacgatgcgcgcgagactgggaatttgaaaaggggaacgcagagcagactgattttaatagaagacgatttcatttcagtccctatacttttagtaatatttgggatctcactgcaaacaaactcttaattatttacgaaatttactattagtgtgaattatttcctcttttggcgctaaacttttttagctgtacaagtcacattcaaagtaaagttcaaatatggaatttttttatatgcctagaaatggaatactctttgagaaaagagtacgaatgtattctgctctttaggtaatcaagtacatatgtgaaggaaacataagtttatatccaaaaattggaatcagccaaagccataacaaacaaattaacttaaatctaagaatctgcagactcatctgggctctgaagaatctcacgaatgaagtttatgaaagagcaaagaccacccaagaagttatggtcaatgacaccattaccatcaagaacatgagcaaaatccaccagcttgacttgtggtctagcatcatcatcatttccctttaagatggattcattctcatagaccattaaaatcgaacaagagttgaaatggtagagcgtttggttctcgaaccaggtcttgagttccagcaactgcgttaagatcccgtgggaaccgccgtaaacactcgaggcaaaagcagagtcaggtttcgagccagtgtccgaaagtgagttagatgatacaaacttcctcagagtcaatctcgctccatctacatcgagcccgcgaagaagcttcctctcgggcttccagaaactcgattctttgtgatcatacacttcgaaaccagagatcctgaaacccgatgacacggttgtggtacccgtgtctttcttcaaacatttttggatgtattcttcagatgcatcaggataccatgttctcgaacccatcttaacatccattactgatggttttgtgtattctgcaagaagattttccaacaccatcatggctgctccatcagaaccttcaactgcttgagtgccgtgatacaccgggaaatatctatggatgtgttctggaacctctgtgtttgaggagaaagattcgtagaactttacctcgatttcaccacgagaatcgccctgaagtggcttgaagaaccgacccttgtcatctacgagaggaccaggcttcccgtctttagcaatgtgtcctgcaacctgatgttcagggactttgagctgcatcttgtttaaattatgaaactgaacctgaagaatgagaaattagatacagatagaaaccactcacaaaaccaaagaacacaagcagaaaaccaaaaacatgaagatgttaagagatctgtggttcagtactcaatgagccagtaaaagatcacaatgagtccatcacagccaacaatgccctagtatctaaatgtcatagaaattaacctaaaagccaagaagatcctgagacaagccacaacaacttagggaatagctatcaagtgttacaagaacaactctgcatcaatgaacctgttgtgtaactcaacaacttaggaatagctattgatctgcaaaactatcacaattttcacaacaatcagagctaaatgaaattcagattagttatcataaatctacttacagaattttccaggaatatactaattcagaatcaacaaaccacagatcgagtaccactttcctggttcaccaaaatcaaaatcaaaacttttctggttcatcgcttgaagaagaagaagaagagaaaagaaagaaaatagaaaaagaaaaacaacactgaaaaggaaaatttcctaattttagctattcaattgaagaaaatcacgaaaagttgctttttcgtataaaaggctagaactttagaaaagtacgatcccattaatcaaacgcaacataaagcaacttagatttaagtaaggaaataattgaagaactttcatggtaagagattcaagtaaacagatatacccaaaaagagtagtagaacaaatcttcagggagaaacgatggagaagacgataagaaaggtgtacgattcttcacataattgaaagtttttgtcttttgttactttttcctttgaggcaacgaagcaatctagctggataattatattattctctcttttatttaatttatgtttaattaaaacttaaaagtcagatgcagactgctgaggacgaaaactcaatagagtaaaccggttttaaccatctttaaatcataaacaaaattagtttatcattgagtatttatgtaataatatattttaagtactcgattatcgtctaattaatgatcaatttatccagtttccagttttgcattcgaattgagttcctcctcggagcagcgtcaaagtcaacggccgtctgattcttgtttatctcctaaacccaaaaacaacgatttcactgtcaccgttgtcaagctcgaatcacactagccgagacgatg

SEQ ID NO: 28449 - DNA, 3003 bp, Unknown
  misc_feature (1)..( 3003): 2750-1469P.txt file - cDNA_ID_2996837; gDNA_ID_2926269; Annot_ID_143385
tttgaacactcagcaggtcaccttgttgcttcagtgcctggaatccattcttataagccgtcttatctcacagagtctggttgctcaaataccgtgagtagcttcaccttccatcttctatgcatgcattctctgattagtatcaatatcttgaactcatcttttattggttcacttagttgttttttcttaaagaatattgaaagtttaattgtgtcctgtatattagaaattttggtctatgcatccctttcttgactaattgtatgattattgtttcacagattttcagtgaagaatttctgggatctgttgaagcatctgttgtaggtctcagttaccttttccgctctgccaatgattccacaggagcacaactgaaacgactggcttcatatatccgcagaacccgggaaaattctctcggaatgttagaacttgttttgagaagaaatacgaatgtgcctgctgacccgaatgctgtgagagtccttgttcctaacccagatgatgattcaagagatggtaggtagttacatttcatgtattacagatcgctgtatgttccagacatgaattttcattatgtgactcgtccaaatttccttttgacagattttgtccaactaggctttttgccacggagtattgcaaaatgggtgtctcctttatgggatattggattctttaaatttgtgggatatgtgtatcgggatgaagtccttggagctgcttcttgtaggagcaacgagaaggtgcaactagtgctgcatgtattacaggcagggtactcttcatatgcttatgagatactttgcataaatagagtatggatacatctaaaaatctctcttgaattttgcagggagtgtccatttcagatatgtcaaagttgattcaaccttatcatgttgttgcattgtgctcgttgattgcttcacttcagagatgtactggcatttggaggctacaagaggtaagtttgattattaataaaactaaagaatcatcctttcagacccttgagttataacgagagtatatctgtctctaactgtgttcttctgtattgggtttctgaaaggtgttaggccgttacaagtggcccgaatctcaggaatctgatttcgtctacagtaagttcattgcctatgataatggtaaacaaacaccttaatagggtattaagtttatagtttttctttttcttataataggtgcatcctcgattggaggctcagcaactacaggatttcaagctgatttttcatcagctgcaggtaaaaaagcgttacagcattttgactcccaggagtctgatccagaggtaccatttttttttgaagcacccttaaaaactgttactacaagttttttgcatgaaacgtttggtctgtgttcttcttgatcagtggggatgctggagtaacagggaagaacgggaagctccttccattaaaataatcttccctaccatagaaagagtcaagaatggccatcatggtgtcttgtcttcaagacgtttgctttgcttctctgaggtatttgcttattttacacttgtataatgcccaaagcttttgttcagaaagataaagtaaggattgctttggactgattcaataatgtactggaaattatgaacctcaaactttgtcttttgactatcttgtgcagaaaacctggcaaaagtggagacatagcaatgtgcttcacgatgcagttcctaatcctcaagatagagttggacacccaatgcatatcaaggtaagaacaaaggagagctctgtctgtgacaataaaagatttttcgagttggcgaaacccgactcttccactgtagtaaaatgtctttataaactatgaacaggtggctaggagactctttacctccacgagaggttcacgatcttcttcgtttggttgggtttacagcggctcacataatttcagtgcagctgcctggggacagaccatatccagatcctccagaaacaaccaggaccagtcaaacaatgccatcagagcagttaaaaaacttcgtgtatgtaactatgagctcgggattgtgttcgttttccctccacctcatgaagaaaccgactcatgcgaagggtctaaaattgatgatattgtcttgccttttgttgtaccggctccaaaatatggatggagtgataaaccggctacaggtttggctatgagggaagcttttgctgagtttagggaaggctctacaagtttctgtggagaatcagaagttgaggaagaagtagaagaagaagaggaagaagaagctgatgctgaaggaagaggagagtttgttgcagaagaggagaagcaagaggaagaggcttatgctgaggccttgtggagccaggttgagtcatcctcatcctccctcagctcctgaaactatgtcgtttcggaaaatacccttgtatatgtaactactgttgtttgcaacaaacataaaattttgaaaagtataataagaaatgaaataattcatttcatactctaataaaaaaaaacgaataatgtaatacattgaaggaggacttaataattagaaaaaggttatataattagatacattctttttttaaaaaggttatataattagatatattcgagtggttagaattttttttccctttgtaaacatttgaaacttaagaaatttctggtcaataaaatgtaaagttgaaaaagtaatagaaatattcttagagaaattatagcaggatggaaaaatggatcaccacaaacaataatagcaaacgaaaacgaaattcaaaaaaattcaggtctctgaaacaatatatatacccatagccatctttccatcaaatcatccagaaaaaacaaaaaaaaacaaaaaaataataaaacaaaaaaatatcttttttttttctaataaaaaaaaaataataaataaatatgagatacacaaatgtgtccattttattaggcatgttggtgatctttgtttcaccaatg

SEQ ID NO: 28450 - DNA, 3003 bp, Unknown; identical to SEQ ID NO: 28449
  misc_feature (1)..( 3003): 2750-1469P.txt file - cDNA_ID_2996837; gDNA_ID_2926269; Annot_ID_205044

SEQ ID NO: 28451 - DNA, 3000 bp, Unknown
  misc_feature (1)..( 3000): 2750-1469P.txt file - cDNA_ID_2996841; gDNA_ID_2926269; Annot_ID_143391
tgagtcacatggtttgctagaaggcgggacgacgtaacagtcaggtacatacggtaaactcctctcttgtgcagaattccccattttgaatgtgcttgaatcctcacctttctccattattggtatttgaatttgagtgttgagaaatcggttaatattgtgaagggataactaaaatgaaagtgtgagtggctcctctatatataaggtttgtaggcttgtagtcgtttattgatatttcggagttatatattaaaatatgacggtcgaatactaaattattattcttcctttttggaatatctagagcatgtgtaactgtcaattgtttatcgtgtaccaataagaaactaaactttattatcaaaatgataatataatgaacatccatatgttgtacgaaatgtataagaatgtccaaattcatatatgacgagggatattaataagatgttgggatatagtaggaagtaggaacactaacatggatttaatttttaaatggagacttcgatctcattcatagtcccaactactaaaaaacaaaaagaagctttccgcaaaaaagcatcctcttgtccggatttcaagccttcataaatatgttggacacatatgtgaatgcatgtacagataaattcgatatatatgtcgtttgagttgtaacaattctgtaaaaataataatgaaattgttatatacggtcatgcgtaaggtctaggtaaaatgtattgcgccgggttccttcatgcaatgggcatttatcttcctttgggaaagacaaaaaaatgtctgatgtcacattgtcactgacattaaaatgagaattttcaatcataatttaacacaactagcaattaagaaataatattacatcgatttttcatcgaaatacaactacctagcttctagtgatatacagtattagtactatttttcgttgggtatattagttaatttataaatacgtaatacgtaaataaaagttgcaaacaaaatgttcatcctagaaattatattttaggacaaaaagaattgttttcttgtacatgttttaaaaattcgactatattttaactttttatcccaaaaggctaaaccatatatctagtataatttttcgatcatacatgttctagttctgatgctccaacaactataaaaagtgttacaagggaaattctctggacgcatattattaggtaggtttggtaaagagaaacactcaggattagtcgaggagttatggttcaacaccccttcaatgccaattccaagccctctgcaagtattttcgagaaaaggaaaagtacataacaactaatatcaccattccacaagatcatatataaatacaagcattatttactggccattaaaatcttccctatatttgtatgttgtgcaatcaagaacaaaaaataaatatgaattactgcttcaatatctccatcaagatttaaccattttagggttgtggactttaactaacagcatatgaatcatatgaattgtgaaacacgaaaaatttgttaagaacaaaaaaaaggctatagggaacaaagcagatcatatatgttgtggtggttgtgaagttaggttatccaccaatgagcaaccttaacctatgccttatataaaaacatatatatttccataattccattcacacatatgcatatagacaactatagcaatacaagaaaattaaacgcaatttattgagaaaatacaaacagcgtgcactatgaagaagacgtcgaagatacaatttcttttcaatctctgcatcatatttggggttgtagtaataagaagatgtaacgcaacgacatactttgtaggagacagctccggttgggacataagctccgatctcgagtcttggacttcaggcaagcgattctctcctggtgatgttctaagtaagtatctttgatcatgttggcttcatccaactatatatatactacataattaaaaactcaaattaatttacagtttcccttaatgaactaattagtctaattaattatgtgtataatgtttttgcaagtgttccaatactcatcgacgcatagtgtatacgaagtggctaaagacaactaccaaaattgcaacacaacagatgcgatccggacgttcacaaacgggaacacgaccgttgctctttccaaaccgggaaaccggttctttgtatgcggtaataggctccattgcttcgccggtatgaggttactagtcaatgttgaaggcaatggcccatctcaggctcccgtgggatctccccaagccgccacttcagggattcttcaaccatcttctaaaaagaataaccctgcgaccggagtcgctagctcagccgcccgttttgttggcgacagcggttggaggggtaccatgggaatttttgtatattttatggtttttgcttttccattcatatggttttgctgattaaaaactatctataataagtgttttcatgtatatgtgtattcatatttgccctataatgagtgagagtatttatttgttgaatttctttatttttgtttgagttcatgaccaaattaaaacctaaatttttggttcgttatacaaatttcgttttgtttgctcagcaaatttcttacaaaaatgacatgtaaacaacgttatgcttaaagttattaatcaatcaatgtataataaaaaaaaaggaattagattctttgactacattgaatttgtatttgttcgattcgatagcggaaaattcaaaaaataaccgatatcggtttatattttaggtaattttatctggttcggtgtagtaaattcaccgtttgaccgtatctatatcacagatgattcactgcgattaaaagttgtggttatcactatctaatcgtgatcgctaccaaaacgcaaacgctagttaccggaagacacgtcttgagtttcgcagcatctctctcctctcctctgttcatatctctctttagaaatttctcaatg

SEQ ID NO: 28452 - DNA, 3000 bp, Unknown; identical to SEQ ID NO: 28451
  misc_feature (1)..( 3000): 2750-1469P.txt file - cDNA_ID_2996841; gDNA_ID_2926269; Annot_ID_205050

SEQ ID NO: 28453 - DNA, 3000 bp, Unknown
  misc_feature (1)..( 3000): 2750-1469P.txt file - cDNA_ID_2996855; gDNA_ID_2926269; Annot_ID_143397
atatagaaaattatcttaaacaatacatgaaacgttaacgccacacaaaagaagaagcaaatcaggcgtgactttttttttgtttttgttttttgtttgtgttgtgtgtgcacaatttggcgtgagttaacgtagatctctatttacttcccatcgttttgcatggagcatgcatgtgtaccgtaccgtgcacgtacaccacacaactcttttcataaaagccctctatctttcaacaaacatccgattagagtagcaacaatagagatcaaacgtaactcacaaaatgctctcgtttcttatcccagttgtacagttttttcaggtggttatcgctgccgtagcatctgtagtcttcttagtgttcgccggtataaccttcggtgcctcaattgtgggactaaccatagccacaccgctttttgtcatcttcagtccgattctcgtaccagccactatagccactactttcctagtcggaggggctaccgctgcagttgccctaggagtgacggcatttgctctcatactttggctctttaagtaaaatttatttattcaatttactattattttttccatgactaaagttttttgaaaaccctattcaaaccctcgaggtgcacatctcatatatccactatttatcaaacgtcttacatatcatatattataaggcatgtgtgcatctacaacgaacctgcataatgcatgttttattggttctaatgttgaataatggatgttttcagcacacaaaaaaaatctaaatagtttcatgtacacttgtgtgtgtgatgtagacataggattggagtaaaaccgaagaacaatccagctccgaaaggagccccaaccaaagcagatcaaccgggagcgtcgggaggagcgtctggagataaaccgggagaaatgtcaggagcaggaggaccgtcgggagataaaccaggaggagcgtctggaggaggagataaaccgggaggagcgtcgggaggaggacctggaggagcgtcgggaggagcgtcgggaggagcgtcgggaggagcgtcgggaggagcgtcgggaggagcgtcgggaggaggacctggaggagcgtcgggaggaggacctggaggagcgtcgggaggaggacctggaggagcgtcgggaggagcttcgggagataaaccggaaggagcaccgggagataaacccgggggagcatgggggggtaaaccggggaaaaagccaggacataaaccggagggagcgcgaggaggtaaacggcttgcgtggtggtaaggatgatcatatggagcaacttgaaacttaattattaggtttcataaattaaacctcatgtatccatctctttttagtaaatattaattaccgtagaagaaactacatgtttcaaatatcatttctattaatgtatagcatggtacaaagaaattaactatgaaacaatgctttgtttaaatgaagtaattaatcggtactatagcgtatatacatagaatggatccagtttaaccaaagcaactgtatgtgactatgtgaatgattcaatcgtgagacattgaaattgtcgtttctccattacctttttggaagaaaaaccatcgaaagctagctaagactttttttattaaacgaacttgctactatttctatgttttctttaaaatgaaaattaaatttgttactgtttcacctaaaactcaaaagtattgctttttaattttattattaaaaaaaaactaatcttatttatgttaagaaacctgtcaatttttcattgttaatttcggctctataattattaattaacaatcaatttctcaaaaattgcaatcatgattatgattagatatatattagttggattgtgatgcattttttgtaatataaaatggatgtttgtattagtttctcactcatgtaattaaacaccaaatgctagaaactagtacttttgtttctcagctctcgtctattgttatatctgcaacacgaacaaaaaccttatctaggtgttatatatcacggttatgtttatgagttagaagggattcttcaacaaaaatcacggaactacttgtatatatgtatgtgtgtatccgatcgaggttgacttccggggttggacgttgaagaagacgaattcattgattgggcttatatatgggcatgtattacttggttcaagtttgtaacacttttagctttttcaattctattcgaaaccaaaatattgggctatatatcttcatacaaccttcaagataaattggaccaattttagaagagcaaattgaacccggccgttagcgttagccaaaccccaactccttttcagtacaattaaatcaagaatttctaataaatcgtgaatttctagacatacatatcataatttcgtcaaagcgagcctacacctagttttgagctacataactcttttttttttttttttttatgattaggaggtttcaaaacccttggacccataatttcttataattagttttgtaatactaaattcaccattgagagcgacctctcgtcactagtaattcgaagatctcatattcatgacctatattaaccatcttccagtcaagtaatttcaatcgaaattcatcaaaatcatatatttaacttagtaatcacatatgatatggctaatatacgtaatataacgataaagatttcttcacgctttgatattccataaagcaatggaaatatggaatggaagaaaacatttgaattttacaagaaacaataaatagaaggcctacaaaacatgacaacccacacacacacacacgaaaagagaaaatataaagaaggacatgtaacgtgacgtagcgtagatctccattcactccaatcgttttgcatggagcatgcatgtgtgtgtaccgtgcacgtagtagagaccacacaactccttcataaaagccctctctctcttaccatcaccaaaacacaacaatccgatcagaaaatatg

SEQ ID NO: 28454 - DNA, 3000 bp, Unknown
  misc_feature (1)..( 3000): 2750-1469P.txt file - cDNA_ID_2996865; gDNA_ID_2926270; Annot_ID_143408
gaaaaggttgagaggcgtggcctttggtgacattgcatggggcatgaaatgacttagcctttgaatcaaaccacaaaaaagctttatcccttttgtgtttgaaaacaaaaggttttaaaatgataacatcaaagtcctgttactataaaggaacgatacaccaaaatagaattatgtaaaactgtttgagcttggatgtctacacaaacaataactctttgattttatttcatttttgaatgggttgttcattttttttttcgcttacgtgactatgccatttaattattttattttccatacattagagtgaagttatactttgtagtagatggtagaaccgtagaaaaatgttagctaatgttgcagactatatctattccaataaacttttgaacttagaactaaatcactaatatatacataacaatatgtatacgtgtgtactaagaaataatattcatggggccaagtaagggaaaagacaaaatctcagatacaaataaagcaaagattccttttgtttatttccaagatcatttactgaaaacagaaatgagaaaaagagttggctaagtgatcgatcgtttgtacatcatgatcctaaggttggataaagatttttactcaaaatgatgtttgttttgctaaattgatcaatacatgagttgggatgcggagttgatgtttgtaattaattgtcaccaaatttgcaaaattacaatttgacataacaaccgagttggaaacaaatctttatacatgacaaaaaagggttacacattttttgtatacattgtagtccacatatgaaaaaaatatatatatagccgtagacgtaacagtatcgatcgcttgatcatcaaattttttatgcgagtatttgttgttttatgtataaatttggacatgcatattggaagaaaggtgcctttaggcaggcttattgggacaagtaaattttgaggcatattgtgaagttgagtggaagagttatcattccaatgttgtaaaagaaacaaaactttctctctctttctgcattgcatgtcccctttatttacaaccacctctttcctcttcacgtcttaacgaatatattctactttacaacttaaatacatagagagatacaccgatacatgtgcattcatagaatattatcaactctctcgttcaatggtcaaatcaaatttctgtatcaacttacttcttttgattccaagtatttttcatgtttttaagttgcggcccacgcgggattctctctctctctctttttttttatctatacaaaactccactaaattaggtatatattcattctctgacatatgtagattaaagttgatcgcaatattttctattttaatttctcttgttattatattatgctgaaccacacacacacacacatgtatacgtttacaaataatgactgcctaaataagtgaacaatcaaatcaaagcactagaaatgtcatatgtatatgatgtggctaagtcatggtaattcgtcaaacaacaacaaaccaacaatatgcatactgttgtgttcacttcgttgatatttgtttaacaatacattttttcttttgataaatttattactaaaaggatgaaaaatggttacacaaatggactcaaatatttgttgtaatgctcatgtaaaacacaaaacctcccacatacaaaattataaagaggagacaaccaaaatagaaaattaacccgagtaattatgaattgtgacttccaaagagatcttgccgtagcttctgctgctaccttagtggctcctttagctaattaaccctctgctacaacggtaaattgttgacgatgatattcatataatagcaacattgatagtatttacatatattttttcatgtctaaagttggatatggtaactcaaaattgcactgaaataaatcattattttggtccaatttttatacttatcttttcgacaattcatggtttgcatatcattggatgccgtctatttttttacaatgacttaccctataatgtcttaagtatctttttattttgttttatataatatatatacagagagaatatttggaagacataaaagacaagaaacgaactaagacagaaaaccataagctaaaattattctttggttgttgttttcgcatggagcctataacacagagagtgtccatccagaatcgcaatcatgaccatctgccacttccatcctattttaaatttgatacatatcttgcttttccagtacacgttattttgttttctactccaagaaaatgctcagattataaaaaatataaaactaaaaatatgtaagccttcgttcaaggtggtaaattggtttcgactgaaacatggtctcactttttccgttcctaaacccgaaacaaagttcagaatcacacggttaaattaaagtccaaaataagctagataataaattaattttaggtcaaaccagaaagtgtaaattcgaatagcaagatattgaaatgaaaataattaattgttacaaaatcacgaataccaatagaattttcatttcaaatgaaatcctaactcgtcttattgctcatgctcatgtctttgaagttttacctttagacaatatctaagtaggtttaagtacgaaaaaacctaatgccataacattcaaatcaaacccacaaaataaaatcaatgccactgatttgataagtgaaaacaaaataagaaaatcttacaaaaagtattatggtttattaatacgttaacgtggtccacctgaattgaggccatcatgtaatgccgtccagtttggataaatcaattaatttcgaaggtatacaacatgaatctcgtgtttacctatctaacaatataacgaatttattttcttgggagaaactctttaccaagttttgttactgaatcggttcaaagaaatacaaattttggaaattaacgacccaatttcagacggcccatgtaatatcatg

SEQ ID NO: 28455 - DNA, 3003 bp, Unknown
  misc_feature (1)..( 3003): 2750-1469P.txt file - cDNA_ID_2996873; gDNA_ID_2926270; Annot_ID_143410
agggagccatgtatatgtacatgatatcctttttaagttagtgatgcgatgcatgcaaaccatttttaatatatatatatatatatatatatatatatatatatgcatatccgactacgactgctatggtccctatttaaaataaaataaaataattggttatataattttgtggatccgttaataattatatataaatattaagatgttgatacgtgtgataaaacaccactttcataagctaattattgtattatgctaacaaaaagaataatgataatgtataacaaccgtcaaccgtagagagtattttatttgatatgttttagataattaatacaaggtatctaacaacatcgactacattattagaaaaattatattcccactaagaaataaataaataaataaatatatatatatatatatatatatatatatatatatatatatttggagttaaaatgcattttggatcgcaaaccttagtcagcaaaacgtaaagagaagacgtgcatgagatgatggtgaagttttcatggggtagtgtctccattgagtttcctccgtttagaattcaactttatttgctgtcaaaaaaatatatcaaccttatttttaatattcaaccttttttatgcacaatatctaaattagttttttttttccgttctaagacaagcaaataaattacaagagtgattttgttcaaaaaataataattacaagagtgagaagagaaggctaaatagtcataggagaatactcagaaatacgacgacagaacataaaagtccatttggaagattcattggaaaatacattacgggtagaaaaaagggtaggccacgaaaatgattaagatttggaaatcgtgggtaccattcaaatatatgagcaagtaaattattatgcgaatatgtattgcatagttttcttttaacttattatatgtgaaataagtggtggtgtcattgttggtgttgtttgctccttctttaaaaagcatagtgtttagaaaatcaggaatctcttgcaagtaaagtagagatgacataattacggcattgcgtagccaccatgacacgtggctttttccactccgtcacacctacgatgcaatgatctcattaaacccattttattccaatattatcacattcattcatttattcataccaagaaagaaaaactctcttatattaacatatgttagtgggtacataggactaatactaatagtgtttaattttttcgtaaaatgaaaagcaggtagagataagatgcagagggcaagaactggagccagtgttgacactacaacacgtgagagatgctatatggagaggaagcagagacacttcttctctttcacaaaacattactttgcttccaaactcatctacctctgatcatctcatggtcctccattatggtaggactatttcttaactattttatactctattttatttattatttttatataacaccatattctcaataaaaataactgcccaccatttcttcttctaccttttttaaagaaactcaacatcccaccttcttcaattgtttttcccagcttctttttattttttttggtgggtggtctcgattatttattttcacttaaggcttttccttggtgcgatttgtccaatgagcaagaacgaaagagtatctaattctgtaggagtgcataccccgattgatgtcttttattcttgtatcttctggggttgcgagtaatgttaacgcatgaaaacacatgtattaagtattcatattcattatttttcatgctacatactactattactatttctaggtgactttctttggacataatgctactttaggtaggttcagaatgtttcatgttgtatcgcagaaaatgggcctgatttcggctcaccaaaccaactcaatgaatgtaactgaatttgatctgcgcgctcatattagaagcccattaatatttttcttttgagatcaatgagcccattaaaatatatgtattgatattgatacatttggtaaaataatttataactcgacctagaaaatatgttttactgtaaaatttgacaacaacaaatacacttttggaggatttttttttttaattacatttttggagatttatagagacgaaaggcataataactttgaatgggtatggtttttaaactagtttttggttttagtttgtccgaaaatctattttgtacccattcaagattttgaaaaaacaagttttcctaaaaaatagagaatctagtttttgagtgttttagcaatttttcaaagaaaaccaaaatctatgttttgggagtttctttctcaaaaaccatcgattacattttttatttttgttttagagttttttgttgaaaaatatattatctattgacataaaaactaaaatctaaacaaattaccattcaagtttttaagaaactaaaatctacaccaaaaacaaaaaccaagaaaatcaaaaactaaaaaccaaaatccaaaatccaaaaaccattttagaaactacaaacattcatggcaaaattaggaataattggaagagataccacacaagtaaaatgaaactccaattagataaaaacgagtagatgaaaattaaatttggtgaattcgttgtcgatggagaaattgtcggcaaacaatgatacacatacataaatcataatggattggatcgttgattgagagcacaacaaatgaaaaatactttagatatgtatagttgaaaaatatattttgtaaactaataaaaaattgttctatacgattttatttggtcttaccctcttggtaaagtaactaaagtagactaactcaactctcttctagtcttcttcttcgaactctttttttaagaccaaaaaaaaacacacacaaagagatgtcttttgtctgactccataatcacaccatcaccaagaagaagaagatctaggttttgcatctctcgtcattacaatg

SEQ ID NO: 28456 - DNA, 3000 bp, Unknown
  misc_feature (1)..( 3000): 2750-1469P.txt file - cDNA_ID_2996881; gDNA_ID_2926270; Annot_ID_143414
gcccacagccttcaccgtcattctcttcccctagtgcaactttatcatactcatcttcctctgcctgtgttaagaagcataattcatggaaacaacactcagcatcaaagaaagtgacatcctattcataatacggtatgtgctacatatagttatagcaagaaaaactcaaattcaagaatcttaaagctggttacataggttgatgattcacgtacaaaaactctataagtcacacaaaccaatatgatactacattaaaaattcaatgctcttctcatatgaatctaccaaatccaagagaaaagaccaacactgttccctaatttcaattagctaagcaatgagaaacaatcgttaagagaccaaaattgatttacctcgtcatcgagagtgcgatcaaggcccatggaggctctgatactccacacaccatcaaaatcctcgccgcaatcaatatctttgagatcatcctcggaaggcttctgctgttttaagagctcgtcaaaggatgaagcacaaggaatctcgtctctatcgtacgaatctcgcttccactcccgcttctctacctctgtgtcggagagagtccacaccgaccccgattgctgccgcgacgccggagcagaagacgacgtggaaaacttggaagacgaaggacgagagaagggtagagatccgaagatcttcgcaacgcgagactggaaatcttcgtcggctgatccagacgatgccattgtgaagctattagaaattgaaacacacacaaatcgattgctgtgaataaacgaagaacgaacaaaataatagaccgcctttcgtgtgatcctataacaaaacaaattttaaatgggcattttataatgggcctggcttaatggaatttcctacttcttggcccaatatcggcctactagtcactgttacctctatacagtttttaatttttttttggttgtgtgctaaagtggattttagtatccgtaggccgtttgaggtcaataaggaaatgaaagatgcgacagtctaaaaaggaaaagagagatctaagttacattagattgatagccatatgtcggaaatcatttgagagagaaaacatacgataaatgttgtgagaaagatgaaagaaaattgatgtgagaaaatctgattagaagaccatattaaatgttggttaatagtaatacataatgttcattattatgtttttaattgcagatgtcttagttttaccagttgaacaaagatcttaacctagatttaagacgattatcgttatgattaaacaatattgaactagctggacaagactcaagagatcatacatttcattaaacaataaggattttgaaaccaagaaaatgtattttaataatcatatgcgactgtaaagtctgcaaaagaaagtaagatcatcgtgtccattttttccaaatttctcccacttttctttttgctttaacaatttttttccaaaagaaagtaatcataagtgttcaattttttatatttaaagatattttcatataaaataaaataaacatgtcttaaaaggaatcatttataccccactggcctctctgtctctccggaacaaaagataatggagaagcaaccagataacgggtcccactctcccctctctattaatactctcgagagaatcgcgtttactacacgcgcctcctaatttccagcctctttaatactacacgggctttaaaggcgcgtggatatagtggattttagccagagtccttgttttctcagatgaccactgttacagaaaaagcacagtcagtcctctctttaaaaaatttacacttgaaacgacgtcgtatcttaccaaccttcacgatctccggcggtaactaaaacggcatagtttcgccgtcttttgtggttaaaattttcacaaagacggtgaagttttttttcttcctttctttgatttgtctgtctcttctcttctcccgagacacttcatctaaaaaacacacccccactgttttcttgttttgttctctctcgatttcgcgagaaaaaaacaccagctcaaaattacgcttggctcgagactttgaagatcatcggtttctgtttctgttggatatttcggggaagctttgggaggagaggatctcacgtttttgttcgtttatggcgtctgtgtgagacatagtggtggttctagcttttaggtttttggtgtgtgtgttcgtgttatgttaattgctgtttgtgtcgaagaagaggaagtaataaattagctcaaaatgcatttcactaagcttgatgactctcccatgttccgcaaacaggtttgtttctactacatatctttggttcctgtctatgtgtgcttgtcttgatgtgtccagtcttttagtgtcgtaggttaaaattgggtcatattaggcgagatttgttcttcaaaagttgtcaacagatactaattttggagccattaggatgtgttgtgtctggaattttgaatgtccaccgacatttatattccaaaatgtgagtggaacttcactggaaggttcgaattaatgtgtcactaagaaattggtttatctggacggcctattcgcgctttaacttgttgctccatgaaatgtgaaatgacttatgatccagtgcacttgtttgggtctctgattcgtgtgtttaggatacatttgtgtccacttagctactactttcatgctcactggtttagtaggacttctgctatctaactcaacttaaatgctaaggaagttcctagtgtagctcaaattctgtccaacaactgctctgtttgcctgaagttgatgattcttttgcccctatatagagtgcctgaatcactcaatctttggggttatccatagttgcagtttcttccataattggattgtgtctttactgttttctttgcgtttatgtatttttccttccgcagctgcgttcttacattgatatctttttcttaaatagttacaaagcatg

SEQ ID NO: 28457 - DNA, 3000 bp, Unknown
  misc_feature (1)..( 3000): 2750-1469P.txt file - cDNA_ID_2996885; gDNA_ID_2926270; Annot_ID_143418
tttttagattatgatatggaagactaatttagtaattaaaaaaatcaagaaaagttttctaaactatctgctgccctcaagtaaaaaaaagagaaaatgacggggttttatccccacggcggagtttcctgactaagaaactcggaaacaacgttggcctccaatatcttgacggcttcttcagtcttcaccgacctcggcgtcttgtactgactcacagaagagcctcgagacagaaagaaattcatgagttcgtcgaaggcgccaggcttaacaaccttaatctcaagaggtccaatgttcttatcttttcttcgttcttgtctatagagagggtccagatacttctcaacggtgaagcaacattcttccataacatcgcggttaggttcgagcttggcgtccttgactttgctcccaagttcccaatagagcacatagtgtcctacaaacgaggacgaatccacacggctagtgaactccattagcatcaggtcatgtggctcgagcaggagctttgcgtttgtcactgccttaaggaggtcttcttcgtatgtattggccatgtggaggctcagaacaactttctgtcttcccacgaaacggaaatgtggtgaattgttgtagaaaccagtaactcttaaaagatcacccacacggtacctatacagacctgtcaaaccatatggagatcttgagagagacattttttgttacacattaagaaaacaattaaaatgattattttgtctttctatcattttctctaagcaaagactctgcaacaaatacttaccagaaaacgttgtgacgacaggttcataatcatggccaattttaacatcgacaagatcgacgaccacatggttctctatgggatcaagaccagcttcttgttggtctttcttgacctctaagaactcgaagtacgccatagatgggatgatggtgtacgacacatcgctaggcttgcacagaggattgacattgacacccatgaaacattcagagctgccataccacgatgaaatcaacggaagaccaccgccatagaattccagcaacggaatgtactgtgccatggagcctgtaacgacggcttcgacgcattttgcttttggccaaagtctcttcactattgcctcccatgaggttttactgcattcttgctcgataaggctcgctaggtccggatttggagcggtgaggaacttactaatccctgagacacattgagggtctgtgatccagtcactgagacggccagtccttatgtttgagcataactcttgccaatgaccttccaagtacttgattactctgatgaagacagaagcaaagggtgcaccgaggcgagctacattatctcgttgtagaagcccacaaagcaattgacagtacatgctctgagtagtgtcttcacaagtagaaatttcatgcgggcttatctgtaatctatccctgcaagtaatataacaaacacgaaaaacaaacagtagtaagcaccaatgagcatgttcacaaaaaagtgaattgtgtaatgtaacgtggggaaaaagtttttgttaatttaccaaagagatgagttggttttgtttacgcttttcaaaatacaagttatcatagtcctgatcagtatcccagaggcagtctctctttcagggttcacgaaatagaacgtgagagactttccttctctaatcccctcgacgtacctgcaattacaatgaatgtttcttttggtatcacatcaataaaacaaacccacgttggagtttagaaatatttacttatagagtaaagatctatagagagatccaaacataatcctctgttccccatcctctgttgtcaaaggaatcaaattttgaattcctgctgtagtaccagagctgcaaaacatttaacttccgttatatattcttcacttcaattttaatgtacatcattaaagattaacgactcaagtatcaacaagtttcaaaccaaatttcctatattaatcttttttgtaaacaagtggacggacttatgaaactccatgtgcatgtgtgtcaatctcattttatgatatataagccaagattccaagtctcttctggaaattctctaatctataaatttgtctatatccctccagatcttgcatatacaaagctttgaaattattttggttatcctgcacagatccaaaaaaaaaggcggatcgttttgaaggcacctcatcacaagtaaactgatgggtcgatcacagatgagatcagacgcctctccattagcgatacgattgatgtaaggcttaatatcttcataggtcacaatgggtacgttcttcttgaaggtttgcttatcaacttgaccgttgaggaaacctttaagatactcggtatgagcattacgtgaaagtactgcttccaagatggaatcttgaatctgcgttacgttggtggtcacatcctcaagaagagacaggctagcttttgggtctgttagatcaaactttggcaacatgcttgcttttgattgtctgccaacaacaaaaaaaaaaaaccttctaagtcgtatcacgaaattgtttacaaaagagtgaagagcaagcaaacctttgttctggcgaggtggatggatgagctttggcctgtgtctttctatgcttgaaagctttgtaaggagagattagaaaaagcagtcagtcaaatggtgtggtgtgacgatatgttcgttgccgtatgatttgttcttatttccataaatagaattaactgacaaagcataagtaaagaaaatcccatttttagaaagataaatttattcattaaccctaattaattaggataatttttttttgaattaaaccgcaaacaaggtcggttcaacttgcgtctgtccggttaacaaaatattgaaccgatcgataaatcgtacgagagcagtcgcataaaaaagctccgaaagagagaaatcaatttgaccaatcaaataattgcggtggtgaaaatg

SEQ ID NO: 28458 - DNA, 3000 bp, Unknown
  misc_feature (1)..( 3000): 2750-1469P.txt file - cDNA_ID_2996896; gDNA_ID_2926144; Annot_ID_197639
tgaggatgtcggtgtctatatatcttcgggtgaaatggttagtagatatcctttgactgttgacgtcatcactccaccggaattgcccgaggaattgtcgagagtggaggtcgtcaataaaagttctattggtaagaactatgatggtttgggttcaaatgaggatgaaatgagagataatgcaaccattgtgataggcgaattggacggacaaggaacagaactaaatggggcaatagtggtggttgatgatactcaagatcatgagattggatcacgtgatgatagggatgatgatgataggggtgatgaatacgttgagccaccgcctgatgtagaatctagtcagtttaagaaagaatgggaagacggtatcggtttgactttgcgacaagaatttccaagtagggcagcattgcaggaagtggtggacaaaggtgcatttgctaacagttttgattatgttattaaaaagtctgataaggagcggtatgttctaacgtgttcaaaagcgaattgtgactggcgtatacaagcttcatgtgttcaagatacaagtatttactctattagaaggtacaacaagatgcatagttgtacccggattagtaagagtagtacaaggatgaggaagaggaaaggtacccctgaattagtagcagctcttcttcatgatacgtttcctggactgttggaaactccacctcctaaggttatcatggagcttgttcagactaaattaggtgtgaaggtatcatactccaccgcattgagagggaaaagacaagccgtttgtgatttaaaaggtagcgcggaagatagctacaaggatatcaattgctatttgtacatgttgaagaaggtaaatgatggtacagtaacatatatgaagttggatgagagcgggaaattccaatacctattcatagctttgggagctagcattgaaggctttcaagcgatgaggaaagtgataattgtggatgcaacacatttgaagaacggatatggtggtgttctagtctttgcctcagctcgagatccaaatcgtcatcattatatcatagcggttggcgtactcgacggtgagaatgatgctagttggggatggttctttgagaagctgctaagtgttgtacccgatactccagaattggtatttatgagtgacagaaattcaagcctcatcaagggcatacgtaatgcgtatactgcggctcatcacgggtattgtgtttggcatttatcccaaaatgtcaaagctcattccactaacatcaacagagacgtactcgcttggagattcatggagttaagtcggatttatacctggtcagaatttgagagggagtatagagtattcaaggtgagatatcctaccgcggtgaattatttggaggattcaaccgtgaaagaaaaatggggtaggtgttgttttccgggggaacgatacaatttggacaccagcaactgtgtggaatagttgaattctgtttttctcaatgcaaggaagtattctttaatacccatgctagatgcgatcatggccaaaatttctttttggttcaataacatcgcaaagatgccgcttcaggatctgttgataataagtttgtgcctttagtggagaactacttgcataatttatgggtggatgctgagaaactaaaagtaacagagctaaacacattccggctcgagtacaatgtccggggagttgaagggaacgaatatttggtcaacttgcacttcaaaacttgcagttgcaaggtgtttgatatccaaaagtatccatgtattcatgcgttagccgctttcattgtattcgatagcgatacaacaagaactcgaggtatggaattacatgaattggtttctaagtattattgggcggaattgtgggcattggcgtattatgggactatttatttagttccgggtagatcacagtgggatatcccggatgatatcaaagcgttgaaggtattacctctgcctcggaaaaagaagaagggcagaacaaaagtgcttaggattccatccactggagaaagacgtccaaaacgtcaaaggactcagaacaaaaggaggccgagacagtctctgcaatggttgttatttggcacccgtagtatttgattttaatcatgtaaaccttattcgcgttgtgtgcaactatgtaacactacactttcgttctgtaaaactatattttatttcactcggaattcaagtttaacgataatactaagaaaacaggtgaaaactatgatttgacgataatactgggaatacaagaaaaactatgaatgatatgaaaattcgaatttatgtttgtttgaaacatcaaatattaaatagactgtaaagagataaagaactcttaaaaattaatttaaacgaattaaataaagaggaaaaatatttgttgaaaatacatgttaatagactctatcctacatattccttgtacttttaagctcacttttgatataaattccaacttaggattgaaattttgcaattttatatattgttaacatgtgagtgcactaaacatttagaatttaatagtgatagacttctctcaactgaacaactagataaatcattttgaatgatatgtaaaactgtttaaactataaaacaagaaaatacaactacgtggacattttgtacaaccaataattagggtacaactgcatataaaaaaacggcgcacgtgtataaattacggcgcacacgtggaaatcaccttattctccaaaaaaattaatttctctccaatttcaatttccccccaaatccattaaaatttcccaccaaaaccaaattccccccaaaaccaaacaaatatctcttctctctctcactcaaaattcattctctctcttcaaatcattctctctctccgtctcaaaatcattctctctctcgatctcaaaatcatttctccattctctctctctctcaaaattccttctctctcaatcagctatg

SEQ ID NO: 28459 - DNA, 3000 bp, Unknown
  misc_feature (1)..( 3000): 2750-1469P.txt file - cDNA_ID_2996896; gDNA_ID_2926271; Annot_ID_143422
ggtgctatcaaagggtttgtgatttcctcaaatttatgacaagtaaatttaaaggttaactaaaaagtttttagtaaaaacccatgttttttttacagatttgcttacattgatctaaaagaaggcgcaaataaggcattggaacttaatggtagtgacatggcaggaaaggaacttgtagttaagacggctctactaatgagagattcataccttggctattcttgtaatggaggtattggcggccgttttggtggacgttttggcagtgttggaggtatatttggtggtggtcgttgtggaggtcttggccagtattatgcacaagtatagactaagtatataccgagactataccgagcccttagactttgtggtggtcgttatgacatagtcactatctattcatacttgtgcttaattagatgaataaaccgggactataccgagcccttaatcacttctattatgtacaagtatagactaagtatatacaagctaatagccagtgtcgccgctgttgaggcttttttggtggtcgaggacaacagacttagttttaatcccttagacttagtgcatgcaagaagaccacaaatagatagtgactatgtcatagcaaaatttactattgattcttatgtgactaacttgtgcatacggaacaacgaaattgccatggaaaagcaaagatttttggtttttcattttcgtggctatttattgagtagatcgtggtttagtataaattaacaacaaattttagtggtaaggacgtggctatacgaatttctattactatttttaaattttcttttatgagtggcttttattaaatctaaaaaaggtgcaaagaaggcattggaacttaatgaaagtgacatgacaggatagtaacttatagtgacatgttttgtcaatgtttgtggaactatttcagggtgtctgttgtgcgagttttattgcgatcaaataactctaagaaataaacttcacaaaggaacctcgtgatcactatcatgtagtactataaaccaatcaattgacgtctacaccagttctagtttgggccttctggccgaaggaagagcaattgtagtcactgactccatgaaccaacatgcgcaccataaaaccagaacttggtggtaacattttagatgtgtaactaagtggtacgttttcataaaaagaggagtcatcttgtaagtctaggttagatattgattcttctctagtgcaaaatttactaaatcacgccatttggctagtcgaaatagttctatgttttatgttcattaaaaaaaatcgttgagtgggcaactcgccggttacactcattgttaagagatttgtcaaatggtaaaagtacggaactatagatcatctttggtaatttataaaaaggaaaaaaaaaacatgtataagagtttgagttttttcttacccattatctttaaatttttgttgttttctcaaatttgtagaacctattatttctgtagattttttttttttttttaaatcaaactcggctcaagcagtcgtatggattttgggctttaatggcctttgtaatctctctactgttttgtttgtactttatgatttatcagtcctgggcattcggttatccattcggtttcggttgatgtccattctgttttcggttctttcggttttaaagtttaatatccattcgattattttgaaatttcggttcggtatcagtttggttctggatctttcggttcataatttagtatctatttgattattttgctttaaatattttcgaatattttggttttttttggatattttttggttattttcgagtatttttattattttatttatatattcatgtctttttaattatttattatagaaataactaatatttttgaaaatataattatattttggatattttcgattcgttaccgacaccgattcggttttggtccttttgcttatagaattttatatgtattcggttattttcaaattttcggtttaattcggtttggttcgggtcgatttttttgattcggttttggttcgaattcagtttatttgtcgatgctagtttatctatagaataaagtcctcgccgagaaatcatctcataactccccttatgcaatcaacaagtctctcaactccccttattgtctctatatccctttctcttttaatgagatgtatagagactaaattacccctcctccttctttttataatatctattataaaactaaataattaaaaaaaaactatattgaaaaaaaaaaacagaaaacgatactctctctcctctcctctctctctcctctcctctcctctctctctcgagctcactcatcgctctcttgctcactcatcgtctactctcttgccggaattcgctcaccattgttgccatatccttatcttcggcgagcttcttcgtcatagaaagaaaaggtaagtttttcgagctgaatgaagcttaaaattgaagattagaactaagagattttgtcaattagatttgagattaagcaaattgtgtttgggtatgcacattggaagtttatgcatactttctgggttgaatagatttttaaatgggtaagaaatggtttccaacaactgaatcatagtgaatttcagttttgaacccgaatccattcgatttgagctcttgtcaggaaatacatctggtagaactgcgtagaactgcacatgattcaattaaaaaatatgtgtagtatgacttagttgcaccagtattaaccatttacatgtagtatttatttgggtttagtagtattacccattttcatgtagtatttatttggtacaggagttttacccattttcatgtagtattattagttatacatgtattatacaaataggtgtagtatgactagttatacttgtgttacccagaattgtagtataactagtatatctgacagagtttttgtattgttgttgtaggatacaatg

SEQ ID NO: 28460 - DNA, 3000 bp, Unknown; identical to SEQ ID NO: 28459
  misc_feature (1)..( 3000): 2750-1469P.txt file - cDNA_ID_2996896; gDNA_ID_2926144; Annot_ID_139055

SEQ ID NO: 28461 - DNA, 3000 bp, Unknown; identical to SEQ ID NO: 28458
  misc_feature (1)..( 3000): 2750-1469P.txt file - cDNA_ID_2996896; gDNA_ID_2926271; Annot_ID_205123

SEQ ID NO: 28462 - DNA, 3000 bp, Unknown
  misc_feature (1)..( 3000): 2750-1469P.txt file - cDNA_ID_2996904; gDNA_ID_2926271; Annot_ID_143425
actcgtcatcggtcgtgaattgatgaaccaatccctatcgttacttagccatacaaccaaccaaccccactggtctaagtacaatgatagagattggggatcgtacgattcccttggttcacgatggccgaatcaagctcttggcttattggtccattcgttctccaaacgtacgcccctccggctacatggtggacgattgagccatcggcttatcgaaccatccatgtttccgttccggtcgtttaacactacgaccgcccacggtttactaaccgtttacccgtccggtccatggtggtcgataaagctttcggcttaatgatccatccatgcggtccgaacgatatccttatcacacccaagggtccgtggattcatccactggatcatcgtaggctagcccatgaaatctttcttccgtcggccttaggtttgctcgcgggtccaacatccgttttgtccatcggttcccaccgtggactttcccgttggttatccgtcgagtcaccctttggtcttaccgatctctgatcggtttcaccatggctgaggagatagatacatgaaggcggccgcgatgttgatcctatatggtgaatcacgttccttacccattcttggtgctttctccctttatcggtaagattgcatccatgggcgacccttgggtgtgttcggatgcacttatccttgtgcttcctcgaacacttttctcgatccatcccatccgacgatcggtctgtccgacccgatccgtcagacgatcggcatgtcccatccgacccgtccgacgatcggtctgtccgatccgtctggccgatccgatccgtctgacgatcggtctggccgatctgatccaacgatcggtctaccagatccgattcgtctctaagccgaacggtctaccctctccatcctctacactccatcgaaccgttggatcgggaggtagcatgcgcatcagttcggtcgagttatactcgccgagccgcaccccctttccgaccaacaactctaggatgtgttggaactcctttaagaatgttttatggtgttttgcatgttgtgagatgatgtgagatgccttgggcgtcctcccttatataggaggcgaatggatgcttcccgaagcatcacatccggtccttgcacccttccgaaaggtcacatccgttctttgcatcctttcgaaaggtcacatctgttccttgcatcctttgggcgatgcaaccgttcgttggtacccgctcgaccttacaccttttggccgagacacctcttcacccgtgagctaccacagtcgaccagctcgagtgtcagctgaccggaccacccagctgggtcagtacttgattagctcaccgagctcagtcgagctgtcggtcagctcacctagctgagctagctagttttacagctggtttagctcacctagcttagctagctagttcatccagcttgtccagctcacctagctggttcggcttgaactttctcgttcttcctactaagtattttggtccgttcctcgaccatgatctagttttctcttaaaacaaaccggccttttttatgaacgcgggacgcggtcgttacaagtctaccccccttaaactgaattcgtcctcgaattcggcgggtgagagatcttgtttactccctaacttgggacacgggcgttacaagtctaccccccttaaactgaattcgtcctcgaattcagcggatgtaagatcttgtttactccttaacgttttcccatctttagtctctccgagactttagatatcatatttgatcaaatctctatttccgagcttgatcaagtttcctgatctttgtctcttacgacactcgatcaaattcctgatcctggtcctttcccggactcaatcattattttcgatctttgtcctttcttggccttgatcaatatttcccgatctttgtcctttcttggacttgatcaacgttttccaatctttgtcctttcctggacttgatcaacgttttctgatctttgtctcttccgacattcgatcaaatttccgatcttggtcctttcccggactcgatcattatttcccgatctttgtcctttcctggacttgatcaacgttttctgatctttgtctcttccgacattcgatcaaatttctgatcctggtcctttcccggactcgatcattattctagacttaggtctcttttcgaccttgtcgtttttttcatgatcttggtcaatctccgataagatcaaaaccccagaaatagtcaaatcccgactaagtctgtacccgatcttagtcaagttccgactagatccaaatttcgttgatatcggtccatctccgaatatatcaaccaacttcccgtcatgttaaaagctttgactaaaaggataatatcttggttcccgatcatgagttcggtaacaatttccgtttccaaacacatcgatccctcaacttccttatccgccaaactctcactatgacgttttctcgagcacctatccatcctaggatcaagaatgctctgataccaacttgtgagaccccgtcccggacgtctcggcgtccggcgacgttgtactcaagttcgcgcctcttcccggccgaacctcttaatttttcgctatgcaacatagaattgcctttacgaggctaaaatctataatcgctctcttattacacagcggaagtctttctaaccttggtttaattctaaccaactcttgtaccggtttcatcgtctttgttccttagacatagatcgatcctttactcggtcaagacatgcatatgttcgctaactattctaaggaaaacaatcgcatattcctttatcctactttcacggtcaattaccaaacgtctatcttaactaataagctagatcgttacataccttggtcaatatgcggatttgattccttagcccgtttgtcgccttactccattcgttcaacgactcgtcatcggtcgtgaattgatg

SEQ ID NO: 28463 - DNA, 3000 bp, Unknown; identical to SEQ ID NO: 28462
  misc_feature (1)..( 3000): 2750-1469P.txt file - cDNA_ID_2996904; gDNA_ID_2926144; Annot_ID_139058

SEQ ID NO: 28464 - DNA, 3000 bp, Unknown
  misc_feature (1)..( 3000): 2750-1469P.txt file - cDNA_ID_2996908; gDNA_ID_2926271; Annot_ID_143426
agcactctcagagtaaggaaaacattcctcctcgaaagcaacatctcgggaaacaaaaattctttcagtttgaaaatccatcactaaccatcctttctttcgaaattgatatccaagaaaaagacatcgagcactgcgatcttcaaatttgtcattcgaacgtcttactagctttgcatagcaaaggcacccaaatatccttatatcatcataagaaggaggattctgaaataatacttcgtatggtgttttccctttaagtaggattgaaggcgttcggttgatcaaatgagtagcagcttgattgctttctccccaaaaacgagttggaagctttgcttgaaacaacaatgctcgagcaacattcagtatatgttaatgtttcctctcgactctcccgttttgctgtggtgtatcaacgcatgaagtttgatgtacaataccgttttctgcgaaataagaactcatacacatgaattttgtaccgttttccgttcttattgttttgactttcttgtcaaattgtcgaaaaacccatgccacaaagtttttgagcattgtggataccgatggtttttcaatgagaatttgagtccaaacagctcgcgagaaatcgtctacaatggtgagaaagtaaactgctccacaagtagcttttgttctataaggaccctaaacatcacagtgaattaaagagaagaaatcatctactttatttgaactttctgaaaacgaaacacgagtttgttttggtctgaagcaaacatcacaacattcttctaaagtactaatactatttttgaaaacaccaacatctgaaagaaaagataaaacttttggagaaggatgacccattctcctatgccacaaatcccgagcatcaactgtcctgacacgatttatttgaggaataaccgcaccagcaagatgataaaccccatcacgttcagtgcccgctccaatcaaagtcctcgaagcttggtcctgtatcacacaaaactgtttagtaaatatgacagcactcgcaatgtcatgtaagagttatgacacataaataagtgtaattgacaattcaggggcatagaatacgtgacgaagtatcaattgtcctccgagaattcgtgtgccatatcgggttgcccaagtgaccttgtcatttggcaatttgatagggcaaggatctattttatgaatttatgttagaagattcataccaccagtcatatggtgtgacgctcctgaatcaatgatcacattaaactcactatgagttccatacaaaatcagtttttcactcttaccagagtatccctctttgcttgctccatttgacttcttgcatttctcaatgaatttggccaatgtattcaattgactatcaaagagctgcagaagaccagttgtggacgacgccgacccgcttgttgtcgtagtcatggcaccagaaacatgtgaggcggacaacgaagaactacgaccacgttctctgcctcgcaaggacccgcgacctctaccagatgaacctctccctgcgttttgagatgattcgttccaccattcaggataaccaaaaatcttgtaacattggctcttctcatgacctgtcttttcacagtgagaacatgtcaaggattgttgtttgaagctatccgcaacggacaccgaaaaaccaacgattcctcccttttgttgtggttctcgtgttgcctcaatgtgtctctcttctggaactatttgtgagtaaacgctctccaaatttagttcatgaagtcttgatagcagatttgatggggttgtgccaaatctttgattatcaagtcccattaaggattggtggatgtgaagtccatcttgtttcttcttgtatttcttcatagaagaacagctagaactcccacaacaacagataaatcctttgtctatatctgagatatcatcccaaataatcttcaatcgtccataatattcttctaccgtttgtccatcttgtttgcatacgctgagatcagcgtggagttgatgctctcttgtcccgtcgctaacagagaagcgagatttcaaactactccacatctcagaaacatcttcaactagtgatattgatgatcgtagctttggctccacgctactgtagatccatctgatgatcatcgagttcaccatctcccatcgttctacatcttctccatcaccgtctggtcgcttaatacttccattaaaaaaccctaccttacgcctggttcgcaaggaattcgtcatcaatttggaccatcgttcataattgttcctattcaacagaattggtgtcaacacttggccggtattgtcggttgagctaagatgataaggagacatcaaagctccttcaccacctgaacttccgacgatgagtttcccggagctctttgtgtatttatcttcagttccagtcatgcttgattcacaatctggatttttgtaatatttcaataatcaaagcaatcttcacaggctaaaggtaggctctgatatcatgtaaagtcaaagattgctctgaatatattcagttgtgttattcatattgaaggtggcgatacaaatatatatgtgtacatatcgattttaaacctaatacacaaactaataaggcttcgtacaaaccaatattctaatcatcattgttttcctctaagcccatctctaatacttagcccatgcttttcctcttactaactacctcgttctacacatacacaagtttcctcaaaatatttccatcatcagacatcggtgattgtgagacccaactccatattttagcccatcaaaggttcatcttccctaataacttaaaatctaaacgtgggagtatatattggtgtatgtatcaccttcttcatgaaagccatcaaaaagaaacgcaaaacctaaacttgaaagagatcgtgagccaccgttttgtggttttcatgatgatcaatcatctatggagagatgtgagagagagctgaaccaccaatg

SEQ ID NO: 28465 - DNA, 3000 bp, Unknown; identical to SEQ ID NO: 28464
  misc_feature (1)..( 3000): 2750-1469P.txt file - cDNA_ID_2996908; gDNA_ID_2926144; Annot_ID_139059

SEQ ID NO: 28466 - DNA, 3003 bp, Unknown
  misc_feature (1)..( 3003): 2750-1469P.txt file - cDNA_ID_2996936; gDNA_ID_2926272; Annot_ID_143439
ttgctttccaacatgaataaatgcaatcaaagacatacagaacacgataacaaaagaagcttcaaggaggataacaaacctaactaagcaagtactgagttgatatacctgcatatgaatatggggaatgcacattctgggagtaatgatcgtcctcagtaagcttagccaaaatcaaatcgattgcccgcatctgctcctcgaaggtcccagataatgtcactaacctatcgctcaacccataaaaggtattatccagaggggatatcttaataccagctttagattcctcaatgaatgacctttttgcaaagaaagaaatgtcttgagggttagtgacagcagtacaactgaaatcagtattccttggaaaaaaacataaaagcaatgccatattctagaacttaaaaggaactagatattccatacgcataaactactgcaatctgagtcatatctaatactcagaaactttgttcacctgttatatatagggtcttgacttgtttatgcatgcattcagagaaaataattgctctcttaaagatatgaaccagagaagatttgaacatagaaacaatgcaagaacataaccagatacattatagatgatatttggtggttaagcgtgctgtaggaaatggtgtcaaaggaaacaggctatggattatagaaggtctgaaaacctcaaagaaactgctgcaacaaatacagaacggaaacttacttgatggtggcccctccttttccgattatacctccacaagaactgttaggaaccacaagtctaattcttctcctaggctcaacctcattaccatcttcagcatgaagctagcaaacagatagaaaagttaaaactgatttcattgtgacatactatataaactaaataaacgcaactgtgacatgaaatacaaatttgtcaaaaaagattacctcactgtgcaatttatcaaggataagttccagtccattgacaacttctttgattgatcccgatatcataataattctgtcagtcgtccccgggaaaaactcttgattacgtgaaagctgaatccttgccccagactttgcctgaaattcagtgatggtcgagccacctttcccaatgacggaaccagctgccgcattggatacaagaaaccgaatgtgtgttggcttctcagcagaatctgaaaagaggaaaacacattagatagtcaaatagatagcatggttcactaaaccgcatcagtattgagctaatcattgaattgaaacagcgtaatttaaccatccttggaaaatgaatctatcacacaggaaacattctcacaagttttcatcagcaaaaaaagacattaatcacacatgtccgttgacatatcacagagtacttaaacgagatccgattcacgaatgtgacgaaataccgaaacaattgagtcagagtcgaaggagaaaaaaaaacagaagaccagatcggatcgaaaataccagcttcggaagaatcatgcggttcaggggatctcttagccagctcttccggtgaacctgccgcatatgactcagtagactccattgctgctacagaagataaacggcattaaccaatcgacattatcaattcaatgaagagaaataagaacgaaatcggagagagaggaagagataagactcgttcatcgaaatctgagattgagaaggaaaaattccaaagtttacctgtcttcacacaattcgaatctgctccctccgtcgtcgtcgtcacttggcgccggtggttaaatgaatctgagcaaaactaagtctcaatcgtcgtatcggtgcttcctcggcttcttcgtctttgtcgccgagcggtttgtgaagtgaatgaaggtggctctggtgtccttcgtctatctatccactagcctcccttattctattattttttatttttcctaaatttaattttattgaccgcctctctatttcttttttaatttttttttcctctttcacaatcatctcactttttatttgttaaaatatcaaatcaactcaactacaaaatgtgttaacatcaaaatgtgctacgaaataaaacataattagaaaataaaacaccaaaattatcatttttctacaattttaaagcaatagaatgaacatgataataataaaataaaaatggcaatatgtgtctttttctctctattttctcattttagaatttgattttattgcattggtttgatttattttcatagtttgttagatcttgaattgcagtaaatatatgtttatcaaattgtacggtagagttgacgaagacgatagatacgattaatggtaatgcatgtttatgatttgaatcggtcgatttaataatgtaagttcaatattattataaggtgattttggttttttagcccggcaataatgggaagtggctctttagccaaaataaataatgggaagtggcaacctgtgttttcttcacgactacagattcattggttaaaaccttcaataaaataatcatgttattttgtgaactttaaaattagtaatcaaattcctcacacattattattttcaataattagataactctttttcgcattttcttaattaattttgtactctttaattaggaaaaaaactaattattttaatcaaaaatactgacaagtgttatggatccaaccgagtctggttacatgacattttcatatttacttactcaaattgcgaaggttattcgttgttggcccaatatatacatttcacgggctcttgttgggcttgctttcaatattcagcgtattttaactgtagcgaacgaaacaacgtcagcaggctaacatgcgcagtcgaagcaggtggtgatggtggtgccacctcccaaatcttcgtcgtcccaataatcttatcacgtttctctcactctctctccttcgcttgtgtgtttaagctaagccgttagtcgttaaacatctcatatcctaaaacgccgtcgttttagctatg

SEQ ID NO: 28467 - DNA, 3003 bp, Unknown
  misc_feature (1)..( 3003): 2750-1469P.txt file - cDNA_ID_2996941; gDNA_ID_2926272; Annot_ID_143441
aagccaaaaacaatttaatgttttaatcagaagtcatttgcaacttgtagacacaaacgttaaattttagtcggtgagtacttttgtttgtgattcatgtcaaacgtaaaacataaaagagaaccatgtcaaacgtaaaacataaaagagaaccatctaaatttatcttttgaaacctattatactttgacgaaaaaaaaagccctattatacaattaagcatgagtaaaaaagaagcaaatgttctaagcaacggagaaataatttttcttatcggtccttttacaaacgacagccatatatcatttgtgcgtatctcaaagcaaaagtctcttctctctttgaaaagacaaaatcaagcaactaagcaagtaatgctaacttcacagttacaagacaaaagaagacattcacataacggtgaaacaagaaagattgtgtttgatatgttttcctttaatttcggttaattggaaaatattgtcaagccatgcatagccaaagtaaatgtagtttaagtgaatatcctattcacattgcctgaaattttcaaaacaaaaagatatagacaaaagatcaatgcatatgtgatatgtcgactagctagttatacaaatatcaaaatttactaagttaaagatgcatgattgtatatggatgtcgtaaaatgttaaaaccaaaacgtgcgtttgttccctctcaaacgaaagtttgtgacttcgagaaatattttttttttcagtaaaagacaaaatagtgaagaagatgcaatgcatgagttgagtcatatacatactaaagcgtttctagtttttggagaatttgctaaaaccgtaagcaatgattttcctataaatatctaaaacacaataactttctttgaaataactaatcacagcctatattttgttttctaaacacaatcacaatgtcttatcatgataaacatatataaacgaagaagggaagaagatgagtggatattatagaaagaaaacgtacgtttgtgtaatttatattaagcgatcagtgaaagacgtatgtgactgatgagacctaacatagacccaaaatccatgcaaccttgtctttcgtcccaatgcatttgtacgctttctcatagacattttcttatttgattatatcattgattaaagtataattatagagaatgaaaaaaaaaaatcaactatgccaccatgtgatataatttatttatttttcttgattattgcatgtgagaatattggttggtacgaaaccctcacaaagatcgatccaaattggggaaatatttttagtgtttatataaacataattaacgcaatctctttattttgccactaggaaactgagcattattatacaaaaagtcacattttattttgccactcggactcggttcttatattatataataggttatcttagttttgaaaaaatatggccatgaaggttattaagaattgcctttgcccatttatgataccaatatataattgttttttcttttgtgtgttttagtaccaagatgtaattgtttgctaaagtctatgagaataccaaaccaaaataatttgaggatatcagaaataaacaaaaataataatattgataatgtggtgtgaagtttgagctttccttccctttaaaaacttgaaaggtcaaagatgttgtcatctcacctctctccatttaaaatttcaggatcccaaaccttaacattgctaaaacccaaaaaaaaaaatctaccacacctttctcaggtaggccaatgtttacacctccatttttgttcacaatcttcttcttctgtctgtgaatttcctttattttgattcctcatttacaaactggtacaaaggaaatgaatatctaattaactcttatttgtacatcttctgatccatctctgtcttttcagattttgtatttgttttcccaatagatttgaactttaaaacccaaacaagaagagagatgctttgattttgttacatacaagtgtttgttgcatgaaactagtaattatatattttaagttaatttcactttaaaacatttatgagttatctttattttcttaagtacattgtgcaaacttactaagaaaaacaaatccaacttttttgtttttgggatcattgttttattaaaatcattaaagaatttgtactacatgtcttactcaaatgtggatttggatatggtcttatgcatatctaattaatttataattacagtgacaatttagagattaaaaaacatgacgtgggttgagatgatcatgccacgtgttgtaatcgtagaccagatcctcgcttccttgagactcgccttccttttgcttatttttaattttagcaaaagcgaaaaagtagacaaaattaaaattaaaaatagattattcatttccaaaggaaaactaaaataaataaattaattaattacgagaaaaagacaattaaagagtgattaattaattctctaatctctctctctctctgtctaatggccattgcaccttctctctttgaaaaaaatccaatctttttctactttcattaataaatcaccgattattttgttttctcttcttcttctgcgatccttcattgaatttgatagcccaatttcgtcttataggagcttcatctttcacctttttgttcttaattgtgtttcgccattgacgaagaacacgaagaggtacgtcttttgttaattggaagtggaattttgggttttgattgttcaatttggctgatgattggtatgaataccaggtgagagagatgaattggaggacatttgggtgtgaaattttgaatcttttggatgttgggattttgtgttttctgggatcttctcagaaattctgtggaagatgtgatgtttggttttaggggtttgagaatgattgatggagttactagtatgttgttttgaattatcggaattgacgttaaaaaagggatttttaggttttggcgtgagaggatg

SEQ ID NO: 28468 - DNA, 3000 bp, Unknown
  misc_feature (1)..( 3000): 2750-1469P.txt file - cDNA_ID_2996945; gDNA_ID_2926272; Annot_ID_143443
atcgagcctcggtcgatccgctaaacttaaagatgagtaaaaagaaatcagaatgctatacatgtttaaaaggtacagagagatttacaaacatagagagaaagcaatacctgaagattggccacgcaagtacgaaaagcagacctgagagtatatgcacaagctttctgctcaaactctgctcaccataaaacaatcaaagttattgtttcttccttttcttactttgttaacacaaaggaacggtatatgtttttagcggtaggcgattacggatagttaaaagggaggttaggaaaagtggtaacatataaagcggtaaatatttttggaccactttgttcttgtccgctttaccgattggtcatgataaagtggtatactgcttactaaggtgttaccaattcttataaaaattcagaatgaaaaaactaattcacaacaaaatttcctaggcttatcattgtttctaatgagtactactgcaaacacaacttgagaaacttctttcaacatatagtggtgttcgaataaaactggaattgtaaacggagaaattgtgtggataactaaaacgattattaagagacctgttgaatgacgtttcgcttggtgagactctcgaagcttaagacaagcgcgtatgctccaccaagcactgccacggtggctccgacgtcatgcaacagcgaattcgtcgcaactgctgaagagatcagagaacgacgagcacgtaactgagtagcagagcccattccggtcaaaccaatgaaacaaggagaagaaatcaagaagccaggagaacagaaccggtgagtcgtcaaagagttgttcccgaaccgacacaactgatgattgatcggagatagaggtaaggttgctgccatggacggagggaactgagtttggaggaggaggaagaagaagaagaagaagagaatcttgacaagtcaataagataaggaaaatgatattttgtaatttatctttttttgtttgggtgtttcgttagtaagaactaaaaagacgtaatctatgaggtgtcactttctgattgatcgagaagaatgcaaaaaatctgcctcacattgtaatttcgtctttctttattgggacagttggtcagtttgtactaacctagtggtgggaaatggccaatgagcatggcctattcgggtaattgtgttttttacttttttaccttccgtactttatttttgggtttattgtaaaatccgaccgaccctaattatgacggtgaatctatttttttctcaacctagtatatattctgaaagcttagacgatctacaatattttgaactgagaattgatttttttattgtaaatcgtttttaacaattaaatcgttttgagtttttctgtcactttatctttttcactagttgtagaagacctaacattttagtacttaagaccgttactattcttttggtctgaaattttacattgtataaattaccattcttcaacatggtctgaactctgaactccaatccaagagagataaaacatcattttaaaaaacggattgactatactaacacttggatgaaatttccagttttaaactagctgttctctacattatcatagtatatatcatagaaaatttgtggaacacgacaaaacaatatattatatgatctcaatggtaaaaacaggaaaaaactatcaaatggactacaaaccaactataaatatccgcctttcaattgtatcaaaaattactacccaagatatatttgtaaaaaccatgttatgtccagtgtatatgcaaatatgggtgtaaatgtaaaaagtactgcaattaatttctcaataattgcacgaacgaagataatatctaacaaagtagaaaacaaaaagaaagaagaaaggagtacaaaatcatgtatatgagagctagctataaatatggaccctcaaacataggcgattgacggaggtacagtataatagcataatggagaacgaagggtgcggatgatgaggatgatgatgtgttgttgttacttaacttccatttattctttcatcaaatgacgtctaatcgatttaaattgtctttggtcatgatttgtttgttcttatacattctgagtttgaagaaagttgtatgtaactatatatgtacatgccccattgaagagtcaaaaataaagtagtctgctgcaatgaataacattggcagagaatacagatagttttatttgcattataaatcggttatacaaaataagtaaataattgctcgtttgtaaatattctggtaagtaacagttttatgttttcatttaattttgattgattcgtactcaatcaacacgctagaagtcaatggtttcacactattttctactaattttttcatcaagtttcaattcaaaaataaatgtagatgaaaaatggttacgataaacaacaactatagagtcgaatactccggttatatcgaaccatatagtccagttaaaaattgaaatggctttgcatgaccgcatcgccggttaacactgattattagatagagattagacaaatgacataattagatagagatatacgaaaaggatagtgattccattatcactaatagtgacaattactgctcaagaaagcaagttggacttgagtgataaaacgcgtgaaattattgtcaccgtcctaacaaaaatatattaaattcgaaaaatgtaaatttagtagaattattaaaagtttttgacataaaaattgttcaatctctccaccactgtctccgcttaacagattcgctaactctaaaaagttttacgaaaatcaaattctcaaatctgaatctctttctctctttctcatggtgaagttttgtggcacctgaaactgagagagaagcttcttcttcttcttcgtattgaaacaaaccagtgaagcagagcagtttttcttctttctccatggtgagaaactctctttcgctcgagatcgatgacaatg

SEQ ID NO: 28469 - DNA, 3000 bp, Unknown
  misc_feature (1)..( 3000): 2750-1469P.txt file - cDNA_ID_2996956; gDNA_ID_2926272; Annot_ID_143449
cgttgagaatgtagcgaaagctgtggctaggcttgcgaggaaatgcaacgatcccaagttgaagtgctttgagaattgttttagtgatatgatgaagactggagctgacccttatggttggcagtttgggtggaagaaaatggataagaaagctaagaaaatggaacgtttcatatcatctaatgctagtctctaccaggagactgagattcttgctgatcttgaacagactttcaagagaatgaagagcaatgaatctgctactgacaatcttttggagtatcagaaaaaagttacatggaaaagacacgaagtgaagaatctgcgggatgtgtctctttggaaccgtacttatgactataccgtcattctcttggttagatcagttttcacaatccttagcaggactaaacatgtttttggcattagttacagagtggaagcaagtgatgttagctctgcagattctgattttattggccgcagccactccgtttctactattttaactcctgtatctcataaatctgagtctagtggtcttcctagatttgcttctggcccccttggaagatttaccggtccagcatcgggttcagctgctacaaggtccacgaagatgagtgatttcctttcgggttctctcagcgccgaatcacctaagtcaggtcctcttgttgcagaaaaacacaaacgtttcaagttttactctggtcagcttgggaagatcacctccaaatcaggaccacttatcggaatgggcaaaaacaacaagaagatggggcagaccccggaaaggccttcaatttcctcagtgaaaaagcaattgaaagccaaccgattaacacaggttggcccatttaaaggctgtatggtgtctcacgatgggattacgcctctcagcactagggcccggaatggagctaggaatagtagtgctgagcatcacattcttgaagataattctaactctgttcacgttgaaaacttgacacttccttcccgacccaagctgtcagatgctgctcctaatacccttggtaccgcttgcttagcattacactatgctaatgtcatcatcgtgatagagagatttgttgcgtctcctcacttgataggagatgatgcaagagacgacctttacaacatgttaccggcgagcgtgagaacatcgcttagagaaaggctaaaaccttactcgaaaaacttgagttcttccacagtttatgatccaggcctagcaagagaatggacagacgcaatggcgggtatcttggaatggttgggtccattagctcacaacatgataaaatggcaatctgagcggagttacgagcaccaaagcttggtttcaaggacgcacatagttcttgcacaaacccttttctttgcaaaccagcagaagacagaagccatcattaccgagcttctcgtaggcctcaattatgtctggagatttggcagagaactcaatgccaaggctcttcaggagtgtaccagtagtaaaacccttgagaaatgcttggacacagataactagtgaagctctccaagacgacacacacaagtctggatttttactacctcgttgacctaaaccggcactggatctcacccactgggtaaaccataccgtgggcgcgccctgtatcctatgcagcttggaccaaaccagagtacggaaaggtgctcgattaattacatgagaggtattatgatctgagcacctctttatcttcttccccgtttactattctgcttcgtggattgcaaaattctgacttgtagtaggatgatgatgcgttgtatattgttctatgatttttattgtggtgagttacatactgcatatatacgtatgtgccaaggttgttttagattctgtaatactcgttggtgatacagaagattccttaaattccgatttgtccaagttttgtcctgtattattattactcgtccttggtcttctcctcccttttggtcaactgtattcgtatgtgggtttgtcaaagtttgaaattaaagtcaatagatttcttagttgattattgtttcttcagtctacatgtttaaattttatgatataagttttatgaatgaatcgcacttgatctagctggccaagagaagaagattagtgttttgtattcttgattccaactccaagtcccatgtcacagaattcagcatgctgaatcgttttatttgtcccaagcacatgctgaatcgttatagcattaaagaactttatactagtattttttagagaaatatctagcatttaaaaacaaatattagtatgatgataaaaaattttaaaaggaaatatctaccattaagaaacaaatattggtatgatgatagtattattatatgatgataatatacaactagtaatattttatagaatgggtcatcatacaattacactagttaatatttactaatatccattttaggatattttaaaatatattaaatgtaattaattttctgttgatatttcatagttttagatcaaaaatattgtaaatattttgttaattgagttaaaataagaaatctctatttaattaccaaaagttacattaaactctttcattaataaatggactatatcaacaaactctcatcattatatattaaggttgaattaaaaaacaataaaggtgagaaataatatatttcctttttaagaaactcttaatcaacaaatttcctttttattttatgaaaaagagacaaatttccttttcctaatcttattatataggtgagaaataatattattttagaggaaaaaaaaaagaaggtgagaaacgtaaactttggccgtacggaaacagcgtcgtatttggatgtctcattgtctttgtggcaaaaaggcagcgtgctaaatccgtcctttgccaccgttgagcggccggtgaaccccaagccgaatcaccgtctctcccacctctctctctcccctctctctctctccttttttacatg

SEQ ID NO: 28470 - DNA, 3003 bp, Unknown
  misc_feature (1)..( 3003): 2750-1469P.txt file - cDNA_ID_2996960; gDNA_ID_2926272; Annot_ID_143451
gttttgatcttaaaatagaaatgattgagcaaacctcaaaaatgtcttcttaggatcacaaaatctttcctttagcttattaaagccgggagttcaactctctctcccttgtagactttttgttttcaaatctttttctttcaaaaaatcaataattagttaatgggcataatatttggttttaattaagtccatagattttttaggaccatctctaatcacgacaaatatcctaaattgtaacacatttaaaacttaaaagtattgcattcacaatccttaaaatatatatatatatatatatatatatatatatatatatatatgaaagttatatagaaacgataactccttactcaacaattagcccaaaaaaacatccataatgcatttaaactaggaattttaacaaactcaaataggttggtagttaaaaaaaaacaaatagtagatgtacatacgtacctttaaaaatatatactcatatcgaaagttttaaattttgcgaaattaaatacatttatctatcaattaaaatacatttaataatgcataattctgtaatatctatctttaatttccatatagaaccaaaacaaaataaacatatcaaatagttttaacttaacaaaaacgttagggaaaagttgacctaactagcttgattgacgttgaacttgtcaatgcgaaagcgatatttccaatatatactacatgtagtattatttatatggaagtttctaaaaaggtgttgagtggattgttacttgttggaggatgctattttttccttcttgccataatattttacgagtatgggataactacatactcatgattatgaaacgctcactttatttgaaaaacctcctaatacaccaaatatgtcactagattccaaaacgtagaccaattgtatctaatctcaaattctcaatcaaagtattaatttaccgatggtaagaaaagttaaccgatataattatcaaaagaaagaataagtcaacagattcttaatctctttattttggtatatgaacatttgtacaaaaatctcaaaagatatgtaactgtttaaaatataaattcactgagattaattcttcagactcgtgttagctataataatgtcaagagttcttcttgtttcaaggaaaaaccttaaagatatgtatattttctgtaattatgatgatataatttgctattcattgtcacaaacattactttaaaaaatcgtattttcattactacaatgttgactaagaacaaaaatacattgattattgatatatcgtcaactgaattttcttccgagggatataattctcaaacatagcaagaatctcataataatgtttcgtgactacctttagacgaaatttttttaagattcgtaacgtgacttatggtctcttgctgtgggggtcaatgcgaataaatctaaatgtatgggagtcaaataaaataccaagaaaaataaaggagcagcacccaataaactatatgggaccagaaatcctttcattggtttaaaataggattatcccgaaagatgaaggactaaattgaaactgattgggggtaggaagagatccgtcacaatcattaatggcttccacgcggaaacttgtcgtttatacaatttcattaactttcgggtcgggtttatattccaaatgggtcaaataatattagtttaatacactaacggagtaattaattggtgactacaattttatcagtttggtgcaattagaaacgaacatagtcgtaaaatacgagttcggtgttatacctttatttacgttaaaaaaatacgagaattttgtgtcaaatttcaaattaatttcatgaatatatggaaattattagatactctagcgaaaatagtgattatgagcgttttacaaaaatacgattttagcattgaacttcctttatgtaattcggtcaaatgttggcatgaagaagcaagtttgcaacattaaatttcatttaaaaatcgtgttgacatactttaaaatctaaatataggaagaagaccaaaacattaaatttagtaagattctaatgaacatttataagttataacttataaccaacaaaagttgggtttagcgttgttgctttatctgaaaacttgcaaactaaaccattttaataggactaatgacaattaacaacaaaatacacttaagcaacaacgtcctcgtgaatataatttgggcctcaggcccatattgctaacgccaactgatatttcactttattccttcttcatctcaccacactctctctctatctctatctctaacggcatagctgactcagtgttctccggcattgactcgcctgagaatcagaaagcttagatcggtgagcttttagctccattttctgtttatttacatattatttcctttttttctctctcccttttttatctggaatttgttctgctaaattttccagctgttacattttccgatcacgagaagaatcactgggtttttatgttaatcaatacatgttcctgttttctgatcataaatctcagctattaacacctgattttgattctgcgtaataaaaacctctgatttgcttttatcttcactttccccataaacattgcttactttattcgctcttcttttaccgtttccagctaaaaaattcttcgctattcaatgtgtttctcgttttgttgatgagaaaaatatctgacaaaaaatcatttattgcattttatggtgcagattcttagttaatgtcgccttctctaaccaagtcagattaaaaaggagtgttcgtccatgttgctttgttttggtgtttggagagagttttcggagagttaggtgagtgttatttggggtgaggtagtgataaggtttgaagggggagtgattcatcaagtgtgttatgaattcgagggctgatccgggggatagatattttcgagttcctttggagaatcaaactcaacaagagttcatg

SEQ ID NO: 28471 - DNA, 3003 bp, Unknown
  misc_feature (1)..( 3003): 2750-1469P.txt file - cDNA_ID_2996964; gDNA_ID_2926272; Annot_ID_143452
cttgcagtacttagagtagaacatgaattagaatatcttaagaaagtcatggttttgaacagatggacctccagcgtgtaacaagcctctttacaatttgaattcaccaattagaagagaagcagttgggtcagtctgtgaaagttcgtttcaatatgtaccgtcaacgcccagtctgttcagaacaggtgaaaagactggattccttgaacagatagttacaactactggacatgaaatcccagagccgaaatctgacaaaagtatgcagagcattatggactcgtctgctgttaatgcgacggaagctactgaacaaaatgatggcagcagacaagatgttctggagttcgaccttaacaaaactcctcagcagaaaccctccaaaaggaaaaggaagttcatgcccaaggtggtcgtggaaggcaaacctaaaagaaagccacgcaaacctgcagaacttcccaaagtggtcgtggaaggcaaacctaaaaggaagccacgcaaagctgcaactcaggaaaaagtgaaatctaaagaaaccgggagtgccaaaaagaaaaatttgaaagaatcagcaactaaaaagccagccaatgttggagatatgagcaacaaaagccctgaagtcacactcaaaagttgcagaaaagctttgaattttgacttggagaatcctggagatgcgaggcaaggtgactctgagtctgaaattgtccagaacagtagtggcgcaaactcgttttctgagatcagagatgccattggtggaactaatggtagtttcctggattcagtgtcacaaatagacaagaccaatggattgggggctatgaaccagccacttgaagtgtcaatgggaaaccagccagataaactatctacaggagcgaaactggccagagaccaacaacctgatttattgactagaaaccagcaatgccagttcccagtggcaacccagaacacccagttcccaatggaaaaccaacaagcttggcttcagatgaaaaaccaacttattggctttccatttggtaaccagcaacctcgcatgaccataagaaaccagcagccttgcttggccatgggtaatcaacaacctatgtatctgataggaactccacggcctgcattagtaagtggaaaccagcaactaggaggtccccaaggaaacaagcggcctatatttttgaatcaccagacttgtttacctgctggaaatcagctatatggatcacctacagacatgcatcaacttgttatgtcaaccggagggcaacaacatggactactgataaaaaaccagcaacctggatcattaataagaggccagcagccttgcgtacctttgattgaccagcaacctgcaactccaaaaggttttactcacttgaatcagatggtagctaccagcatgtcatcgcctgggcttcgacctcattctcagtcacaagttcctacaacatatctacatgtggaatctgtttccaggattttgaatgggactacaggtacatgccagagaagcagggctcctgcatacgattctttacagcaagatatccatcaaggaaataagtacatactttctcatgagatatccaatggtaatgggtgcaagaaagcgttacctcaaaactcttctctgccaactccaattatggctaaacttgaggaagccaggggctcgaagagacagtatcatcgtgcaatgggacagacggaaaagcatgatctaaacttagctcaacagattgctcaatcacaagatgtggagagacataacagcagcacgtgtgtggaatatttagatgctgcaaagaaaacgaaaatccagaaagtagtccaagaaaatttgcatggcatgccacctgaggttatagaaatcgaggatgatccaactgatggggcaagaaaaggtaaaaatactgccagcatcagtaaaggtgcatctaaaggaaactcgtctccagttaaaaagacagcagaaaaggagaaatgtattgtcccaaaaacgcctgcaaaaaagggtcgagcaggtagaaaaaaatcagtacctccgcctgctcatgcctcagagatccagctttggcaacctactcctccaaagacacctttatcaagaagcaagcctaaaggaaaagggagaaagtccatacaagattcaggaaaagcaagaggtaactaatgtattctacaatctctgtgatataattttgagattttagtaactgatgtgtccaaaccagctccttatcactgttggtgcgttgtataggtccatcaggagaacttctgtgtcaggattctattgcggaaataatttacaggatgcaaaatctgtatctaggagacaaagaaagagaacaagagcaaaatgcaatggtcttgtacaaaggagatggtgcacttgttccctatgagagcaagaagcgaaaaccaagacccaaagttgacattgacgatgaaacaactcgcatatggaacttactgatggggaaaggagatgaaaaagaaggggatgaagagaaggataaaaagaaagagaagtggtgggaagaagaaagaagagtcttccgaggaagggctgattccttcatcgctcgcatgcacctggtacaaggtgaagatccacttctcttctcaactccatttttattcacacaaattagtagaatactcaaaaatgatgttttgtttgcaaaattttaaaattcactagttaaccatgtcaaataatattcataatgcatcttgtgaagaacaggtgtgcatttatggtgacagctgaatggtttatgtgcctattatttcttttactgctatagatgaccaattgaacttaaacgtttacaggagatagacgtttttcgccatggaagggatcggtggttgattcggtcattggagttttccttacacagaatgtctcggatcacctttcaaggtatatgagttgccttaataaattgagttccaaaacatagaaattaacccatg

SEQ ID NO: 28472 - DNA, 3003 bp, Unknown
  misc_feature (1)..( 3003): 2750-1469P.txt file - cDNA_ID_2996968; gDNA_ID_2926272; Annot_ID_143455
ggaaccacagggtttcaatatttatgtaagttgacactcatttagcctaatgtgctattatatatatttagtgtcaggcttgtttgcccgccttttctttcagtattctttttctggatactttcttggttttaaactaatgatgataatgactcatcttgtaggttggtgggggtatgggaagaacacacagaatggagtctacttttgcccgcctggcagaaccaataggttatgttccaaaggaagatattttgtatgctgtgaaggccattgtagtcacacagcgagaacacgggagacgagatgatcgtaaatatagcagaatgaaatatttgatcagctcctggggaattgagaagttcagagatgttgttgagcaatattatggtaaaaagtttgagccttcccgtgaacttccagagtgggagttcaagagttacttgggatggcatgaacaggtattgttactaaaacccttttgaaaattgcgtcactttcagaactttatagcatggcttaatcaataaaatcttatcgtcgttgtgtactgatagggagatggtgcatggttttgtgggcttcacgtagacagtggtcgtgttggaggtataatgaagaagacgctgagagaagtaatagagaaatacaaaattgatgtccgcatcacaccaaaccaaaacattgtcttgtgtgatataaagactgaatggaagcgtcccatcaccacagtacttgctcaggccggcttactggtaagcagttttatttgacccataaggtatgaaaatctaatagctattgtgtcttaagctgagcaaaccattgcttatttgtgcagcaacctgagtttgtcgacccattaaaccaaactgcaatggcttgcccagcttttcctttgtgccctctggcaataactgaggcagagcgcgggatccccagcattctaaagagagttagggcaatgtttgaaaaggtaagatctctctgtgcacttatctaatcttgtgccattacaggcatttgatattgatgtgcaaaacttcttccttgtatcaggttggtctggactacgacgagtctgttgtgataagagtaaccggttgtccaaacggctgtgcaagaccgtacatggctgagctcggtctagtcggggatggtcccaacagctatcaggtacggttggagcacaagctcttgttactagtgatgagacagtatagtagtaagcaagcaggctaatattctgagttgttgtcggttgtgcaggtttggctaggaggaacaccgaacctgacccagatagcgagaagtttcatggataaggttaaggttcacgacttagagaaagtctgcgagccattgttctatcactggaaactagagaggcaaactaaagaatcatttggagaatacacaacccgcatggtaagtatcacatataacttctctttaactctctcactgtggcttgaacatttatattgaagaagaagaaaaaacaaatgactgtgttttttaactttaacaatggtaaaattgcagggattcgagaaactgaaggagctgatagatacatacaaaggagtttctcaatgagcacaacagagatcatctttcgttttataattcatgtaatgtaatgtctctgtctgaactgttactcttcggtaactctgatggagaacttgttctcgttttggtttgattttgtaccctcttttttttttttgtttttttggattgctttgtctttgattggataatgaagcattactgtatcaaggctaattagcccatcaataagcctttttaaagctctggatatggaaaagtcagaacctctctctcttatctctctaaattttagagagagagagattttgttcgatgttttgcatgctttaccagcttatgaatccggatgtgatccggttttgtcgatctatctcgctgtcctatctcgccgtccggtgtatccggtgttgtttacggctatcccgttgccgttctgtttgtttcaccgaattgatttgggaaacaatttgatatcagttttttcttcttttctaactggaaattttcatggccttctctcgatccgttccaccaccatccacaatcaggtaagtgttttggtgtttcgattgggcgactgttttagtctcatccacatgaatcaatatccagatttgggcgaattctgggttgcttgactccttccaaccgttatagttgaaacggtccggcgtttttgacggcttcaatcacctcatttgaggtccgtcttgccattccaggaagtcaagatatcaatttccgaagtctattcttattagcaagtgatgacaagagatcagaagcttcacctcgtggttgattgtttgctgacaacttctttcatgcttttgttctcggaaaagatccagtgatgagaagagaaagaatttgaagattaaattgaatcttttatctttttcggtttaatagttgtttgtttttataatccggagatgtttccggttgttcactcgccggaaattgtgccggcttctgtctgcatattttgctgaaggggttgtgggtaccggtttactaggttatccggttcacccggtttgtaagattggtttaatgaataaaaatcccttatgagaaaaaaaaaaaagctctggatatcatttgattactcctctttctaagatggcttcttatgctttttctttctgttgttgctcagttgctctgtttaaatatggactgtttttttaacccacaagtaaaacattttgagaaatttacacaccactgtaattttttaatgtccacaattatttaaaaaaacatattcacacataaaaaacagaatggacgggaggggtataactggaaattttttcacatcgattaaattggttgaaaacctaatcgccttaaaccctaattgtatcatcctcttccttgcgttctctctttctctctctcgccgacgacgaaaacatg

SEQ ID NO: 28473 - DNA, 3003 bp, Unknown
  misc_feature (1)..( 3003): 2750-1469P.txt file - cDNA_ID_2996971; gDNA_ID_2926272; Annot_ID_143457
cttaactctttgaatttgtattcgtcttaacagactgggaaatcaaagcattttgggttcatacagtttgaggaccctgaggtatactttagattctgtataaaattggtgaaaccgttgtgtgctatatatatactctagattcaattcttgacatttttatttggttctctgcaggtggcggaaattgcagcgggtgcaatgaatgattatttgttgatggagcacatgcttaaagtccatgtcattgaaccagagaatgttaaacccaatctgtgagtgattttaatcgactttttttcgtagtgatcagggatcttctttgcaaatagttagttggcatatctaattgtgtaggttagctattttacttggctgcttatgtactttgtgctatattgttgaatgaaagagctctatataacaatatactatctcgtgtggtttagcgcaagctttgaagtacaatgttctatggtttacagagtgagacttaatgacatttgagtcataggatgatactagataggatgtgataaaataagtgaggataaaagagagtttattgaaagatcgttttcttggctgagatggttttatttatgagtcataaaattagggtaaagaaaatgtgattcttgtcccctaccttggtttctaatgactccatactctaaaagatgtgcgagactctctagtgtttccagaagagaacatgcatgacctattttgagaattgttcttttcaagtagttgtggatcttaatgtatctatgtcctgaatgttataggtggagagggtttaaatgtaacttcaaaccagtggattcggttcagattgagcgaagacaacttaataaggttattctctccacttttcttgttatcaatatgccatttctcttgaacaagtggctctaactttgatttatgtcactgttgtatacaggaaaggacattggaagagcataggaaaatgttgcagaagatagttaaaaaggatcagaaaaggaggaagagaatcgaagccgctggaatagaatacgaatgccctgagcttgtaagtttccgattacacaattctatacactacatcttcaacattgaactaataactgcatgttttgtgtcactgcttcaggttggaaacacacagccagtcccgaagaggatcaagtttagtgaagaagactaaaagctgaagctgaacaacacttttccgataaccttttttgaatagaaatctgttctgttgtactcttgatattggatcaataactaaactttaaagtttgcaatgaaaacttctgtttcaatgattcagattttctgtatagcatcaagatactttcccgagacagcgggtgttagattctctctgttgaaaccgctctttctaggtgcaacggttgcgatgagaacaaaattctcaccatttcctacatcgatctcatacaactcggcaaagacatgtctaaactggtcttgaagctcttggtaaaatgtcttgttcggaggaatgacattgataatgaaaaccccagaaggaacaagaacagttcttgcagctagcaacacatctttagccacaaactcaaccggaggagcagtcatgccgtgaattggatcagtagagtccagatcaaccatcaagacatcaaatctggcatcatcatcacagcttttagaaagtctctttaagaactcaataccatcttcaacgtgaacacgagctaagctttcctctaacccgaagtattgccttgcaatcctcaagacttcaggatctatctctacgcctgtaacttcgaaccctaactgtagccttaagaaacttagcaatccaccacctccaaccccaatgcacaatgcctttggtttagatttgagatgatcatatacatcagaaccaatcaagctaagacttgccaccattggtgccaagtaaggatgcacaagttccgtaagatcaagcttgaactctgttcccattaatggcagagaaggattcgaacaacttctgggaatgattttaatggcagattgaactaaatttggcattctcttaaacctcaatctcctcctaaattctctaactccatcatcgatctcaatctctacatcttcaattaacatttcaccaacgaaaggcccgacgcatttttcaatctctacactggagacaacattatcatcgtaaatcagaaaaggcacatcgtcgatttcttctcgtgttagggttttaggtaacaaagctaccacaagaggtttcaatcttatctcgagtttctcagattcgtcgtcttcgccgttcggtcggtgataaaccgcaggtaaatcagagtcagtatcgtgatcatcaccgatcaagatcaatcgagagatttctggcatgttaaggagaagctgtaattgaccggactcagtggagaagatccaatcggattctcggtgcttggggacgagaatggcggcgactcggggaggagaagactcagtggaatgaacaggcgagtcgaggacggcgacgcggaggagatgaatcggagaattagggttagggatagtgaaagagatgaaacgagaaggagaggttttctcgaagattctcacatcaagcgccatttccttgattttgatttcaccatcatccatcttcgtctttttatgatgctgcttacagttaaccgtaataaaaccaaaccagaaataaaccgataaaaccggaataaaccaaaccagaacaaaccgatcatgtgactttcacgtgtttcaactccgaaattttcaatttttcatttactcatcttcttcttcttcgtcctgggcttttcatctccaggcctctctcatttccttctctgagtctacaaacatgtagaagcaggtgttttaattacgtcatagcagtaggagaagaggctttaagtcctcttctttctctagctaccgaaccactttttaaaattcgcccaaatcacaattctgtttgcacttagaatg

SEQ ID NO: 28474 - DNA, 1797 bp, Unknown
  misc_feature (1)..( 1797): 2750-1469P.txt file - cDNA_ID_2996975; gDNA_ID_2926273; Annot_ID_143460
aagctttttttagagacttcaatggtgagccaaggaatggtatctcttacaaagtctctatgcactatgactccaagagtccgtctcaagaatccgaatatgttgcagaaactaaagactggatcttgtaatttccgtttcagaaatctccgtgtcttatgcacaccaaagctgtctcagtgggaaccgtcacctttcattcatgcttctgcagaagaagctgctgatatagtattggacaaaaccgcgaatgtgttcgaatctattgtctccgagagtgcagaggaagagaaagtagatatgtcagcgcaacaacgaactaattctcaagttcaggtacttaaatggccaatatggcttttgggtccatctgttctcctcacaagcggtatggcgcctactttatggcttccgttgtcatcggtttttctcggttccaacgtggttagtctactttctttgatcggtctagattgcattttcaatcttggagcaacccttttcctcttaatggctgattcttgcgcacgtcctaaagacccatcacagtcctgcaacagcaaaccaccatttagctataagttctggaacatgttttcactcataatcgggtttctagtcccaatgttacttctcttcggatcccaatctggccttctcgcttctctccagccccagattcctttcctctcgtccgctgttatcctcttcccgtacttcattctccttgctgttcagacattaacagagatcctcacatggcactggcaatcaccggtctggctagtcacaccagttgtctacgaggcttaccgaatcttgcaactgatgagagggttgacacttagtgcagaggtcaacgcaccggtttgggtggttcatatgcttcgtgggcttgtctcttggtgggtattgatcttgggaatgcaactcatgagagttgcttggtttgctggttttgcatctagaacaacaacaggtcagcaaccacaatctgttgcttctaagtaaagacagataaatgtttcttcgtttagtttttaaagtcatgtcaaagatttgtaactctttcttcactgtatagcttttattattcgtgggttggtgataaggattaaaaaaaaacacatattctttatgatcatattcgctcttttagttaggtatgtgatgttattcatttcaatattaaaggctgataggttgacgttaaggttgagaatatgcaaaggttgacacagattcctgtcaaagaaagacatttaagaatttacgaaaaatgatgaaaatgtttctcttaagaaagtagagcataatgtcgaataagactagtttatatggttttgtatttttactaagtcatgtcagaaagaagaagaaaaatatatgtactgtgttatagccttataagtaataggtttttgcatttggtgagtacttggtaacagtaaaaaaaagaaagttatacgttacgttgtgaaatatgatcagattataatgtatattctttactttagttgaattgttgttgttgtaattcatctccacgcgtttgcgattagggcgcgtttgcgtttttatcaattttaaatgaattgacagtattacccttgagaaatgaacaagacaaatagcgatgtcccactctattcattagctctgtctaatctctctcgatcgacgactgctctctctctgaaccggagacggtgtcacgggacgaatctaatcgccgggaaaccgttttttttttctctcggaaaatcgatttgaatctccggcgatctgatcgggatg

SEQ ID NO: 28475 - DNA, 3000 bp, Unknown
  misc_feature (1)..( 3000): 2750-1469P.txt file - cDNA_ID_2996979; gDNA_ID_2926273; Annot_ID_143461
aatggaaatacaaccaacaagtcctgcaaaagctccttcccatgtcttctttggactaatgctaataagaggagttctaccaaatgcctgcaacattagttgattaacttcagccaggagaagttcttgcgagactatatgcatgccctgaaaagatacataccttgccaccaagaaaagcaaacgtgtctgaggcaattataccacagaaagaaatcaatatagcaacaagtccaactgtccaatgtgcttggccgccgaggatagtaggccagcttctcccaattcctataagtaattaaactgctcaggagacttggctttgattactttacggatcaaagctaggaaagataataataagggagtgcttgccggtgtttagaactggagcagtaagaccacaacgtagcttaacccagaaacaaggaagatatccacagtaaaacaggccaaacatcgtactactcagctgagaaaaacgcgggtttcctctctgtaacaacaatgccattgcaacaacaaacgccgctgaagttatcgagatatctatatgaccaaaatacctacaaaaaagataaaacctttattcagaacaagagaaaagatcacaggcttttgcggtgtttactgactgaaactactcacaatgtaagtatgggcataagagcacagataatggagcagactctagaaagatatcgtggaggaggtgtcattccttgagcaattcctttacttctcaccagctcgaaatattcccgggcacttagaagaaccgcagctgctactgctactgtgaatacccatcctccagctaatacaatacctcctacagacaatccaattcctagaccgaaagttactcttttcttaaactggcttctagatttttgcttctgatcatctaaactcgaatcttcttcaacattttgcaattcttgatctatgttgtgttcctaaacagacaatagttacagcaatgccatgataagtttctcagcatcacatagcaatccacaagaacgattattcgtactactaagctaacacatcaagagaaagaggagtaaagttacctcctttgagttggcatcgtcaccaatttgatttgattcagctcgagcaacggccgtgataactctccggttaacagaaatcggagtaaagcgagaatgagacaacaatggtttcgggtacttttcagagaattgaggaagaattagatatttccttggagaggaacggcaagggcatgtacagagagagctcaatgaaagcggtaatggcttatacctacagacttcaacaaaaggcgccattggaatccggtaatcggaaagaagaagaattcaaaatcctaaaatttggataaaggacaaatctttacgataacggaatcatggaaggaagagattttgaagattgtgtgattcggtgaatctaatcggagcttatacgttttgtacggtggagatgctaatggtggaccttggtggtacgacgagagaggatctgaaacccacgcgcccctgttagcgcgttgataactctccttctttgttattgcccgaaagtctctggctgcaaaggaaggtcttacgtggaactggaagctgacctgagtgtcaagtggcatattgttttgtttgttccttggataaaggattgtcttgttcttcatgtgtgttttaagcgttcctcaaggtcttcacaatgtggatggtgttagtcctacaggagtgaagaagtttgcatcttacatcttagtatcagaggaagaaacagaggaatcggatggagactgtggtagggcataaaagagcgaagaccccaaagggcaagcaacttttgatcagtagattttgggatctttgttagtcttcgagttgaacagattctcaaggacaagcaacttttgagcactgtgacttatgtggaaccttataaccttgaaacttgtcttggagtaatatgcaaatttaccaattgttcatgttagagggaaaatgtatgagattggtgaattgctttcagaaatattgctctattagatgaatcaactactagtcaaagcccttgctcgaggacaacgtctacatcctttgcacttttaaagagctcaacaaattcctgtggagggaaagaggttactgtggcgatccatggctcagagtcttctccatgttcaaatgatcttgaaggtgattcaacagactctgctcttccttgcaatctaattcccacgagaacattgacagcggtactcacaaactcttgttggtcttgtctcaatggtttctaaattctaatcttatgaaagcttaatatctaagaaaaagatttaaactttgcttctttttggtcttctgatctttagtgatcagaagtagaggcgatatagtatctatgtaaatcagcattaattagttgaagtacttgaaaaatatctgatcatttcattcttaatgatatgagtcatcaattaatcctctcttcatgatgtgataatgaatgcttgagaaaattgcagaagaaaacaatgaacaaaaactattattacacttacgttctatacgcccattaaagaagatgatcaaagcctaacactatctacaaagaaaaaaagttacaaccacaatcaaatcctttacgcggagaaactagaattcaataaatggcgaacagaggatgctacgtgacggttaagtaactaaaatttaaatttgtttaattagtttttgatggtttagtagttgtcaaataaaccgacaagtgaaaaaaggaaattaacacgagttaactttttttgtttaaaggaaatttgaatcccaaacacatgtgaaaaaaggaaacttgaaacctaaacacatgagagagtttataaatagtagtcggtcgctgctcttcaattatcttctcgaatctaatcgattgatttctcatttggattcgtcaagagaatcactgaagcgtttgtgttccaagtagaaagatatg

SEQ ID NO: 28476 - DNA, 3003 bp, Unknown
  misc_feature (1)..( 3003): 2750-1469P.txt file - cDNA_ID_2997005; gDNA_ID_2926273; Annot_ID_143475
gtacacgcaagccatgctgccatatccacaacgagtacctctcctggtgaaaaaagctccaatacagatgacaacacctcatcagacagaacagatgttagacgtgaagtaacacgacctataccctttgcagcagaccaacgaaccacggtgtcctacacagttcagaaaataataaatttcaaaaggacaatgcttgcagatactagtaacatgtgcgattgtctggttggcagctgaaagtttcaagaggcggaaagttcacataagatattaattcaggccatcacagctttacgtgccatctcagatatgtataacattcaagatctgtttaagtactatctggttactcgagtctacaacttaatataaagcagcctacttatactcaaattattgtgtgggcatctattcgtataagtttagagataaccacctaaagttatcagcctaacagtagtatctcaccctttaaacataccgtgtccctcaaaccagatagtagcatttcaataatctcttctaagatttctggaacatccatatcttcatcctcttgatcatccaaactttctggttgtaagatggcagtcacagtatgatcaggcgccaatctttgagatgaactcgtagacatattctcagaaagagaggcggtttgagcctgcaggtaattcaataaataagtctcggatgactaacagaaaatgactaccaaacattatgtcaatattgacattattcatagagtaaaaatataaaaacacatgacgaggaagagttcctctttgcactactattctacaagctaaaaggtatgtaccacatagcgccaggaaggtgagcgatgaggaagacaaacaagccctatcctctgagttaacttgatcaaatacttgcgaagcagagaacttttagccgccgcgtttgatttgcttagcacagtcacatcattcaaaacaataggaagcacatctagcaacactttccggctagcagtctgccaacatgagtagacatattagatccagatgcaaattggaacaggttaagtaatagaaaccagtaatatttctacaagatacaaaacagataagtcaaattgattatgtactttacagacatctatatatgtttgacgtgttaagtatggaccaaagttaaaacaaagagaattccaggttacaaacagaataaaccttaaaaatggcagatagagcttccattacaccaagcaagcgaaagtggttcgtgacactatcttccttacaagacaaaacttcatatgtccactcaaaaaagctgaaacggaaatgccacaatagaataaagaaaattagttaatccattcacggtgagtaaattgtacatgttacaattgaaaacagcagtttagaaacaatcttaagtgttcaaagtgaaacaacactgaagcactgatggtggtaggaacagacctcgaaaaagcttttcccatatccggacgagttaaaagcttagagagtagcaacctcgatatcctgcgcattggtccagcactgcacagatagtccttacagaaacctaatatcttcaataccaaaggagcaaggtcatccacaccaaaggtcttgtcatcagcaatgcttgtatcaacagaagaaatatcaaacggaaccaacacaaggattgaaagccacaaaagagtaacacatttggcctccatttctccagtgctttcttgcctcaaggcagaaacagaatttgtactatggcacttctcgaggagcaaaacggcgagttccagatcggatacttgatgcggaaagaacttgataacagctttgtacccacatacagtaactaaagcatagataatgatgcttattggcttaataatctcaagaatttcatcaggtttggcctctaaatcaactgttttggagcggatgataaacattaatggagaaactatactctctaagtaaggttccactaattgaccttgctcctggtatttatccatctacaatacaacaaaacaaagtcggagaaagtaaatcaacatgatactgaaacatgggttggatcaagtagatgaagtcaaaagactaagaagcgtacaatggatcggatcttatgaacagaagtaggatcaacaacacggccatttgaaacaatatcatcgagaagagatttaacgagcttccattcttgtaaaaaatacctctgtagaactctctccttagaatcatgctcatcgtcttcttcctcttcaatttttaccgccgtttcgatttcgatcttcgtcggcgacatttcctctgctctagatgccattactggaaagagaaaggggttcaataaattcccgcccgccgataatactctcagtgtagaaccaccggcaaatcacgagatcggtgacgtcgacgatgagtttacatgttaaggcccatagtaatttattgggcctatatacccatgttcctattttgggcctataaccttcctcaatgtagcttcgttggtctagattttccatctttgggtgcttttataaaccggcttaaccagagttggtaggcttgatacttgaatctctttctggttttgtatattcaagaataagcaaacatttccttaaaaataactttttttttgtcgtacctcattttaaaaaagatattttatcctatttcattatggcggaatatccaaagaacaaaaaatggtagtaataaaaatagcgaaaggcatagaggatcactaaactcttagccttaatcagcggtcaagattataccttttagtgagatccaacggtcatatttgatccaagttgtcccttagtgaaaacgaagagatggcgaaattttgtttgattggctaaaaatcaacacactgataaaataagagttgcagagagagtctctcatcttcttcatttcttcaccaccatcatcacacaccttcttcttcttcttcttctctctctatcacaagagagtcaaatccatg

SEQ ID NO: 28477 - DNA, 3003 bp, Unknown
  misc_feature (1)..( 3003): 2750-1469P.txt file - cDNA_ID_2997013; gDNA_ID_2926273; Annot_ID_143483
agcggttttatcaccattgttgcagattaagtcggtgaaaccggataaatttacaccgcggattgtggagaagaaggatgactacgttcatgtggaatatgaaagtccaatcttgggggtaagttaagtaagctttatgttgctctctcaacctccatacctcaatatattggacaagaccctttggtttttgacagttagtagacgatgttgaattcttgttcactcctgggaagaactcgaaagtggaatatcgatctgcatcccgtaaagggaacttcgactttgatgtcaatagaaagcgaataaaggtaacaactcggatactcaagtgatatatctctgttattgccactggctaatagataatatgctcacacttttcttcattttttacctatggaggcattgcgacaagagctagagaagaagggatgggtatcagagaacagcttctgaagaaaagagtttccagattctattcttgtctattaaatatcttaatgtgatctatgtaaaaacattgccataaatagtgagagaaacattgatttaagacaaggattcgagtgattctcatacataaggaaacagttttggagaaacttcaaacacgagtcatgattttaactgtaaaatatcaaacccagtagcatttcatacgagttctacaactcaggaagctcgatgttgaagtgaaataacaaaccgataaggttggctaaatgcactaaaggagcttagtctttcctcaggtccatgagttcggtcttgataccgtcggccttaagtatcataatctcaagcttgtctccctattacagtaaacaatccacaaagcattagttagagaaaaaaacttgaggaagatgaagtagttgtgcaacgtaagggatatagattaagtaaatgttttggtaatattttgaagacttgaaccaaatgcaaatgatatgagcacaaaggcaagctttaggtggcgtggtgacaaaagaagacacaaataggacaacttacagtgtagatatccctctctgtggcagatgcgaaaacagttttaaccaagtcaactgcttcagcttcggaaaggggcgtgtttgaatcctacatggtggcagaagacgaacaaataagcaacagaacgattcattttatctttacaatgcgaaacgccaaaagcacgaatgaagaatatcaacaaacctgtttaggtagcaaaagaggacttggagacttgagctgattgtcaaggaaaggcatgatgagtgtggaaccagaaccttgagcaccgtatccaactctctcgtatgagccaacagcgtcgtaagtaaagacacacccttttcctggatatattcaagactaaagatcacacaaagtaccctcttctaaagtcacatcataacggagaaaaaaagaggagcattttaccttcctcgtcaagccctcctagaacattaaaggcatagtaggggaaaaaccgcttgaaataaagcgtgttggagagaagctgggccattgcaggacagctcatctgcttgttatgctgatgttgatagatctgaaggaaaccaaacacagagaaaacactcttacacaagtctttcatcattttctaatactgcgaaggatgaaagataattgatcaaacgaccaaagtttaactcaccaagtgtctggatttgagaaccttctgcaaagctttcacatcagcctggaagccagaggaagacaaaacagctctgtccgctctggaaaagttaaaagaagacaacagcttaacaagagtcttacaagttacataagatgaaaaacacgagaattctatctatttccatacgaatgaatacttgtggtatataagatcaacaacacagtaacaaacactctttacgtaaggttgaacaaactcaaagaactacacacattgtcaataaacgttataagaaaacgaataagctaagcaataaaccggattatagaatgatcaatgtaatcacaaagtttatatagagataattgtaaccactatcaaaagccatgtctaataataattaagaaacctattttatctccacccatatataactggtttcacccagatctacgaattacgattgcaaaaaaaccctaataatctacagcaataatagttcgattgccagcatggaatcactctcccaaagaatcaacagtgagagaagaaagagaatgggtacttacagtttatggattttggagtaatcgcgactaagaatactgtaaccagtagacatccgagtatcggcggcgataacacagtaatccgatccagcgatggccacacatgttctgaaaaacacacaacgattaaattcacagtaagtgaatcgtaacacaatcgcccagatagcaaatcagaataaagaagaaagacactaagcgaagaaacccagcaggttgattaaaggtcacacgatccgtaccctccattgttatcgtaaggagaccagttcgcgtgctgtttagtcatggcggatttgagagagaaagctttgagctagggcttagaagaatgaaaaatggcagacgaagctttccgggtttgtgttttgatgtcaaagaaacttccgaatcggatcttattagctctggctttgttaacaagaaaaagacggagactcaaaacaataccgttttggacgtggaaattacgggctgtaataggctttataatgggccttatttgggctttgaattccaaagaaataatctttcttttcttttcttcttcttcttcgtcttcgattttctctctcaacgcaaactcgtaagctgcttccattttcccttctagaccattgatttgttcttcgaaaaaaccgttctttcttttgcctctcactctagttccttctctcatttctacttctctagcttcactgacttgctgctaccactaaatcttggcatttgtggaaagttgggaatttagggtttttgggtgtgtgtgtgaaaacaatg

SEQ ID NO: 28478 - DNA, 3003 bp, Unknown
  misc_feature (1)..( 3003): 2750-1469P.txt file - cDNA_ID_2997021; gDNA_ID_2926273; Annot_ID_143488
tcattggacgcaaacttctcttcttcctaatcctaatcggtcaaccacattcgcacacaatccaaatccactcacttttgtcgtccggagtgtaattgagggcgttgctaaaaagacaagtgctagaatcacctggttatatataaattcaaacttcaacaaatgaaaagaaattataagaaaaaaacttcacgcgtgcgtcagaaggaattgcacgtgtgactgacacctagcatttgctgtctccaaccccatcctcttcttttctttgtcttccataaggtttttggtattaatacttaacctacttagggattagcatttcaattatacatacacgaatatatataggtctggttctgacataatttacaaagataaagactaagatcgacaaatcaatgaatatagacagaaagagaagtcttattttcttctactaattaaaatagccaaaagggactaatgtagtaatgtagtagaatggtaaactatgagtagttctatatcccacaagacacggtctgactcgttgtgttttgtaatctgacttcattagtgttgtttgggtcccaatccaattccccatgtccggcacatgctcgtctttctcggtttcacgcccattcaaatctttcccttttcataaatttcaccatcacggttaacggtaattcgttggtgtatcttttcaaaaagcgcctcatctttacttttgtttgtttgttagattgcttcatatttttcattttcttattcaactctttgtttttccttgaacatcacacttcaaaagaccaaaactagtggaacccatataccgcaccatgggggcacgctcttgtgttattgccataacagaacccatcatccttctgatttgtttaccttaagccacaacttaaaccctaaacctccatatttcaaacccttttctctcctacatgtatcactgcttcacttccacttttcatcaacctcacgttcccaagccctaactatatgtatatataaataactctatatttgattcattaatttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcaacggtctgatctcggattgatctttatatatataggggctagtgttgtgatcttccttgagttgatgtttataatgtagtagttgatattgaatgaaatcttcatgttttttgataaatgattatagcttgatcaagatttagaagttagcatagaaaaatgcatgagaagactggttaaaattttcgtgcacaagtagctaaagagaataatcttgcttccttgtttaatggcaagacttgggaacaagatgattacattggcatacacttttctagacttttttctaggttatagacacaagtcaatactttgtattctagttacatttataaaactaaaatttcgattgtaaactatagaacaaaaaattatgaaaatcaataattgtaccctggttaacttataactaagagcatccccaacgatatatcttagcctaatcttagcaaacatcttagcattagattaagaagtagttcgttcttaaccattggagatgctctaagaacttaaaaaaattctcctaaacaaaaatatgaatcgaaatcctatcagaaaaagtctagcccggaaatctctggacgtgtgggccgaatctaaaccctcttaaagcccaatttgattaggatcaagagaaaggggaagccctaaagattggcgtcctgcgttcatcatcaccttctctcccgccgctttctttcatctttacaaaaccgattacttttgtcggaatctgacgtcagcatacctgctaccacttccagagttcaatcgatcttcgcctcgttgaaacgttttccctcttcgattatcaacagtgtctccactcgtatcatcaccgcctccaactaattttgccatctctctcgttgttccaatttgattctactagtgagctccgatttaatttagggttttgaaagatg

SEQ ID NO: 28479 - DNA, 3003 bp, Unknown; identical to SEQ ID NO: 28478
  misc_feature (1)..( 3003): 2750-1469P.txt file - cDNA_ID_2997021; gDNA_ID_2926273; Annot_ID_205215

SEQ ID NO: 28480 - DNA, 3003 bp, Unknown
  misc_feature (1)..( 3003): 2750-1469P.txt file - cDNA_ID_2997029; gDNA_ID_2926273; Annot_ID_143491
taaaggaatctagtttttcagttgccaagcattagaaaaaagtggtgaggactccagaaattgtagttacgataagctatgttatcggggaaggagctagttgatgtgatcctttggatttaggctcagctagacgtttagataatagcttggcatcgagtggttcagacgcaacattatctttcgtcttcttccttttgaccaacattagacaccgtttgaaacaatgaaaaaggcggggtactttgaagtccaaacagtctaaaatgagtgtcgtcttaccaaactaaaaacgacaggctgtgttgataacgtgggctctcttgggctttgaatataagttaatgggcttatatgaaacctgtattttctattttgaaaagaaagttataaaggacggtgtggaccagaagacactcttcgttttctctccacgtgggatatcacaggttcaagttccaacggtccatttttttgggtgcaaaattccaatggtccattaatccacgcatttaatcttacgacgttgtttagcataattaattaatttgaaatttagaacaaataaaaacgcaagagaacacaaaccacaaaatggaaactagtcaattagaagatctcaatatttcgacactactacaaactaacacaccaaaacaaaacaataacaatcatccaattctaaattaactaataagattaaacgtaaaccgtaacactctaattcccagtttttaacaaacagcatcacaaagaaataaaaactcgtcgaaggaagacaatggcagtcttcgtaattaaggttttgtttataacaagagagatgtggcggcaatagtgaccaatgcggtgaacaacgcaggagcgttaacgtgaaacgccgcgtttttcgcattactgttctctgaacttgtcggcgagtctgacggagctccttccggtgaagattcatccaccggtggtgctggcggagaagctgcggttggagaaggtgcttccacaggagacggtgacttagccggggtcggtgtcggtgcactcactggctccggtgccggcgccggcgatgaagattttccgaaaagctcagcgggaaggagcacattatccacagtgaatataacaacaggtgtctcatcgaccaccgtgtcggcgagtctcgacggaccaacgccggtatggagaataacctcgtcaccggaagttgacgtcgttaaatcgtatttaccggcgccgttagtggctaaagtggagatagcgtctttgttagtctttaacgatcctttgggtttgtattcagcgagggcgtgatactctaggagcgagaccacctcagcttgtgtgagattcgtcagatctggtacacctctagctttaaaagcttcatcggacggtgcaaaaaccgtcaagcctttttcaacggtggattcgaatgttttaataacaccgctcgatacgagcaaattcgcgaaggttttgcaaccggctttctcgagaagtccggtgatgttgctaactccggcggaagaaggagcaggtgcggttaagattccgggagcgatgatcggagcgttgatttcgagaacggagatgttgtaagggatttgtttaacggatttggtgtaagaggaatcgagcttggagccaggagcggcggagccaaagccgactttgcctcctttgagatcggtgacgttaacgaatcctaggttcccgagagcgtgtccggtggtttggtaaagcgtggtggtgagagttgtgcctttagagagctgatggagttttaaaggatcgtagtagtcgaggaggacgaggaggctgagagcatttttgacgacggagagtgggtgttttccggcgagggaagacattgcgccattgttgagaacaaggacggtgattgtagtgcggctgttgatttcgtcggcgagttttgtttgagaaaggtagttgttgaatgaggaatattccggcgtatcagagaggatttgagtaatgttatggccggagacggtagaagctacggtgaggagagataatgtgaaagcgaagagagtgaaagctcgtgatgtcgccattggaatttggaaggttgagttgaactgtggagaagagaaagtgagaagacaaagagagtgatgaagttaataagaagaagaagaggttaaatgttaaccatggttatattgaagagttaactatggttaatttgagaacacgtgctgcttccttttgctaaaaagcctgtaatcacgaaaatgggtgggctttgagcttctttctttatggttcgtcctcttccaaaagcaaccgaaccgaaccgttatatcattatcaatttatcatccttgttagagttaaccatggtcaagtagctaactaaaatttgagcttatttatggatgctcattagataatcatccaaaattttgtaaaaggcactcagataaaaaggatttagatatttttacttgacaactagtaatatcgttagtacttagtagactcataaataagtgtcgttatcagttttaaatacttggtcaatagttggtaacatcttttagaaatggaaagaaggttctaattgcccgacacagcactgataaagaaattattattttttataaaaacgacaaatcaaaatacgtagtttactactgtcatgtaaaaatctgcaaaagttttatcatttgattagaaaaaaataaaataaaccttcacaaatcagtaaactattactccgtattaattaatgggcggagatgaggctttaattccttactttgagcccaattatgaggctaataacaatgtgtgagcacgtgtcactcttcagcttcacatgattatgtattgggcctgtaataagcccaaacttcgtaagctggtcaaaaacaacgacgaagagaaaaagctccgccgcagaatctgagatcggatctttagagagagagagaaagatgcagagggacgtgtcgagctgcaacacttacaactatg

SEQ ID NO: 28481 - DNA, 3000 bp, Unknown
  misc_feature (1)..( 3000): 2750-1469P.txt file - cDNA_ID_2997033; gDNA_ID_2926274; Annot_ID_143493
tcagacactaatacattatactgcttttaattctcaaacctaaagaaaacagagacaaacttacagaagaaggagagaaaaacagagaaatgatacattaaaaagatttgagaatggatgtgtatatatatatatatatatatatataattatgttgttaatttatatatggatatataggataacaatatatcaagaaatgatttgatatgattttatcttccttataatttaagatacaacaagttgtggttttgttcttggtatttgattctctggaaactggtaagaaacttggtgttttatgtcagtgacagtgctttgtgatcttgtacgatgataacgaaaatccaaatattaatttttaatttcccatttgtttggcttttctaatcgtgcgtataatgaagatgcaaatttataatcatatttaattttcaaaatggatcacaaatctgtatcagaatctcagttacgaagtccccatgattctctaaaatttaagatatattatcatttttagtatttgaatttttaaactatgggcttgttcgatgtgtatattattatttgtcaattttaattatcgtgaaaacctcaaattttaatacgaaatctttgaccgatatgatagctgcatagttgcatgggccagccttgtaacgcgttataagtagctgcgagtcgcatttctttagttcaatttgttttctttcctgaaatataattcggactgtagaactttgataagccttattattatctgagcccatttatcgtttctcattaatgggcctctaatggaagagttggacccatcttatccgtagttatttaccatggaataaaaaatgaaactgtaagtaatcaataattaaataaatataagaaaatttggaattttacatcaccggaaagtaaatattttaccttttaatggctggtcctaaatgccaatcctgatatgacagaggaagattcgagtaaaaattgaatgtggaaataaatactaactgtagaaaacaaacaaagggtaaattcttcatatagatggaaagcgaagaacagtaaatgtgaattcgctacggtccggctcacactgcccaaaaaattcctcgaaagctcttaaaaacagtagtaaatttgaccctatatttttagaatacattaaaaagtaaaaaaggcctctttgttaaattgcaaatagaaacaaatagtaaattccaaaatttccatgaagggttgttttccttccatggggaaaagagttatttttcattgtttatttcataataaataacttttactgtcaaaaggaatataaaattttaaaacataggtatgggagagagaccgaagtctgataaaatgtcttgactcggaccaaatctcaaacgagaaagacaacaattaaaaaaattccaagagcatgcttaacggattataatatttttttcaacatcatttgttctattatctgttttttttaatgttttattttatggcaataagtgtttgacacttagttattcaaccgcatttcaatctgtaggaaaagtttacataatgtatgattccttgcacaaacagaagatccaaaatttacatctgtagctcctccaagtcaaccaaaatccttaggtttgtgatccaatttcaaaaccccataatttttcaagaaaatttgtaaacccataattaataagtttgatgcattgactactgaccaggacattgtacataaatgaacaataacattatggttgcaattattaatgatctctaagcaccacaaaatattttttccaggacaccatcatcattcctcaccaacttactttaatgttcttacttcaaaaaacaaaatagagaatcaaaataaaaaaatgaaaaaccaaaactatggtgaccactttaaccactgtctctttctgcataattttttacccaaaataccaattctctgcatgagaataacagaaccaaccacattccacattatttccattttatgtgaaagattattttctaattagttgaatcataccaagaggccacagagcagcatgtaaacccattaaagaaagtttctattatttgggaaggataatttagtcatattcaaatttatagtttctttctttatgagttggccaatcatttattcattttcccacttactataccaacacaaaataaaaataaaagccacgtgtcagccaagtcggattcgtcaaacccaacaaaataaatacacgtgtcaattaaagagttttaatgagtccacccaccttcctcgggccccacactctcttctttccagcccgttgataaaggcagcttttaattactctctctgctctctttttttttctttattggcttttttctcttcttcccaaattcactcttcttttaaagctacaaaacctaacaaagttgaagaagaagaagaagctcgtgctctctcactttcttttcctacggtgttttttttccccctgagctgcaacattcttcgtcggaaatcttcccggagaaaattcttactaggtgagaattcctcatttccagatcgtaactgtccaatgactcctttacttaaaaaaactcaagttattttgctcaacatttacttcagccattcacttgaaggttgaatatttcttcaatttctatgaatttcaagtaaactgtagctacttctattcatataactagcctttgttttaccggatttttcttcattgttttttgctttgttttgcttcctccgttggccgaaatgtagccgttgagatagatttttgttcttttcttctactaaatctaacgcctaagaatacgaacaaacaaagtttttgttttgagatgtactgtttttttttttctcttgtgttcaccaattttcttctttctaatttcagctctacataactgaaaatggaggtcttccgcaactaaaatctgttcaacggagaagagggttgtggaaagatg

SEQ ID NO: 28482 - DNA, 3000 bp, Unknown
  misc_feature (1)..( 3000): 2750-1469P.txt file - cDNA_ID_2997044; gDNA_ID_2926274; Annot_ID_143496
tagattcaagtccacaaccaataaaatttaaaacatttagcgagaagttatcatgtgaggtgagacacataaatatggaacggtgttggatgacaatttcttgattattttattttaaataaagttattaccttactgttggccattttgtagaaaattcaaaactattttaaaaataattgttggatatattttttttttttatcagaaactaaaatacaaaccattcaacaaaaactacagccattcgtatttggatacatgaatccgttcacaattatatttcatgaatcatgataggtctgtgtgatagagatatatgcgttgttctttctctatgtattatggctaactttaaataattaaatcgagatttagtcatagtttggcaatgcaatcacggataaagttcaaaagtttacaaatggaatttgaaaatcacatttttgtcccaaaatatgtatattctatatttatttatttaaaagatttattatagtaaataaataatgcaaaatggatatacttttaaaaagtagagatagagttagcaattcgttaatggaggaactcaattaactatatttaaaaagacagctaagcttcagatttgataaaacaaaagcttgattatagtatatttttaattattctttttattgtttattcccttgtcaactcctcttccccattgacagtttctcacatcatccctacatagaaactgtatataacagaaattaattattcctgtgactctaataaccaattgttatcatatggttattggatcctttctattggtcggctacgtgagaaacaatggattagcagtaaaaagactaacaaatacaaaaaaaatgccggcctaataaatgtgattacaatatacacaactattcttagtagaatatactaacttactacgctacagaaccaactggtttatcatagtatctcgcatattaacttaggctagagagccaacctttttgaattaatgaaaaagttgagacacaaccactaaactttacggcattaataacggatctcatttatgaacctgcgtacaaatttggtctgaagttaagtggtactatcccggaaataacttaaatcttatcctaaactatattctttccattttatagtacgagatgttttggaaaaaaaaacaaatagtttcataataaagtaatattttcaagttcttatgcaatattttatgattagttattagttatattatgcattttctttatgtttggttgaactttttaaaaatatgtaatttttaatatacgtgtttttagttaaacatcttatattttaaaacggattaagtatctttttagtcataatttatctttatacacaaaaaagtaatactttgtcgattcttaacccatgcaattgtttatgtgttctgaaattgattgatatgatcctagctcaactggcgttaatagacttcgtatgaagggaaaaaatttcaaaatcattaatttaaaagttcgacgtgaaaaaatgtaataatttaacattctcttataatgcttccgtaagataaatttatggactattatccgactttttgataatgggtatgcaaaaacttgtcatatctaaaaaaaatatcaccaatgttaatttatacttgggcataaatgtatcattaaaaaaaccttggtggcttggtgcatatagaagagagtgaggctgtgagggagcactatagaccaactagacatctctaagcgaggagaacccatccgcatcgcatgtatgcattgagatagctagggcctaggggccattgagtcgatcgaccacatacacctctttaaataatcttctaatattaaagttttaaatcaatgccccgcccaactctaccttttccacgaaaacggaataaagtgtttccgggtgaaagaaaatacttttcaacgatagattgtgttgctatttttatagaatatgttaaatttaagtataatataagataggttcctataaaaaaattgggtagaaaagtttagctttgatactccatatagtttatatattagtgcagcgaggtgatacgtttactagtctaacttaacaaaaaaaaaagagttaattagtttatatattgattctttcaacgtaatcaatctgatttagataatccgtcccaactcccaattatatctgtcattcaagtatttgattacaagggcaattcatttcggactagttgattgtaaatttcgtgtctcgttatctatttgaaatagtaggtctatttagggggtatacatctggattgatagctgataaggactatatacatgtctttttgaatttttgatatataaactactattcaaaattatcttcatagaaaaacggatcatatcatttggatatcaaatttaactcgagatttcaaataaataattcactattccaactgatcttactacatcagtaaaaaaaaattggtagtacaatctcgaggaacaaaaaagtttacaaatgaaatttagaatcttgtttaatctttaaatggatagtttttcataactcttttaattagtctagtttttgatacaaattttatccggttatagaaaacattaaaggaccctaagtttggatttcagcaaaattatatatattccattctcacttagggatgaaatgacatcattcatcactacgtcatttgagcttacgtcaagctcaccataagcaaaagaaatgggtggataagttcaagttccatctcatttcctcacacatctctctttcttccttctcatttcctcgcatcttcctctaaaaaaaaaaatcaaagaaaccaacaaaataaaaagtgcccatcattacaaatcttatttccaccttatatttacacacacttctcttctttcctttaatcatacaaaccacaccaagaggaaagaaaaataagataccactcaccaaaaacttcctcaaaactaacaaatg

SEQ ID NO: 28483 - DNA, 3000 bp, Unknown; identical to SEQ ID NO: 28482
  misc_feature (1)..( 3000): 2750-1469P.txt file - cDNA_ID_2997044; gDNA_ID_2926274; Annot_ID_205243

SEQ ID NO: 28484 - DNA, 3000 bp, Unknown
  misc_feature (1)..( 3000): 2750-1469P.txt file - cDNA_ID_2997047; gDNA_ID_2926274; Annot_ID_143497
tcttcatttgcttctttgactctgtttttgttctatgttactgtgagagatatcgccgtatgaacctatcagtgttcccatttctatatcacgatgtatgcgagttttgtgtatttctgatgttcatgtctgtttttgctcagtatgatatgaaactactggcggtggatattccgatggcgtctggtcctgatcaacgcttattccttattggtgatgaagaagagtacagagtcggtggtggtttgatctctgagttaagagatcctgtggtaaaagcaatggcagcaaccaaagagtttgataatcttgacagaattgaagaggaagaagacgccgaaagagaacttcaagaagccgaaaggaaggaacgtgaagagattgaacttcaagaagccgaaaggaaggaacgtgaagaattcgaacttcaagaagcagaaagaaagcagcgtgaagaaatcgagaagcttgaaaaatagagttcttagtcggttctatcgtacttgcacacaaactaaacatcttcagtggatatagaacaccacagtgaatctgtttaaagacccttacaaacttttgcagaataaatgttagagtatgttactgtttctggtttgtgattcttcagagaaggatggctttgtcctatataaaccggttttgacttgagggaggaaaaagtttttgtctttgcggttagtaccggtttaatcatgatggaaagaaaaccaatacagaatccagagtaaaagctgtatgagacttgcatatctatgttgtctttgaccaatttctatattacaaaattagcaatcagttattatggttcatcaaaaccacctgcatcgtgaagaagatatagttttccatcgaagaaccaaacataagccctcaatgctttttatcgaatgttcttgtgtttctttttgaatcttgcacagaaaattgtgatcttcgaatctgttgcctttagggtgaaactattctgaatgcaaaagcacaaatcatctgaagttgtaaggatttaaaggttaatcctctcccaaatcccttgttttttcatacctagattccatcaaggtcacaaatttacctcatttgaattccctctctttttcataattgttgtaacattaaagagataatggttttgattttcgtttgatttgatgaagttttaattcaggagtgaatcttgagccaatgagaggcaaatctggattagactgtgtaaagagttgatgggaaatcgttgtgcaagaacttcttgttgtagaaaggtaatcaataaaacttcttgtagcatgcaattcaatgtttcattagccatagtttcaaagggaagatgaagaatctgtgtccatatatgtgtgttacagttatggtcatgtatatgctgctgcagcaacaacaacaacaacagttatggtcaaacccgaagccaacacgggtccaaaggaaaggtccatccggtaagcagaatcgagaaatgggaagaaaagatcacagaagctaacaaccatggcaagatcgtaagctttcttctttaaataaatttcgcttttctatgattcttcctattttccatttaagtaactactagcttgataaattcaatcaaaacagctggtggtgaatttcagcgcgccatggtgtgtaccttgtaaaaagatagaaccagtattcagggaccttgcttctagatacccttcaatgatatttgtaacggttgatgtcgaagagctcgctgtaagtaaactgaaaacttgcgtgttgttgagaagatagataagactgcagttttatgatatgagattgaattggtgaaaaaacaaaacgcaggagtttagtaatgaatggaatgtggaagctacaccaactgtagtgttccttaaagatgggagacaaatggataaacttgttggtgctgaaacctcagagcttcagaagaagacagctgcagctgctgatctctttctcagaaaaccttaaactctaaaacacataacagaacagagttaggtttttccattgtctgtcaaaaccagaagttacttgcggataaagtaagtatcatgagctctttctttgaataaagatctgatctggtaagactgatgactctctttaacgttttgttctcagacaaaatcttgtcttttggctgacaaaaacacaaaacatgaagatgaagatgaagaggagtttagtgatgatgaaggtttatttgcagtcatggctctcttctttagagctcatttgtgcagatgcatcttttcaaatggttctgatattttcaacactaaacgaagtgcttcttgtgcatatttgttttattaatccttttacattttaatgttattttctatattactgtgtgttcttcaatttgaaaacctgaacaaacctgtcaaacacggtatagaagaaagtttaacgtatttttcaaactcgaaagggttttggtcaataaccatatgctttatgttggcaaattagtaagatgcacgttgatttctttctttttaaaaaattatgattaaatcatgatgatgagtgatttgttctttcttcgaataaaacagatacaaacaaattaaaaacagaaaataaaaaaaaaaagcaaatttgatctagaaattataataaagggatgtttcttggcgatctccaaagttgacttttcaaaatccaaatcgttaatactagaggaactggacctcaacttccaaatccaatggtgactactcaatgcaactctcagatcttaattttcttgaaaagaaataaattgaaagaagcaaaataatagtcaataaacaagtctgttaaaaccttcatcaccttgaccattattcattatagtgcctgatctgattcatataataatatatctcctcctcctacttgcttgcttgaaagatcatcaacaaagttttattcccagaaagaaaaaagaaaaagatcattcatcagagttaagtcaatcaccaaaccatg

SEQ ID NO: 28485 - DNA, 3003 bp, Unknown
  misc_feature (1)..( 3003): 2750-1469P.txt file - cDNA_ID_2997058; gDNA_ID_2926274; Annot_ID_143501
tctgattagaattttcaacacgatggacggaactcgtctgcaagaggtctgatatgtgataactatgaactaactagctttcattttcttaacaccattattgtaccatatgttatttaagtaaatattttggtaaggattctgtcaaggtaatggttgagcaaacaagctgtcacgatttatttagaaagactttggtagctattaataacaataatggaatcttatgcagaacatatgtcagttttgtttgcatattattgatgaattagtccaatgctgctttgttacaggtccgaagaggcgtggacagagcagatatctatagcattgctctatcaccaaacgtgcagtggcttgcagtatcaagcgacaaggggactgttcacattttctctctcagagtgagagttataggggaggacgcatactccactgaacatgagacttcttcaaattccctgcagcctcttgtttctccagccagtggtgccaaccctggttcgtcattgtcttttctgagaggtaagacagaaattaggagatatctgaaaaaatgactgttaccgtgaaagtacatatgatatgccttgtttctctttaagaactgcttatggagtgaaaggacagaaggctagattatattgagtgagtacataagtgaaacttccaagaaatagctttcttggttcatgagaaaatcagtgatctttatagaagtgtgtccctaaaccttgtgaaattttatgtgtcactaggaaagttattgtttttttttttttccatttcatagcttttctctaaaccagcaaatcgagaagtatatttcaaatatataattgtgcagttggatcatctcatgcttctgtctggtacctaacatcttcagacattgttgcaggtgttctaccaaaatatttcagctcggaatggtcattttctcagttccatgtacctgaagtcacccaatactttgcagcatttggtgctcagaacacaattgcaattattggcttggacggaaggtagctaatctctctgaatgtatattcacatcatccacaagtattatatgcttccatcacactagtcagaatagcaaaaacataaaataaccaacaaccacacatatgatttatcggccttacagtttctacaggtgcaatttcgatccagtgaacggaggagagatgactcagcttgaacatttccattttctgaagcaagatagcccgagatagtcagaccacgtgcttggtttgagttttatgtacataacaattggctctgtatatagatttggtgaaaccgcatacgattttattcttccaagctttacttgattgaaggaaaatgtattcttgattggaacaatgtatatacaaaaaggatttttttttggttataacactaatttctacagagaatcaaactgcaattcgattacgtttattaaaatttcaaatcagaatgttgattataggacagatataacaaatgcaagatggttcagcttacatggtcatttcaaggttacagaaccggatttctccatttaatttaaagacttatacatttaattattaatatttagtaactttaattttatagagacaatatagaaaattatgcaatggagatgctttaaaagtattaggtgccagagttaaaaaaaaaaaaaaagtattaggtgccttgtcgtcaccagattccattggattttacgactttttgttaaactcacaagtcgctagcttgtggtttaagcaatctttttttttttatataaaatttacatatattaaaaattttatgtggtttttttttacataatagttaatgatgcattaaatttaagcaattttaatgatgcattgattttattaattccccttgctcaaaatactttctatggtgtgattaacacaaattatattattattcttttagaaatttttgcttgtaaatgctagttttgattgcattattattcttttttcttttacgtcatttacgagaattttcaattttgttttatcaaaaatttctaattgaatatttgatgttgcacataaactgaccgtgatacatgtgcttgttctgtatatagatttgttgaaataacactagagtatgctaccaatgttacggatcacggtctccaagcaattggtaaaggatgcaaagaattaaaacatcttgaaatactaaactgtcctgttagtaaaacaggtcttatagaagcaggcgagagctcttcttccattagatatctttacgcatcaggtaataaagatggaaaggaaggaggagtgcaatcttttgcacaaaataatgataatatattttcttttcatttgttgttaagattctccgagatcttctcgagatcttttttggaaatacgataagataggctgaataattcttattctgaaattttttggtaatgcgaaacctttgttttatatgttcaagaagaaaagaaatattaagaattttttttttgttcagtcacacaactttagaacaaaattatgttaataattttcttcattttaaatccaaaacttcaaaagttagaaaacatatgaagtaaaataaaataaaatgtgctaagctataaattgattttagtttacataacaaattctaattgaaacttatttttttatatcgtcaaaaaacaacaactaaattctgaaaaaatatcaaaaactccaatttggaaagtataaattacaaactaacttgttttattttatgttttaatataatagtttagttggtttaataatagtaagtgttattttattattttttaaaagggaagggtttaaaaacccaccaaaaaatcccttaaatggatgcttaaaaatctctggtcgcgggcttagccccagtagactagttagatcactgtgtggtctgggcattgagttatcaaagaaaaaaagggaagggtttaaaaacccaccaaaaaagttgagggttttgtacatg

SEQ ID NO: 28486 - DNA, 3000 bp, Unknown
  misc_feature (1)..( 3000): 2750-1469P.txt file - cDNA_ID_2997062; gDNA_ID_2926274; Annot_ID_143502
gtttgtttgcttcatcatttggtttttagtaaatgaattttagcttgagcagttcatattcttgctcttaggtgccatccaatcgatgtatgctccagaaccatttgatgttgggaggatattacaggcagacattctttcaaatggtcaaaagttcacagttacaaccgatgatccagttgatcctggttggtattacggaaactttagacgatacaaagatttttaagtggactataagtgaatgtttggcttactgaaatgcagattctggcttgccatcccgcgtagagtcgctgatgcgaaagtctaacagtgaattcagtgtatgttacaacgttcttcaagattttcagaacttattcttgttttcttggaaatgtttgcattgagttcatgttctcaaactcttcttcaggtggttatatcgcagatgaatggacaagactatgcatctcgatcgcacgtttttaccgttggaaagacgaggataaagctgtctcgaggatggatcacaaaggcgagagaattatattcgacatccatgcaggtatctagagactctttcttcattctatttaacagaaacatctctttgacattcaatgaaaaacatttattacaagttttttggtatgataattattcagctctgtggagttagaggcaatattaaggctcctaccaaggcagtgttctggcaaccaagaaagagtctaactttcatactaacctttgagtcagaacacgaacgtaacgcagccatagcccttgctcgaaaatacgctttcgattgcagtgtaagcaaaagtagtcaaaatgtcgcctttctcagactctgcaaatcactatggttttgcactttatacagttttaagactgcaggtttacataacaggcttgcttaaatctgcaggttacactgcttggtccagatgattaagtgaagaagacaatgtcattaacgaaccacctgatattttttcccctgacgccggattttcttgttctgtgtgtttgtgtgcggctactttttgtttatttttcgcactggttcaaagaaggaaggtgcaagtttgggttctctactgatgatcatacaatgttgctgcgtagagttttattataggcagcagacttctttttttttcttttcttttgcttgatcatttgtttggtttggtttgtttgattgttttatttttttattcaacattgttaatcagcttatgagtgtgagatcaaaacccaaagcggtttctggtttgtatctgttaccattgtttcatcattttacctgcttctgagaatttccctcttttattatcagtaaatgagtaatctgtatataaaatagattgtacatgtgtttgaataattatgaacaagaattctctaactattactagatacgatgatcaaacaaagggagatcaatgaggttgagtggtggcatgatccagatattctcataagggttctgttttttccacttgaagcaaacctcactctcttcatcaaccttataatatatgcaagtcctcttgaatccatggaacacagagagacacaaacagttccatattccactctgcttctgctgctcggctctggattcagaagacaaagcgcttgcgtagatcgtcaagcctcccagtgttttcctctcagcccattcaaagctagtaaggtcaagtttaagcactgttgggttcatgtgtctgtacatataaatgagaaagatctctccttggtgttctgtcataaagcatccgttgcttccaggacgtttaggaggtctcccaggaagaacattccaataattcaaagatgggtcaaagagagctaagcatccggtgtttgtgaggcagtagaagacaccattggagaagacaatctgctcgaaagtgttgaagtttcgctgtaaccgattcttgaacacagatgttttccactctttagcattagcaaaatatgtcttgatggtgatgtaattccaagtgacagaagtgacagtgaacaagagacaactagttgatgtaggagcacaagagaaagccattctttgatcatatgccatccaaagcgtaggcatgggtacgcaatcacgagtaaagggattgaagaaaaggagttgataagaattgggattgtacatgagtaaccaaccatctttggagtaacaaactcgaaaaccggataactcagggaagtgaagattgcagtttttctgcattgatgggtcataaagttcataggaatcgtctgttttggagaagtaaataagccaaggagatgtatgtatcactcgaagagaaacacaagcttcgtgccatgttttgcagacagcagaagcacggatgttatctttcaacgggagacgagaaattaccagttgtaagagatcacaaggaaggtttatgaaagtttgatacttttctttttccttgctactctgtttcttccttttcgtcttcttcttcttcttcgacctgtaaaagtaaaacccaaagtctcaaaatctcaaagctacaaatcatatttttaagccgaatttgaaatttttgaaaactcaagatccaagctttgaccttcttctggtaaccatggtgaagaatgggagattaaggattaggttttggggtccgacgaagtcgtaacgggaaagaagcacaagatatcggagaagagtctcctggccgttagattaggacgacgacgactgatccaacggtgatctgtgatcgttctcttggtctcttcgccgttgaattttcagattagtcataagcaaatcatccaaagaggaccggttcggttttatacggtcttaaagttattaaattatactattaattacgatgatctaaacggcgtcgtatcaaatccatctcatatgcttacgataacgtcccattgccaagctggttctttcactcttcaggagaaagagagagagagagagagagagagagagagttatcagagatagcaaaaatg

SEQ ID NO: 28487 - DNA, 3000 bp, Unknown; identical to SEQ ID NO: 28486
  misc_feature (1)..( 3000): 2750-1469P.txt file - cDNA_ID_2997062; gDNA_ID_2926274; Annot_ID_205250

SEQ ID NO: 28488 - DNA, 3003 bp, Unknown
  misc_feature (1)..( 3003): 2750-1469P.txt file - cDNA_ID_2997065; gDNA_ID_2926132; Annot_ID_196971
atcatccaaaagtcgcgtcggaaaaaagtgccgtgtctatgtttgtttttcttttgttatttgttggtttttttttggtgtggtttctatagacttttcttttaaaaaagattacagtccaataagaaattgaaatagtaattgggctaacgtgggttagccagagttacagaaagagagaattttcggtgaagctaatcggagtataaaaggaaaaactgtcaagcttttatgcaattttctttcatcgacctattgagttgccggtgattgcaataacaacgaaatttcagagttgtgcttaggactgcctagtcctgaaattttggaaaccaaagttacaaaaaacgtttttgaggttatttcctaagatttagaaaacatgggttctttatattataaaattaaataatttgggcctattttatactgtaaaattttaaaaacaaatcagaggcccaaagtcaatgtttcacgaggctctgtttaggaccggccatgtccgttttgttgatggatactaaattactaatgacctaacgggtttatttagaccgaaatagttttattagctaaaaccagttttcaaatggtttgtgaattgcagcatgcaatgtgtgagcatgatttcccaattgttctatcagtgtcaaagtgatatgggccaatccgaacgttttatccaaatggatcaaaagttttgattttataagattgatgagttaaattagaaattttgaatcataatggactaattatcaagaaaatgacactggtaatacatttcttaacacataatttttcctatttttataaacggaatctgaccataagtataaagattgatagaagttttttataaactattgtgtatatcacatttgtttaggaaatatgttagtaagaccttggtccaattggttcacctgatagtcaaaaatgtgtggtggtccttcaggaagaagtccaatctgaaacattttgggccgtttctagaagaactgattggatcagctgatagaattttattaaacaaaaaaagactatttgtatattgatttcatttttagttcccgagaagagtagaacaaatgctaaaatgtatcatgcggcccaataaccaacaaaactagttgaaagatggatcaatggtttttacatgaagaaagcccaaaccatacactaataatctaatattctattaaaaggacttgctgttattcggcccaatagccaacaaaactaattgaaagatggatcaggggctatggaatacctcagaataaaaagtgttattcattgcagaggaccccttaagcggacatggttgggtccttgttcgacaagacttagtcctccatcttggcctcaagagtgctcgacgaagtttatcaccgcttcatgcggaattttattccttgctatgggcaatagaatgcatgatctctattagcgatacttctggcgcttttgcttccgactgttcagacctgatttctatcattaacaatcaagaagattggccgacattcgcagcggaattgacatcctatcgctccttagtttatttttctccttcttttcgtattagatttcttcctcgtagttctaatactcgagcagattgtttagctaagaaaactcgggctcgtaatagccttttctcccatgtaagcacatcggttcctgaatgattctttctagcggagagtctctttccgataacttaatataaatggtgtttgatgaaaaaaacaaattatcgtaatgatcctaaaaaggagttagaaaatattaatatcttatctacatctagatgataattgtttttatgatccttattagatagtgtttaaatttaattatccactaatttaagcataaactatatattctatcaccgtttaaccaatccatataaatctcttttaaagcttctagaaatgagtctcacacatcagaaattagctattttcttattttattacaagaagagaaaaaaacaaacaaacaaacatgtgttactctcattttgccacatgcattataacgtataggtaggtgaatcacctaacttgtttcagcttatgtaattaactttaccaatatattaatttattgttgataagtatattttaaattaagatatgggaccagaaaaataacaaaagtttctattaaaaaatgcttgcatttaaaagagaagaatgtataaaatctttatcaaaaaaaagagtatatcatagattcataataataaaaaaaatttgataaatgactttttatttaaaaacttaagatattacaagctattactctctttgtttatttttaattgattttctaacaaaacacacatattaagaaaacatattaaaactgattataaatgtatcgatttttgtgatttatatttttctataattctaaatcaatgatatttaattatttgtgttgaactttaaaatttatcattaataactaataattagtgcatagaaaatctaaaaatcaatctttttgaaacaattttttttctaaaaaatcaattaaaaagaacagagagaatattgttttaataataaatgttttattggtaatccaatattaaaataattatatggattaaatttaattataaattttaaaaaatttgaacaaaaaattatttagtgaattgattccaacatgtggaaaaaaggaaacagataattaaaaaaattgattggttctgccaaaattgactaccttcaaatcagagatgattttaaaaataaattcatccaattaaacttgccacatcatcaacttggaccagaatattcgcagtcaccaaaaacaaaccaatgtgtccaggttcaatgaatctggaatcacctggttcttcgtatttttgttatataatgccacgcttctcacaaatcatcttgaattgaaaataaaaaacgaagaatcaaaacaaatcttagagaaaacaaaaatccaatttttgctgtgaagatg

SEQ ID NO: 28489 - DNA, 3003 bp, Unknown; identical to SEQ ID NO: 28488
  misc_feature (1)..( 3003): 2750-1469P.txt file - cDNA_ID_2997065; gDNA_ID_2926132; Annot_ID_138775

SEQ ID NO: 28490 - DNA, 3003 bp, Unknown; identical to SEQ ID NO: 28488
  misc_feature (1)..( 3003): 2750-1469P.txt file - cDNA_ID_2997065; gDNA_ID_1620846; Annot_ID_50937

SEQ ID NO: 28491 - DNA, 3003 bp, Unknown; identical to SEQ ID NO: 28488
  misc_feature (1)..( 3003): 2750-1469P.txt file - cDNA_ID_2997065; gDNA_ID_1620846; Annot_ID_170220

SEQ ID NO: 28492 - DNA, 3003 bp, Unknown; identical to SEQ ID NO: 24393
  misc_feature (1)..( 3003): 2750-1469P.txt file - cDNA_ID_2997079; gDNA_ID_2926132; Annot_ID_138789

SEQ ID NO: 28493 - DNA, 3000 bp, Unknown; identical to SEQ ID NO: 8151
  misc_feature (1)..( 3000): 2750-1469P.txt file - cDNA_ID_2997082; gDNA_ID_2926132; Annot_ID_138793

SEQ ID NO: 28494 - DNA, 3003 bp, Unknown; identical to SEQ ID NO: 17642
  misc_feature (1)..( 3003): 2750-1469P.txt file - cDNA_ID_2997086; gDNA_ID_2926132; Annot_ID_138799

SEQ ID NO: 28495 - DNA, 3003 bp, Unknown; identical to SEQ ID NO: 17540
  misc_feature (1)..( 3003): 2750-1469P.txt file - cDNA_ID_2997096; gDNA_ID_2926133; Annot_ID_138806

SEQ ID NO: 28496 - DNA, 3000 bp, Unknown; identical to SEQ ID NO: 15417
  misc_feature (1)..( 3000): 2750-1469P.txt file - cDNA_ID_2997100; gDNA_ID_2926133; Annot_ID_138825

SEQ ID NO: 28497 - DNA, 3003 bp, Unknown
  misc_feature (1)..( 3003): 2750-1469P.txt file - cDNA_ID_2997104; gDNA_ID_2926133; Annot_ID_138830
ttggccatgagattttggaattttgcgggaaagtattcattcaatttataaaaagaaaatattttgattggggaataataatgatgattgttgcgttggaatatttggataaggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttagctgtttgaagaagaaatatgaaaaattatcacatccggggttttcgtcttttcattggagtcgttcttattcgttactgtgtgaactgtgtattattttttgttttacttttgtaaaatttatttttgtgtgtaataattttgtattacaaaatataatgaacagtaaaacccaataataataacattataatctatcaatagtgaattacatttgctaaacttttttttgtcatcttattactcgatttatcataataatgttaatggaatataatttgtcaatcatatgttcctcttcgtctttgctggtgacttgtgaggaagtagatatgtcttagaaaccacaccgaattcaatctcatatgtttgttggtgatgtcttcatagttgtaacttttaatacaatctaacaaagcataaaatggaagggaggtaaggatattgtgttgcatcattcttctcacaatcacttcttctttaccaagattgtcgaagcatgcattataaccattataaccatgcatcttaaacacatcctcccctttttttccttttttgtcgatacctttttatgttcatttgaactttctctttatgttcatttgttctacaagtactattcttgtaaaacatgttatttgtttaattgtccctactcactagtcactacctattttactaaaatcacaatttctacttttagctaccatactattcataatcgtaacaactaacacacttacatgaccaaaaatagatttttgtaccatttaatcttaactattaatttgtaaacgatctcactactattgtaacgtttagtccgtccttactagtgtgctccacgttctttctcaggtctatggactcatccctgtccgacgatcggtccgccaaatctaagaggttttaaagacttgttaacgatcctacaaatcactatacgatatttcatcatgttttatcctcatttacatggttctgataatcatttctcggaaggtcacctatcttaaaactacttcgactcaaacacgtttaactgtggagttctccgcataaattaattattttattctctataaaagttatagaaatggtctcgtcattgtactgattgacatcatcaactggagagacatcaactttgggagctgccaatctcagaagaagtttatctcctttacatgccgaggtggaagctctcctctgggcgatgaagtgtatgattggtgccgacaaccaagatgtagtttttcttacagactgttcagatctggtggagatggtgtcttccccaaccgaatggccggctttctcatcgtatttggaggagttacagagcgacaaggatgagttcacaaacttttttctatctttaatctctcgtagtactaatgttaaagcggattttttggcacgaaaagttcgtacccaaccgcttcatattacatctgtaaacaacattcctcaggattggctcgtttgagtcctaattaattttcggatgacaaaaaaaaaaggtctcgtcattgttaattattattctaattgactattcccattaaagcaatcatagagttacttaagtttgacattcataaatttatgcgactatgattaattattgactaagaaaaaattaaatactaatagtactaacattaaagacaaatgtaacgttttacgtgaagtaatcagaaaccagaaatagtcttcttcttcttcctcacacacatacttctctcaccttatcctccgagatcggaaaatatg

SEQ ID NO: 28498 - DNA, 3000 bp, Unknown; identical to SEQ ID NO: 15454
  misc_feature (1)..( 3000): 2750-1469P.txt file - cDNA_ID_2997128; gDNA_ID_2926134; Annot_ID_138853

SEQ ID NO: 28499 - DNA, 3000 bp, Unknown
  misc_feature (1)..( 3000): 2750-1469P.txt file - cDNA_ID_2997177; gDNA_ID_2926139; Annot_ID_138943
aatcttggcctcaacatctatggtatgaccatcgacaggttcctcttgatctacatcacaaatattctgattctcttccaacctagtgacagttccctcaccactttcaaggccttaagaaaaacagatataacaacacaacggtaaatcaaccgatactcttcaataacatttgcagatctcctatatactattcaataacaaaggttaccttttgcttccgttggcgtctctatggagagtttctttctactattgttggcacttttcgattttctcttcctcgtttttttctcaactgcttcaccaatctgcagctcacttttctcctggacacgtacgaggtcaacggatagaaaaaagtcctcgttactgaggccttgaagagcttttttcaatatcatagaatcggacaagtgataatcattaccactcacgttaacctacaaaccaaaaacaagtactccttccttaagttgttgtcgttgttgattccaaaacaaaaacgtgttgttagagaaagtgttgttaccttcaaggcagaaacagtgatgttgccaacacttggaaaacacagttcgtgttctttgcagaatttgtctgtaaaataaacaaacaacaataaacatgagtttaagagtttagttactacaaaaagttaccaaactaaaaaaaaaaaaagggaagagattatgaagagtcacctttgaaagaagacacgctatcatgactgtcaaggagtagccccaaacgggtatcaatactagtcttcacaaagacacattgcgaaccggaatcagccatcagtaagattattgtaagagaaatgcaaaatagggttttgatgaagttgagaagaaaatgaaactccactctctctgtttgatatttataagcgagtttctttcgtagaggaatatgaaaagctttatgttttttttgggaaatcaaaaacgcttaattacttgggaaaacacaacgtgtaggtcgattctctcttttcatcgtcctttcgtcttctctcttttggtttatgactcattgaaagggtttgaccagatcataacttctttctctatgggccaaataagtgggcctcacgttatatgaagacagagattctctaaggaaaccaggaatactaggaattgttgaaaagcaaagctataaggcgaggaagttagctaagggcttttcacaggacaatgggttggagcagatggattttatcaagagagatgcaagtctatctcaagcaaagaaccataaattttcaaaagacaagtacctggtgtagaatcattgaagaaacagctccaagtaatgccggtgtagaatcattgatctaaagtgaagtgaagtttatggttttctcttcatgagctaaaatgaagttgcagggagaagctcgggatcaatgggtgcctcagacaagcaaagaaaacggtttagttttctggtttaagctcaagtgggaaattgagaaactgacaactacgtgtgttttgtagttacaagttacctgagcggttttttgcagtcgtatagacatcaagacagggttcgaaagattgttcttgttgagctgcattgctgcaaggtttaagaaattcaaaacagtgaggagatgttgaagataagtcacagatgtcttcaatgtttaaggtacaaagaaagtagacaaggcaaacaaagtcatacatagttctatttcatgtacttgaacaggttctaagatcaaacatcagagtgtattagagaattacctgggcctgtgaagaagttgctgatggagttagaaacaccaaatatttatttattaaaacactaagaaccatacatatatagatttctctatttccaaaaatagaattaaccatagtcaagatctttctcaatgtaaaagaaaaatactaatatttttgtttagagttcagactacgtacgtaatatttttcatatcgtatatgaatttttattcgagtttcttttttacctatttggatcgacaaagaattttggatcgagtttattggccgacaaaagacaattaagattatagttatttgttagtagtatttgattatgaaataccaacacatcttgaatgttttctttatgtcaaaataaataaataaatgcatgcattcttttttttttcccttgcccttaactatgtttaattttgctgtgatcaaatttataggattcgaaatcttgacatgaatgaatggtaggaaaaaaaaaaaagcactgtttaagagttaaaagctgacggtgtcaagtcgccgcagcgaatatttttttgtaaaagaatggtttacacttaaaacactcgaatctcaaatttatatattacctttccttttctctaatttctctacttggtactttttttattttaggaagacgtaatatttgttaccagaggcacacgcatgggtaaaagcggaaacaccagaacgcggatacacgtgtcattgatctaacggtgagttagccaatatcctttgacctctagtctcatcaccaatatgcctggaaaatgattcacaaccgtccacgtggcgatctatatatccacatttacttttataccctctttgcccgttttccttcgggcaacttcagtttttgtttccttgtatttattgacttttgaataaaagaattatttcttctttacaattttagaaaattggaaagctttatttattgtctgacccttttactattcttcgggcagctgttcttaaagacatcttccctcttcctcagacacagcttcttctactggagaagaggaggagaacacaaatccaattcacactggaaacgtaagaagaagcgatcaaagcttaaacttctctttgactcatcattgttgttctctctgttttatttttcttctcaatttcttgtttgaacttgtgaaaatcattgaattgcaattgtgtagtgttgggtcggatcctgagtgatatttcgagaccgatgatg

SEQ ID NO: 28500 - DNA, 3000 bp, Unknown
  misc_feature (1)..( 3000): 2750-1469P.txt file - cDNA_ID_2997185; gDNA_ID_2926139; Annot_ID_138946
tcagaggaagctggataaaaccgggcgcagtcctcatcgatgttgggattaatcctgttgaggtgagtggaattttctttttgacatatggtcatggcgtaattcagtgatataataagtttcaaatcaaccagtatgcaacattcatacatgtacataatatgaattgcaggatccaagtgctgcgcgtggatatcgattggttggagacatttgctacgaggaggctagcaaagttgcatcagccatcacacctgttcctggcggtgtaggaccaatgaccatagccatgcttctatccaacactttaacatcagctaagaggattcacaacttccagtgacgtcacttaaaaagaagattgctggccttttgggaaacaaacaaatcgtactctgttttttgaagccaatgatttactttggtctttaaagaaagttatcgttttgttctatgaaacaaaacatgtagtttttaagtcacataaattgtcttcaacattgtttgtctcttcttggtattttgagtcagaactagttttaacttatcccagctatgatatatcccagcctcacccatcggtctcttcgtcattatactttatttataactacctttcaacgaaggttaatttgaaacaagaaaacacagtcacttgttctacattacttttgttaaaccctaacttgagctcgaagccacgaccactgttctgttttcctagtaaaataatggcgtcgttgatgttaaccgattgctccttctccacgacctcgcgtctcatcgatttgaaccgcctcaacggtgctttcctgccccgctggtgcgtcagccaactcaagctttcccaccactgcgcccggacgtggccgcatgcgctcctcttataccactgtgcccggacgtggccacattctctccattcgctcctcttgtatagactaaaccttttcatccaattgcttacgtattttcagatatccaactcttaagattttacttttctgttcagctgatgaggcgatggtatttgatcaaacggctgtggaactaagtatcatgcaggagatcagagtcgaaacttcaagaatggagaaactaatcagtcctggtttagcagtaatcctttttggggacagagagttctctgaagaatataaagaaatttaaactctagcatctttgctccaaaaacaaactctatagagtttaaatttctttcttcttttttacaaaagagggattatagtattatacaccataaaccccgtaaaattaaaagaaggtattcagttaccaaaatcggatttagtagcatttagtttttttgaattttaaatgtacaccataaaccccgtaaaattagtcaaaacaattaatgtgatttatgataattgtaattaaataaaaaagatattactcgattagtaattactgattaactgaatcattgatctcattaaacaattaaagaaagattactcgattagttagcatttagttttaatttttttaatatactaaaaataccaatcggaaattcagttaccaaaattagatttattaacatttactttttgaattttagatgtacaccataaaccccgtaaaattggtcaaagatttatgatacttgtaattaaggaaagaaccaaatgcaatatatggtttcggtgcaaaaccttaaaactgaccaacttctcaattttttatttaaaaaccctaccaaatttctctctcgtttctctccgatggccaagaacaagactttggttactccatcaacggtgaagaagtcatctgacgtcgcatctacgtcaaagaaactgtcgggagtcgcatctccagcgaagaaaccgtcgggtgtcacatctccggtcaagaagccgttggaagccgtcgcatcaacttcatctgaggaggaggaggaagatgagccttccagcgattcagagtcgggatcggagagtgagtctgacactgaagctgagccgatgactcttgctgctgctgctccttcttcttcgaatgagaagagacaaagtgaaggaaaaccagaggaggaacgagccaagactgaaacagagacggggaagaagccactgttgtttcagagattgtggactgatgaagacgagatcgtctttcttcaaggaatgatcaaatttgctaaggatacaggtaagaatgtttccgaggacatgaatggctttttcgaaaaacttaaagattcgattagctttgaggtgaagactgatcagttcgttaacaaaatccggtctatgaagagaaagtatattgagaacaagaaaactactacagagcatgataagaagtgttacgaattggctgagataatttgggtaagtgatggtgatgctactgctcttgtgaagccaaagaagaagaagcttaaggttgatgaagaaagtgattggttcgagaggtcgtttgttgatggtgcgtttaaagaattgggtccgggggttgatgaagagacatggaagaagaattggagtttggtaccggtgaagaagaggaagaggatagaagaaaaggtgaagtccatgcaagctgatgagctcaaaacgacgtggcagaagattgacgttgtgcatgagatgagatctttgatggctaaatatgtttagtctttatctgtttagagatgcatttgcctatgtttttctttttggttttgtgttggaacctttatggctttctcgtttattcatatgttttatgttaaagatgtttttttggataacaaaaataggtggttttttgtttgcatcttagtcttcttcctttgttactacagacatgaaatcgttagataattatgatatgatataaactaataatgattctaggagataattcctaatggatttaagataagtacatatcttctatatctacctttacacacacgttaacttagaaacaatctactttgttttcttctgtttgcctagtaaacaaatggcgtcgatgatg

SEQ ID NO: 28501 - DNA, 3003 bp, Unknown
  misc_feature (1)..( 3003): 2750-1469P.txt file - cDNA_ID_2997201; gDNA_ID_2926139; Annot_ID_138951
acatctcaagtagtttctttattctctttggaagtttctgcatctgacggatcagaggttttgtgctggaggaaacatcttctgcgctagtgctgacaatatttggctgttgtggcagctgattgttccttcctactccgttggaatagattgccactctagaatgaatcagaaaacttgctattaaaaaaaaacagacaaaaaagtttatggtttatcataattcgtcaaaacaattgagtatccaactaaccctgccccaagaagtgtaaatccaagaattagcttaggccactgctgtttcgcagattcaactaaactctcaaaaactgttgcggttccatccccattggaagagaagaaagatgcaggaaagaaacgagaggatttcttcaatgatgtcttggtaccattatgagatgaactctcccttggcagatctttctgcacttcctgtttttttgtcagaacaacattctttgacttctctgcttctccttcagcctctttagcaaaatctgcagttggctttccgttctcattatctgactcgtaagactgagtcccaacatctgatgaaactccaactactactaagtctctttcagcctgatggcttacatcaacaatttcactcaagacttcatcctcaccaacaatagtattctttccatccaatacctttccctgggttgtttcttgggtttgggaaccaaaaagagtcttctctgctctttgcaaagcaatctctgcatcattcacacgttgagtagcctcaagctcaaatgccacagcttgttcggccaaaaccatgatatttgcaacatcctcctcggctttcaatgcgctgatctgcgctctctcggcagcctcattcaatctatctacttccttctgcagctcgtccttcttaacttgcaaacgcctgagttgttcctcacagcttgctaaattttcttggcattcttttatgtcagccttagcagataaaagggcttcctctttatctttaacaccatctctaacctcactctcttcagaagtattgtacccttctgcttctagtgattcaagtgcaacctgcagccttgcttcagccagagataatgccatagtagccttctgaacagcttctttagcaacggactcttcatcaacagcctcttgaaccacattaagtgtttggtttacatcgttccacgcactggctgcttcatccttaagtgctatcgctacctctgaaatcctctgagccttttcttcaaacatggtactgttgagactagccacttccaattctttagttgccttattcagtagatccctgagttcctccaaactaggtgcagaatcttgctctcttgtgtctttctcttccttagaaaacgtaacctccctgtcatcactaccttcagcaaattccaaattccggtcattcccaaccaaatctcctacagaatcgctactttgacaaagtaacctaaaccccagcggaacattttggggttttgcaggaagcaaatgaccgtaaaatcttccattgaaatcagcattcaaagtcaaagaagaacgatacgatacatttcgtttcgatctaatagctgagcgaactttagaatcaatcatcggatcccaaaatctagtgccgccgagtcctttgggacagagtttcgcacttatcattcgattcggcaagcagtaactcgcaaaatccgcaccaccgtgaaacatactctggcgctgaacgctagacgcaaaatccatattactgctgcagaaagacggagagaacaagagactgaccgatcataagagaagagagcttcaaggcttcagctgatgaagaatcaatggcggcgagagtgagtgagaatcgagtagttactgagaggaagatgaaacgtatctcctgagaaaaaacgtaagagagttccgtttcaacagtatttttctcggcggtcttcagattttccgtccaactctctctttcctctttcagtttttttttgcccaatcactcgtggtaggatttttttataagaaagttacgaaaatgccctctcgtgcttagagagattcaattcgtgcacatataatatgccgtgaatataccaccaactctcttactcgtactcgcatgtggtgcgtgcaatatacacgtggttcgaatcaacggctacgttttactgataggtggctcgtttagttttgcactgcctttgggtgcgcgtgaccaagtcattttccaaatgtgttttaatatttgtgaactattattaataaaaaagcgagcgacgttgttcgttgatgagggagcgaccgtacgcttggcgaccttctctgattgcgtagagtcgttttccttattgggcttacctagtaccgtcagcccacaatgttttcatttctttcccacctaaaactaaaagtactcacaagtcacaacttaaaccaagtacacaaggattttatcatgggattatcgtgtttgaagactaaaaagagcacaccatcacccccattagtgcaggtagagtaagacagtaacttttgggttcatattaccgagcaagaaccgttatttgtgattagacatgttataaaccactgctttagtgactatttaaaacaatatattacatgtcgtaatcatgcaacctaactatgttttcattaatcaaatacaaagaataaagagaaaagtgcgtagattcaattatttggcatagactcaaaagagtgtatatatatctgacttttattaaattattaaacacaaatacatattttcataagcaaaactataaaagccctaaacatataacgattacctcaaaggaaaaagtcgttttctcctaattaaaagataggttacttcctaattaatatataatttatgtgaacttcacaatatacagttcaataaaatttggtaatttgaccgatttaaggagagtggaaattagggcttctgcaatcttttttcttcgccgcaatctcatg

SEQ ID NO: 28502 - DNA, 3003 bp, Unknown; identical to SEQ ID NO: 28266
  misc_feature (1)..( 3003): 2750-1469P.txt file - cDNA_ID_2997205; gDNA_ID_2926139; Annot_ID_138952

SEQ ID NO: 28503 - DNA, 3003 bp, Unknown
  misc_feature (1)..( 3003): 2750-1469P.txt file - cDNA_ID_2997212; gDNA_ID_2926139; Annot_ID_138956
ttttttcttatctagaagaagttgttgataagcttttagaattctgttttattgtttagtgaaggaataatcttcaattttgtaccctggcctgaggaataattttaagtttggtggaaaattgcagattgttatgcaactcttagtctataccataagataacctcatgaatgaatgtggtaatagtggttgcagagcgtgtaattacaactgctttgtgttctgttgtttagtggaaatatgaatctccattttggcttgagtaattgcatattttgtgatgtatccatctctctaagtctctagactaacctgaggtgacaaacgcagcgatagagtcgctggataaaatgcgtaaaggaagtaagaaagcagcactgcagatggttgacatggaatgcagttacctcactgttgatttacaactcttatgcattgtgtttggtggataatgcatatcaaacgtgcagagagtactgatcagtttacaactcttaaccggaaactgagattctcggttcggtttaaccggtttctaccgaattcacaggactacaaatattttaagttaggtaagggaaaccaaaagtccacatgtttctgatccacgtcagcatgaaattctaaacgacgtttcagcgtaattcatcttctcttgtataacacttccgattctaattagggtttatcgtttgcatcgctcttgccactacctccggagtctgtttcatttgtttaaggtgagtgaccacattgattttagaatgattatatatgtatggtttgaattcttgcttacctcttgttagctaaggttttatcttaaccattaatttagtaatataggattcttgttttcaaacagtgaatggaggaattaagccaaatcttgaagaacaataggaccgatgatctcacttggttttgctctctctcagaatctgaactggtaaatatattgtttaatcattctctttctttctgcagtcaaaaactaacattgatcaatcattttttcaggatttgctcatcagcttaaaaaagctagtcattcgacgtgccaaagtaagtggtctcgaagatctagtagctgacaaatttgatcttaagatgctccgatctctcggttatcttctaacttccgacactttttgtttttttaaatcctgaaatctgttattgtgaagctattcatctttgatcttgtgacacaatcatatggtatcttgcagggcttgtgctaatggagtatgtaagaaaaagagtagaagatgatacttctcttgccccaagtgttgtccaagaactcagccttttggatagttgtaacttgttgaaaacgcatgtagatgatactgtagacattgaggagattctgactgatatctgcaacaagaagtcaaaaaagaaaacacggaaaaggttgtgcttggtacatagtctaaagagttaggggaaggacctttggataatattccatgccaaatacttatatgcatttctttcgtgtttgaaggagccggtaggaaccagcctgctgcgatggacaagtaacagtgagagagggttgcaaaaccatgagacaacagtttttccatacaaaggctgttggaaaatcaatgtacgttactttccttgcatctggttccgactattcattttcatccactccaaaattattgtctgttttaagcatcttttttttttttttttcggagagggttttaacatctttgcttgttagcgaacatctcttcttctttttgctattcatgagtatgttactcatacactcaaaaatatctaacgagtgtaatattatgtattagcgagtgttttacaattgactgcatgcattttagaattatatcttgattgagtgaacaaaactcaaaaggtctaaaaagaattagttcgaatcggctgaaaacttcgagttccggtttattaccggtttacacttaaccaatctataaattggtaagcaattctatcgactaacataaacccttgataagttaatagattattgtttatacgtattcctactagagacgtgttgcgaaagtgatacgtctcctaattaaagagaaaacgagatttaatcgttattaagaagaaacttcaaagtctttcatggatttttagactctgaagtagacgcttttgtcttctctgtacgtatataatacgttcttattttgacttttatttggcgtttttttccaatttcgttttaaaaattccaaaggtagctaacttttggcactcaactgcgacaagctgttcaaaaatgatacatctgttacatatgatttattaaactaagacatttttataatatatgtattcagatattgattataacgtccaaaagaaaaacagagatgctctgatttttataacccaagaaatacgttacctgacgttaataattgcctaacaaacgattaggcccaacaaaaaaacgtcttataagttaaaactttggtttgggtcaatgcttcatatgattggtcctcagttgggctacaaaagggacacgtgtcaagatcagacggcggttctcaaagcaacccggcaatttccatggaaacagaggtatgaccaacatagtaagtaccgtagagtaaaacagaaaacgaactcacaaagaaaatcttttaacacttgtttttatttgccttgtttttctaagaaactaagatttgtttattcgtttaactggtttggtcacgacaggtgattgatctttaaaggcgagttacgtctttttggttctcgtcttctgtttctgaagaggcaagttctctttcctccctttttggttactagctctttcttgttcttgcaactcttattcacctcttcttatagaagtccatggtttttcgtgtttcagagttttctctaacttagaaatctcttttcctctgcagttgtctcttcttgccttctattgctgataaggtgttttgaaagaagaaaaaaagcctaaaatg

SEQ ID NO: 28504 - DNA, 3003 bp, Unknown
  misc_feature (1)..( 3003): 2750-1469P.txt file - cDNA_ID_2997216; gDNA_ID_2926139; Annot_ID_138957
ttgggatcgttaaattcgatctccgtgaggttcagtctcgcgttcctcctgatagtcctttagctccccagtggtacagactggagaacaagagaggcgagaagaagaattatgagataatgcttgctgtgtggtctggaactcaggctgatgaagctttcggggatgcgactttctcagactcattggtagattcagacagctccaacattatatccgctaacctgcgctcaaaagtgtaccattcgcctcggctatggtacctaagggtgcaaatattggaagctcaggacgtcatcatcgtgtctgacaaatcccgtgttccagaggtctttgtgcgagtaaaagtcggtaatcagatgttaaggactaaatttccccagagaagcaataatccaaaatggggtgatgagttcacgtttgtagtcgcggagccgtttgaggataacttggtcctctccgtggaagatcacactgctcctaacagagacgagccagtaggaaaagctgtgattttgatgaatgacatagagaaacgtatagatgataaaccttttcatgaccgatgggttcatcttgaagactccatctcagacgctatggatgttgataaagccaagaaagtgaagttcgctactaggctccggtataaggcggttctcgatggaggctaccacgtttttgatgagtccatgtataacagcagtgatctcagaccttcgtcgagaaagctctggaaaccagcaattggtgtcttggagctcgggatacttaacgcaaatgtgttccattcgatgaaaactcgggaagggaaaggtacttcggacacgtacgttgttgccaaatacggtcacaaatgggttcggtcacgaactgtgatcaacagcatgaatccaaagtacaatgagcaatacacatgggaggtttttgatcctgcaacggttttaaccatctgcgtctttgacaacgctcatttcgcagcaggagatggcggaaacaagagagatcagccgattgggaaagtccgcattagactctcgactcttcagacgggccgtgtgtacacgcatgcttaccctttacttgttctacaacctactggtcttaagaaaagaggagagcttcacttagcggtgagattcacctgcacatcggtctccagtatgctgatgaaatacacaaaacctctcctgcctaaaatgcattacatactacccttatccacaaaccaacaggaagctcttaagatgcaggctatcaacataattattgttcgtttaggccggtccgagccaccgctgagacgggaagtggttgactatttgacagattggaaaagtcagctgttcagcatgaggagaagcaaagccaacttcaataggttcacgacagtgttctccggtgcgctgtctgtttggaaatggatggaacaagtgtgcacatggaagactcccgtgacgacggctctggtgcacgtgctctacactatgcttgtgacgttcccggagatgattttgccgactgtgtttctgtatatggctgtgattgggatgtggaattacaggtttaagcctagatttcctcctcatatggacgccaaactatcttatgcagacaatgtaaattctgatgagcttgacgaagagtttgataccttcccgaccgtaagggctccggacattgtgaaaatgaggtaacaaaaatcaagaatgatcaaagaaaatcgaaaacgaagaaagacttggtcattggttgatagttttcctccctcatatttttcaggtacgaccggctgagatctgtggccgggaaggtacagtcggtggctggagacatagccgcacaaggagagcgagtgcaagcgttgctgagctggcgtgatccacgcgccaccgcaatattcgtgacgttctgtttcattattgccatggctctctacattaccccttttaaacttgtcgctctgttatccggttactacttcatgcgacatccaaagctccgacaccgcattccctccgctcccgtcaactttttccggcgacttccagccatgaccgactctatgctgtgaatcttcttctggatagagtaatcaacaaacatgccatgtatataactctcttctttgaatctgtatctatctatcgatatgcatctatatgtgttgacaatcatgcgttcgtgaactcgttctccgaattaacaatggtgatcgcaaacaaactctgatgatcaaatcaaataaattgcttccacactcgcaatgttgaaacagagaatctaaaagctcaaaacagagtcggttagatcctaacaaactctttaaaccttctccaattcgcaaccaaagctaaaccatcgcttccacaaaactaattggtcgataaccagcctaaacccggtttgatttaagctgaaccagatccgtgtgatcaatatataaaaagcccatgggccttgaacaaaacaacgtcacatcggtgattaacactgtttttagtgcttaattagttccctccctgattacaaaagtccgttagtgattacggcatgaagagacaacgggaaagaggaagaagcatatctctctctctgtcttgttctatgaacgagaccacttgctttaacaggcggtgctaattattttccagaaaataaaaaaccccaaaaatctgtacgacaaacaatttattaatcaactctttttttttctttctataaggttaatggccagattctttcttctctcacacccattaaaatatttcatcaacttgtcggtaaaattaattcttggcttattctatctttctttctctgtcttcttctttcaatttttcaataacaataatacagatgtgtatacattagatacacgtatactagtactaaacttcactgtgtgatctgatctagagtttttatactatcagaataaataatagtcgacaatttgggatttgtttatggtttacttcacatgaatcacatacgttcatg

SEQ ID NO: 28505 - DNA, 3000 bp, Unknown
  misc_feature (1)..( 3000): 2750-1469P.txt file - cDNA_ID_2997220; gDNA_ID_2926139; Annot_ID_138960
ttgggatgtcttacgaaataattttggtagaagagaatgtaaaatttttcgaataaaaagtagtcagcaaaacatatgatttttggggagtttttagataattaaatcagagaatagagctggacatatgagtaacgtcgggtagaacctgttcgggtttgggattaatgggtatatgatttactacccaatagaataattcgaaatatttggttctggttcgggtcgggtccatttggatttgggtcagtttggataaaaagtttcaggtcctaaaaatactcaaaaaaatagaaacgggtattttctatgtagatagcgggtctccaaaaaaaaaaactttaaaatttgttaagttttaatatatttaattatatttgaatatattttactaaattttgacaaacataacaaataatttttgaatagtttagttgttttggatatttaggtacaaaattaattgacatatttagatttataattataatcttagataataatctattaagattaaatataattaatattttagatattaaattaatgtttgggtttttgaataccctttttgggtaacgggtaatttctggaccaatcggatatccacgggtttaataaaactctacccaataaggaaatttcctaaaattctaacccgctctaacccggttttttggttcggatattggattggttatcgggtccgttttttcgtgagccctatcaaagataatctaatataggatccaattagatccacaaatataaccaaaatattatacaaagaataattctaagttaggccaaaaattaaatcttctaatacaaaggaaacatgtttcttaccaaaacaactcgtatacaaattttacatttacttaaaaactacatatgttgtatttattataaaaataacatttttaaacaaagtcaatccaatgcagcattatatccaaatagtaaaaacattaaaaaatattatgacatcacttttatactatactatttcttatgtaattcaaataaaatatataatttaatttatataaaatattaatgcccgtgctgtatagcacgggttatgatctagtctatatattgttccacctacattgattatttaagtatatttattttatcgaaatttgctaattttccataaatcgatctattaatttaacaatgttattttgaaaaaatggtctttggttattattgtatagttggcactgctttggaagttaatccataattattaagtactattaaatagaaaatctctattgaattgttctatttttttgggtatcgtcataaattgataccatttaaagagatactcttaaaatagaaatctaaatttactttgcaactgattagtgatactatgggtccatccatgatggtgatactaaagtattttgttcagatgattactatcccaagcgacgctccggagacgcgtagcacgtgaatggcttcgacggaatttattacaacgttgtacaatatggaatgtggactagtgttgtgtgtgtgagtactgtcttataaaaagtggaattcaatttccaaaaagattgaaagatatttgcagttgctattattatagccaacgccacggttaacctaatatgacaaaaatcagaaagacgcgtaaattgattattttatgttttcatatgtttgaataagctatcttccatgtagagagaaagagaaatctctttttcacgaattaagaaaatgatacaagtaagattctttacaagagatataagatcatgcatatctgattctagtagtatctatacacgatcttagaggaatagtatgagaatatactagcatgaattgggatttactgctttagatagtatgaagagcttgcatttggagaatgtaacatttatctctttttgttgctgtctttcactagacaaaccaaacaggtctatctttgaacatcaacacaggaacgcatgaagttgctagaagcgttgtggctgatctacgtacgtctaacttcctatcatcctatgtcacgcaaggatatgaagggatcaatatttgccaaacagaaatttgattaccatttaccaatgtgagctttcttctatttttttcactcgtttgctttgggcttcgtattgtttcatccaaatgtaattaaccaaaaaatctcgtatctattgtaatataggcctcggcaaataaaccaaactgaatcaaaccaaatcgaaccaaaattggaaattaaccaaatggataataaattctgtaaccgaaataactgaaaccgaatggatacaaacagaaatataatattttgggtaaccgataatatccgaaatataaatatattttcaaaagtattagttatatctagaataaataattaaaaatacttgagaatatatataaaatagtaaaaaactcgaaaataacaaaaatatccgaaaatatccaaaaataattgaaagatccgaaaatatttaaagcaaaataaccgaatggatactacattttaaaaccgaaagaactgaaatcaaaccgaaccgaaccgaactttcaaacgaacgcctatactataatgtaatctgaatgttctatcttgaccgtcaaaggacgatccactggtatattatttctcataagccagcccaaattacatttcaaggcccaaatccattagcctcaaaaagttaaaaaaactataatcaacggaacattccatttttttttataatattcttaaatcaatttatgtattcaccgtgcttcgccagacaccagagacgcttactaaagcactgagaaaaaactaaatgagattttgatcacactcacacaacggattgcgaaatagtaatattttataatcgccgacaaattcttcagatctccaaaattgaatcttattataaaccctaagatttgcatctgatctgctctcgaagacgaaagcttcgagtactggttgaagctaaagctatg

SEQ ID NO: 28506 - DNA, 3000 bp, Unknown; identical to SEQ ID NO: 28505
  misc_feature (1)..( 3000): 2750-1469P.txt file - cDNA_ID_2997220; gDNA_ID_2926280; Annot_ID_143595

SEQ ID NO: 28507 - DNA, 3000 bp, Unknown
  misc_feature (1)..( 3000): 2750-1469P.txt file - cDNA_ID_2997236; gDNA_ID_2926143; Annot_ID_139030
tgtctctgggggatctatcaatacttcttggcaaaagggtcaacttctgcgacaaggatcgtttggctctgtgtatgaagccatttcagagtaagtcttactggttgcttatgtttgttgaacttaaatcaattacttagttttacgttatgcctttgctgatggatggttttgctgaatgtagagatggggacttctttgctgtcaaggaagtttcacttcttgatcagggaagtcaggcacaagaatgcatacaacaacttgagggggtatggaagtttcatatatgatcggcagtatatatctcattgatcagacaaaagtaggttgctaatccaccttaccttagccacatgttttcattttctacaggaaattgcactacttagtcagcttgagcatcagaatattctgcgatatcgtggcacagacaaggtatggccctggtgtccctttcttgttctcagttgcagttgcctaagcattttgttctgcaattaataacttatttcgttgtttgcaggacgggtcaaatttgtatatttttcttgagcttgtaacacaaggatcccttctagaactctaccgaagataccagattcgggactcgctaatctccttgtacacaaaacaaatccttgacggtttgaaatatcttcaccataaaggtttcattcacaggttagactagtaaactctcttgtcacagctgtaattcccaagcctctgatttcctgcacatcctaggttacttacttttctcatctgatgcgacaaagggacattaaatgtgcaactatattggtggacgccaatggcaccgtcaaacttgcagattttggattggcaaaggttcttttccaataatagatgtttatagcttttactctaacttaattacttggtccatcgtttatcccccttactcaatatatatgtcatttttttcatttaggtgtcaaagttaaacgacattaagtcccgcaaggaaactctattttggatggctccagaggtatacttcgggatccttcctcctgttttgattgttgtgaatacaatgacaaacatatcatatatcaatagcaatgatggatgttatactgttgcttatatatgttgttgcaaccgttgtgatatgggcttgatagcctcaaaaacccccgattatgtttccttcatagtttgattaaatttcctttatttctgtttataactgtaagtatgtttgtgtaattatacgtaacagatatatttgaattccttccactttcattgtagtttaggctatacttgatcaggttatatgttacagtttttcctaaatggaacataataatttgatcaggttattaaccggaaggataatgatggttacagaagtccagctgatatatggagcctcgggtgcactgtgctggaaatgtgtactggtcagatcccatactctgatctagaacccgtaagtcttcaggattttcaaacttttgaactgtcttataatcttaaacgacattgaagggtctacttaatgggattttatgagttaaaggtcagaatttgtgcaaacgcgcaggttgaagccctgtttaggatcagaaggggtacgcttccggaagtacctgatactttatcactagacgctcggcatttcatacttaagtgtctcaaattgaacccggaagagcgtccaactgcaactgagctactgaaccatccatttgtgagaaggcccttaccatcctcaggctcaggatcaacatctccgctaatccgtagatgaatctaattttattagattgcctccataggtgaagcctctagtttcgttttattgagaatatattaggatcaaacgctatattctaacattgatatcttaatgtatgagagcaggggtaaccagaaggtttatgagatattagaccccatagaaactttaggggagacacgagatatgattctttgatacatatgctgttttggttgcgcagcaagagctaaactttctcgagacatatcttcaggtagtttctgtctcattcattggttggttgttgtaagttgtgtcacttgtgtgtgttgagcttatatttaaaactgaagagccttggttaaattagagttttgggtgcataggtttgtttagttttgttaaattatagtatcatgtaatgtataagaagaaccttagttgatttagagtttcgggtgtataggcttgtttggttttgataaattatatagtgtatgcatgtaacccatatcatgtaatgtgtaattatagttggctcttatatagttcctgcttgttgcaactgtttacacatctcatgtctcgatggatttaatctccaatttttcttatatatatatctgaattatacatgcatacatacactataatttaacaaaactaaacttttcttttgggtgcaaaaacataacctatattcatctcttaattattttacgctgaagaaatctgctgtttcaattaaaaaagtatggtcaaaccaacattttctttgaaattttggtgaaagccactctcattgaagtgtatatatgattcaacttgtttcttacaatatttgccccgttgaaaacttttttgccatcgatgagtttctttaagggcaaagttcctttaagaaatgcttttagatttctttgtatacctatgaatttttaatcaagtgatgaagacacggagaaaaatcctaaattgatgctaaatattttatctgtggacttaaccaagtctcccacaaaaataatacaagaatctgcaacaatttttaaaattcagtattcaattattattcagatactattactagattgaaaattcaactcttgtcataagtcgtcgtcaacttcttttgtttgcttcttcctttttctctaacaggtgcagtgttactgccagttgtttggatatttccacttgtgtatttattctctctatctctttgacgtcgtctacagactacaatg

SEQ ID NO: 28508 - DNA, 3003 bp, Unknown
  misc_feature (1)..( 3003): 2750-1469P.txt file - cDNA_ID_2997244; gDNA_ID_2926144; Annot_ID_139037
tagattataactatataatttaaatttaaattatatatttttttattaatattgtttgttttgttttgtgttttagataatgtaattgtatcttaattgttatatctaggatttcacctttagtataccgtcttgtattactatcaacccaaacccgtcataccatctaatcatgttcaatgaaattaaacatatctaatggatttcacccgtggtatatcgtctcgtattactatcgacccaaacccgtcctaccatctaaccccgttcagtgaaattaaacattattttgttatttttgttttaataatactttaatataaaaatatataattcaaatcaatttaaaagttttctttcaaatggttatttaatttttataaagttcatatgatatattattataaacccatcctaccatcttatctcgttcggtgaaattaaacattttttttaataatacacttattaaaaaaattataattcaaatcaattcaaagttctttcaaataattatttaattttgtaagattttccatattataaatattgtaaacgttttccgttaaatattctaaaatgtttaataaattatagataactataatatttatcttttaataaagtataatattaataatgtgctaaactttctcttctttgaagtaattagaatttatgaaaatatattagataaggaaatgctagtaattaggaatattagtttattgataataattaatgctaatggcattccttgtaacttgtaagtgagttccaactctaggatttatttcacaaaatggctgcaaaaatgtatatgtagattgttcataaaagtatacaagtcattttcatgaaatcaaaacttataaaaatccacttcatgtttttttttgtttttttgaaatgttgggttaattttggaaacaaaaatcttttagtactatttttgtcaatcttcctacattttatcccaatttctatctaatgaatttttattaattgttttgggtattttggtaggcatatgcatagtacccgaacccgaggaaccaacccaaaattgacctgtaaactcgattcatatccaaacccgaaactttcaaatacccgaatgggtctaaacttcaaaactcaaaaaacccaaacctgaacccgacccgaataggtacctaaacatacctcaaatataagtatatattaataatatcttagttatatttatacttatacatacaaaatattctgatttttaagttattcttgtgtattgtcggttacttctggatatattcaaataaaactatatgagttggtttggtaattttttaaatttttaagtaatttgatagatttgcatacaaaatttttatattttaatatttaaattaattcaagcccgaacccgactagaaatctaaaaatatccgaacgggtcttaaattcaaaaatctcaaatgaataaaaaggattttaactagtatttataaatcatcgaatcaataatatataattttaattagaattttaagatcaatgattgaataacaatttttggttgaatttccaattcctaagctataaaccaataacccatcctaaatatttcaactaaaccgaaccgacaagaaatcgaaccaaaaaaattctggttcccttatcgatcataggaggcaggaaccaaaaaaacaaaaaaccgaatgaaaccgaataaccgaacgcccaacccttttgtacatacttaaaccgaccatattccatgtttcatgttacaaaaatagttaaaagattttacaactacagtagaaactctataaattaatactcgataaattaataaacacgataaattaataaattttgccggtcccaagtcgggccaatgtaaaaattaaccaaaatcgataagataataagataataatttttttgaaatccctatgtaaagttatagtcccactaatattataaattaataatcataaatcttaagtatatattttaagactaatttttatatgaattttttgttcaagctacaattacaattctttttaaaatacaactagtatgatatctgttgtactcacataactatttgcgtatttgatccgtcatagttgattttgtaaaatattttatttgagaaagcattgctaagatttgtgtaaagagaaactggattaagcttcatgtttacgtttacgttcacgttaatattgtaaatatacatacacaatatcttgccaaaaaataaattaaagaagtcaaataaaaataaaaatctaacataattatatatgcaaacaacaaagcatatagataattaaatctatatatacatttttacagccattttgtgaaataaattctggagttggaacttatttacaatgtctgccattagcttttaattattggtttttttttggcaaatatattaaaagcatatagataattaaatctatatatacatttttgcagctattttgtgaaataaatcttggagttcgaacttatttataatgcctgccattggcttttaatatatgttaataaacattttcaaaataatataatattgtattttacataaatatttctataaattaatatttattaacttatacgataaattaatatttattaacttatacgataaattaataaatattaatttataagataaattaatattattataaattaataaaattttatggtcctaacattatagagtttctactgaagaacaaaccgaaaagtaaaaaatatctaattctgtattaaaccagtaaaatttcgtaccgcagcgataccggtttactaatcaaacccgaaaaaaccactccgtatccgtaatcttcatctctcgctacgacacaccaactgtttaatttcccaatttgtcgccgactcttcgaccttaaatcaccggaatctttctctaggtcgccgtcaagcttctctccggagaatatggttttggaataaacgatg

SEQ ID NO: 28509 - DNA, 3003 bp, Unknown; identical to SEQ ID NO: 17074
  misc_feature (1)..( 3003): 2750-1469P.txt file - cDNA_ID_2997247; gDNA_ID_2926145; Annot_ID_139074

SEQ ID NO: 28510 - DNA, 3000 bp, Unknown; identical to SEQ ID NO: 5314
  misc_feature (1)..( 3000): 2750-1469P.txt file - cDNA_ID_2997251; gDNA_ID_2926145; Annot_ID_197702

SEQ ID NO: 28511 - DNA, 3000 bp, Unknown; identical to SEQ ID NO: 5314
  misc_feature (1)..( 3000): 2750-1469P.txt file - cDNA_ID_2997251; gDNA_ID_2926145; Annot_ID_139083

SEQ ID NO: 28512 - DNA, 3000 bp, Unknown; identical to SEQ ID NO: 5314
  misc_feature (1)..( 3000): 2750-1469P.txt file - cDNA_ID_2997251; gDNA_ID_1620778; Annot_ID_167826

SEQ ID NO: 28513 - DNA, 3000 bp, Unknown
  misc_feature (1)..( 3000): 2750-1469P.txt file - cDNA_ID_2997255; gDNA_ID_2926146; Annot_ID_139086
aagttctcatgaagtttgacttctcattgagtctctttgcagaaaagtcatagaatggtagatatgatgcacttgagagagagactatgctagtccacattaagtttctcttagtactatgaaatataaaatgtccttccatatcgcttttctcgctgaaggtgataacttgaggtggatatcaaatgggtttgtcatatatcctctattgttagttgttttcaatagcctgaggtggataaaggtagttgataagtttttggttgtctatgtgcttcagagattgcttgttccatccaatgtttaatggtactaatacgaggtgcatatttatcaaacaaatagaaattagaaagatctgttagagtcaacattagtaagaaaatgtatctattagctgctacttataatcatttcaatatagtttctttgtggtctgacagaactctgtattatcatttcataagtatccatgttgtgttcctttgcagaaagtcttacaattgttgatattatccagtagatgcacttaatagagagactctaatggtagtccacattatgtttctggtttttataattgtcagtccatatcgttttgctttctgagggtaataaaactttggattcttctgatatatcaaatgggtttttcatattattcatatatacagtattgttaggcgtttttgatagcttgaggtggataaaggctgttgataagtgtttgattgtctatgatgcttgagagattgcttgttccatccatgatttatctttctgtatccttgagatgtagcatattttatcaaacaaatgaagattagaaagatctgttagtgtcaacattagtcagaagatgtatctattagttgctacttttcatcatttcagctggaaacatagtatctttgtgttctgacagaagtctgtattttcatttctctctaaaggttgaaaactgtactacaccgttagaagaagatttgcttgattcagttttgggatcactcataagcaaagatgaaactataatggggcgtctcttcttggaggcaaacatccacgaccaatcgtgccaagccttgctgagcaagtgggatcacttaaagccttcaacgcaaaaggttctttctttagtttcaaaggcaaagaaattcgaaaaggaaaaagaatgcatcatcatgaatctcgctaaagctgagcaagaggtaataatcataaacgataacactctattgttcttaaatgattccacttgactcacaaactttttacaggtggaacttgtgagcacgctaaaccgaaagctggataaagaaaatcgtaagttgctaaggcaacaacaaagccctctttgctccgcagacaagaaccgaaacagcgcatctgcaaaggtaaaagtaccacaaaaagaaagaagtaaacactgcgaaggaaaaagcagctatgtggactctctctttgattctaacttaggagtgttgttctgtttgcagtcaaacaagagaaagagtccgaagacgatgagtagcccggtcgagaagaggcttgagtttagcagtccagaaattagcaggaagcctctatcacctgtatggaataactcaccagattctaagatgaacaacaattgatgataaacaaaatcaaacaactatctgtatcattcatatgtgaaaccggattatattgttgcttctctgaagctactaacaacatgtatcagtattgctatgaacaaatttgaccagaaaatcatgttttcaaactggtaaataactagcttattatatacaacagcagtgtaaaactgacatagcttactaaacactggtgtttaacatttcttacaaaaacgcaaccgttttcggtaacctacaacgacgtcgttgcgtctacaagaacagtgaaatttatacaaacgttgtcgttttcaagtacattttctaaacgacgtcattgcttctacaacaaacagtgagaatcatgaaacacgtcgttttaaaactaagaacgacgtcgttagtctattccaacacaataaatgtgaaattgcgttgcttttcgatttcttcttcttatccaaaactctctcagtcatggctcttcttcgtcttcctggcatttccctccaaattctaggtcacaaatcaaaccagaagaaccctaatcccaatgttgccttcaccaatcactctctctctttatctactccttcactatgtcgtctccatcgtcacgcgacgtttccagactcaattccagcaaaatccagaaacctcacttcgtacttctccaccacaacacaagagccagtcctcgaatcttcttcttcttcttcttcagctcctgaggtagtagaagaagagatttctaaaaccagattgattgctcagaatgttccatggacatctacacctgaagatattagatcgttgttcgagaagtacgggagtgttatcgacattgaggtttttggtttttctcgtttccttcttttgaaatcgatgaattgaatcttttgtgttttggtttaacgaattgtgtttgatttttgatttgtagatgtctatgcataagaaggaaagaaatagaggtttggtgttcattgaaatggcttctcctgaagaagctgcaacagctcttaaatctcttgaatcgtgtgtaagtacaacgcttcctacatgtctatattggaatactatcattgagatttggttgcgttatgtttcatattatctggctttacgattagtagaagttatacattgtgcttattgggctcttttatgttgcagttatctcaatttgattgattattgtatgtaagaacattgcaattcgcttcctccatctctaagttagcacagaatcattgagatatttctctcatttacattactttatgagtagtggaagtgtacattatgttattagactctttcaggttgcagtatcccgtgtaaacaatagatttttctggcctaaaacttgatg

SEQ ID NO: 28514 - DNA, 3000 bp, Unknown
  misc_feature (1)..( 3000): 2750-1469P.txt file - cDNA_ID_2997259; gDNA_ID_2926146; Annot_ID_139087
ttcctattgaaaccctaaattctcttcttgaaatccaaatcttgtttcaagagtaaaccatgcggagcgagagaattgattcagatgaagcagaaacaaaatcgagaacaaatctctcgcaagaagtcgaagaatatatcaaagatacaattgatcattctttaggtcttccgatctccatggaatctcttcagaagaagctttatacggctgaagaatctcaacgccgtcttcgcgaacagtatcagggtctgatttcgcgattaaaggagaaagatcatgtaatcgatcgtgttagggttagtaatttctttctgggtatctttcgttttctgggatttgattgatttgaatctgaatctttttttttttttttttttttataagtctgaagcgagtatgaatgcgcaagcgttgaagaagtttgttgaagagaatcagaaattggctagtgagtgtgggaatttgttgagtcagtgtaagaaattggagaaagagtgtttgctttatcatcaagatcgtgatgcgttgatggagtttgggaatgaatctgatgagagagctagagaagcagaagctagggttcgtgaattggaggatgaaattggaagaatgtctgaggaaatgcagagatttaagcgtcaaatcggagatggtgaagtaagagtttcttcatattaaccctaaattttctttaattgggttaagttgggtttagaattgcattgccctcgagtaaattagtttgctttttgcacttgctggtttatagtttggttagcttgttcttgatgaaatggttactcaagtgctattgtcttctctctactctttaattagcacatggggtaccatcatttggttttctttgttaagttgacaacttgatttatctaagttctcatgaagtttgacttctcattgagtctctttgcagaaaagtcatagaatggtagatatgatgcacttgagagagagactatgctagtccacattaagtttctcttagtactatgaaatataaaatgtccttccatatcgcttttctcgctgaaggtgataacttgaggtggatatcaaatgggtttgtcatatatcctctattgttagttgttttcaatagcctgaggtggataaaggtagttgataagtttttggttgtctatgtgcttcagagattgcttgttccatccaatgtttaatggtactaatacgaggtgcatatttatcaaacaaatagaaattagaaagatctgttagagtcaacattagtaagaaaatgtatctattagctgctacttataatcatttcaatatagtttctttgtggtctgacagaactctgtattatcatttcataagtatccatgttgtgttcctttgcagaaagtcttacaattgttgatattatccagtagatgcacttaatagagagactctaatggtagtccacattatgtttctggtttttataattgtcagtccatatcgttttgctttctgagggtaataaaactttggattcttctgatatatcaaatgggtttttcatattattcatatatacagtattgttaggcgtttttgatagcttgaggtggataaaggctgttgataagtgtttgattgtctatgatgcttgagagattgcttgttccatccatgatttatctttctgtatccttgagatgtagcatattttatcaaacaaatgaagattagaaagatctgttagtgtcaacattagtcagaagatgtatctattagttgctacttttcatcatttcagctggaaacatagtatctttgtgttctgacagaagtctgtattttcatttctctctaaaggttgaaaactgtactacaccgttagaagaagatttgcttgattcagttttgggatcactcataagcaaagatgaaactataatggggcgtctcttcttggaggcaaacatccacgaccaatcgtgccaagccttgctgagcaagtgggatcacttaaagccttcaacgcaaaaggttctttctttagtttcaaaggcaaagaaattcgaaaaggaaaaagaatgcatcatcatgaatctcgctaaagctgagcaagaggtaataatcataaacgataacactctattgttcttaaatgattccacttgactcacaaactttttacaggtggaacttgtgagcacgctaaaccgaaagctggataaagaaaatcgtaagttgctaaggcaacaacaaagccctctttgctccgcagacaagaaccgaaacagcgcatctgcaaaggtaaaagtaccacaaaaagaaagaagtaaacactgcgaaggaaaaagcagctatgtggactctctctttgattctaacttaggagtgttgttctgtttgcagtcaaacaagagaaagagtccgaagacgatgagtagcccggtcgagaagaggcttgagtttagcagtccagaaattagcaggaagcctctatcacctgtatggaataactcaccagattctaagatgaacaacaattgatgataaacaaaatcaaacaactatctgtatcattcatatgtgaaaccggattatattgttgcttctctgaagctactaacaacatgtatcagtattgctatgaacaaatttgaccagaaaatcatgttttcaaactggtaaataactagcttattatatacaacagcagtgtaaaactgacatagcttactaaacactggtgtttaacatttcttacaaaaacgcaaccgttttcggtaacctacaacgacgtcgttgcgtctacaagaacagtgaaatttatacaaacgttgtcgttttcaagtacattttctaaacgacgtcattgcttctacaacaaacagtgagaatcatgaaacacgtcgttttaaaactaagaacgacgtcgttagtctattccaacacaataaatgtgaaattgcgttgcttttcgatttcttcttcttatccaaaactctctcagtcatg

SEQ ID NO: 28515 - DNA, 3003 bp, Unknown; identical to SEQ ID NO: 23375
  misc_feature (1)..( 3003): 2750-1469P.txt file - cDNA_ID_2997273; gDNA_ID_2926146; Annot_ID_139098

SEQ ID NO: 28516 - DNA, 3003 bp, Unknown
  misc_feature (1)..( 3003): 2750-1469P.txt file - cDNA_ID_2997289; gDNA_ID_1971905; Annot_ID_58530
tttattcactggactttcccatatataactgctccattgttttacatttttagaaccctagtttgttctttccaggtcatttactatgtggtttttagatgtggacaataatatagaggttatgaaattatctgaatccatactttttgaatatgtgaaactcggataaacatcaaaatatccgtatcagaatcagtaaaatgttagtagaaaatatttgaaggtataaagagttgggcaagatgtgttagcggcaatgattttgaatgtgatgagaagtaatatctaagaacaagtggttagatacacaattatgtgaatagctgatatagtagatacaacaaaaaaatgattgatgagaaggagatagagaaagggaactttggtccattgaccaatgtgtttgcgatcactttttcaaattttgaagtaattgactacattgtacaatttatgtgtaatcatgcatatagtttctacatcgattcatcatacaatcatgagttttcatatatctagatcctaattacaatcaaatatatgtttgtgagaggttgtatgtgactttgaataaaacacaacatcctccattatatctcttttgaggatttcagataattttgaggatttttttagttgaaaacacatatatctaactaacatgatttaagtggaatttgggaagattttcaaacaaatcattacaactactctaaattcacttaagatcaacaaaatcataaaaactcaaatcatttaaaacaaatggttggatacactttgaaacttgcaacttatatttcgattggttgtttttttatagtcgattgttcttaaaaaaaaactatatacttgatacatatattaataaataaaaaaattaaaactatagactaaatgttttgctgtgaaagtgtgttatttatatcttcaacatgagagaatgcatcattggtggtgtgagataaaaccattgtgtctttctaacccacatctaacaaatattttatcgaattgggccttaaaataataataagtgaagactcaataacactaaaaatgcagcgaatattctagctctacaatgttcttcggtataattagagttaaaaatttgtggagactatatataactcattttgcctcccatgggtcataagcaagcaaaaaaaatggagcaaactttcatcatgtagaaaacttgtctttctttctttaatacatatttgaaggtctaaaagagttaggcaagatgtgttagcgacagtgttttcgaatgtgatgagaaataatctttaagaacaagtggttatgtacaaatttatgcgaatagatgataaagtagatacaacaaaatgattgagtagcaagagatggagaaagagaactttgctctattaaaaaatgtgtttgagatcattttatcaatttttgaagtaattggctacatcgaataatttatgtacttatatatagtttctatatcaattcatatacttgatatatatattataaaaaataaaatccttaaaactacaatttttgtttagaaaatgtgttgtgtatatcttcaacatgagagaatgcatcaaagtggtgtgatcaaactcttttaatccaaatctaacaaatatattagggttttgtgccaacaaccctcaaaaatatttttttttgcaacataacctttcatattaaatacatgtaggtcaatactctgatatcaaaagtcacccacagtataaccacgtgcatagattttatataatctttgggcgtgcttagattttgcaaaccgtataagtatgtatataagttattaaactacgtcgtttgagcatcttttcggaaaataatacattactagagtggattggaaccaataacctataatactaaataatgcacttaaccaattgtgctgcaagatttattgttgatattgcataccgataaatatatattgtgaacattgcattctgggtttcttcatcttcttaggaaattaggtttattagcaatccgaaatctctattcacgtgaactagtttgtttatcaccactgatttcattatctttggccatcatcaacaatttgtagagcaagcaagggctcattctcatcgcaattaatctattcttcatcgaggaaagctctgagacgaggcgtgggtggaagaattgagcgtgttcagacttgggtttgatccgatcgtaaccgctcgcgctgtttgtcaagttttatgtttacaattctgaaataatgttattgttgtattcgattcatgtttaaactatatatattaatcggtttgtaaagttaacaaaatcactctgctcaattggttaagtaatctttgaatagttcaatatgccatgcgttcaaatctattttccaacattattttgcgtttttgtttaaaggctcaaaacaacgtagttttaataacctatatataaacatacggtttgcaaaatctatacacgtctaagagatatactataggtgacttttgagatcgcagacctgcatttatttaacttacatgattgagttacaaaaaaaattacttagagaattttttggcacaaaatccaatttttataactaattgaaccttaaaataataataagtaaaagccgttttttttgttaaaagaaggctcaaaacgacgtaattttaataatcatgtacagatttatatgatttgcaaaatctatacacgtgcaagagttatattgcgaacgacttttaatatcacagtattaatctacgtttgtttgacataaataattaagttgcaaaaaaatattatttgtgttttttttatgaagcccaatattttatttaattgggcctaacataataataagggaagcccaataatttgtagcaaatattctagggttagaatattcttcaacagaattagggttacatgtgcggactctatataaatcttttttgcctcctacgaatcacaagtaataagaaaacaatg

SEQ ID NO: 28517 - DNA, 3003 bp, Unknown; identical to SEQ ID NO: 28516
  misc_feature (1)..( 3003): 2750-1469P.txt file - cDNA_ID_2997289; gDNA_ID_2926146; Annot_ID_197754

SEQ ID NO: 28518 - DNA, 3003 bp, Unknown; identical to SEQ ID NO: 28516
  misc_feature (1)..( 3003): 2750-1469P.txt file - cDNA_ID_2997289; gDNA_ID_2926146; Annot_ID_139113

SEQ ID NO: 28519 - DNA, 3003 bp, Unknown; identical to SEQ ID NO: 28516
  misc_feature (1)..( 3003): 2750-1469P.txt file - cDNA_ID_2997289; gDNA_ID_1971905; Annot_ID_176968

SEQ ID NO: 28520 - DNA, 3000 bp, Unknown
  misc_feature (1)..( 3000): 2750-1469P.txt file - cDNA_ID_2997297; gDNA_ID_2926146; Annot_ID_139119
tggatgaggtctcctttaccaggatatatggggccggattttgttccagccccaagagatttcgtcccaagtgaagttatttggcccgaaaagttttttggtcaaacgaatctatttccggagatgcatgaagcatgtcaaatgttcattcaaaaggtaaatgtaagaatagtgtttcgttgttgccaatgtggtttggtttagggtttaatcaaatttcaggtttagggtttagttgtgttgattgttcgttatattaggtgaatcatatagtggtggtatagttgtattgatggatatttagcgagaaattgacatttatattgttggacaggtggataatcaacaccaagcttatcgaaggcgtcaccgccaactactcattaagttgcaagacctggagagaggtatgaggcggttggaggctcatccgaaagactgggtgagatacggtttcgacaaagttgctgacattccactgccactaaggagatggtgtgttgagcatgatggatcgtcaccgaattatgcgtgtttcgcggagccaattcccattaaggaggacgatgaaccagatgatggaagttactacaggagagtggatgagcctccacgcgagtatcctcctgactctctctttcaataaacattatgtctttgttttgcttaagtttgtaaaataaatctaaatctaaattgtggttttaaatctttattttgctaactatctgtgttttgaatacaatatatgaatctaaatgtttgaatataattatctgtgttttgaatgtaaattttgctaacaattatataatcagtcgaacggaggtactttattggtcgaaccatttggacaacttagtcgagccatttggactattagtcgaaccggatgaactatttgaactaatcagtcgaactggatgaactatataggtcgaaccgtttgaactaaccagtcgaacacatttgaaccatttgaactaatcagtcgaaccatttgaactaatcagtcgaaacgtctcgcacgcattcaaatcgccaacaatccttaacagaaactcttcaatgtttccatcattctttgcaccagcttttactaccttgaccaagaagtacaacagcactaacttcaacctatctgaaccatgcttcatcttcgagcacttagcaagaacatctaaaacctttatcctagattcttttttgaatatcctcgaacaaagttaatattccccattgtatttagttcttttggggaactgtggcaatcaaacccacttaacaacgcatgctctttaatggaatacctaataggtactccatttaccacaaaccaagcctcctcgagcaaatttgtcttcactatgcgtaacataagcacccacatgcctgacgattaacgttctctaccccttcttttagaattgtattcaccatttcctcctcctccagctcctccccattcccgtctttcgcttcttcgaattgttgaatgacagcgtcaattagaggtttcaaagatgtacctgtctgatcctcttcaatttcggcggttcctttaggagaagcctcatcaccatcacgcggttcctccatagccttttcaatcttagcggtttcttttgtagtatcattcgccgcaacatctcgtgctgctggttcggtcggaaccaagtcgacggcatctccgtcgttctcaatttctgaagtaactggttctgatgtcgaaactttaccggacggcttgtccgtcgaagtaactggttctgatgtcgaaacttcaccggacggcttctctgtcgaatcatatacagggccacctttaccgtctccggcggcatctccgtcgttttcaatttctgaaggaactggttctgatgtcgaaacttcaccggacgacttctccgtcgaatcatatacagggccatcaataccgtctctaacacgagtcatcaaactattacacgaatcaagaattcgtcggaaaattgtgaaaggcgagaaattatgaatttgattttggaaaatttgaattgaatgagagtagaaacggtttgattttagaaattagggatttcgcttaagtgtttggaatgggttttgggttgctaggcatggatcttaattggatcggatattttgttgggtcgtctgagtttttggtcttttgccaattatttggattttctctcatttatctttaattcgacaaaaattgggaattagaagagtggcattcctggttactttttcgcagatagtggcactccagacatttgaacttttatcacttatgccacttttttgaaaaaactgatctggactgccatcagttaatctgaatgccaccgaaaatgtgatataccagttgtacccttaatgagttgattaaaaaaatgaaaaagaaattcaaaagctaaataaagaaaatcgagttcggagattctcctcttcgtcgtcgtgttcttcttctttggtcgacgttcatcttcttcgttggccaccatcgatttcctcatgccgccgacttgaaatccggcgtaaaagccacgaattaggtcagtttcttctcatatttcctttgacattggtgcattgtgattttagattgggattttgaattctatataattcccagctcgattcaatttgatagtttgatgattggtttgcaaagtaaagagtaatcgattagaggttgccgaaacgttatttgaggtgatgagcaaaggaatgtaggttgaatgtgagttgaatttgaattccgagatttcatattaaagatttggggggtttgtgtttgcaaagtttagattaaccaattagtttaacgaataggtatgtattaacattggaaatcaattgaaaggtaacgaattaggttcagtagaatcgagtgcgacgagagattgatttcaacgtatgataagagtacatgtggtataactattaaaatgtttgattggagttgaactggttgtattttcaggagcgatg

SEQ ID NO: 28521 - DNA, 3000 bp, Unknown
  misc_feature (1)..( 3000): 2750-1469P.txt file - cDNA_ID_2997324; gDNA_ID_2926147; Annot_ID_139132
agaaggacctatactttgtgctgctcttgatggaatgaagcttccatcattccctgagtatgaagttagagtcaggttgttaaatatgtttcctttcgtctttatggtttcggatttcgagtttttgactaaaggaagtttttggttgatagatatgcaacggaacatagatgtggagtggttgtaaaagggccaaaacttagtgggaatatatctggaacagatccattgaaggataatcgtttgcttcttgaagctaaacctttggatgaatcagaagaagctaatcacacagccaaagtcgtgaacgaattatcccgggagatatcgcgcattcttgtttcccacccggttaatgtaaagagagctgcacaaggcaagaatattgctaatcttgttcttttaagaggctgtggtattcgaatcgaggtttgtgttcactgtctcttacgaatgcttttaatgaatctatttgctccatctacttatctgttatgggttttgtatataaaggttcctccttttcacgagaagcatggtttgtggccgtgtatggtagcaccaacgaagattatagccggacttggtatgtcccttggtattgatattcttgaagctctgggagccactggagattaccggacgcttctcacatcgaaagcgattgctatagcgaatgcgctttcagctcctttgaatccctgcccaaatgtctttgaaccagcagaggacgggcataaaccgggaaggtcagatggttacgatttcggcttccttcacattaaggtgaaaacatgtctctgtcttttaacacaacataaaaaatttcattctgattctaaattattcgtgcaggctatagatgatgcaggtcatgacaaggctacattgttcaaagttcgaggcttggaagctgtggataaagcgatacgtcagctcgctaagcttctatggcaagctgaatcttcttcaaattaccagtatttcttgtgtgtgactggtgatcattctactccagttgagtatggagaccacagcttcgagcctgtcccattcacaatgtgccggttaaaggactttgtgagagcggttggaggagaatcagctctattagagacatctttagacccttttccacttccaacggatatagcatccagtgaaaatgtcatcggaaaagaagaagaagactgtgggaggagggaagcttctctggcgattagtggagattcagtctcagagttgaacgagattgcagctgcaagaggatgtcttggccgtttccatggcggtgaaatgatgggagttatcaccaagtttctgaagttggatgtataaatcaaatttcataaaattttgcattttttctttgaaaatttggattttggaagtgtaataaaaaattatcaactctaacaagctcaggaagttgaaaaaaaaatgtctaacaatgtttggaggtgtagttgcatgttaaagtttacactttggctcttaagatatacacatgaaatttcctttttacattagctcgacgagaaattaaagatatcgaaaaagaagaattttttttctctcgtgactcaattgcctacaaatttataaaaaatgatggtcacttagttaatgaagacactatctttactagatctaaacaatctgtaatgaaaattacttcacgttaatgaaagtcaatcatgcatttcattgtccaaacgaatgcttttacatttcaagcacataagtcaagatttatcgaaggttgacagctcccataattggcgtgtcttcatttgatagtgtataaaaccatcatattcctgagaaatcatcattcctttccaggaaccataaatgaaatatatgaacctgtgtttctgtaactatctccatttgagttaaagtctacgaattggcttcattttactctaattggagaacctcacttgggtctttatccacattttcataaaacttctcatttcaggctttccaaatgtattagatatttagatgatccaaaaaaacttgaactatgggagccacataattcaaagcaacttgaaaatgttagttaatttatattgaagctctctcatcattctacaaataaaataaaacattaaataaatgtgatatatatacttattaattatattgtctacctaccagactaacaagcttaccagtccaccactgtgtttggtttatatgtcgagaaaaaacaaaaatctataataaagaaaataaaagtgactggagaccgataaaataagtatcccaagcgaaaagtccaaaacccaaaatcagaccagtaatataacttgaccgtttcttaaccggtaattaccggttaactccgtctcttccgtcgacatttttccttaccagacccgttttgtttttgtcttgtttcggtctcttaacaagtcccgttttgtattcttcttccttacttcttattctatctataaaacaacaacttcactcatcatgactctttttccccattttcttactctcttgccctttcttctctcactctccggcgactgttacgagtttttaacacttccgtcgtcttctcaggtttggttcttctcatttatgttaaaccattatgtatggtaattctagaatgtagatctggttcgttctcatggatcttgattaatatgtttgtttaatccacgtattagcactaattttggattattatttggaactgttatcattagataagttttgaattatttgcttaagtaagtaaagaagataagagaaaataatatttattagtctgaacataatcttatcttaagataaacagaatttatttccaaaaaaataagtttttgttaaactaaacacaatttattaccagcaataaaaagattctgtttaatgttgttatcttaataactgatcttttgtctgttttttagttgttgttgttgtttatgacaagatcttgttctatccattaaaaccaaagaaatg

SEQ ID NO: 28522 - DNA, 3000 bp, Unknown
  misc_feature (1)..( 3000): 2750-1469P.txt file - cDNA_ID_2997328; gDNA_ID_2926147; Annot_ID_139133
tataacaagcttatataggtaactatgccgcacaaggtcattgacatgcacttccacgaaagagaagaagaagaagatactggtgagagtagatcatcctcaagaacaccgagagggcatttcgtcgtttacgtcggtacgaagaagaagttggaaagattcgtgatccccacaacgtttttgaagagcccttcattccaaaagcttctagacaatgcggccgaggaattcggttacgcggaagctcaccgggacaagattgtattgccttgtgatgtctctactttccgaagtcttgtcatgttcctgacttctcatcaggacaagtcacattaactatatgagcccactactacgtcgtctgaatgataaaatggttatatgttatgtatctcatattgtatgaatatggtttaattcttataatgtacttatatgctaactttattcaactacgaactacgagtgtaagatttttatttatcatatgttgaatattagttcaatgtgcttttgattggtaactttaagactacgtaaaacttatagcagttaggtattttatatcaagcataaaaaaaaaagtcaaataagggacgaactttgaatatagtgacacatgttttatcaacattttttaaaaataagacaaggaaggatttttgttttacatttactctagaggtttcgaaatttatgacaaattaaagaagtgcaatttgtgttgatccaacaaatattgccgaaacacatcggcaactgcgtcgaactcaaaaatcacattcgcttttctacctagaacaactcgagtagccacattcgttcacaggaagaactggacaattaaggttcttacattttggttgatgactttcatgccactacttaatagttatgacctccatgagtaattattttggttccgccattgattgtaagtccacagaaaacttcactgagtttatgtttacttctcctcttccatttagttgagatcatcaatttagctatactcatatggattaacttggactaatcaatcggaagccttttttttttaatgtaatgtcaaattatatttaaaagaaaaatatatacggttttacaacttgtgcataagaattttgaaaaaagaaatcaaaagaattttgaaaattttagagaataattaatcgaaattgtgcaacaaaaggtatctagctccgagattgaatccagtggaataacgttataacgcttgtcacctgaaagtcgaatagctgaaatctgatttcgaatttgtttatccatccatcctgtgatacgctgagccggttgtgaggtttcaccatgtttccggccaatcaatcggaaggcttattatgatttatgaggtaaaaatgttcaaaacctgcttttctccatttgctttataaaaattcgaaaatttattttcttaaattccatttactgtacttcttactgttcatgtaaataaaatattatatgaattaatcaataaaatgataaaatcatgtattaacaggcgagtttctaatttaatgctccatgaatatgttaaatcaatctgtttttattttttatttttgtttttgttgattttcttcttattttgtttatattttttattatatatcaaaatataattgatttgactgacgaatatgacaatcacgctagatcatccacattagttagaacccctcatgggtttctttaaaattaaaagaaaaactatatttatgatctaattataacattacaagtgttaagagagatgcttaatgagagatcattgtatcttccccaaaaaaaacctctctcactcttttctcacagtcacaattctttttctttcttcaataatttaatagaggataccacctccaatggaaatgctctaattagaattttcaaaaagtatcaaatatattaattaagattttacatcattcattttaaaaaaaattatagagtagactttagcaaaaaaaaaacatattactcaccaccatatcattattttcttaaaccaaattctggacaaactctatcaattaaaatacagctacaacactaaccaattaaataacttaaaaagaaaaatcaaactaatttataagacgttgaaacattaaacaagtgcgaaattcttttaaaaaattgtaggtgatggagaccaaacagtaaaaacttacacctcaaatttgaatttaaagtgtttgtgtaaaacagtttttagttttacccccaacaaaatcaaatcaatcaacaacaaaactaatgatgctaaaacctataagagcattcacaactgtggaactctcattttaattattaaaatattataaaataatgaaaagaaagtatggaaagagacaatgggagagaatcgtcaaataaaactctctctagagaaactttgagccatatgagagaacctctactttacagatgttaagattttattggtaaaaaccaattattttaattaaataataaaattataataaaaataatattttttattcaatacatacccatttttgaaaacccaccattgtggatgttctaatgggtttaaatccctttaccaccaaaacgacatcgtttacttaatgactttaaacttagcctaaaacgacatcgttttacgtaatgacttgcatctttctaactgagcagaagccgacaaacgacacacgacgtcaccacaattctcaactttggagctgcagacacaattccggcgacgtttacgattctgacaccgccggtaagggttaaaatggattctgattctgattattgtagattcgttatctaaagattcgaactttctgaacatttcatcgcaaatagctcattcatagaattagagatctctacattgctttgtaataagagatcgatcgttatgtgaatcattgataattcttaaagtctcagacttttaatttcctctttaccaattggaacagaacccacttgtagcaaatg

SEQ ID NO: 28523 - DNA, 3000 bp, Unknown
  misc_feature (1)..( 3000): 2750-1469P.txt file - cDNA_ID_2997336; gDNA_ID_2926147; Annot_ID_139137
cttcaatatttactcacccaagtctttaagtgaaaactgatagctagattttgtaaaatattttcaaatgcatccaaattgtttcatgtgatgattatgtcattaacatagaccaatgaatagaggatggtataacattttgtatgtacaaataaggaaataatgcattcagacacttagtttctaaaactggatttgatgagataattattgagctccaaataccaagcccgtgaattgctataaatatctttagcaatacattcttaacaatattttcaacaatgtatcactcacacaatctttaaacaatttttgtgctatagcaattttataaattataatgttataattatacaaacctcaaaaatttgatagtggagctactcacatactctttttaaaaattctgaagaataacctactcgaactattagctaattcaatatactattatttattccatattttaagttaaaattataaaaattagcagaaaatcctagagcatgagaaaactaataaaataattttaaatattaatattgatacaattaaatatgtaaaattaaataatatgtataattaaccattatttacatttactatttagagaacatgtgataaatgctaaaatgatgatgtatcattcacatgaaaagttaaccaactttcataaatactagatgaattcccacggtacgcgtgggtttgttttgaaaattgtttagataaaaatatgttaattatttttgttactaatttatgttttgtttgttattttatacttagtaaaattagattcatcttatgtacttgcattttttattgttatattcatttttgactctaaatattaatttctatatactttcatgtataatctgattatttttatatccaaaattctaaaatctgttcattatcatgaatatatcacaacaagaatataaggtatttttatttcaagaattttcgtatgaaagaaagaagcaaaaattaaagagttattttagtaacactttttagattttatgctattgcatatagccatataagacaaatggatttattttaaatttcatagtatgtctaacgtctcaaaagactattacttgaaaatgttgaatgtcaatgttacgaaattaccataagatataaaaatgaaaagacagaatttcatatgatacaatatgaaccataacgtaataataataaaaaatcaaggtaaaataaataaactattaggtagcaaacaactaaactacaacacaaataactatttagtcattatagagtgatgaccattgaccattaaattttttaaaaaataagaaataataaaagtaaaataaaagtactaattgatttatttaaataaataattttataattttatttttattttgaaaaaatcatttaaaaaatgaattaatggaggatttaacacaatatgagacttttgattttctctcaattaattttgctgattttttatttaatcaatattcaatgatacatgtcatttttttgtgtgatgatatgtcacccatatggagaaagttagccacctttcatatatgatatatgatgattatcatttcgtaaattatttcaaaagcatataataaaataaatactatacaaaatttcttcctaagactattgttcttcgaaagccataaatagtcatttggactggtcaaatggacaataagccaagacgagactataaggctataactttctaagatggttgatataagtttgtcaaagacaatggtctcattgacaaatattttatctttttcaatggttctcaaaggagagcgaagttagtaagataaccattcaagttgacagaatggtcaatggactctatccaactagttgcatcacttaatctgagttcaatttatgtcggtgcagtggatactaattgtcttccatttaatatgctttgataccagatccatagaaactataggggtagtaaactaataatgataacatttgttttttttaagaaatttgatattgcaaaatttgatatactaattaaaaataaaataatggataatttggatatatcctcttatatttaacacgtttttcgttatattggaataaaacaaactaggtgttttcaatggataattattccaagagatatgagtatggagtatggaccatggtcctagaaatttgggatggggattggcgggtaatccttccggacgtggacaagtttatttttatgatgcatatgcttaataatctattactccagtaatttccttaaaatcttaaacaaattcaaagaagaataattcaattttacttgttaaaacattgaatctttgacaaacttgaaaatcatattaatttattttattaatagtattaaaatattaaacgtcaaataattttctcgtttcagattttgtggtccacaattgctcacaattacatatagaaaaaaatatttagctattatgttagtcaacttatttgtaatatttcaccagattactgtattactatttaaatcttgaactaattagccatccataattcataatcggaaatttatttatttgacacacatgactggacaaatgttttcccaaaatcagcaatatgtaatacttttttttttgtttgggcaaagcaaaatattttgtttttcatgtgaaaattattttaaggtcctttttagcagaaaacaaatgttttgggtacatttcgcaataattccaaagttaactgctgtaaaccaaaataaaaacaaaaaataattattctgaacaattctagatattctcttcatagtctctggtctcttaactcgccttctatggaagctcaagtgtttataatcttccattaaaaccctaaaatactttttcaatttcttcttccaatttgcttcttttctcttccgatacaaatattcatttttgggttacttcgattcctttaaagctttagaaaacaatg

SEQ ID NO: 28524 - DNA, 3000 bp, Unknown; identical to SEQ ID NO: 4761
  misc_feature (1)..( 3000): 2750-1469P.txt file - cDNA_ID_2997344; gDNA_ID_2926148; Annot_ID_197862

SEQ ID NO: 28525 - DNA, 3000 bp, Unknown; identical to SEQ ID NO: 4761
  misc_feature (1)..( 3000): 2750-1469P.txt file - cDNA_ID_2997344; gDNA_ID_2926148; Annot_ID_139177

SEQ ID NO: 28526 - DNA, 3000 bp, Unknown; identical to SEQ ID NO: 4761
  misc_feature (1)..( 3000): 2750-1469P.txt file - cDNA_ID_2997344; gDNA_ID_1620729; Annot_ID_49356

SEQ ID NO: 28527 - DNA, 3000 bp, Unknown; identical to SEQ ID NO: 4761
  misc_feature (1)..( 3000): 2750-1469P.txt file - cDNA_ID_2997344; gDNA_ID_1620729; Annot_ID_166035

SEQ ID NO: 28528 - DNA, 3003 bp, Unknown
  misc_feature (1)..( 3003): 2750-1469P.txt file - cDNA_ID_2997347; gDNA_ID_2926148; Annot_ID_197881
tgtcgaagactgttttctttttgggagagaaaggagacacagactatgaggacttactgggtggcctccacaaaaccatcattctaaaaggtgtagtgggatcagacagtgagaagcttcttcgcagtgaagaaaacttcaaaagagaagacgcagttccacaagagagccctaacatttcctatgtcaaagagaatggcggatctcaggaaattatgtccactttagaggcctatgggatcaagtaataattttctatttcagcttattatctcaagatcatatacttcaatgggttggtaaacagtgaaaaaataacaagactacatactttcatatattgtataccgaaataaaaaagttgaatattaactttgcttagtatagattcaataaaacaagtatgcacagcttctttagacgttcacacttagaaagattgatacctgaagaatcatggtactctatctagtgtggtatcgcccatccttcggtctaccatagaccaacaatttgttcctcatcacatccatatttggcagtgtaaaaacaatttctgccacaagtggaagttattgtgacaacaaaattgaaaaccaagttgagcctgaaaacaatattcaaccaaaacacaaggagacacctcaacaataacaaaagtgaatccagaaactattaacattaaccttgatctaggtctttcaacaaagtcgggactgcagtaacctgtatcagtccctgcagaaatcataccacttaattctctacatctaatctcaatcaatttcaccgtaaacatcagataaggcaagatataaccacagcaaacaaattcagtagaaaatggaaaataaattcaggtgaagaagaaataccattcttttgagaaagcacagtcctgatgtactactgcaagtacacctacatcacttcttctcagtcaggttcttatccgcaaacgtacgcacagtaaaactttaagaaggttctgaatcagatattcgcaagaacgcaaaaataaagataatttcacgtgaatattcagcttccagcaaatttaaaaggagacataactgaaaccagagagggaaaaaagagtagcaaaaccaaagggcccttttgtttctcattataatttaagttccttacaaactaaaagttgttcaacaactatattaaatgagtacaaaaaactcacaacagaaaagcttgcaggagatcacattggtcacaagaaatcatctccatccatacttttcctatatgaacctatccacacaatcacaaataaccatcctcaatcagaactcctcctccgaaccagaccatgacgatcacttcagtcttaaaaactcatcttgaatagagattactcaattctgtaccaacccaaatcaccaccttgctcacaatagaccatcctagataggaatcttcatatcagaatcaacccaaactcgtgttttcaaagaacaagaaccacaaggaagaacaacagacgccacaaaagcacccaatctcttaacataaacaaaatcaccatctctcaacaaagcaaaccccattgttcctaactcactagaatcaacacaaaagtaatcaccacacctacactgataaaaaagatcaatcacatcaccagtaatctccactgacatatcctcaatactaatctcatcagcagtgattccatcatgtcttgaagatctaagatcattatcataaactacacgtagctctgcatcgcttagaacttcccaagctttttgaatcttcagaaacttctcgtcgtctgagctagaacgagaagtattgttgagcttatctggatgagagtggagaatcgcagaacgatagctatttcggatttcttcatagctagcatcttctttcacggagagaatctcgtagtatgtctcgtgaacacaattctcaccgacaagcatgatttgttgaatcctccttaattcacgacggtgctagggctcaaaattcaccggcgacggcgagaaaattcggaggataaagagaccaagagtttttagtgtgttggtttcttcgtctgaccattcgggttttcgggtcgattcggatcagtctttcttccggatttcgggtaattctgggaagattgggtctatataaaagagaaccgaaattgtttcggttagctcggtttggttatggtattctcggattcgggttggtttttgaaatttgattaaaccccaaggtccccaacctatgattgaacgatattttgattcggtttttttaacccgaattattctataaaccatgaaagtcataaaaccaaacaattcaaaaaaacgtaacattttcaaagttttaaacatataaatctgaaccgaaccgaatttgttattttgagtcgattcagatattttagatccagtatactcaagactaaaatataccgttgaagtataaaatataccgttttgacaattatcaatcttaaaagtaatatcaaaagtgtcacttaaaacattacttttagtatttgtataatttttatgtactatatttccgtacatttttacattattccataaaaaattatctctcatgtttgtaattaaaatatttgtacagtcatatgttatccatcggacatatgattatcatatgtatattgttttgggttttttacgaagacatgttcgaattttagatctgacccggacaaaactgaaacccgaaacaattctaatttgggtatatgctaaccgataattgaaccggatttttcgaatcgggtcgcttaaatcattttgggatcttaaatgtttgggcttgggcctgatttaaaaaaatcaatacttgacccgattacgcaaacccgtttacggaaatacccatcttcaactggttccgtgaagagacgcgcaaaagacgatcgatcaacgttcatttgtgtgaaatctgttaactttttctggggagaattaattttcgtgaagattttgtagaatcgtgatg

SEQ ID NO: 28529 - DNA, 3003 bp, Unknown; identical to SEQ ID NO: 28528
  misc_feature (1)..( 3003): 2750-1469P.txt file - cDNA_ID_2997347; gDNA_ID_2926148; Annot_ID_139195

SEQ ID NO: 28530 - DNA, 3003 bp, Unknown; identical to SEQ ID NO: 28528
  misc_feature (1)..( 3003): 2750-1469P.txt file - cDNA_ID_2997347; gDNA_ID_1620670; Annot_ID_48140

SEQ ID NO: 28531 - DNA, 3000 bp, Unknown
  misc_feature (1)..( 3000): 2750-1469P.txt file - cDNA_ID_2997347; gDNA_ID_1621195; Annot_ID_174724
cgaagactgttttctttttgggagagaaaggagacacagactatgaggacttactgggtggcctccacaaaaccatcattctaaaaggtgtagtgggatcagacagtgagaagcttcttcgcagtgaagaaaacttcaaaagagaagacgcagttccacaagagagccctaacatttcctatgtcaaagagaatggcggatctcaggaaattatgtccactttagaggcctatgggatcaagtaataattttctatttcagcttattatctcaagatcatatacttcaatgggttggtaaacagtgaaaaaataacaagactacatactttcatatattgtataccgaaataaaaaagttgaatattaactttgcttagtatagattcaataaaacaagtatgcacagcttctttagacgttcacacttagaaagattgatacctgaagaatcatggtactctatctagtgtggtatcgcccatccttcggtctaccatagaccaacaatttgttcctcatcacatccatatttggcagtgtaaaaacaatttctgccacaagtggaagttattgtgacaacaaaattgaaaaccaagttgagcctgaaaacaatattcaaccaaaacacaaggagacacctcaacaataacaaaagtgaatccagaaactattaacattaaccttgatctaggtctttcaacaaagtcgggactgcagtaacctgtatcagtccctgcagaaatcataccacttaattctctacatctaatctcaatcaatttcaccgtaaacatcagataaggcaagatataaccacagcaaacaaattcagtagaaaatggaaaataaattcaggtgaagaagaaataccattcttttgagaaagcacagtcctgatgtactactgcaagtacacctacatcacttcttctcagtcaggttcttatccgcaaacgtacgcacagtaaaactttaagaaggttctgaatcagatattcgcaagaacgcaaaaataaagataatttcacgtgaatattcagcttccagcaaatttaaaaggagacataactgaaaccagagagggaaaaaagagtagcaaaaccaaagggcccttttgtttctcattataatttaagttccttacaaactaaaagttgttcaacaactatattaaatgagtacaaaaaactcacaacagaaaagcttgcaggagatcacattggtcacaagaaatcatctccatccatacttttcctatatgaacctatccacacaatcacaaataaccatcctcaatcagaactcctcctccgaaccagaccatgacgatcacttcagtcttaaaaactcatcttgaatagagattactcaattctgtaccaacccaaatcaccaccttgctcacaatagaccatcctagataggaatcttcatatcagaatcaacccaaactcgtgttttcaaagaacaagaaccacaaggaagaacaacagacgccacaaaagcacccaatctcttaacataaacaaaatcaccatctctcaacaaagcaaaccccattgttcctaactcactagaatcaacacaaaagtaatcaccacacctacactgataaaaaagatcaatcacatcaccagtaatctccactgacatatcctcaatactaatctcatcagcagtgattccatcatgtcttgaagatctaagatcattatcataaactacacgtagctctgcatcgcttagaacttcccaagctttttgaatcttcagaaacttctcgtcgtctgagctagaacgagaagtattgttgagcttatctggatgagagtggagaatcgcagaacgatagctatttcggatttcttcatagctagcatcttctttcacggagagaatctcgtagtatgtctcgtgaacacaattctcaccgacaagcatgatttgttgaatcctccttaattcacgacggtgctagggctcaaaattcaccggcgacggcgagaaaattcggaggataaagagaccaagagtttttagtgtgttggtttcttcgtctgaccattcgggttttcgggtcgattcggatcagtctttcttccggatttcgggtaattctgggaagattgggtctatataaaagagaaccgaaattgtttcggttagctcggtttggttatggtattctcggattcgggttggtttttgaaatttgattaaaccccaaggtccccaacctatgattgaacgatattttgattcggtttttttaacccgaattattctataaaccatgaaagtcataaaaccaaacaattcaaaaaaacgtaacattttcaaagttttaaacatataaatctgaaccgaaccgaatttgttattttgagtcgattcagatattttagatccagtatactcaagactaaaatataccgttgaagtataaaatataccgttttgacaattatcaatcttaaaagtaatatcaaaagtgtcacttaaaacattacttttagtatttgtataatttttatgtactatatttccgtacatttttacattattccataaaaaattatctctcatgtttgtaattaaaatatttgtacagtcatatgttatccatcggacatatgattatcatatgtatattgttttgggttttttacgaagacatgttcgaattttagatctgacccggacaaaactgaaacccgaaacaattctaatttgggtatatgctaaccgataattgaaccggatttttcgaatcgggtcgcttaaatcattttgggatcttaaatgtttgggcttgggcctgatttaaaaaaatcaatacttgacccgattacgcaaacccgtttacggaaatacccatcttcaactggttccgtgaagagacgcgcaaaagacgatcgatcaacgttcatttgtgtgaaatctgttaactttttctggggagaattaattttcgtgaagattttgtagaatcgtgatg

SEQ ID NO: 28532 - DNA, 3003 bp, Unknown; identical to SEQ ID NO: 28528
  misc_feature (1)..( 3003): 2750-1469P.txt file - cDNA_ID_2997347; gDNA_ID_1620670; Annot_ID_164078

SEQ ID NO: 28533 - DNA, 3003 bp, Unknown
  misc_feature (1)..( 3003): 2750-1469P.txt file - cDNA_ID_2997358; gDNA_ID_2926149; Annot_ID_197918
tttatatgaaatcatgtggtctagaacttatactagaatatatttcaacattagtccacaacatcaatctgaatataagggtgagtttcaaacttttctttaggcatatattatgttcacatcagataaaaattacattgagtggctcgtgaatacactcaacagagttttttttaacattaaaacatgcatagaattttttcaaataattttctcgtacaaaatatgcaacaaataatgataaacatatttttaaatgcaaaatagttttatataaaatgaaaagaattattacttgcgatagaatctataagccttaatcttttatcattgtgcttataattttgtccaatcaaatttctcaacctttattggtttattatagactcattgcgatcgagtaatttttacttattctagtttttcttataaataaatcattaattattgctatgtgatatattttctttcaaaatattttatgaatcaataattttagtggttaaaaaactatgtgaaagtgaaaataaaaacacatgtagttggctttatgcattcatataatcattttatacgtggtgggaatgagaatacttcaacaagaaaatatgattgtgagtaaacacatttttagtggtaaagtagacgatagatttgtaaatagatgtaaattagatgatgatttgactagtaatttccatgtataatatttttcgaataaggaaaaaacgaatatataaataaacaattctcaaaataaaatattatatatttattttctacttacaataagattttaatatatctttttgttaaatttattttagttttaaaaattaaacatgcatattggatggagtttaatctagttgaatctaaaatttaatagttttacgaaagatttgttattaattttagttttgaaattgagaataaaactaatgaggcatcaatccattaaatatatgtaagaacaaatcttcatatattatataatatgtttggcaaatatatataaagtaactgaaaacaaagtgaaaatttgagaataattgtgggttttttagttttatgtattaaaaaaaatgttgttaatgaaaatccatattattatgatataaaacaaattcattatgaatataaacataacagatatcttctataaaattcattatgatataaaacaaaagattaaaataaaataaacataacaaatatcgcttgtgaaatgagatctatatgactattgggctgaagttgggccttgagaaataagagtgcgccttataatataggcccatttaaagtatgtattggcgaatccacgccgaaagagagagcgaaagggacgatgagcaacagaagaagaaccggagacgatgacaaaggattgctctggaaacttccccaagttaggatcagagacattggaaaagttggtccagcttttggactcggtgtcggttgcggatttggtttcggcgccggtcttatcggaggtaaatttctaatttctcccaattttgatcgcagactcgcgaatcgctcgaagctatttatagatagttttggtttaagagagtagagattggtttgatgaaaacaggtgtaggattcggaccaggagttcctggattacaatttggtcttggatttggagctggttgtggaattggtgtaggttttggctatggtgttggaagaggagctgcttatgatcactctcgttcttattacaacgttggaaaaccatctctgtgagtatttgtctgcaattagatttttagtgattaaggatttgaagaagaagatgatgattttgactttggtgatttgttgacaggaatgaagttgattcactgattgatgaacttgttgttagcacgaagaagcttgtgaaagctactacaaatgaaatcgacaagtggttaaaatgatgaacttttaggatttgttgcagcttccaagtaaatggtagtgtttggtttgttcttagatcaataatgtagatttggggctagtgataatctcctttctttttgtacaattttacgtatggtataaagatggattcgcataatttaggtggctgatttatcattctggtaatgtgtatggtttgagtgctgatttttggtgctatgagttgttctttatggctcaacttggatcaatatggaggttgagtttgagattttctctcagtttaaggaggtagaatagtgcgtatagtggcacagtgagctcagctctagggccaaagggcataaattcattatagctctttcgattctaccgtagtactgtgtgtgaaccggcactgtgaaccaagatgattaaattttcgtattctctatgtacatgatcctgcggctcaatcgcttcagtttcgatccacatgatgtatatgttatagaattgtgggaaactccttgtagaaagagtatgttcacgtctaggactagtcggatgattcgtttctctttttggtgtaatgagtatgttcataactgttgatacaatgtgaaaatctaaccgttgagcttgggagttttacgtctatatgaaaattccggttgtcgtctacattacggtagtaaacaggaccacagtgattccaaatgtcccaaggaatttactgaaaaccccaactaggactgtgaaaggcttgtggatgacatttaacagttgagattttcatgtgtttgagattcttgtaacacattttgctgtataggtgaaagcttagccacacaaaaggagaaacagaggatatggataaaataaattatccaacaaaaaccaatctaaaagccacatcagcatccacaaccaatcagaggacagaatcatatttcacattttcaatccagaccaatcaaaatcctgaacgaatcctactctccaccttataggagcagtttcgtctcttcctccttctttcacttagctcttcctagtgttaaaccagagtaaagcttgaaactttggactaaaagaatg

SEQ ID NO: 28534 - DNA, 3003 bp, Unknown; identical to SEQ ID NO: 28533
  misc_feature (1)..( 3003): 2750-1469P.txt file - cDNA_ID_2997358; gDNA_ID_2926149; Annot_ID_139215

SEQ ID NO: 28535 - DNA, 3003 bp, Unknown; identical to SEQ ID NO: 28533
  misc_feature (1)..( 3003): 2750-1469P.txt file - cDNA_ID_2997358; gDNA_ID_1620659; Annot_ID_47927

SEQ ID NO: 28536 - DNA, 3003 bp, Unknown; identical to SEQ ID NO: 28533
  misc_feature (1)..( 3003): 2750-1469P.txt file - cDNA_ID_2997358; gDNA_ID_1620659; Annot_ID_163753

SEQ ID NO: 28537 - DNA, 3000 bp, Unknown; identical to SEQ ID NO: 4120
  misc_feature (1)..( 3000): 2750-1469P.txt file - cDNA_ID_2997362; gDNA_ID_2926149; Annot_ID_197935

SEQ ID NO: 28538 - DNA, 3000 bp, Unknown; identical to SEQ ID NO: 4120
  misc_feature (1)..( 3000): 2750-1469P.txt file - cDNA_ID_2997362; gDNA_ID_2926149; Annot_ID_139229

SEQ ID NO: 28539 - DNA, 3000 bp, Unknown; identical to SEQ ID NO: 4120
  misc_feature (1)..( 3000): 2750-1469P.txt file - cDNA_ID_2997362; gDNA_ID_1620685; Annot_ID_48438

SEQ ID NO: 28540 - DNA, 3003 bp, Unknown
  misc_feature (1)..( 3003): 2750-1469P.txt file - cDNA_ID_2997362; gDNA_ID_1621141; Annot_ID_172848
catcgaatgcatgcattgacgtttcagatgactgtgtcttttcgataacttaatgaaattgattttttcacaagataatttctaaacctaaacaaatctatcatttttgaattttcgtttaacattaaactcacatctaattacttcacaatacttaatggggttgaccgatatcaagtgttgtttcgaatttctaacttgtgtttatgttttttttttctgtttttaaagtttcagtcattggccaattgtgtttcttccgttgatcagtttgttttcatctcaaataatcaagcctatggcaaggtaatattcaaatctttcatttctacaaagaaaatcagagtattatcaatacatatatccgtttctcaataaatatcatttcacataattaataaagtatataaaaaatatctcgtaaaaagcaattattcttggtattgtatttattatttttatatttgtttagaattggattggaattatgtattttctatggaaattcatattgaaatctaaacaatactagtcattttaaaacagaaaaataatttgaaaggagtagtagcaattaagattgccagtgcactggttattggtattagttaaatattttagaccaccgaccgcatttaaagaagtagttaatatgtataagacaaaataagaaacaattattgaaaacaaaaacaaaaaagaaaagaccattaactctagattcacattgtgacatggtatttaatgaaaagaccattaactctagaccgcgttattgaagatataaggtaaaactacaaaaaatataacaaattgaaggagcctttaaataattaggcaaatgttatatcttgcgttcctgcctccgggcatgatgtgctaaacatttgtctaccaactcttgctttcacttgcattgataaaccaaatacgaccaatttaaacacatgaacctcaaccttaatgttggcctaagagtctcctaattgaatgatccaagattgaagtaatcaaaaaaggcagtacacctatttcaatgacaaggcatttgtatgaaattggttagtatattttttttctagacgagaatatttaaaaacgtaacgtacgcaatatgacgtcaaaagaaacaacgcagcatttatgaaacgatattgtattgttgtgcttggttaaccaagtgacattaatacattaattcgtttttatgtacgtttataagatttcgtttttaaacgcaccaaaaatatataaaaccatctttgcaatgaaggaactgcttactacactgctcgcttgtccaacaaaggttttttaattgatctttcgggaaacttatgattccaatggcggttttatcgaatggtcaccggattttgttgaattcatcatattttgtcaaaacaaaattcagatcttagaaaaatttataacattgatttgtaaaaagtgtataagatagtcctttgggattaccttatcgttcaatggaccataaaaatagctcgtttaggttccattactttccatcggagtaaatacattagtccaaataattcgttttcgtaaatatataagcctaaataattgtgtccaccaatttgtatgttggtgtgttttcacttgcacactggtaaactaaagacaaccaattctaacgcatggatattggggtcgtttagctaagggacaaaatttgataaataatgaacttagagacaattagtttttctatctttgtaaaaagacaaataaagtaaataaatagatatgaagttgaaaaagttcaaaaaaaaaacagcctcagcttttgccttgcgtgatagaacgagttcacggacatgcaacgagcaagagcgagttgacatgcatttaataacggctagactaacttaatcgcacacagatattaacaaattgtctgcttgtataatattgaccttttagtgctttatatatgtgttttcacgtgtacacattctagaatcgtataatatctgtttgtatgttaaaacttctccaatctgaaaaaaaaaacaataattaatagtctagccgttactaatatgcatgttaactcgttcttttttgttgtatgtgtattatttcacatgacaagctttaacctttaaaatgcactcaactcgttccttgcacaaaaagtcaattgaatatacgtattgtcccatacgcaaggcaaaaaagcagagataattattatttttttaaatattttccaacgtcaaatctattttttttgtcaatataccttaaaaagaaaaaaaactaattgtctctaagttaattatttattaaattttgtctcttaacttaacgacccagaaagcctccttggttcaatggttgatcaagggttcattaatacttatatactaagaggtttggagtttgaatcccagctactgcaatttattaatagatttgcagattaattgaggcaagtgtgcaggagatctacaacgatgtacaattatagccgttcgccaggattatacgcagagaagatatttttggtatccatcaagcgcatggagaagaagaatgaggtgtcgtatatcgtggatctaataagggaaagaaattatgcataataaaattgtctatgtaacaactctcgtaatctgtaatagaaaaaaaaaaactaaacgacctagatattcatgcgttaaaattggttgtttttttagttatcaatggaaaacacaccacatcagaattggtggacttgggctaatatatttatgaaaacaaatagtttggggctaatgtattatctaatgggctaattaataaaacttaaacgaactatttctaaggcccattaaacgatagggtaagcccaaatcactatcttacgcccctctttatattcatcgccactgaaactgagaaaagggttagtttcgctgcgctgtttcaagggttttcgtttttatcttttcctccgaagaagaagataagaggttgaagaagaagaagatg

SEQ ID NO: 28541 - DNA, 3000 bp, Unknown; identical to SEQ ID NO: 4120
  misc_feature (1)..( 3000): 2750-1469P.txt file - cDNA_ID_2997362; gDNA_ID_1620685; Annot_ID_164581

SEQ ID NO: 28542 - DNA, 3000 bp, Unknown
  misc_feature (1)..( 3000): 2750-1469P.txt file - cDNA_ID_2997366; gDNA_ID_2926274; Annot_ID_143504
actaaaagagcttcttctcacaaactctaagtcactacacccaaactaaagtattgcacgttcaatacggagtactcatcaatcgttacagagttaaccgaaagaaccaatttcacaactactacatcgcagaggacagccattacatttgttttgtccttacaaattttcagctacacaagcaggaacaataaagctacaactagatccaaagtcaaatagaaattcatttcattcaaagagtcaacccaaacaaatcacagtgatctacatacaaagagaaagaatcaacaatagaaggaagatcgaaagaggaggagagaaagatgtaaaaaggcatacatggtgggagaatcggaaggagtggcggcgagagcagcttctttctcggaagccatgacggcggaggcaggtgagaaatgagatgatagaatcgaaacacggtggctcattaacacaaattaaaccctaaattcgtagacggcacaaacaacttcacccgccaatctctttcttccaaccaatgatatcttgccacgtcatacccttatttttccgttgtctgaacctctttcttctttatgggcttactactagcccaccaaagaccaaacccatttctttattgcctaatcaaaattattgtcttcatccacaattaacccacaaagtactagataatactagtaaacgtctgttcattcactacaaactcttaactaaataagtaaaagccaacaaaataaggaaaaaggagacaagaagtgaaaaaaagtgatggcgagtaggtttggtatcattggattctacatggaccccgttgcatatgcttaatgctcagagttaattatagtcatggataacacaaacacatcattaagacacaaagtagagttgtattatctaagaattaagtaagaaatgctttacagcttacgaaaattagtttataactaaagtgattggtatctaattaaagtcaaatgcatctctcattatagtacagagtactctcttgttataccacaaacagaaagtaaaagtgcgattatgatgtttgaaccatctattcatgttaacgtgacctgaaatatcacatgctctgcttagccttttttgtcactttagtgaggctaggatattaaattcttggaatttaattaagaaaattccttaacattaaagtattataattctagagagacccactctactggtctttaatgataatttgtccaattgttctatttatttgtccaaacatgataaaatgcgtgatgagttattgaattaaacaaccatggaccacgaaaattgataaatatcaacctaactaattgtttaattcattcaatcttaatatgaaaagagatggataaattttagcaaaaacattagtgtataagtgattattatgccatacgaattgatgaaatgaaactgtaacgaaaaaacttgttgctattattgtcattcgaagaagattatgctccaaaaaactgtattcgaatcttagagactccggtcatgataaaaagattcgtgaacttcgactaggaaaaaagaaattaatgtaattcgaaaacaattgtaacttatagtactaattatatactagctatatatgtaactcgtgaatcgtgatgttaacgcatttgatagctcttaggaggaaaactaatttgagtttgacctttcaactaaaaacatagattccaccaaatgtagtactcatgactacacgccaaatgttacagtatctctcaccactctccaagatggtctaatacaataatgtttgtaactttggataagcttttgcatattattgattggttagttaagaaattgagatatcctaattttagtaatggatctaaaaatgtagtattacaggttgtaaaaggattggacacatatatccactgtttttcttgaattttgtatctgattctttttatacattttgttaaaaaattagtatttgtagcttagagtcatataacatgtatctctacattaactctttatcatatattggatttgaaagtttagtttcttagatagtttgcttaagattgagaagaaataataatggttgttaaaggaacataattagatccacacgaaaagctaaactagaaaacacaaaatcaataatgtgaaaaagagaaaaagaagagaaatccagtggagccaaagggtcggtcgggccccgacgacaactcgcgccagagcgtgtggttcaaacaccatgtaacagcgcgtggtcactttttttcatcccagcaaacaaaagacgagaccaggcattgacaacaaattataatcgttttcttctttctctttttgcactctttgggttttctaacgatgatggcgtgaaagaaagagagagagagaacaagcagtgttcaagaagagagagagagaggaacaaaagtgtctcttttttcttctctgcattgcccatttatcctgtcgtctttgacgcttttgtaaaagctaaaaaagaaaaaagatgccaaacgacgacgaagactagagagagatagactaaagaaccagttgtctttattcttcttcttccttcttccttcttcactcttgagattctctgtttcttggtcttgagtttatccgtaagtttgtttgtgtttttcttgagttgattgattctactttcatttctcctgatttttgtcgtatactgtttcatgacatcaatgtttggttacatgagttagaaattctccacttttttaaaaatatatataaaatgtttgttctgtttttttaactgccctttgatgttctgattctttctcatttagtgtaatcgatagtataatgcatttcttgttctgccttaaatcttttcctatgaactagattagagctaatctagtaatcttccttccaattcaaatcatctaatgattttttgatttgctctttgtttattgttgttgaaacagataaagatccggagataaaatg

SEQ ID NO: 28543 - DNA, 3003 bp, Unknown
  misc_feature (1)..( 3003): 2750-1469P.txt file - cDNA_ID_2997385; gDNA_ID_2926274; Annot_ID_143514
cttagtttatggtcatatagatgttttccttatttctctgttcacttcccagacttgtgagtttttattgcatcttgtatatcggccaatttgcctagttgttggaccaacatttgcttgtttatgttgtcctcaagagatttccgctgtgtagattttaaggtctcgttaggttcaatcactttgataagaccgagtatgttcccagtcctgtcagtgattgcagataatctatacagttagcaatcaatgtgctgatttttttcacagccttcttctggattgcagcatcttattggttatttacttggatctgtgcttttccgttttgattttttttttcatgtggaaaaaatgatccttagaagtcggtttcgatgaactaaatgtgattctagcatgctaggtgaatttcctgacaaatgcttgatgatttactcattgtccactcttcttagtattgcctgtttatttcattttgcagctttaatcataaaactggggcagaagacgttcacttcactcatgaatccgattctgaagctgatgaatctgacaacgatgatgctgcaaatgagaccactgatgaagacgagccttccagtaaaatttcttcctcgcctgagcagtcttttgaggaagttcctggtgaaaacactgatgacgaagccaaagaagaagaagaagaagaagaagaagaagaagaaggagaagaagaagaagaaggagaagaggaagaagaaaactcttcaatgctgcaaaatgatcaatccggtctaaaaatgattatggtgaaggatgtctcagctggagctgaggtatgtatgatttttcatttggttttcaagttagaattatatgtcatttgcattgatgccatgattttctgtgtaggtattcaatacatacggtttgatgggtaatgctgcattactccacaggtacggatttacagagctcgataatccatatgacatagtaaacatagatctagaattagtaaccgaatggagcacatcctcattcacaagccggtacactcgagctagactggccttgtggagaaaactaggttacacaggatgcgagagtcaaaactcagaatactttgaggtatcttcaaccggagaaccccaaaccgagctcctgatcctactctatatactgctcttaccagacgacacatacaataaactggatctagctgaatcaacaacaggagcttctccctcgaaagaaggaaaaagatcttcttcttacgagataacaattgggaaacacaagtttgtgtatggagaaagcggaaatgatattcttctgacagatggtgtttgtgaagctcttctaactattgtggataagcgagagagtttatatggatcattgagctcattggaagatgacattgttagggtgaagacttgttgtcttccgagagacaggagactatatcattcgcttgtgttgcgtgtgagtgagaggaagattctaaagaagcttaggagctacatccatacccagaccaatgagtcttccagcggaaagcgccggaagaagatggttccaaaatcctagcaacatctttagtttgcttgttgaattttcacttttcatccccaagttaccatttttaaacgacttgttctactaacattgagtttcatctataatggtgatcgaatcttagcagatttgatcgattcttttttgttctatttatagaaattcttgaggtttaaaaataaaagaaagaaaggattttatatcgtgagtagtatattgagtaatcttcagacggaagcaaagaaagcgtgacaaaaagccggcgactgtcagacaggtagaactgtaaatatggagaaagatggggttactttaacaaaggtagacacgtggcacgtgggaattaaaggatattacagactttacacagaattacacagagataagacaagttcttttttaagcttttttttttttaacagtcaaaaagactcaatagagtgtaacggagagattcttctaccagagttgctctcttttggttcgttttcttcctccaaaatccaatcttaccacagtttctttagggtttcttcttcgtcttcctttggatctatgtgaacaggtatgtaactgattgagctgctctttctgattaaccaagtaaattgttctcttgaatcttatcattttattttgtttcatttttcttgttggatttagatccttggatcaaatttgctcaaatgttgtggtaaagtctgtgcctttgattgtatttcggatattttctgtgtgttttactctgatattgattaggatttgtgtatttcgtattttttttttccattgaagcgttttctgtgatctggtttttgatcgatcttattcctcttgattaaccgaacgaaagatgttttgatttctgtagatctcttgcattgtactttcttcattgttcttaattcgattttctctccattgctggatcgcctgatggctcatttagagtttttttttctagctcaaatgtggttgaactatagagtttctgagttcattatttggtcattttttaattgagttggcttgattaaagaagaatttatttgttaatcagctagattagatttgaagattgtagtagattagtatgatgtgaatgttctaatctgggaataaagggtctagtgttgagggaaacatgagatttttcataattgggtgaaatatgtgttgtaaagtttggtcttttatttgcttaattatgacttgtggttccattgactcttgtagtatgaactaagctctgaggtaagcttgggaagtagggatatggccaaaatctctttggtttaccaacttagcaaaaaagttagcaggagttggtgatcagttctcctaccggcttttgcaggctaataactaatacctgactgtaaaatcttccaaggtttcaaccacacagggaccttgtttctcttgttattgtaaaggatg

SEQ ID NO: 28544 - DNA, 3000 bp, Unknown
  misc_feature (1)..( 3000): 2750-1469P.txt file - cDNA_ID_2997396; gDNA_ID_2926274; Annot_ID_143518
atgatataaatgcttatgaatatgttatctatgattgatctacgtgcattgtattagtatgaatcagtcaaacttcattatttatgaaagcaattctctttttgaacacttttgtaaaactaattaatatacttgttttcttttacttccttagctttttcgtgaaaaacaatatatatatgcatatatcttatttgagcttaatctttgaccatcaaatcatcaatagtttgtgttacgatactttgaacagtttcctaataattatttggtattattcactacagaattgactctctaacaaaaccgaaacaatcaaaattggattgttaatttcagttactttcactttggtttgaatgtaacaaacgagagcatgcaaatatatatcacgctgtacgttgccgattattatttggcacaaagatttttctagctgctggaaaaaagggttgtatatattttaggctttttagccaatacgatcaatgttcacatatataaattctcatcaaaatataaactgtaacgtgaacgtacaacattgtgaacctttacttgaatgaatcaatttatacgattgttactatatcttttagcggaggaagagacaaacgaaagagagctgcagaagcaaaagaggcccatttcgcttttcacatcccataattccaaagtattggccggtggaatctaaactttattttatgtttctcttcattttttatccatatcttttgcacgcctttaaatcttcaatttatataaatttacacgggaaaatcgtgttaacataaacgataaattctataaaaataatataaagtaggagaatgacacagagaaaagtaagagaaactcaacccaatagagtctacagtctagttcagtttaggtttgatttatttttttaactatgttttttttctgtttaaaatatatagaaatcaaattagtatctatttccaggttcctcgacattagaaggaacataaagcacattgatggcagaggatcggatttatagttttgaaccttctttcataccctccagatagcatggtctttcaacatattattatggagggtgattgtaaagaactgcataatattttaatacaaagaagtgtactcgagtattcttcatgttctatataaattttctctttgatgtataaaatttgctcaaggattatgtagaacagtatcatataggcttgtttttatagatgaagaaggtccgatatacattaaaatgaaaggaaaaaaaaagtaaagagaagacaatgaaatgtagcatattgtttgatagttttgttgttgtatcaaacactctgttcaaattcgaataatacatgttaaaaaatccaagaaataataataatgtaagcatgtttaacattttatgtgagagttcatactgaatactttcgatgtgagcatgtttaacattttatgaattatggaataagagtcggttgtatatataatgtaagtggtaaattcaaccacgaagccattaacaagaaaaacttgagtccaaaaagtgagtgggtagagagatgaattagcaaatgctggaatgtgattagatgcccatttggaattgtttgcctctttgtttccatttctagttggtaaccaaaaacgcacccacattcttcatcccactttatccttattgtctatctaatttttttcctaatcaaatctataatcacaattatataatcgagaatttagcatctccatatatgtacccatgttttattcccatgggaccgggtcagttcatttcgtgtgtcaattaatatagttcagatttatatgcatgtgatccatgggtttggaagcataaaatctcaaatctaaaaagccagaatatattcgaatcgatcatatatgtcgaagcatttggaacagttatctatagatgacgtctaaatggatttttttatatatatttactggtaaattaaatagatttgaagatgagtttcacaaaaatcttccctaactttatcaagaagtatccaatagtctcacataaagtgatattaatgcatattctagaggaggtaatggatcatgcccaacttgatttttttttaattattaaataatgaagcacttgcaacatattttcataagaaaaacatatcgcaataattaatctctgagatttgctgatctttttaatttattgggttctctgttgctatgtattgcatcagcattcacaggaaatattttaattaggatcacattcctatggatatggttactcaccaacaaaaacaaatccactctcgtaattaagcagtttttgcaacaaattacagacattatttcatctgcgggtcccacaaacaacgtaagcctaggtcccactttatttctgctgccacttgtaagtcactccgtccacttgttttttctttcttctttgctttccctacaaatccaaatcattcgtcacacttataacgatagagttggaattgattttggaatttgtgtgttcactgttcgtcatttacgtgtgcatttttatttccatttccgtcggtttaattttgacttttgatcatatgtatatattgaaacaaatgttaattaaatttgtatatgtacacaattgatatggatttaacaactagtactatatagttatggtgttatgtattgtcctgatttgatctgatttttctgctgttgatttggtgtaagccgaaaaaataaaaatgccaacgtcactaaaaaggaaagaaataaatggagtaattaattattttcaggaaaaaaaaacaaaagctcattcgaactcatgatccggaatatgatgctctatataaatagaaagaacctctctcaccaatttgttcgtaggaagagcacaagcctccacaagtggtgttgcccctctgttcctaactcctttctcttatataaaattgtgtatcctccatacatacaacaaagagagaaacttttgatatg

SEQ ID NO: 28545 - DNA, 3000 bp, Unknown; identical to SEQ ID NO: 28544
  misc_feature (1)..( 3000): 2750-1469P.txt file - cDNA_ID_2997396; gDNA_ID_2926274; Annot_ID_205266

SEQ ID NO: 28546 - DNA, 3003 bp, Unknown
  misc_feature (1)..( 3003): 2750-1469P.txt file - cDNA_ID_2997408; gDNA_ID_2926275; Annot_ID_143527
ttttatgccaatcaccatcaaaactacaacttgggatcttgtatgcagccttagctctagtgatcactggaacagctgggacgcggttcatcttggcatccgcaggtgcaaaccaatataagaaacctaaagaacaaggaaggttcttcaactggtactttttcacactatatggtggagcgattactggcacgacagcaattgtatatgcacaggacaatgctagctggaagcttggattcggtctctgcgtcgctgctaacttgatcagtttcatcattttcgtcgctgggaagagactctacgagcatgaccaacctttgggaagtccttatacaagtctagttcgcgttttagtcgctgctacaatgaaacgaaaggctgtgatttcatacaaagacgaagactatcatcaccgcgagctcgaaaaagagaccaagacttatgttgcaatgccctccaagagcttcaggtgaaaacaaaaagctttcctgattcatggaacttaaaaagagagctaataaagagggatttttattatgcaggttcttgaaccgtgcagcattgaagacagaaggagactcaaataataacatgtggaggctatgctctgttcaggaagtagaagatttcaaagccgttctccgacttgtccctctctggacatctgtcatgttcctcagcgctcccctagcggtgcaaatgagcatgactgtcctccaagctatggtcatggaccgtaaacttggcccacacttcaaagtctctgctgggtctatgcaagtcatagcactcgtctctggatgcgtctttatcatacttaacaactggactacctatcccatgtatcagaagctaatccgcaaaccgctgacaccgctacaaaaagtcgggatcggccacgttttgacaatcttaagcatggcgatatcagccgttgttgaagcaaagaggctgaaaacagttgaaaatagccatctcatgtcagtgctatggctggttcctgctctcgtgattaatggaataggtgaggcctttcattttccagcaaatattgcaatattctatggagaattccctgagtctctaaggaacacagcgacttcattgacctcggtggtgatgggaatctctttctatctgagcacagctcttatcgatgtgatccagaggaccaccaagtggttaccaaatgacataaaccacggaagggttgacaatgtttacttggtattagtcattataggagtctctaatttcggctacttccttgtctgctcttggttttacaaatacagaaacctcaagaatgatgatcatgaacaagatcttaaagatgttacaaactaggacactaacgtgttctgtcctcgttttctctatattgtagttgtgtcttcatgcaactaacttatgtgctacatgcaaactcactgtttgccgtttgtgtttacttttaccaataaatgttatttgtatcaaactcatacctcaaattattagtatcctagctccaatggaccgattagagctcatgagctgttagctagcttttttaaggattcttcacctcctttatattaaccaaaaaaaacatgcaatgtcaattcctacttaaattacataataaactaaagctataattataatccaaaccgatatataatctcgtttaattacaaaatctaaaccctaattcttctttgtaaacccaaaccgccatttaaactcatctaatcgtaaaaaaactaaatcctaatcgtaatttctaaacctaaaccgacatttaacctcgtttaattgtaaaatctaaatctgtttataaacctaaaccaatatttaacccgtttaatcataaaactaaaccctaatcgtactttctaaacccaaaccttttgaaataaactcaaaccgacatttaacctcgtttaaccctaggggtgaacccaagtatttttcatcattaatcaacataactaaaagggccaagagataattagtattgtacttaatcttaatcatctaacatagatattccacattggttgtgtgaacaaaatctaacaacatatatacaccaacatacggcaaatggtttgtcccgtcgaggacatctgataagattggaacgatacaaagaagatctgcaaggatcacactcacaaatcaagaaatggtccaaattgttttgctcttttttgtttctagaaaaagaaagtgtgtcatttacaatcttgaaagattcaagcaaaatcaattaatacaaacgatggtttggagaaaacttaacaccataaatcactttgaattttgtatgtcttataagaaagatgtaagatttggcttgagaatatataaacaatataattagagatatcttgggaagcaaggcgtttatcttgcgaaccaaatatagggtactatgaaatgaagcccgtgaaacccgagagaagaaaatcttaatatatgacagcgttggtagcatggtctcgtgatttgttgtttgacatgaatatttggcttcagaagatttgacttttgggaacgaaaacagagtttcaaacgtgagaatggtgcttagattttttttaaaacattttttgggcaataagaaaaatatttatgcatctgctgatacaaacgattttgacacaatattcgatcgtgcgttttttatttctttattaacattattcaaagtttctttttagaatatttttctgatgattatgaatactacgtactattgaagatttggtcaaataattttattgttttctataactgtcaccaacggtagatggactgtcagaatctgattaggtctttttgggaccaaacaagattagtaccaaatcactgcacctacataataattgttatggatttgcttatatatatagtttcaagtcttttatctaactccattataacacacaaacacaagtcaactttgcattataactccatttgccctcctggttcatcttgttctctaccatg

SEQ ID NO: 28547 - DNA, 3000 bp, Unknown; identical to SEQ ID NO: 16870
  misc_feature (1)..( 3000): 2750-1469P.txt file - cDNA_ID_2997423; gDNA_ID_2926275; Annot_ID_143533

SEQ ID NO: 28548 - DNA, 3003 bp, Unknown
  misc_feature (1)..( 3003): 2750-1469P.txt file - cDNA_ID_2997427; gDNA_ID_2926275; Annot_ID_143534
gcaattaaaaaatatttagttattcaatctgagacgtatcggcgctatgccattgctagtctatatttgttacaccgttaaactagttacacattgctttttagaatatgcaaatgatcaaatgcatggttgtttaaggttggatttttatttttttatccaaagtttaaggttgtatttgtgcccatgatttgatagcataccaaatcgattgggttaacaactgctatatattcttgcaatatattttgtttatgcatcgtaatgtatagggaagttatctgctaattaataattagagtgatttttggaaaacaaaatagagacagaattaataaaaccattttaaagagagaaagttttgacaaaaaaaaagcgagagaaagttttgataaatcaaccaaaaatgcatataacaatgacatgtgattgctttttaatttgtttgtgatttctgtaccgatctccatgttcgatttcatcactaaatcggataaaagtgtatgttcttctttaatgtttttgcatgaaatatcttgcaatgcataaagactgagatttctaccattacaaaagtggaaagagaacatctatgtaatattgggtctctgcatttgcatttgggaacggttttggcgttttcaaatgacaactcactcccacttatagtcactgacacacacagaaacttttaaaagaacaaccatcactccacacacttatgtgttcttcaaatgttttatttatcatttacttcaattatacgcacaagttacaacaagcaagtttttttgtgcaatattctcttttataatcctgtttgtcctataccaaaacctagattaatcactgtcaaaccaacatcataaaattgttggttaagtcatataaaccattcgtttccaataagtgccatagaaattgaatattgagcatagtcagaatatatatttatgtttggtctggttttgtttgacaaagagagtatattcaggtttataatctaattatcaagacagagttatacagaagatagataaacgatactagtgttacgtttctatacaatcttttgaaagtaaacaaaagaagccatgtggaatcaaaaacattcgaagcatgggaagatcaaataatccagtgatggagctagaacggaactaaatcaatcatgaaacctaaatagttttttaatctttctagaatctcttcttatcaaaaaatttccttatttgtataaaaagcctcgggaaagttaacttctcatcccaaactcattcctcagtttatctctcgactagagagtgaaggaaaaatcgaaggataatctgtttcttccagcacaagttaacttgcaaggtagttttctcccttcgatttatactgtcttgctcactttcttaggctatttttaggacgattcatttttttaatttgtatgttattcatctttttagggttcttgtcacattttcggccttaatttgtatgtgtaaaaatataaatagtgaagtagatatcattttatatcgtctagcactctagctactagcttgatctgaaactagtatatatataaattatttgaatgtcagcttttttttgtgaaagtcacacatcacatggtagttgcatatttcaagaactcaactgaattcgatttaaaatttctccaatcataattcataaagatatgtatttcaatttttttaaataaaaatagattttcctatttaccatgaaattttttactctttttatttgttctcatataaatagagtgataaactattttacaaagttcatttatgtggaaattgataaaatgacaagaacatgaaaaaaagacaaagatttttagttgaaatctgtgatcgatcgaacagaatcggttcagctactgtttttgtaatagaacaactgtccatttttataccaaaatgactaaaccacccttagaagatgcatgtgttgtgtggtactaaaaactcaaaaaagcattgaaactttacacctttgtgtcgttttctcaattttacccccgcttcatttggaattgtcactctcaaaattggcgtattttccagttcatatcttcattcatctatggccccataaaccataactctttgaaccatatttaataatgttacctgcatgcatatacattcatataaaacatgtattcattatcatgttagatatgtctagtctattatttcccaaaagaaagacacctaagagagcaagattcttgttattcatgataacatttttgaagattcaaaaaaaatgagtgattgatgaattatttatggtcagcatctagtaaaatcatatcgacatatccagtcagccttagtagaaatgcaccaaagtgatatagagtggatttctctcgatccgtgtagaaatggaccaccacattgtctgtttagaatattatatttttttgtataaaattgtagacataatctcttattaataaatatttaatgcaagttagttatttttaattttatgaaaagaggttaactccaatatgtaccatactacttgaagaagttaaatgacaaaaaaaaatataagtaatactaccatttccatatattgtactgatatttcaaactttaatcaactttcctttctatttctccttctttttttatggtcaaacccattctgtttatgactaaacatatgacatatctaaccgttattaattagttcacatatcacatatttgtatagtgttttcattttcagtaatcaaaccatccatctaccacaaaagaacttggtcatgtgtccatttttagaaatcaataaaatattataccatatatttatagtatctaactttaagagaataaatatttttatttgccgattcatatacacacacatgcgtgtggtatctatgtctatccattaaactaattatatataaacttattttctggccacaatttttgtttcgtgtatagagagagctcaaagatg

SEQ ID NO: 28549 - DNA, 3003 bp, Unknown; identical to SEQ ID NO: 28548
  misc_feature (1)..( 3003): 2750-1469P.txt file - cDNA_ID_2997427; gDNA_ID_2926275; Annot_ID_205307

SEQ ID NO: 28550 - DNA, 1826 bp, Unknown
  misc_feature (1)..( 1826): 2750-1469P.txt file - cDNA_ID_2997435; gDNA_ID_2926276; Annot_ID_143536
aagctttacatgttgaaacttacaatatttcgagatgagctaatttttggagctctggtgacaaagtcccggagagattcatattcatcagcaggctgcttggcaataaaaggaaggatcagggaaggaatatctggtcatgtaagcaactgttccgagaaaagagaaaaaaaaaagacaactgaaccagcttctcccaaaagtaaagccttttagttaactccagcatatatacaagcagactaacagcgaaagcaagaaggtacataagaagaaaaaaaagaagcaaattcatacagttctcggacatgcaggtagtcgtcagtaccaatctcattaaagcagataactccagtccaatttgatctgcaagggtcgcctctattccagtttctcaaataatctttagggtcaagtagacttcttttaacagatcgtaaagcagtgacttctgaagggtgggttctttgagcatcggcaagcagaaggacgcaacaacaggcaacaaggagcgcatgtagatagagtctttgagggaacaccatggtgcctttggaaagcgtaacagcgtaagaagcagataaatatagactgagaccaaatatccaagcgcacaaggagctcgtatttaagacagaaatagacacagcaggtctaaaattcaaccccacgcaattcaatagctcaaagacaagatcattacctcactattgagatcagcaatactagtactagttccctaagagaattttccaaaaaggcaagcggataagagaaagcttctgggatggcaaaatccctgaaacgggcgagagaagtcaaaatatgcagacggcaatgcagatcaaatcaaaacatcgggaaaatgatgcaattaatcgagagagaaaaggggggaagaaatgaccttgatgggtgtttgctaggtttgatcttgacttgtctgccattttaaaaagcttaaaccttcttccgtggtcataattcggaactgggttgactctacctacctgctccacaagtaccctcgtgtgtgtgagcctttttgaccaatagtaaagtagaaagtagaaagaaagaaacccctttagccattagcctgcatttattagtatcagcaacccaacattgacggcgtttcgagacgcgctcttgtccctttcttctcatgtcagtcaacttctttctttcttctcagtcagagtctcagagagagagagagatattttattcctccccaatggctgggggctgtagtcacgcatgttattttagtaggcttgcattaaagcccatttaggttataaggcccataatgtatttaataggctgcccatttagagaagactgtcgtcgcttcctttaagtcaaccaaccctttggattaaatccacaatgcaattcgtccaactaaaaaactctcaaccgttgatttgattcacacacagacgagacaagacaattccgtcccctctctctctctctttccgcagctcgccggatctcctttgtcttcttcccctgggttccgtttagctcaatccctttttaggaaagactccgtggctcgatcctagtcttggcgatcgcctctaccctttttgactctattcttcttcttcttcattcatttcccctcttattcattgcctttagggtttcttacacgatatgagctaaatacgattttgatttcaccctaagctttcttctattgcttctcgtcgttgcaggtactctttttttttgttttttggaaaacgcgttttctttccaccactgttagctaatcatcttcatatatgcttttagggttttcttaaatg

SEQ ID NO: 28551 - DNA, 3000 bp, Unknown
  misc_feature (1)..( 3000): 2750-1469P.txt file - cDNA_ID_2997443; gDNA_ID_2926276; Annot_ID_143539
acaatgaatgcgtcctctcttcaaagataacacacacattcaatacgtgaagtgaaattcaataactcaataagtatcaataaaaattttcttctatgttttcatttacatttaacaagtttgataaatgaatggtattagccgtataggcttccataatgaccacaatttggtccattcttaaggataaaggtagaaagtgatgctttgtctttggttctaacccaacccaaatctccaacgttttccttgtctttgcgtgtgtattacgatcgagtggtcacaacacgattttttaatatgaactgtagcttcataattatctttatttatctcgaatttcatagatttttttaaaaaaatttacttgtgaaaatagtttcaacctatactttttgcttagaaactaggagaagattttaacattttcaaaatccctaaacttttcttcttgattgcataatttatactatatgtttgccaaaaatttctcatttttcttgttttttccaattctataacttcttttcaaatatataagatatagccatagttgaattatggaatttttcaagtaacgtaatgtcgtgattaaataggaatatgtagatgttgtcgagcatttcaaacaaagataatgttttgtcctttgttctctatcagttgtcgtattgcacgtcgttgtttcccttacaaaacaaccctaaaaataaggtcaaaactcaaaactgttccaccttttgtataacaaacgcaacacgatgacaaaagtatctatttaataatacttgaacgacttaagtatcatgattttgtcattgcgtctataatcataccgagagtttgagttttacacaatactaaagtgatagttaattaatcatatataaaagaatattatctactctacgtactcataatattcttacaaatatttcatcaactttcaatttctccttacgctataatgctatatcattatttttaacaagaacattactttcaacttacactacccaatatccttaatcaaaaagttctccaaaaaacatatcccatttctttgagctatataaaccatgttatttttatatttatttgtttacttcccaactgcactacaaaagtttagagattatgataattacaaaataagaactattgaaaattttcaaatacgaactagaaaagtctaattaccacggaccacggtgcataacgttcattgatggaccgaagcaaaccagttggttcttcataagttcttacttattgcttacgtttgattacatcatttcattggactatcatccatgggcctaataaaacttcattatgggccatctagtgcaaacccgtttggaaaaagtactttacggtgagatcaaaatcgctcttctcatattattgtacgtacaccaagctaagctaacataatattttatcaagaatcttttttctttatccttttatcccttgaaataatatcttcaagcgtgatccaataaaatctcacaacaaaaaccgaaacacgtatacaaaagatacatttcaagacttaatccattagctgttctttccggcttttcggaatttgactccatcaaaaatgagaaaccaaaatacaattcaaaacgagaaagcaaataaaatgtgacatgtgatatatgcatgtgatatcccaagagcttggcgataaatacaactcagttagctacattatgatattatcagggactagtgtccaaactatatattattaaaaatttgatttataccaccaatcccccgatcccatcgagagatttaatttgatcagacaataatcgtgtattcattctcttatattattgcactaagagctcacatgagctgctagctgtatatcaattagaatctacttgattattgttaaaaaattaggagcaagagatcaaatcttatatatctataactagtcgtagtagatggagttttgggaagtgacccggtaactaatagtatggagaacgaggtgggatggatgaatgaagcgtcgaaggatagcagcaacaatggtgaatctttcattgaaatacaaatcaacaaagcagtcagaaccacaggattgagcatctcttcttcgccatctcccgagaacgaaatgcagacgacgacagcaatcttctcatcggccactagttgcttctcagcatacagcagcgtgacgaggttgatgatgaaagtggggtgtttgagtatagtgggagtcataagagagaaagtaaacgtgggagagaggtgggtcctccaagttatacagagacgacgaaacaagagccccctacgatactactacgaaggcagcatgagtaataataaggatgaagcattaacggacgattccctcaaggcagctatcgcttactgcaatgcctcatctctctcccctctacaaacttgattattattattataataccttttctacagaatcatgttggaaccaaccaatatttgttgatgtgtccaaatcctagggcatcatcaactatatcattgtttttttttctttttatctttttgcttttatttccgtttaagaatatattttatagttgtgatcctcattatcccaaatcccaagtcaggtcaaacatagttttgaggcttggtcagctgatatttttacaagtttgttgtaaaaacttgtaaacttgagtattttaattaaatgaaaataaaccataaataaatgaagttctaaacttgagtaataataaaaacagaataaaaaaaaaggtatgtggggaagttttgaaggggcttttgggcttagaaaaggaaagaagtaaaggaagaagcggcgcacgtggcaggcagtcacgagagtcacgagagatcgagagaagtctttgattctcttctctcatcaaatcaaaatatcatctcagagactccgattctctctgtttctcctccacttttcaacccaagtccaccctcaaaattctcagaatg

SEQ ID NO: 28552 - DNA, 3000 bp, Unknown
  misc_feature (1)..( 3000): 2750-1469P.txt file - cDNA_ID_2997443; gDNA_ID_2926276; Annot_ID_205316
cattcaatacgtgaagtgaaattcaataactcaataagtatcaataaaaattttcttctatgttttcatttacatttaacaagtttgataaatgaatggtattagccgtataggcttccataatgaccacaatttggtccattcttaaggataaaggtagaaagtgatgctttgtctttggttctaacccaacccaaatctccaacgttttccttgtctttgcgtgtgtattacgatcgagtggtcacaacacgattttttaatatgaactgtagcttcataattatctttatttatctcgaatttcatagatttttttaaaaaaatttacttgtgaaaatagtttcaacctatactttttgcttagaaactaggagaagattttaacattttcaaaatccctaaacttttcttcttgattgcataatttatactatatgtttgccaaaaatttctcatttttcttgttttttccaattctataacttcttttcaaatatataagatatagccatagttgaattatggaatttttcaagtaacgtaatgtcgtgattaaataggaatatgtagatgttgtcgagcatttcaaacaaagataatgttttgtcctttgttctctatcagttgtcgtattgcacgtcgttgtttcccttacaaaacaaccctaaaaataaggtcaaaactcaaaactgttccaccttttgtataacaaacgcaacacgatgacaaaagtatctatttaataatacttgaacgacttaagtatcatgattttgtcattgcgtctataatcataccgagagtttgagttttacacaatactaaagtgatagttaattaatcatatataaaagaatattatctactctacgtactcataatattcttacaaatatttcatcaactttcaatttctccttacgctataatgctatatcattatttttaacaagaacattactttcaacttacactacccaatatccttaatcaaaaagttctccaaaaaacatatcccatttctttgagctatataaaccatgttatttttatatttatttgtttacttcccaactgcactacaaaagtttagagattatgataattacaaaataagaactattgaaaattttcaaatacgaactagaaaagtctaattaccacggaccacggtgcataacgttcattgatggaccgaagcaaaccagttggttcttcataagttcttacttattgcttacgtttgattacatcatttcattggactatcatccatgggcctaataaaacttcattatgggccatctagtgcaaacccgtttggaaaaagtactttacggtgagatcaaaatcgctcttctcatattattgtacgtacaccaagctaagctaacataatattttatcaagaatcttttttctttatccttttatcccttgaaataatatcttcaagcgtgatccaataaaatctcacaacaaaaaccgaaacacgtatacaaaagatacatttcaagacttaatccattagctgttctttccggcttttcggaatttgactccatcaaaaatgagaaaccaaaatacaattcaaaacgagaaagcaaataaaatgtgacatgtgatatatgcatgtgatatcccaagagcttggcgataaatacaactcagttagctacattatgatattatcagggactagtgtccaaactatatattattaaaaatttgatttataccaccaatcccccgatcccatcgagagatttaatttgatcagacaataatcgtgtattcattctcttatattattgcactaagagctcacatgagctgctagctgtatatcaattagaatctacttgattattgttaaaaaattaggagcaagagatcaaatcttatatatctataactagtcgtagtagatggagttttgggaagtgacccggtaactaatagtatggagaacgaggtgggatggatgaatgaagcgtcgaaggatagcagcaacaatggtgaatctttcattgaaatacaaatcaacaaagcagtcagaaccacaggattgagcatctcttcttcgccatctcccgagaacgaaatgcagacgacgacagcaatcttctcatcggccactagttgcttctcagcatacagcagcgtgacgaggttgatgatgaaagtggggtgtttgagtatagtgggagtcataagagagaaagtaaacgtgggagagaggtgggtcctccaagttatacagagacgacgaaacaagagccccctacgatactactacgaaggcagcatgagtaataataaggatgaagcattaacggacgattccctcaaggcagctatcgcttactgcaatgcctcatctctctcccctctacaaacttgattattattattataataccttttctacagaatcatgttggaaccaaccaatatttgttgatgtgtccaaatcctagggcatcatcaactatatcattgtttttttttctttttatctttttgcttttatttccgtttaagaatatattttatagttgtgatcctcattatcccaaatcccaagtcaggtcaaacatagttttgaggcttggtcagctgatatttttacaagtttgttgtaaaaacttgtaaacttgagtattttaattaaatgaaaataaaccataaataaatgaagttctaaacttgagtaataataaaaacagaataaaaaaaaaggtatgtggggaagttttgaaggggcttttgggcttagaaaaggaaagaagtaaaggaagaagcggcgcacgtggcaggcagtcacgagagtcacgagagatcgagagaagtctttgattctcttctctcatcaaatcaaaatatcatctcagagactccgattctctctgtttctcctccacttttcaacccaagtccaccctcaaaattctcagaatgattgctcggatccttgccgccttagccgattccatg

SEQ ID NO: 28553 - DNA, 3000 bp, Unknown
  misc_feature (1)..( 3000): 2750-1469P.txt file - cDNA_ID_2997447; gDNA_ID_2926276; Annot_ID_143542
attatggaaatagaaaccatatttcatggtaccaatactatattttggcacatggaaagataattccaactcacttcttaaagtataaatcacatcagtcattcgatgctttttttcttcttcttttaaattgaaccgatatataggatttatttgtgctctcgtaaatcaaattaagtagtttgcaataaattagattaaaaaatggtcatatcataacataaatgacaaatccacaccacatgttgacgactatattatgttatgttccatcaaatacaacttagcatctaggtgaaaagctaacagagatttagattaaaatctagaagaacaattgttcttgttactttaaaacattggccaaaattacttccaaccataattagctacatgtttaactaactatacagaaaacaaaacatgatttagcacacaacaaaaagataatgcataatatgattcacacagagataaggtttagaccctaattttgattgtattactcttttctttggtgtaatacaagaaaaactatttgggtctaaagggttgttattatttatttctcataaaaactaaaatgaagagaagtaatttggtcatgtcataaatggagtacataaataaaactgacaacaaatactatttgggataatatttttccataaaatggttatttctcattttttttaaaaacaaaatatttagggcccatattagggggtagtagtacagagaatcaactgtgatgacgtcacctgttaggttgcgtgactcctgggcgctgtttctgtattacgctatcttcccaatgctctctctttttttttttcatctactggtttatataattcatgttcttgaaagtttcaatactagcttttaaaaatttaggcttgattttacatgtttgagaaattatttagttcagtaagataaacagtaaacaatagcaccagtggtctagtggcatgatagtaccctgccacggtacatacccgggttcaattcccggctggtgcatattcttttaattttatttcaaagattagaaaacgttttgggccgttgggtctaaaaataaggagcccaatagatttttatggtttgtgtgcaaaaggagcccaatataaataaaattatattcttcacgtttttttgaattgaagatatcgcaattttttttttgctcatgtatagatccaagattttaatttagcgggactcataagcacaattaatctctacgaatgttgtagaaaattgaaacggtaccatcactcgcctcgaaatttctcccattgggctttattgctctgtaaccattaagatattcggttctgcatattttttccacgatatagattttaataattctcaaaatcttgatgaatgagatggagtgaataaaaacttgagtctagtaaattgagcaacattacaaatttaggatcacgaaagatccttgtattagaatctcgagacgagaataaggaaacgtgtcatagttagcagcttaaccgacgtatcttccgcatcaaaccaagttcccaaacaaatatgttcacattttcattacaattaaaacccttttaacaaaaaaacaagtttttgattgttattcaaaactatgtgtcaaatctaaatcttaaatcattttttccagtcctctagtagacctaagatcaaaacctgaattttatggaaaggcgagtagaagtggagatgatcggcccactccagattttcaaactaatctttcacatctcgaaaccttaaaaatatgataacaaaataaagttggacaaagaaaagaaaaaagtgtttggcatttaataaaacgtctcattcattgcgaagagattagatagtagagaggtcaaattcaatgtcgcagccgacaatagataagaagagataaggtcttcgttatatttttttgtttgttttttaactgtcacgtgaaactgatatccacaaagagcgaatgagagacgtagaagagtcaaagattaaaaacccaacgaactttgactcatcctttgaaggtgttcgttaattatccattttttggtctgactcgtggcatgtggcaactaccgaccttagataagcctggtcctactctcgtattcgatcaccacgtgtcgatcggcttatccgacacctcgagtgggagttgtatgttagtaactagataacggtcataggtacgattatgacattgacatgaaatcatattccaactatcaacgttagtgtccttgtttttatcccctgtaattcagtcaattaagccatcgtaccaggtgagtctttgatattgttgttgtctacgaaaaaccattagatgatctctaattgatatttgattcaacctatggtaaaattatcccaaaactcaaatattacttcaattgatatcatcccaaatattacctagagaggatcaagctttttaatcgtcaattttggttatacaaaacgataaaaaaaaaattgtaagccaaaaataaaaagtaaaacgaaattgtgaatttttaataattcttttgcataatacacaaaagaaaaaaaactcatactccacatgtcaagtgatgacacaataaatgtctaaatttttacaatcaaaaacaaaaaaatgtataaaaaattcgtgtaaccttttttttttgttgtctaaaaaaatgacatgattttggtaaatagccaacaaatttgtagtagagtagtaaagttaggtttcatcatccatctctataaattctcaagaccgacctatacattttacttcccctttcctctcccaaatattttcacaattctctctataacttcacccttcgtataaaccgatacatacacccacacccacatatatatatatatatatctctccgtatttacacatacgtatatagacacatacatcatacatatacgtataatagctgaaagagtgtttttttttagagcgagcgacgaattccaatg

SEQ ID NO: 28554 - DNA, 3003 bp, Unknown
  misc_feature (1)..( 3003): 2750-1469P.txt file - cDNA_ID_2997449; gDNA_ID_2926276; Annot_ID_143543
gcgcattacatctatagaggcagataatgaaaaatatatgtaatttttttttgggttatatactattttatgttcagccaagaaggtgaaaaaggagcgattgcttaaaaatgttttcgtgtggttacccgtgatgcaatgtaaaaagaaaaaagaaaaaaaaaagaagagaagagaagaactaataattacgtgcactttaatttactgtaatactttattggagtgccttggttctttttcaatttttgtggtccatcttagccaaaagaggaaatacttttatataatataaaatattgtaacgcaaagtattgcttagtattcgaaacacattttttcaaatgatttacgtcccattatttcccatgcaaacggaaatatcctctaatgattatttcaaacacgattattacagtacagtcgaaattactttcccggtttaatcatattctggcatatcttataacatattttttgcaaaggtattcgcttttgtttttgtgacaaattatttattaggtttttaaattattacaaataactctcacagacgtatgtaatccaacacataaaatatatggttgataagaattcacatcaattttgattaatttagggactataaatatgttatatacaataattaatctatgcatcttttttaatcattgtgattgttctagttataataaaatatggttgatcacaattcacaacaattttgattaatttatggactataaatttgttaacataattaatctaggcatctttttaaatctttgtgatttctctaattatataatatgaactgcagaatttgattgttctcaatgtataatcttacgggtcataccataccatccatgctttgagttagggatgtcaaaataggtcaaaattcatgggtcaactcaactcaactcaacccatgaaccctaatgagttgaaaattttgactcaaatgagttgatgagtcaaatgggttaatgagtcaattggtttgatgagtaaaatgagttgggttgtaatggttaatggtttcaatggtttacccaattaacccatcaaattttataaaattgaattaaaccaactaaaatctctaaaccaatgccaatttaagtttaaccaacacatctaaacaaatttaataaaattaatatttttccaaatttcttaaatatacaagcgatgaaattgagaaaaaataaattcgtaatttttccaccaaaaaacataaacccgtgattttctcgccaaaaacgtaaacccgtgattttcccgccaaaaacgtaaacccttaattttcccgccaaaaacgtaaacccgtaattttcccaccaaaaacgtaaacccgtgattttcccgccaaaaatgtaaacccgtgattttcccgccaaaaacgtaaacccgtgattttcccgccaaaaacgtaaacccgagattttcccgccaaaaacgtaaatccgttattttttcgcccaaaacgtaaacccatgatttttccgtcaaaaacgtaaatccgtgattttcccgccaaaaacgtaaatccgagattttttcgccgaaaagcttaaacccgaaattttccagccaaaaacgtaaacccatcattttccggccaaaaacgtaaaaaactataattttcctgtcaaaacgtaaatccgtgattttccgtacctaaaacgtaaacctgtaaaaaataaaatccgtaaatatcttaagtttgatgataatgaattaataatgataattatttattattgttttataataataattaattaaattattacttaaatgggttaacatctcaaaccattaaattaaatgagttataggttgacccaacacatttaacaaaatgagttgggtcaacccataactcatttattcttaaactcatttgattataagttgagtagagttgggttatccattttgatatccctacttttagtactatagctacaagcctacaactatggagattagtgtgaatgtatgattgtcgaataaaaatagagtgactaaatattttaagcgtaaaaaggtatttattccagcaaaagaaaagaagaaaaacgacaaaaagaagacttaaaagttgtagaaatgtcagtacgtatgtgaaagactgagacacagaacactttgtacaagaaccagttccagtgtcaccggttacagccggtcgccttctcttgattccccaaagcctctcccaccaaacccgggacttttcacttttcatcagtatttttttttgttaaagattttcatcagtattttatatatatatatatattataaagatcgaatttgtttgcatgatgaggaaagtatatcgagttactatgtatccatcgtttgaaatacccgttttaaaaaaaaataatgagatttatttttaggacttcagtatatatacgattaacttttaacagttgtgtgactaaaacgaaatgtaacaaaaataagagaaaactacaaaacaggtagtgaaaaatgacaaaaaaattgtaggacgctaagacgaaaaaatgattcaagaaagaatatgtcttttcaatttcagttttacgaaatcgtgtaataacgtaaatactaaatcacgatttcacagaaccatataaaatactaaaatcccacgcaatcattaaacttaattcaccattctacggatgacctatgagagagcattgaattggctttagtaacaaacaccaaaaagatgaatcttgaccaaatttgtaatgctcatactaaattcctccaagtcttataaacattagatattttatattttaggttttcaaaatatgtcatataaagaaaaatttgatatacatattgatcgtgcttcaaaaagacaccaaaagagcttctctctctcttaacctctcgtttcgccattatctcttacactgttactctctctctctcttcttcttcttcttcttcttctgcatctcatcgacatcatcctttcccatg

SEQ ID NO: 28555 - DNA, 3003 bp, Unknown; identical to SEQ ID NO: 28554
  misc_feature (1)..( 3003): 2750-1469P.txt file - cDNA_ID_2997449; gDNA_ID_2926276; Annot_ID_205320

SEQ ID NO: 28556 - DNA, 3003 bp, Unknown
  misc_feature (1)..( 3003): 2750-1469P.txt file - cDNA_ID_2997453; gDNA_ID_2926276; Annot_ID_143544
acatatatcattagtatagtaactatgttataatttggtttattaggtttgaataagtgttacacttttgtttttgaaaatttatccgttggtgataatgaataatttagggattttctatcgcttgagggttattaatttattatggtaaaatgttattttaggtatcgaattggttcataaacgcaagagttagggtttggaagccgatggtggaagagattcacatgctggagactcgacaatctcagagatcttcttcttcctcttggagagacgaacgtactagcaccaccgtcttccctgacaacagcaacaacaacccatcttcgtcctcggcacagcaaagacctaacaactcatctccgcctagacgggcacgaaacgacgacgttcatggcacaaacaacaacaacagctatgtaaacagtgggagcggcggcggtagtgcggttggtttctcgtatggaattgggtcgtcgaatgtgccggtgatgaatagcagcacaaacggaggagtgtctttgacgttagggcttcatcatcagattgggttaccggagccttttccgatgacaactgctcagaggtttgggcttgatggtggtagtggcgatggtggtggtgggtatgaagggcaaaatcgtcagtttgggagagattttattggtggtagtaatcatcagtttctacatgattttgtaggttgagattatttgtgtggaaaggaaaaaatatgtttgacgtttgggtatgtataagaagatatgggggaattgaaatgcatatgatgtgtatattagaatgtttcttcttctttttttgttgtttgcttactttcacaaatgttatctttttaagaaatgaaattggattcaataaccaatgttaaaaacatgggttagactttagagttgtctatgtcttggtgaaatataaaaggcatctatcattgttttaatattttggcatgattcaaaacatggtgctttttttttttttatgtatgtcacaattatcgttgaagaacgcgattaagatgtttatcattgatcgttgatattatattttgaactatcttgttttacttgatagtaaacattgactaaacaacatgttttcaaaccctaaaccttgaaatatttcagactatttgagttatctttttgagtcggatgcagttttgactccgatccgctcaacattgttgaattcttctactcataaaagaagtttgagccgatttcaaacacacaaaacaaatgagttcggtttaatgttcagtgtgtactaatacgttggcttttgaagatcacatgagagcaaaagtattgaaaataaaattgtgcttttgttgcttcaaataactttccatttgcttttggaaaacaagaaagatatatatatatatatatatatatatatatacataacctttccctctcatgggaaaaaagtaaatctttttctttgtagaatttattctccgatcctaaccatttctcagcctttttgtttgtttacaccatttttgtttatattcttggattatgtctatatagaataagatgtaaacataaactgtattagcaaatatgttttgaattatatgaaattcaataattgagaagaggttcatgtaatgagccgagagaagaatataaaagcagtcaaataattttttcaaaaaactatttgtatattaaaaaggtacaaagtaaaaaataaatttaagaaggtgccatcattggctcctaaagaacaaactacaaagaatcaatttctcatgatttgatctctcacaatccgtctcctttatgtggatgcggaaaaacactctccacacgtttcatgtaaaaattttagttaaatttctaaaaacaatagagatactattcgatttgttcttgaattattcatgaatacatatagtggcaaccttagacactagccacgtcaaccgtacatgttatatcatatatttttatattggtctatctatatgctgaactagagtctagagataaatatgagaacatataagaaaccatggacaactaaagatattgtctttctgtgtgagtatttgttccagaagcattaaaccttcggaataagtataattcttttgcaccattactatttttataagcttcaccagctctatatatattctcaccattaacataaaacaacaacaacacgaagaagaagatgaaggtacttgatgatgaacgggtaatctgcatcctgaggtttaaaaccaattaagcatatacatatgcgaatgtatagtttttaatcctcgggatacagtttacctcttccttactcaagaaaacacttagctttaacggttttggagaaagaagaagcatcgaattaaatccatttgaaacaggttagttatcttagtgaagaatatatccatcaatcataatttggtctagtcattcgaagtgggatatgatttgatacatatagtctaaaatatgattttatgccagtaatattttgttttccctgtcccctacctatatctagagcttgagatcctccttttaaaacttttagatgattaatcgttttacaaatcatagtcccagactttcgttccaatctagatcggtttagatgcgttttgttttggaatttatacaacgaaaaccaaagtttagattaaaagattcgaaaaccggattacataaaatctggtccaggacccctttggttaacgaaaaccagactaaagggcagaaacgtcatttgacaaaaagaaggatgattctctccttcctctttccccaatgcaaagaaaaagcattatagacttttcaagttttccgatataagcacgaaatcgctgtttctctcttcgacgaagctttgataatttgatctcaatcgatcgattctattgagaatttgtgtacctgttttcttataaggttaactaaggattgtggaatcagaagtgttgtgtttttgtgatcggagattatg

SEQ ID NO: 28557 - DNA, 3003 bp, Unknown; identical to SEQ ID NO: 28556
  misc_feature (1)..( 3003): 2750-1469P.txt file - cDNA_ID_2997453; gDNA_ID_2926276; Annot_ID_205321

SEQ ID NO: 28558 - DNA, 3000 bp, Unknown
  misc_feature (1)..( 3000): 2750-1469P.txt file - cDNA_ID_2997456; gDNA_ID_2926276; Annot_ID_143545
ttggaatgggatccggttaacgcaatatgtaagtaaactgcataacaagtgaactattcaaaacaaatttcttgaatcagatcattgtgattgattagttcttggcatacatgtattaggtggtaaatgtcgccatgggaaacactgcaaaaagaagaagaagaccgttgttttcgcaggtacagaggatgaaccgaaaaaccaaaaatatattcaaatgcccatatgattgtactccattttaacttctttgctcttgaaggtgcggctgttgcggttgtgggagttacgctagcgattgcggtagcagtaattggaaccaaacatagccaccaaaaggttaaaaaggatatccacaagaacattgttaaggagcgagaagagatgcttagcgcaaattccactggaaaatcatcaagaatcttcactggcagagaaatcacgaaagcaaccaacaatttctcaaaagacaatctcataggcactggaggttttggagaagtgtttaaagctgttcttgaggatggaaccataaccgcgatcaaacgagcaaagcttaacaacaccaaaggcactgatcagatcctaaacgaagtccggattctctgccaagtcaatcatagaagcttagttaggcttctcggttgctgtgttgatcttgaattgcctctcttgatctacgagtttattcccaacggaacgctgttcgaacatctccatggcagttcagaccgtacttggaaaccgctgacttggcggcgcagactgcagattgcataccaaaccgctgaaggattagcttatctccactccgcagcacagccacccatttaccaccgcgacgtaaagtcaagcaatattttgcttgacgagaagctaaacgccaaggtttcagactttgggctgtcaagacttgtggatttgacagaaaccgctaataacgagagccatatcttcacgggtgcgcaaggtacattgggatacctcgatccagaatactaccggaatttccagctaactgataagagcgatgtgtacagcttcggggttgtgcttctggagatggttacatcgaagaaggcgatagatttcactagagaagaggaagatgtgaacctggtgatgtatattaacaagatgatggatcaagagagattgactgaatgcatcgatccactgctgaagaagacagctaacaagattgacatgcagacgatacagcagctcgggaatttagcatctgcgtgccttaacgaacggagacaaaaccgaccttcgatgaaagaggttgctgatgagattgaatacatcatcaatattctgtcacaagaggttactgagacatagctgtcttagaaaattaccaaaatgacttgtacccttgccctgtttccggttatggattggagaaaaacaattcatagaaatggatttttgtaaaatcattgagatgggttttgtttgatatcatatcaagatccaaaacatggtatgagacgatatagcagctaaaaaccaattaaagaaagataaaccaacagaaatctgaaacctatcgcaagagagagcgggttgctgcctgcaaaactcagtgtctttagtgaataaaacagtaactcctgcagaggaacacgcggctgcaagagcgagaagtgcagtgacctgcagaattccaaaagaaacctatcaaacaaataacctttaaaacaacaagacaccaacagtgaataagcatataatgaaatggaagataagtttaatacccaatcaccaacagtgaaaaggctcaataagatagggcttcgtaaatcactttttctccttatcgcatatacatcaagacacgcaagtccaaagctccatatcaattgaagacccatagatgcgactaagaagctgaaatcattggcaaaagcaatctatcatcattttgtatcttttgagataaccccatacagtaatcgaaatatagaaataattccatttccacatattttttaccaaacaaagaaaaaaatcttgtcaaagtttcaggcaaatgttaatcatacacaattactagttcagttagctctatcttcaaaagtttatccaagaaaaaactacaaagtcaagatttttgatacatcagtgtccaatgtcttcaactaaactaaactaaaccaaaacaccaagaccaatgagattgaagatggacaattaccagaaagcagtgtaattggaaaagtcgtaagaagaaaccataacaccaatggaagcagcagcagttgcacattgccctagtctcagtatcaacccactcattgttccaggactcccaatcatcttcttcattgatcagaacccaaaaacaaacacaataaacagaacaaaaccaagactttctatcctgttcctcaccaaaatccccgggagaaaaaaatcgctactttacaggaaattgatcataaaaaccctaaacccataattttattcaggaaaatttcacaaacccaaatctcaaaagttgacttatgatcataaatcgtacggaattgggtaattaagagcatcgccaccagaaaaccaacattaaaaatgacaacttttttgagctatatgaatttaaaaacaagtatctaccacaaatttaattctgcttttttggaggaacaattatgtttcccttaacttcaagccaacgatattaaaattgaagttggaagaaacagtgacgcaattctgacgccggcaagagctattttgttcttctctccttttgcctttaaggacgtgtccacacacagacattcctctctcactgtacgaatgaccaattccttttaatatatgggcttcttatggcccattaagtaattgggccttattaaatggctttttatctcctacataatgctttgcactataaacaaaccttaaacctctcttcttctctcagtaaaaccctcatttctgtttctcttttcacttttaaggaaaaccctagaatcctcagaaatg

SEQ ID NO: 28559 - DNA, 3003 bp, Unknown
  misc_feature (1)..( 3003): 2750-1469P.txt file - cDNA_ID_2997467; gDNA_ID_2926276; Annot_ID_143551
ggaagatggaagcaagaggtatagtgctgatttactaaagatttctctctttgttcttgttgttgttacaagaattggaagaaaaaacagtactctggatttatatgttggcttgatttctcaggaacgtgatggctattggaagatgatgcagaagtatatagggtctgatgttacatctatggttactcttcctgtgatcatttttgaacccatgacaatgttgcagaaaatggctgaggtttgtggtcttagattttagattatatgaaagatcttttagcttctggtttctattgaacatgttttggtttctccatttgttgtctctgcagttgatggaatactcatatttgctagacatggctgacaaaactgaagatccttacatgcgtatggtatatgcatgtaagcacatccccactcttcttgttcttccttgtagttttttcatggtgtgactaatttcatctgatctttaatagcatcatgggctatatctgtgtattacgcctaccagcgtacctggaagccgttcaatccaattctcggtgagacttatgagatgactaatcataatgggatcaattttatagctgaacaggtgagtgatttctttacaactcatattccaatgtgacttgggaaaaattatgagttcttagttgacatatgtcaatgttttgttcctcaggtctgccatcacccaccaatgagtgctggtcatgctgaaaacgagcatttcgcttacgattgcacttcaaaactgaaaacgaaattcctaggcaactcaattgatgtctacccagtaggaaggtaatatctcctaactatgtatttatatttaagagtctccttgtgagactaaaacactgaacttttcagtcaatgaatatgtgtgcaggacacgagtgacacttaaaagagatggtgtcgttcttgatcttgtacctccactgacaaaggttcataaccttatcttcggtcgaacatgggtcgattcgccaggagagatggtcatgacgaacctgaccactggtgacaaagtggtgctttactttcaaccatgtggctggtttgggtaagttctttcttcatcaaacttaaaaaccttcaaacaaatctgatcaattgaaatctcatctccatgcttctccatttagagctgaaatgtggacctaatggacagatctggacgatatgaagtggacggttacgtgtataattcagctgaagagcccaagatgctaatgaccggaaaatggaacgagtccttgagttatcagccatgtgatgcggaaggcgaacctcttccaggcaccgaactgaaggaggttttatcaatttctctcctctaagcaaaccctctgcatactatatctagtcacctttctaattatgttacttccacaggtgtggaaggttgctgaagctccaaagaacgataaataccaatacacacattttgctcacaagatcaatagttttgacactgcccctaaaaagctactgtcatctgattcacgtctacgtcctgatagatacgcgctggagatgggtgatatgtccaaatctggattcgaaaagagcaggttactaactactcatagtcttttggttagcttccctaagactactaatcccaaagtaatgcaaaggctaatagaagccgggtttttttttgttttgcagcctagaggatagacaaagagctgagaagaaaagcagagaagagaaaggccaaaaatttgctccaaaatggtttgatgaaacagaagaagtcactcctacaccatggggtgatctcgaagtttaccaattcaatggaaagtactcggtgcaccgcgccacagctgaaaactctgaggatacaaccgatgtgaagttgacccaattcaacccttggcaattccaagatctctctgcttaatcctttggtgccatttgttgtgtaatgcgttgttactttcttagatctttcatttgtttttggtattaatcaccagtttcattgtaattttccataagaaagagtctatattttgataatctactctctttgtaaggctttaaagctgattactgattttctgagttgtcttgaaagcaattttatgaattgaagtgacgtcgttaaaggagaaactatagtagaaggaaactgagaagtttcttggggcttaagcaactaataaaaacgagcaagcgattcttttctttgtttttttttttcctttttctttctgtcaatagataaacggaatggagcagaagtaaagataaaatgaaatcacaagaacatcgaaagtaaaatctcttggtttggtaacaaaaataggaagttggtgccaaaaacagaagataaaccaaaaaaacaaaagttagtaatttattggctgtcatgggtggatgaggtaattacgcaaaaggtcgtggactcacgaggttggttaaaattaaaaacaactgcaacatttattttttaaaacgtttttttgtaacatgaaatttctatgaagattgggtagaatgcatttaccgcgtttcatgtgggacgacgtcttcttattatatcccttcgcaactaaatcctcgcttccatattttctttcaacactttatcatgaatattgaatacacacacacactcataactatgatttttcttatcgtattatttaaagtcattaagtgaacacaaatatatcgtaaagaaaacatctaattatgttagggtttctttcgaattagttcgttaaatatgtctaaactaaagtttatatggtatactaaaccgacgcatcttcttctgattgaaccgacgtatttttttaacttttaactgtcttccataacttcccattttcttctccaccactctctctctctcgctcgctcgcatatatatacgtcactttttctctgatctcataacactgttccgagagtgaggagtagaataccttattaccggtttaatcaaaccggttcagtttccaaatg

SEQ ID NO: 28560 - DNA, 3003 bp, Unknown; identical to SEQ ID NO: 28559
  misc_feature (1)..( 3003): 2750-1469P.txt file - cDNA_ID_2997467; gDNA_ID_2926276; Annot_ID_205328

SEQ ID NO: 28561 - DNA, 3003 bp, Unknown
  misc_feature (1)..( 3003): 2750-1469P.txt file - cDNA_ID_2997471; gDNA_ID_2926276; Annot_ID_143552
ctttgtaaggctttaaagctgattactgattttctgagttgtcttgaaagcaattttatgaattgaagtgacgtcgttaaaggagaaactatagtagaaggaaactgagaagtttcttggggcttaagcaactaataaaaacgagcaagcgattcttttctttgtttttttttttcctttttctttctgtcaatagataaacggaatggagcagaagtaaagataaaatgaaatcacaagaacatcgaaagtaaaatctcttggtttggtaacaaaaataggaagttggtgccaaaaacagaagataaaccaaaaaaacaaaagttagtaatttattggctgtcatgggtggatgaggtaattacgcaaaaggtcgtggactcacgaggttggttaaaattaaaaacaactgcaacatttattttttaaaacgtttttttgtaacatgaaatttctatgaagattgggtagaatgcatttaccgcgtttcatgtgggacgacgtcttcttattatatcccttcgcaactaaatcctcgcttccatattttctttcaacactttatcatgaatattgaatacacacacacactcataactatgatttttcttatcgtattatttaaagtcattaagtgaacacaaatatatcgtaaagaaaacatctaattatgttagggtttctttcgaattagttcgttaaatatgtctaaactaaagtttatatggtatactaaaccgacgcatcttcttctgattgaaccgacgtatttttttaacttttaactgtcttccataacttcccattttcttctccaccactctctctctctcgctcgctcgcatatatatacgtcactttttctctgatctcataacactgttccgagagtgaggagtagaataccttattaccggtttaatcaaaccggttcagtttccaaatggataatctactctgcgaagaatcttggcccgcgagtcctttaaccccggagcctttaccaaacttccgtcaccgttctcacgacaatgacgtcgtgaagatgtatccagagatagacgcagcgacgatggaggaagccattgctatggacttagagaaagaattatgttttaacaatcatggagacaagtttgttgagtttttcgtctcaaagaagttaaccgattataggttccatgcgtttcaatggctaatccaggtaccttaattattattatctctttgtttgtcctatgtgtgatatttgatagtaaaccgcaaaaatttgtagatacttataacaacctataaaatctttcaagatagcctttaaaatttgggtttacgaaaaagttttttgcatcaaaattaattatcgatattataaaaatatttggtatgtattatttttattttttaacatcatattgttttataaaccaaaagttaatttttggttttactttctcagactcggagtcggctaaatctttcatatgaaacggtattttccgccgctaattgttttgatcggttcgtctacatgacttgctgtgacgtaagtatacataagcaaacacaattacttaatgtgataaaaactttataattgcggttgaattaatgacatgttcattataaataaatgcaggaatggacgaattggatggtggaactagttgcggtaacttcattatcgatcgcatcaaagttcaatgaagttaccactccattactcgaagaacttgaaatggaaggtttaactcatatgtttcacgttaatacagttgctcagatggaactcataattttgaaagctctcgaatggcgtgtgaacgcggttacgagttatactttttcgcaaacccttgtgtcgaagatcggtatggttggggatcatatgatcatgaatcgaattacaaatcatctgcttgatgttatatgcggtaaaatttgatctacatataaaatgtttcttgttataaatgtaagattgacgtgaaacgggaactgatatggaatgttattcttgatgcatgcagatttaaaaatgcttcaatacccaccaagcgttgtggccactgctgctatatggattctcatggaagacaaggtgtgtcgagaaagtatcatgaatctctttgaacaaaatcataaggaaaaaatcgtgaaatgtgttgatgggatgaaaaatcgagacattgatcatcagtcgtcgagaagaagatacagtgaagggaggagtattctgagtctgttgcagcgaggcgatgtgatgaatatgaatggggattataacgttgaagatctctctaaaatctttcagattttccgatacgaaaagaagaagagggatagaggaaaccaccaagacaacattcgtccggcaaaaagaatgacaattgaaatgtcaaattacatttagcattttatgaaagaagcctacaaagagagaaatgtttgtttgttttttaattgtttttacacataccttgactcaattgtaatatatactacagaataatgtattgattaataaaagttaaaaaaaaactactcatattttattttacagataaaacaatcaaatctataacaacaaaaaaactctaattgtaatctgataaatatatacatatcattttataataattaaataaaatcatggaatattatttaatgtaatcatgaatacattcattatatatacatatatatatatatatatattttttaatttatttttgacgacaaaaaaatataaatgagtttataattacattaaatattaccccataattttttttttgttggtgaggccatgattttgttttactgtcagaaaattctagcaaaaaaaggaaaaatgtgttgcaggatataacacgtggcgaaatatgaatggatcggagaaagagagcagtgtagccacaagctaaatcctgaagtgatttctgaagataaagattgttcatatcaagtagttttcgttaattcactctacaaaggaaaataatg

SEQ ID NO: 28562 - DNA, 3000 bp, Unknown
  misc_feature (1)..( 3000): 2750-1469P.txt file - cDNA_ID_2997473; gDNA_ID_2926276; Annot_ID_143553
ttcatgcttggattcctctgaactttgagagaacacaaagttgtaacctttgttctgctgttgtctaactttcaaaacttttgtcattactttctcattcttcaggaaagctttaaacttgttgcattatcttctacaagagaatgactcagactccgatattgctatagaattcgggcttcaccatttgatgatgcacctcgtgtctagcttcgatgctgatgtaagagaagctgctcttcgaggattgcttgagctcgtgaaagctagaaaagactgtagtacttgtggttctagcatagtgaaaggcgatgagagactcagacagattctaaaagatcggatcaaagcaatcagccgggtcaaagcaatgagcttgtttatgtcacaagaagatctatcagccgctaaagaggagaggcagctcttagattcactatggaccacaatcttcaacgaaccttcttctctttagagacaaagatacaaagagacaaaaccgtctgtgcttccttatatcatgagtaagcactaaaaccgtcttttatgtctttggacccaccagctaaagcttgtgtctttagaacactagttaaaaggatggtaaccactgtataatgaccaaattttgattctattttgagttcaaattttctcagtttctcattcaatgacctaaaaacagaccgtacaagtaccaaatcaagctactgcatgataaacataacataaaaatcagaagcctctcactttggaggacagaaagtgataacataacgagaagctctacacttattcaaactactagaatcatcaaacgcataactataagctttaggacaaatcgctttaaacagattcgcgaacagagtcggcttacacgcctgaggattcgcatattcaccggtgcaacaatacttagccgattgcatcgccaagcaagcacttttacaaccaaccactttcccatctctcttaacttccaaagctgatggacaacaaatgttcaaattcacttcacaagccgcaacgccacatccaactccaccgccgattggtttcatcgacaccggaagattgaaaccgtcgacgagacttacgtcgtagaaatgaagcggagaggaagatgagcctaatgtcatttctactacggttgctggtggtacaccgccggttccttggcagttgatagagccgtcgttgcagtctccggtttggcatgagcctttaccgttttggttaaaggtgcagccttgtctaccccagattcgaccggaccatttatccggtacgtctatgatggtttcttcgccgcttcccatgtggaatccgccgtttcttggtgtgatttggcctccgccgccgagaattcccggccaaatgctctcctggcagttattcactattataagctgagctccatctgcaaaagaacaaagtcactattattgagaggaatcaaaacgagaaacaaaacccatttcataaattatcgagaaggagaagagatatcgtaccagtgaaggctgagatagtgagaaagagaaggaatagagttgcagatttcgtcattgttgttgatgttgttgttgttgtgtggggatatatcacttctaaagtttgcttttgtgtgtgttgtggttgttttcaagagaatattaataaagaatatgttgaggacgtcgtggtcgaaggaagaagtggaaacttgggttgcaagactaatattggtgtggtgaagtggattgttgtatagggaactgccaagtgctaacgttttataaactgagactttcatgggattagtgggaaagagaaagatatggaggcttgatcgtgagccttcttctatgaagaatgggttaaagttggatttaaagaaaaagagaaagattcatatgtctctcaaacgtttattattggataaagattaacactcatagatttcttcatcattgcatttctttaaggcaaatttgtttatactttacaatccataactaattttcagacctagctaaaatctcattgtctaacattttaattattcttagaaattgatttgatatttttgaatatagttttataatttttgtaataatgtcgtaatgttaccacctgaattcactgttttgagtctatatgaaaattgtaataaggaaaatgttagagtgcttcactagagttttgaacttttgattttatatgtcagtttgtttttctttcaaaaattatgttatatgttatctatgcgtatataaacttcatcacttgctagtagcctagcatgtcccaacatttcttacctttgctatgacctttttcactttgtacatcaaatcagcagagagcatatatgcattacttcaatgagaggatttgctttgtttttaaacaaaggctatatttacacaaaacaaatcattctctttttaatgttcttataatattttgttggtttttgaaaggtaataatagagatcgaagccaagaatgtcactagagtctatagacttgcttttaataacaggtggggaggttgaaggttttggtgggtaggtatcttgcaagacatacatataacatattgatgagtactacttgctcaatattacttcaagctgaagcaaaataacatatgaaaccaaattgagataacacttcaaatcatattgcaaatgtaaagagtgaatttgcacaatgatttacaaagtgaacatatacaacaatggattataagttctttaaaaaccacaacaacaaaaaaaaaaaaaaaaaaaaaaaaaaaattctagaggaacttttgggtcaatttttggtttatttggttatcacaaaaccaagccaattataccgatttttccaaaccaaactcaaattataccgattgaaattggccactcttagtgacgacggcgaggaagagctccgccgacgtttactgagtaaaacctttacttctgagcaagacaagaaaaaagaagatattgagcgattatg

SEQ ID NO: 28563 - DNA, 3003 bp, Unknown
  misc_feature (1)..( 3003): 2750-1469P.txt file - cDNA_ID_2997481; gDNA_ID_2926276; Annot_ID_143556
atctgcaactctattccttctctttctcactatctcagccttcactggtacgatatctcttctccttctcgataatttatgaaatgggttttgtttctcgttttgattcctctcaataatagtgactttgttcttttgcagatggagctcagcttataatagtgaataactgccaggagagcatttggccgggaattctcggcggcggaggccaaatcacaccaagaaacggcggattccacatgggaagcggcgaagaaaccatcatagacgtaccggataaatggtccggtcgaatctggggtagacaaggctgcacctttaaccaaaacggtaaaggctcatgccaaaccggagactgcaacgacggctctatcaactgccaaggaaccggcggtgtaccaccagcaaccgtagtagaaatgacattaggctcatcttcctctccgcttcatttctacgacgtaagtctcgtcgacggtttcaatcttccggtgtcgatgaaaccaatcggcggtggagttggatgtggcgttgcggcttgtgaagtgaatttgaacatttgttgtccatcagctttggaagttaagagagatgggaaagtggttggttgtaaaagtgcttgcttggcgatgcaatcggctaagtattgttgcaccggtgaatatgcgaatcctcaggcgtgtaagccgactctgttcgcgaatctgtttaaagcgatttgtcctaaagcttatagttatgcgtttgatgattctagtagtttgaataagtgtagagcttctcgttatgttatcactttctgtcctccaaagtgagaggcttctgatttttatgttatgtttatcatgcagtagcttgatttggtacttgtacggtctgtttttaggtcattgaatgagaaactgagaaaatttgaactcaaaatagaatcaaaatttggtcattatacagtggttaccatccttttaactagtgttctaaagacacaagctttagctggtgggtccaaagacataaaagacggttttagtgcttactcatgatataaggaagcacagacggttttgtctctttgtatctttgtctctaaagagaagaaggttcgttgaagattgtggtccatagtgaatctaagagctgcctctcctctttagcggctgatagatcttcttgtgacataaacaagctcattgctttgacccggctgattgctttgatccgatcttttagaatctgtctgagtctctcatcgcctttcactatgctagaaccacaagtactacagtcttttctagctttcacgagctcaagcaatcctcgaagagcagcttctcttacatcagcatcgaagctagacacgaggtgcatcatcaaatggtgaagcccgaattctatagcaatatcggagtctgagtcattctcttgtagaagataatgcaacaagtttaaagctttcctgaagaatgagaaagtaatgacaaaagttttgaaagttagacaacagcagaacaaaggttacaactttgtgttctctcaaagttcagaggaatccaagcatgaagaaaagtgaagagtattattacctttgaaatctcacactatcagtttccaaagcatcttttaaaccagagtaaccatttgcaatccggaaacctgtgatcccaggtttattattgcgaatcaaagctgtaccccaaatttaccacaatacattcatcagatttacgatagacatttttgtttttgaaaaaggcattcgaccatctaagtatataggatagaactcagagcagcttacatgatattgcaccgagagcctgtgttcgagaatgcatatcggtgtctgaagtaaaccttaaaagcaaggactctaaaccattggcttccataactgattcttgactccgaggattgttctcaactattgtgcttacaacatctgcagacttagcccggatattagcattggagtttttgaggtagccaagaagaggtaccaagcctccaacggaatgaagatctgcccatacattcaaagaagtacaagttaagcccagcaatcaaaagacagatatagaacaaagttacaaggtcaaagtatgaaaagactcaccattagccatatcaatcgattcaacatgttcctgcaactcatccaacaaacctaccaaatcatcataactcaaaatcttagtaaccaacaagagagaaaatagctaagaaaacaatagtgaactccatattgaaccttcaatatcttgaggggtcacttcatgagcctccaaaacttgttgaggtgtctgcaatacctgtgtaatctccttcaaccgcttgactacatctaccgtttgtgattgcatagcttctgcaaaccattttcgatcctcctcactgtctaaccaaacaatttcatatcatcaaaaaccatctaccaaacaataccaaatcaaatagtcaaattccactacatgattcattcctcataagaaactgacgcagaaccacgcaaatttctaaaacaacccaacaaacaacataagctccactaagtgaccaacaaaacctgaaattacaaagaaacttcgtaccttaattggcaagtaggtcgagtaccatcggagtgagagagactccacttaagcagaccgtcccagttaggtccgtctttcgccattgaagcaacggaagaagagaaagactctgcgaaggtcagagagtcagagacaatgacaaatagtttgggccttatgttcacgctaacttaataatgggcttaacaggcccaattgttaactcgaaatatcttgaaggggcctaccttatccacacacaaaagaaaactgaagaaccccaaaaatcccaagtgaaaacgttatccacttcgagagagtgacacgtcacgaagcaaatccaaattcaaaacctttccataaaaatcaaatcacttcttcttattacttcccccaaatcgaaatcagtcacttaaaaccctaaattatg

SEQ ID NO: 28564 - DNA, 3003 bp, Unknown
  misc_feature (1)..( 3003): 2750-1469P.txt file - cDNA_ID_2997487; gDNA_ID_2926276; Annot_ID_143558
taagtgctctgtttttgtaagagatctgaagaaattattctttagagaataattttggtgttcttggggatattttcagacaatctatggatttgttgactggagttacacctccgactagtacaagttttgtctcttcatttcgccagagacgacaaagctctgttttcggttcgtttacttcttcaccaagcaaacagcaacttctcatagacaaagacgagatccaaagctctgttgtgtcctccatcaaatcatttcttgcttctcatctccagctatcagtcccaggggatcttttaactccccaagaaaaccgcagttgcacattctctcaatccgttctcaacggtaataattgcattaggaatgttcaatctgagttttggttaggttttctctgttttccaagattagtcaaataatcaaactgaaaccaaatctgatatatattgatgaactgagtttacgtttagtatagcattagtgcgagagtactgagtttacgattatcttttctatttagattgagattcttaacattctctttttgcaggaattaacgttctatgtggagtagctttacttacaatgccttacgcagttaaagaaggaggatggttagggcttttcatactcttctcctttggcattatcactttctacaccggcattctcctcaagagatgtctcgagaactcccctggaatccacacttacccggacatcggtcaagctgcattcggaaccactggacgcatcctcgtctctgtaagattatttttcaaataatcaatcttaactttgtttgtgtgtgaattgtgatcctaacttaacttgggtttggaattacatttcagatacttctctacgtagagttatacgtaagtaccaaactctctttcatgtttcatatcatgattgaagaaattgaggtcctaactttgaatttttttctgtaggcatcttgtgtggaatacataatcatgatgagtgataatttgtcaagaatgttcccaaatacctccttatacatcaacggattttctttagattctactcaagttttcgccattaccacgactcttattgttcttcctactgtctggctcaaagacctcagcttattgtcctatctctcaggttcatctcgtaattggcacacacaacaatctctgagatttgaactctttaattaaatttaagaaatgttttgtttccttagccggaggtgtcatctcctcaatcttgcttgcgctttgcctcttttgggctggatcagtagacggggttggatttcacataagcggacaagctcttgatataactaacatacctgtcgcaatcggaatttacgggttcggtttcgggagtcactctgttttccccaacatttactcatccatgaaagaaccttccaagtttcctacggtgcttctcatcaggtaaaacaacttttgcttatagcgcaagaaacctctaggtctaattttcatcacttctcatttcataaaataattgtttgttgcgttatgtagttttgcgttttgcactctattttacattgcggtagcggtttgtggattcacgatgtttggtgatgcgattcaatcccaatttacactgaacatgccaccacatttcacctcatctaaaatcgcagtctggacagcggttagataaccttccaaatcaagaatctcagaccttcttcacattctgttcataataattttctctcaattcctatctcatttgtatgattaggtcgtaacaccaatgacgaaatacgctttaacgatcactccagtaatgctaagcctagaagaactcataccgtcttcatcaagaaagatgagatccaaaggtgtctctatgctctttagaaccatattagttctctccactttggtcgttgcactcacagttccattcttcggtaaactatctctctctatcaatttctagttaccctaacttcttgcacaagaaacccctttgtataaaacaatgaccgaactcgttaatgtaacaacgttaattgcagctactgtggcggctctgattggatctttcatcgcaatgcttatcgtaagttctccaagaacaaatcaatctcaataattgccggaaaaattaaggatcaaaacaagttcttgacgatttcggttttggtctttttcaggcgttaatattcccgtgtctctgttatatcagcattatgaagggtagattaactaactttcaggtaagaatataattgaaaacttcgattttgattatatatttttactgtcaatacttcgtagaaaattgagactgaaaagagtttttatttttcagattggaatttgtattttaatcgtgataatcggcattgtaagcggttgttgcgggacttattctgctatcgccagattaatcggcgaaatgacctgattggttttgcagaataagtacgtatattcgaaggaataaaccggtatatacttgaataaaaccggtttttgataaaccaatggttttttgtgtgaagataatccaatttgatttttttttttggtattttattcatagttttaagtccattttactcaatgtagtcttcatttttttttttcatttgctcatttaaaaataaataaataacagaatattttggaaaatgggactggagtaacacttgcattgatggatttacacagttttggaagttagtcaacagagaagacgaaaagaacaataatcaaaaaaattgcaaattcgtagaatcctaaaaatatcgtcagcatcaaatctacaccgcaattaaaataaaaggaaacaaatattaaagaaacattaaatagttttctctccattgatatgtttccgtatatagaagaaatctctttgactcgccggaaaacaaaaccccgttgttctccgtctatctctccctctctctctctgcacatttcttctacctttctttgagatttgagaaaacagaggaagaagatg

SEQ ID NO: 28565 - DNA, 3003 bp, Unknown
  misc_feature (1)..( 3003): 2750-1469P.txt file - cDNA_ID_2997495; gDNA_ID_2926276; Annot_ID_143563
taccaaaaatttctaaaataaatataactaatttcctaggtatatgaatgaaagagtcgattcccccacccaaaatcatcattcaaaaacaattattaaatcttttttgagtaaattgtttttaacgaatttgtggtcttccaatcgttgaaaaaattatcatatgagtagaactgtattgtcattgcactgcgattagttttttttttttttttataaacgattagtttaaattattgttgactactatactactactcttcaaggaattcgtgctccaagtggagggctcataaacataagtggaagcttcaaggctgcatgcatgcatgcaatgcaacaatgaatataatcgagcagctgacctatcattacttttttctttttttctataaacaatatttcaaaccataaatgtaactattttctaatttcctagctaggtatatactcaaaatcatcattccaaaacaattaattaaattatttttgagtaattgtttttcaacgaattatttgtggtcgtccaatagttgcaatatttaccattgcactgcgctttaaattattctttttataaactatttaatataaattattgttgactactacagaaaaattttaaatcatgaaaatagttgatttttccacatactccgaaacatactttggtttttggcatatataataaatcttttctgttattttttcatagtatgttaccaaaagaacgaaacttgggttcatgattaatccaaaaccaagtgcagaacttattttcgacttttgagttagttaccattctcaaaacaatatactttcaaaatatatatctactaaaattgatgaacaaggatacgatttagagacaagaggatctaatagtgtatggatccacggacgaaacaatcgggacgattttcgatacatattgtcacagctactgagattcaaaacaaatagtgacttaatggttaaattccaaattctgagtctctctcaacacatttacttaattaattaagttcttaattaaatggtgtccttgggtctaggaactagacgcaccaaaaaagtcataaggaaaagaagtttaaatgatttttagttcctcaataattggaaccaaagagataggatcggcttttgatcctatcttcttgattaaattattaaacccaataaaccaattattgatggaaaacaaaagaaactttaaatcactcttgcttcgtacaaatattattgtataatataatacgtattattaagtattttgttatgtatataacttcgtgtcccaactttctataagtttatcatatatatatgatgctaatcagtaatcaacttggtatgttaccaaaacaaatcaaattggtctgttacagtttttagacttggcaaccgatattgaattcagattacacgatcggaattccaaataaagtattactcacgcagccaaattattggacccaaaaaaaatcaaaagaacattcgtagactaaataaaaactaaaagcaaattatatttgaatatgatagacgaaactagctggctaatcgattctaaaaaagagaggaaatgttattatcagtcccatagattcgcggtatatcatggatacacacaagcttgggtttgagaaataactagtgtttctccaaaattatatttcctattcgagaaaaataaaatcatgtatcaaatcatgaaacaaatcatttgataatcctgtaaaactgatcatgtattagcacgaaaataaagaattagaaagcatagcgtagtcaccttcttaatttgacttgtacgttagaacttagaaacacgcggattttaattaaaaaagtagttaggagaagaaacacaattaattaattttaaaagcaaatatatataattaaaacaaatgaaatatattgcaaaatagcttttaatgatcgaaaagagccagagagactttgctataaaaacccctcctctgcctctctcaatccctcccccacaccttctctttctcttagcatactctgctcttcctctctctgttgttctctgttccaaaggctttgaggtaaataaagaaaactactagtcttctttttcaacgcctttccgtttccttgttctgtttatcaacatttcgtcggttctatgttttccttacgaacttcatgccgtttggattcttgcgtcttagattttttcttttggtccaccattttcaccgtgaacatcgtcgtcaattcactaattttacgtacatttatctaaatttatttgtgatagttttttatttttatttttatagttaaacttgatttcgttaaaactatttttttttggaggcttgttacttaaaaatagaactattaccaagttgaaatatttctcatgccaaacattgaaccggatccataaccgatcagagctaaggttttttaaattaaataaaaattaagtcaaacgggtcaaataatggtcataactcggttaataccggtttaattttgaatactccttcagtaatacaaccattttacaaccttctatttttgagagaccaattcatcattgtagtgacatagtacacaattaaatttttgttgtccatacacgtgttatatgcatacaagatacatacgtacgtatataaattcgtatatgattcatcttttgtctgtacatgcatgattgcatgtagtactaaaaattattaggagccaattagtggttgaaattcgctgaatctctcagttcacgtttaacaaaaatcttatccccagtttttttgggacatagcaactttgtgtccattcattacacgaaactatttctgtttttttttttacaaatctaatctgaaaacaaaaaacaaatcggtccttattatccatgcaaaatctctgtgaaatatcagaactaaaaccctaaaaaagaaacacaaatatttaagattttcttccctgatccaatcaattgtttcagaaaaaatg

SEQ ID NO: 28566 - DNA, 3003 bp, Unknown; identical to SEQ ID NO: 28565
  misc_feature (1)..( 3003): 2750-1469P.txt file - cDNA_ID_2997495; gDNA_ID_2926276; Annot_ID_205339

SEQ ID NO: 28567 - DNA, 3003 bp, Unknown
  misc_feature (1)..( 3003): 2750-1469P.txt file - cDNA_ID_2997499; gDNA_ID_2926276; Annot_ID_143564
atagaactattaccaagttgaaatatttctcatgccaaacattgaaccggatccataaccgatcagagctaaggttttttaaattaaataaaaattaagtcaaacgggtcaaataatggtcataactcggttaataccggtttaattttgaatactccttcagtaatacaaccattttacaaccttctatttttgagagaccaattcatcattgtagtgacatagtacacaattaaatttttgttgtccatacacgtgttatatgcatacaagatacatacgtacgtatataaattcgtatatgattcatcttttgtctgtacatgcatgattgcatgtagtactaaaaattattaggagccaattagtggttgaaattcgctgaatctctcagttcacgtttaacaaaaatcttatccccagtttttttgggacatagcaactttgtgtccattcattacacgaaactatttctgtttttttttttacaaatctaatctgaaaacaaaaaacaaatcggtccttattatccatgcaaaatctctgtgaaatatcagaactaaaaccctaaaaaagaaacacaaatatttaagattttcttccctgatccaatcaattgtttcagaaaaaatggagttcgagaaccggtacggacttgcaacgtcgcagaagtacgactgtctcttgttcggtacgcacctaaccggaataaaccaattacttttgattaatttacacgaatattttcttgaccggtttggtaaatttctctttagatttggacgatactctttatcctcttagctccggaatcgcaagagaatgtgggaacaacatcaaaggtaatattttttttttcccgcaatcgattatcgattaacaattcattcttaaattggttttttgtctttccggtttaatagattacatgaccgagaaactcggtatacctaaggacaaaatcgtcgaattgtctgatcttctatacaagaactatggaacaacaatggctggtcttagggtacgtgatcaatatcatctctaaacttccattatttattcttacaaattatttttgtaacattttatcgttctctaggcgatcggatatgaatttgactacgatgagtaccacagcttcgtccacggtcgtttaccctatgacaacataaaacccgaccttgttcttcgcagcctcttgcttagcctccctctccgcaaagtcgtacgtgtcataatcacatttttatttaattaaataccatacgctatataatatagtttgaatagaaaattaatcaacattgtttattcccgtaatcagatctttaccaacgcggacagagttcacgcggccaaggcgttgaagaagttgggattagaggattgtttcgaaggaatcatatgtttcgaaacgctaaacctcatgcacacaaacgctgcgtctaacaattccgagatttttgatatcgttggacattttaaccggtctgaaccggtcggttcacttcccaaaacgcctgttgtgtgtaaaccatctgaatctgctatcgagaaagctcttgaaatcgccaatattgatcctaaccgaacggtatagcaaaccggatactttcatttttttcgtttttttaaatacatggacaacaaaactaaaatttatattatttctcatcgcagctgttctttgaggacagtgtccgaaacgtacaagctggaaaacgcgttggtctttacacggttctggtacgattatcttagtttaattaaccaaacataatcaagtttaattaaacaaaacaggatagtttaataatattgactttggagtttgttattgttgttttcaggttggtaaatcgaccaaagtcaaaggagcggattacgcgttggaaaacattcacaacatgaaagaggcgataccggagttatgggaatccgacaggaaatcgtcggatgttggatattccggcaaggtcgccgttgagacttctgttagagcttaggaggagtactgtttcgccgttgtacctaattttccaccactgtcattttcattttcttttttcaaatgacgtaatgtcatttttgttttttttttcgacttgtgtttataaaagattaataaaaaatgagaaaataatttccatctagtttgtaggagaaataaataattaaatatcctctaggtatcttctagaatcaatcaaatataataaacatactttaaaaatgcataagaaatcaacaagatctcaccatacacatttttcttttttgccacccatagatttctttataaaaaaattaaagatatatgctatatacttttcaccatatgctacaaaatgttgatacggtcgtatctaatctaatatagtaattttgttaaactaatttaaagattagatttttgttttatcgtaataagtctacaatgtgatcagttgaaatggctaagtaattttatttcaagtagttgatactaatattcttcttcaatatttgctcatgagtcatgaatcatgatggatgttgacaaaaaaaacaaagcttgtgagtctgtgacagacgacagttcaattatacagttgtttcggaatatgtacagaaccaacaaaaaaagtcaataatttcgtagtttaattatggaagcttttgataaaaaaaaaaacaaattatggaagcatgtcgtttttgtggcgacgagttcatgaaaaacgtcacgtagttagatattcaaaatgatcaattgccataaataacagttatggcccataagtaacagagatagtaagggctgggcccaaaaattcaattaagaaattagtaagagtgtcagtaatttttaccactaagaagatgacatgtgtaatcacaacgactaaccttcaaatcagacggtcatcaatgctcacaccaatcggtccgttcccatactctcctttaatggcttctgagagatatttaagtttagcaaaaaaatcctaagcttctacaatg

SEQ ID NO: 28568 - DNA, 3000 bp, Unknown
  misc_feature (1)..( 3000): 2750-1469P.txt file - cDNA_ID_2997507; gDNA_ID_2926277; Annot_ID_143566
gaacaaattaggttgcagaaactcatatccggtgaacaacctagaggaggaggcactggtattttcagaaacagccaattcagatgacactcaccaccatttattgcctcattacttgtattaatattgtaattttaattcatcggcattgttgatgagaatctggttgtcactctctttgtttgaagtttatattgttgaataaaaatgaacttttaaccttattaaattttgctcggagtcattgtccaaaaataccaagttggttaagagtccacaagaccacaagtaaagttttcgtcaactttgtttgaccaatgaccacacggataaattggtaacaaaaggaattgtgggtccaaattataataaactgaaaatggatggtgtaaaatgtaatttatctacaaaattaaactttaggataaacattggatttttgcaggaatcgccggagggagaagcaatggtgacgattctatcaactcctctctctccaagacttacatttctctgtgagttcttccctctatctctcaaaactcttattgatcttacgattcagtaagctggttccataagactagttaagtgaccaaaactgttccataaaatcttataggtgaaacaaaactgtcattatctcggagcaatcgctcggtatgttgttcattgagtgaagaaccaaaagaccaatggtaaaatttgcaatcttgagagataattttttttcctttttttggtttgattctggagataaagcttggtcttttaattgcagcttgagtcggagaagtcttgtttatgttttagttgcttcgccgtgtttgttgttaccagcgttgtcttcatctgcgaagactaaatcaaagagtccttatgatgagagacggttactagaacagaacaagaggatacagagagagaacaatgctcctgacgagtttcctaactttgttagagaaggtttaagcttttattcactgtttctttgagtattattcattcttgagtggaagaagaatatgagaacttattgtccttttgtttgtgtttatgtttttgctgatatagtgcaggttttgaggttaaggtattagcttctgataattacatcaaggctgattctggcctcatatatcgggatttcaatgttggtcaaggtgatttcccaaaagatggtcagcaggtactacttcctctatgttagattagttaaacttaggatctgaagttagatcatttatggaattggtatgctctttacttggatatatagaattgaagatatcattgagttttatggttattttgacaggtgacttttcactacattggctacaatgagtctggaaggcgaatagatagtacttacatacaaggttctcctgctagaatccgcatgggaaccaatgcacttgttccaggcaagtagaagacattaacttggctctttagtagtaggatgttaatgaagaatcttctttgacaggaaacacatattgaagatttttaatactatatggataatgatgatgcaggatttgaaatgggaattcgtgacatgaagcccggtgggcgaagaaggattataatccctccagaattgggacctccggttagtgttcttacttgttccttacaagtatacacttgtctgaactgtaaacctgactagtggtaaacttttgctgagccattccgttgaatataccatccctctatcaacaatgtttcaaatggaattactagcttgagcatgctcgtttagggacatatctaaaccaatgtagattagacttgtactgtgtaaaaactgtcttcactttggttcgatcatatttttgacaaaacaaagttcattgggctctaaccaggtgggaccttcgaccttcttcagctcgaagcaatttgaagttttcgacgtggagttgctcagtatccagaattgtgagaggaggactataataggtttctactcagatgtcacatgcagttaacttccaaatgatggtcatcactaagcttcaatgaacctgcattcttcaatcttcaatactctaaatctgcacggcagatgagaactacaaagaaacaaaaagaacaattattctttgcttaggcatttatcttgtgggtttcatgtagagatgcacaattacatagagagacagataaagatcatgtaaagtctcgacctttttcataatcgtagtttacttttgttgctttgttgatcacgttttaagcgtttggagctttttgatatcttctgtctctctgtatctgtgcgtttgtcaagttaaagcaatgcattgtttcgttagttttataatttctaccccaaattttggcactctttatgaaacaccccaaacaaataataaattgtacaaagatacattgaaatttggaacggtagatgtgcaatgctcatcacatttggaaagttaattacgaaattttcatctaaagacgttaagacattttatgtgtggaaactataatttgcaagtaaagcaactaaaacgataaaaagggtaaatgagtaattgcgacgtatccactaaacccttagtctcagctagaaggttcggtttgagttttctttatccccaaaaaaccctaaactcttcttctcgccgacttctctactcctttccagaaaccaagtttcaggtcatcggtgaaatttgttgtgttcccggcgacttctacttttcacctttcttctcggcgtcgtctaatttctagggttcccctgtatttcacgtgagaatctttggcttctttttttctttcgtttcgtctgttcgaatgcatagttaggtttagacttgagaatgttgcattgttggattagattcatacttcagattagggtttcagtttcaattcgttaagttgatgagctcgagtagcttaagatcatctttaagctctcttaattctaaacagttttgtgactgaaattgcagcgtcaagagcaaatccaacatg

SEQ ID NO: 28569 - DNA, 3000 bp, Unknown; identical to SEQ ID NO: 28568
  misc_feature (1)..( 3000): 2750-1469P.txt file - cDNA_ID_2997507; gDNA_ID_2926277; Annot_ID_205361

SEQ ID NO: 28570 - DNA, 3000 bp, Unknown
  misc_feature (1)..( 3000): 2750-1469P.txt file - cDNA_ID_2997511; gDNA_ID_2926277; Annot_ID_143567
ttccattctcactctttctctctcaatggttagatctgtcttttacgtcgcttcgaagtcttctttcttcccttcacatacccaacgaatcctctcaaatccctaattatccaatttcacactcgagatctcgaattggagtctctcatcatcaccaatggcgtctccaaatccctacaccaagcgccgctctccgccgaatgtcgttgtaccgccacagcctcggtataaatccataggaggaggaggatttttctgtaagtctgttctattcgctctttttctcctcgccttgccgttgttcccttctcaagctcctgatttcgtcggtgagactgtgctcactaagttctgggaactgattcatctcctattcgtcggcattgctgttgcttatggtttgtttagccgtaggaatgttgaatccgctgttgatttaaggatgactcgtgtagatgagtcttctttgtcttatgtatctagaatcttccaggtttcttctgtttttgacgaagagtttgatgataattcttgtgagtttgttgatgtgaggagtgatgagagtgtgagtgctcgagcttctgtggttgggaaatctgagtcttttgttgttgaaagcggcgaattggaagaatcgtctgaatttggtgaaactaatgaagtccgagcttggaattcgcagtatttccagggtaagtctaaggttgtggttgctcgacctgcttatggtcttgatggtcacgttgtgcatcagccattaggcttgcctattaggaggttaaggtcatctttgagagataatgctgctcttcaagacaaatcttttgctgatagctgtgatggagctgttaatgcggaagctgagtcattattggctgataatttttttgatgaggtcttggctgctccggcttcacctgttccatggcaagctagacctgaaatgatgggaatcggtgacaactatccttcaaatttccagcctatatctgtggatgaaacccttaaatcgatatcttctcggtctactggttcttcttcatctcaaactagttatgcatcccagaatcagaacagattctctccttctcgatctgtttccgcagagtcactaaactcaaatgtggaagagttggtcaaggagaagagtcgccagagttcatcacggtctagttcgccatccttgcccccatcaccttcactgtctccatctccaccatcgccagaattagtgcccaatgatactcgcagacgttcgccagaattagtaaccgatgatactcccaggcgtgcgtcacattctcggcattatagtgatggttccttgttagaggaagatgtaaggcgggggtttgaaaatgagttggaggggagtaaagtcagaggcagaaaagcagaattcttcagtaagaaggaacggggatctaaatcacttaatttggcagctgaaagttcccggagagggaacaagtctcgcagatcctatcctcctgagtctatctcatctcccgttggtggtgctgatgactccacaactagaagacaagatcttcagcaaaagagtaattgtcatttgcttgaagaaaatatcaggaaaggagtggaagctgaccataacaatctgagggtcaaaaagggaaggagtcacgactctttggagctaacagcagaagattctgcaaaagatgagaaggtcagtgaatcttttcctgctcttgatgtagtgttccaaccaacaaatgctaaagcttcaaggcgcgccatgcgttcttcacgagggggacgtgacactttgccggagaaggatgttgtcaccagaaaattagaggatgacactgtggattcggataagtccaggaaaaaggaccttcctggtaaagacaaggaaatgaaattagacggtccaagaattgaaccacgttcttggagagcttccagtaatgtatcactgagaggaaagtccgtgaggaccataagatctgatcgtcatgggaaagatgtaaagacagatggagattcatctgaggatcgggcagaagctaaagtagaaagccgaggaagaacgaaatcgagaagaccacgacaagaagaactatcgattgtactacaccaggagaaaagttcagaaactcgcgctaaatccgagccagaagaggttgctatggaagagccccaggccgagcagcaacctgaagtaactttcgaagaggaggaagaagctgcttgggaaagccaaagcaatgcaagccatgatcataatgaggttgatagaaaagccggtgagttcatagccaaattccgagaacaaattaggttgcagaaactcatatccggtgaacaacctagaggaggaggcactggtattttcagaaacagccaattcagatgacactcaccaccatttattgcctcattacttgtattaatattgtaattttaattcatcggcattgttgatgagaatctggttgtcactctctttgtttgaagtttatattgttgaataaaaatgaacttttaaccttattaaattttgctcggagtcattgtccaaaaataccaagttggttaagagtccacaagaccacaagtaaagttttcgtcaactttgtttgaccaatgaccacacggataaattggtaacaaaaggaattgtgggtccaaattataataaactgaaaatggatggtgtaaaatgtaatttatctacaaaattaaactttaggataaacattggatttttgcaggaatcgccggagggagaagcaatggtgacgattctatcaactcctctctctccaagacttacatttctctgtgagttcttccctctatctctcaaaactcttattgatcttacgattcagtaagctggttccataagactagttaagtgaccaaaactgttccataaaatcttataggtgaaacaaaactgtcattatctcggagcaatcgctcggtatgttgttcattgagtgaagaaccaaaagaccaatg

SEQ ID NO: 28571 - DNA, 3003 bp, Unknown
  misc_feature (1)..( 3003): 2750-1469P.txt file - cDNA_ID_2997517; gDNA_ID_2926277; Annot_ID_143572
tcttttttttggttaacactttggtttggggtttctatcagcaataacataactgccgctcttcattctctctcatttctttcgctctacattggctctgtgttttttgaattatctattgatttccattagggttttctcacttctttgatcgattgaattatatatgttccgtcaatccatggcgtttcctccaccgatccatggttccgatgcaccgccgccgccacagccgccgtcggtggtgaacgggattgaaacctctagacggcagcagcaacagattgcagcagcttcttcttcgctggtgaaatctcatccgcttcataacttccctttgtctgatctcagatgggctatgaatcacgccaatacacaccggctccgcaaagcatcgagtagatctccgcttcgtgaagctaatactgggaaaggaaatctggtgattgaggaggtgaacgaagcttcaggttcttcgtttgaattgagaccggagaagaagaagggaaacgcgtctggtgttagcgattccgccgcagatagatccgcgacgaagtcaacgacgccggacggtagatcgaagatctttatacggatccgcacgaagaacaacgaagaaacagctgtatcgactgatatcgccacctccgtcgccgcctctgttcaagtgactgatgattcagctggtccggcgatcgatgctgaaggtgaacggatctccgatggtggtggtcaggaagcagacgagtttggaccgaagacttggaatctgaggccgaggagaccaccgccgacgaagaagcggtcaattggacacggcggtggggtattgaagagctgtaacggtgctttaccggagaataaatctctgggaacggtaagaacagagtcaatacgatcgaggaacggtgtagatgctaagatggcgacgacggaaagaaaggagaagaaaccgaggttatcgatatcgctctcaaagctggagatagatgaagatatctacgcgttgactggatcaaaacctagtagaagaccaaagaagagagccaagaacgtgcagaagcagctcgatgtaagattttcacgttgaatcagaatcttacctttgttttactcaaacctgacctaacaatattggcttgaattgttgtatgatcgtttttcaggttcttttccctggtttgtggatgggtaacgtttcttcagaagcatataaggtctcagaacatgcttgaaaggtattaacatttttgatgaatccgattggattacttcttcctgtttactgttgtatagtctgtgattgaggaaataatgtaattgtttctgaatcttgtagggttgaatgagaatgatgtgaagttaatcttgttgaatcggattcgactgaaatcagataggagcgtcgaagaagcttcttccattgattgaggtataaaaggtagtgattcaatgttgtttgtcatttttgagttagactttctccttggtgttatcccttattggttctttgcagtgcaacaaaatattgtagattcatgaatgaaaatgttaaattgatttccctgaagaagagttttagatttgcttgcttggacgatatgtgatgtggctaatatttggtgttcttagatttccgatagttagggacatatcattccttaaggttaaagttcctatcttaatgttaatgatttgcgtcttaaccttacatattttaaaatcctgatttggtgtagagtgaggatgtgaactctgaagttgctatgatttcgaggtctagacttagataaaatggactcactttgtataataaaccttcactttctcatgtctctatctgtactgtgatgatgcagaactgcgaatgattcgtttcttcaagttttggcttcattactggctcgtcggtttcaagagccgaattcaacttcaacttcagatacggtcttaagtcctaactgtcggcagtataaaatgtgaatcaaactagttttctgatccagtcgtcttatttgttaccactgatgtgaggtgttgatacggcctctatttttttttttctgtttaattcattcactttgtgtaataagattagtgggatagcctgactttttgtaaaggtggaaaaataaaatcagaattatcaacataatttatttattccattactaaatttcataaattaaatcattctagttttcattaataaatagagcaaaaaagacggataatttggtcaaacatgtaacagaagaaaatataattacctgcaaatttgatagcgtttttacaaattgttattttaaccccacttccaagttcaaagttcaaactctgatccagtaaattaaagaatataatctggactttaacggtcaatattataatttggactttatacaaggaccacaggcttgatgtgtcactctattcatcatcaattcatcacctccactcgctttgtcccttggtttatccaactcttcatgcactatccgtacacagtaaaaccaaaaaattacggattaataacaaattttgattgtttggacctctatccattttgtatttttggactacttattagtacttaattatttacattagtatattttacatattggtccttttatgtattatgtatcatgcattaattacatattgtagaaagagatttgtactaactagttgacctaaaagaaagaagaagaagagagagtcgtctatatcgagtggttttggtattaattcttatcacgttggatttatatagatgtaaacttcgtagtaataacaatgatgagtcgtgttttaaaagaattttgttactttcttgtgtgataagcttcctcgcaatttcctactgaggaaaagaaatgcaattttaacttccttcaaaagtttatagtaaaaaaaacaaaactcaacatctcattgcttgcatatatgtataaatacctcccacttctagtaacaaagatcacaccgagaaaggcaatg

SEQ ID NO: 28572 - DNA, 3003 bp, Unknown
  misc_feature (1)..( 3003): 2750-1469P.txt file - cDNA_ID_2997521; gDNA_ID_2926277; Annot_ID_143573
ttaaagttcctatcttaatgttaatgatttgcgtcttaaccttacatattttaaaatcctgatttggtgtagagtgaggatgtgaactctgaagttgctatgatttcgaggtctagacttagataaaatggactcactttgtataataaaccttcactttctcatgtctctatctgtactgtgatgatgcagaactgcgaatgattcgtttcttcaagttttggcttcattactggctcgtcggtttcaagagccgaattcaacttcaacttcagatacggtcttaagtcctaactgtcggcagtataaaatgtgaatcaaactagttttctgatccagtcgtcttatttgttaccactgatgtgaggtgttgatacggcctctatttttttttttctgtttaattcattcactttgtgtaataagattagtgggatagcctgactttttgtaaaggtggaaaaataaaatcagaattatcaacataatttatttattccattactaaatttcataaattaaatcattctagttttcattaataaatagagcaaaaaagacggataatttggtcaaacatgtaacagaagaaaatataattacctgcaaatttgatagcgtttttacaaattgttattttaaccccacttccaagttcaaagttcaaactctgatccagtaaattaaagaatataatctggactttaacggtcaatattataatttggactttatacaaggaccacaggcttgatgtgtcactctattcatcatcaattcatcacctccactcgctttgtcccttggtttatccaactcttcatgcactatccgtacacagtaaaaccaaaaaattacggattaataacaaattttgattgtttggacctctatccattttgtatttttggactacttattagtacttaattatttacattagtatattttacatattggtccttttatgtattatgtatcatgcattaattacatattgtagaaagagatttgtactaactagttgacctaaaagaaagaagaagaagagagagtcgtctatatcgagtggttttggtattaattcttatcacgttggatttatatagatgtaaacttcgtagtaataacaatgatgagtcgtgttttaaaagaattttgttactttcttgtgtgataagcttcctcgcaatttcctactgaggaaaagaaatgcaattttaacttccttcaaaagtttatagtaaaaaaaacaaaactcaacatctcattgcttgcatatatgtataaatacctcccacttctagtaacaaagatcacaccgagaaaggcaatggagtcggctaaatcaatcatcggtggccaccaaaatgtcatcctgatgcgtcatggtgatcgactcgacaatttcgagccactctggacttcaacagctgcgagaccgtgggatccaccgcttgctcaagacggtaaggatcgggcctttagaactggtcagagaatccggtctcaacttggggttccgattcaccgtgtcttcgtctcccctttcctccgctgcatccagaccgcttccgaagtcgttgccgccctctcagccgtcgatttcgatcccattgctatgtcatctaaagacgtgctttccatcgacaatactaagatcaaggtcagtcagaatatctctctatatattttttgagaccagggtttgtagtctagtggttttatgctagtgttggtccgtgtcatacatacgttataaaaaaaaaaaacatatattgtggactatggaaatttttaatgattctctaagcaaaattctgttatgttgttcttataaccatgctgatcattttgattgaagcatttgagatgttttatgcttatatatgtcttgtctcgtctgctttaggtggctattgaatttggattgtccgagataccgcacccaatctttattaagagtgaagttgctcccaaagatgggaaatttgatttcaagatttcagatcttgaagctatgtttcctgaaggaacagtggattctaatgtggatatggtttataaagaggtgctctatatgacttgttttgtcgtgtcttcgttcttaatgttttgttttgtgtgactatatctaaactttatttcgataattctcgattccttgtttgtactgtttaggtgccagaatggggagaatctgcacaagcctttgaggatcgatattataagacagtgaagattcttgcggagaagtatccttctgagaacttgctcttagtcactcattgtaagcaaaacagttatggcttttttagtttttaaccaaaattgatgttttcctaatcttgtagttcgtttttttttttgggatgggaaattgcagggggagcagtaagtgttgcattttacaactacttcaaagacgcaactaagtacgtggtagattattgtggtagtgttgaaatgagaaggcagattttgaatggtgatgggtttggtaaatttgaggtagttactagtcatggagtatcttataagtacaccaaaatcccagtccatgatcatgtagttgtaagccgccaatctcccctttaaccggtttatatgtgaatatctggtttaacgggttgcttcaataaaaaaaaatatataagaataatggttcagttattttccttttcttccacaaattttacaaaaatatgtaaagctaaagggttgtaatttttctaacacaaaattgttgttcaacaagaatttgtcagaacgtatttaaattaccattgctataagcaagagaacagtcttagcaaactgctgaaacgacaaaaaaaattgttctttagtattcaaaaaaaaactttgaactatacgtagtcttcctcatgtctgatgcctattgacgagtttattacaatagtaaaaaacaaatgaaaatacaataaaaagtcaatggtcttcttaattgcatgtaatatactatacttgcatcacgccatg

SEQ ID NO: 28573 - DNA, 3003 bp, Unknown
  misc_feature (1)..( 3003): 2750-1469P.txt file - cDNA_ID_2997525; gDNA_ID_2926277; Annot_ID_143575
cttgatacagctgcgagaccttgggatcctcctctcgttcaagacggtatggttcgtgcgtttcaaactggtcaacggattcgatctcagatccaatttccgattcaccgtgtcttcgtctctccttttatccgatgtatacagactgcttccgaagtcatcgctgctctctccgccgtcgatttcgatcctaacgctacttcgtccaaagacgtcacttcaatcgataaatataagcttaaggtcagataatcgctgtaatcgccttcgattttgaaatcttttggtgttccatgtgtatctgtgaatctctgttgattgaattctagtttaagaatgttgagctgaattgttgttgaatgtgtgatattaatcatttaaggttgattattgtatacttctcaggtttccattgaatttggtttgagtgagatgctgaattcaattgctattaagcctgagattgctcccaaagatgggaaattcgatttcatgatttcagaacttgaagcgatttttcctgatggaatggttgatcatagtgtagatcctgtttataaagaggtgaggttttggaattttgtagtatctagacttgtcttgttctgtttctgtttatcttctaatcttcgaagcaatttgagtttaaacttgattctcttgttggcattgtttagatgccacaatgggaagagactgtggaaggctgcacagatagatttcttagtttgataaagactcttgctgataagtatccttcagagaacttgctcttggtcactcacggtaaacaaacacattatgttcttaagtctttttggatcttttacacattctttctgctttgtttctctggagagaacatcttcttctaaggttttattaaagcaaagagtctatgaatagtcccttttatcgatcaaattttgtgtttgaatgtctctttgttgagaaaatgcaggggaaggagtaaggactacatttgcaacctttaaaggcgtacatgtgtacgacgtagagtattgtggttgtgctgaattgagaagacaggtgtcgagtaaagatgggtctactaaagctggagactttgaggtgatcacaagtcttagtcaatgtggaatcaagtaccattccttgagcaccacagaccaaacttctgcttaagtcaatgatgttccggatgatcatggcactagtaaaccggaatcaaaccggatactggttatctagaaacaattctgtagaagatgagaaccttgccggaatactacaatagtaatgtgttgcttccgacagattggagatacggtttcgaagagagaacttctttttaagtgttgtaccggcggttgaaaatgattttgttgtttattattgattctaaacgtaattttgggcagatactattgattaaactgattttgcgtttttatttttacaatgtcatgtgttttgatgtcttcttacttactctgtctccgactaaccaaaagctgtaaacaagaccggctcttcaacaggaaacataaccaccaagtaggttgagtctcatttaagaacaagccatatgccactccttgcactgcaaaaagtcttttcctttttgcttcttctctgcaaaaaaattgttttggagtgcaagtaccaccaaaaacttcgtactagaccatcatcagctactggaatcaaagcaacgatagagtttgagtaaccaaatctgtttgggagtaccagaggttaaatatgatcattatgatgctctctgcggaagatgcagccagtcccaacgtccattggaccttgaagtctatccaaagctctcatactaacatgaaagaagacagtcttgtggttagtatacttttgtggagcggatcataaaatccatctatgattcttcgaagccctttatataagtagctctttcgtacgtgcatattgtaagcatcagcagagaacccaagcaatgagttgattcttcacctctcccgagatgccaaaaacagagtaaacactcaacatgtggttaagagtatatttgtaactggttgttatggtcagagtaaacaaacaacgatggatagtatatttggaactggttgggatatagttaattttttaacacctaacaactacccatcgttgtttgaccataagaaattccgaataaaagataaatttaaggttaaatatgctatatatataaccggtcgactatatcaacaaagatgttatttgatgaagaagtcactagcgtggggtaattttcaactacctcctccattaaggaatggttcgacttatatttatacatttacatgataccgacttattaacatccaaactgtatatcatcccacctattttatttcagactttttgatataaaggatcataatcataagccttgtttcgtcacgtcattcatcatccattccacccatcttcctaaaacaccaaaaagtatattatcttgtaggaatgtaagactagtcgttaatacgatgtcgactgtccacattaatgtaaccccatcgatggagacaaatcaaattactagtttccaagtcatattgaatattaatatgaagttaaaaaacatgtttgtagccttatgtaaattatatcctttttttgtttagttacgtaacacaattgcataacaacaaccacaaacaaaaggttatagcttttttaatgcaaaccaatcaaaaatctttgcaattttctaatgctaaaagtatgaaaaatcgcagttgatattaaaaacaatttaggggatttctcaacaatttacaagttaaatttgttaataataaaacgacttgactttaccatatatctttttcttttttaaattagaaacttttaagaagaagaatacaaaagaagtagtggcactttatgacattttccacaaaggttaaaaaaatcacattcctttataaacaacgatccattagtgtcggaaaacgaaagagaaagaagaagaaagaaacaatg

SEQ ID NO: 28574 - DNA, 3003 bp, Unknown; identical to SEQ ID NO: 28573
  misc_feature (1)..( 3003): 2750-1469P.txt file - cDNA_ID_2997525; gDNA_ID_2926277; Annot_ID_205369

SEQ ID NO: 28575 - DNA, 3003 bp, Unknown
  misc_feature (1)..( 3003): 2750-1469P.txt file - cDNA_ID_2997535; gDNA_ID_2926277; Annot_ID_143587
caacttctgaaacgaaataaaaactgagagaaattctgacttgttgtgcaaaggatagaaccaagagtatcttgaataatcatcaacaaaaatagcataatatttgaggccttggttggatacaactggagaaggaccccataaatcacaatgaatccgatctagaggatgtaaaacacgagaatctgaaattaaaaatggtagtcttgaacttttccccatctggcaaggttcacaaactggagatgttctgctcttatttatctgaatcgccttgctgttttgaaggtgctggagagccttagaatttgcgtgtccaagtcggtgatgccatacttcctctgttgctgcacactgacggtttgaataaagagccacaaactcttgattctccaacacatagagcccatttctacgaggacccgtggttaccactttctgtgtttgtaaatcgattatgcaaaccttattagcatcaaagtaaacaccgcaaggatagtcatcacacaactttgacacagagagaagagatttttgtatatttggaacaaccaagacttcatttaaaggaatcttaccatttgaggatttgatagtggtagatccagtgtgagtaatcgggagataagtgccatcgccaaccaagacagcatcatccccttcgtactctgttgcagactgaagtccattggtcgatgatgttacatgagccgtcgcagctgagtcgggatgccattccttgcctgtatcatctgagacccggagagtagaaaaagcttgtatttcagcctggtaattgttatcaaaccgattgtaacacttgagagcagtgtgaccagtgcgaccacatatctgacacaccggtcttggacctgaaacttgtggggaggattgatgttgggaaaaccctcgtccacgagttgagtagcctcctctgcctttattttgaccagaacgtcctcttcctttttgattggggttgtattgaggagatccagactcagatctttcaatgttgaaggcaaggtgaggagtaacagatgccgcttcttcatatgattgtagcttactgtcaaagccttgaacttctgagacaacatcattgaaagttggagtcggaagcttgctgagagagctttgaatcaccgtggtgatggggtcatagtcacgaccaagaccgttaagaaaaccaaaaattttcattgattcatcgactggcttgccaatggagctgagagcgtcgcagatggtcttgaactctcggcagtagacagagaaaggcttttcctttttggagagaagctggagattccgacgaagtgagaactcacgagcaacactgcttttgttgaagttttcagctagagacacccaaatttgacgagaggtgcttagattgtgaacatgaccgaactaactgatcggtacagaaccaagattcatacagaggattgggttcctcggaggtgacttcgccattgacgacaaggcgagactgagatggtgcattgacggcgccattaacaaaacctatgagtttttgactcgataggagagactcgaattgagttttccacaagaggtagttactgtctgtgagtttgagagtaacagaacttgtaacatgaacattatctggaaaagggtatgaggtcgccatttgaaatacctgttaaggctacaaaggctctgataccatgaaacgattagagaaagtttcaagcttttggtaaaaaatcgtttctttctcaataattacattagggttttacactactcttttatagacattgtagaaggaggtagatatggaacagtctagaatatggcagatgctgtgtagctggctatggtgagtcatcaggcaaaacgcccctcctctgtacgatcgttgctctgttttgagctggagtctattttgtcttcttctatttgactgggctgagatgggccttttgttgttgttgggccggttacttgtttgttgcttacactatacgttttatgagttaaggcttgaattcccatcttatgatgttgtatatatgaagaatttgccaaattcagcttccatatagccacacatcaaccaagcctgatgtcataagaaactattaaaacattgaaaatatgacaacttcattataatttctaacaccttacattagtcatatttagattaagaagtgtttggttagaacttagaatccctaacttcttgtatatattctgacaagttttttacattcatatgtaataccccgtaactttttcttttgagtataatttaaaatcatattcaaaaacataaaaaagaagtgtttggttgtttgtagtgatggtgttttgcatagtcggaggattgtacatgacaacgactgtgtgcttggtttgagaaagaaaattttaggtttagagatcgagttcctttgataccacccgatgatatgaatgtttatgtaattgataatctttattgtatagcaagatgacagagagtagctagagtattgtagagaagttaattacaatattatactttacataaaagagagagtaagaagaatacataattaggagacatgattgatcaaatcatttactctaattgatccttaatattacgttacatatataatccaaaataagtaatatagaatttagaaagtgaatataagaaactaatcaaaattaacctttgtttgaacggtagcggttttagttatagtttttggtttctaaaaagaaaaagaaaaacaatcatagtttccaataagctttttaaagttttttatttcctcaaatctaggataactataagtcttaaaaaaaaaaaaaaacaactagaagtctataattgtctttttagtagaaacctaaagctatttcagtttgttaaattctaacaaccagaaactaattaaaaccttgaaagctaaaaacaaaaatatatatataagctctaaaaaatctctacccattcaagattctaaatcaaacatg

SEQ ID NO: 28576 - DNA, 3000 bp, Unknown
  misc_feature (1)..( 3000): 2750-1469P.txt file - cDNA_ID_2997543; gDNA_ID_2926278; Annot_ID_143591
aaatagagctaagactaactaattcgaaaagcgttcttaagttcactatgaaatgtttacatcaacaaaaaagctctaagatcctaaattttctgatgtgaagcaagagaagaagacaaattaaagaccaattagcagctatctcacacttctgaatatttcgataagcagatcagattctgaacgactatagtgaagatcaattgtaccttaagattgggagctcgagaggcaaggtactcagtgacggagaaaagcaattagaggaagaagagaaggtgagctagggttttcttatcgctttttatactagggaaaatcaaagaaaccaattgacatgtgttatgcgctgcgtctcaagcttcatttcaggcccaatggcgttctttgtcacgaccattgaagcctatcaaagctataacttgaacctgtaaaaatgaatgaatgatgtttctctcagccgtcagatctaatttgagcattgataaatttaacgaatgagaaatatacacgtcaatgatcctcgtgaagatttctatccaatagaatacgtttgttccttctctataaaatctaaaagcgtcgagtaaacctattatcaccattcaccactaaactacttcaatcaacttccttttcccgagaaaatcagaaagaaaattcacgatggcaccaagagccgagaagaagcccgccgagaaaaaaaccgccgctgagaaaccggtggaagagaacaaggctgctgaaaaggctccggcggagaagaaacccaaggcggggaagaaattgccaccaaaggaagccggtgacaagaagaagaagcgatctaagaaaaacgtcgaaacctacaagatctacatcttcaaggttctgaagcaggttcatccagatatcggaatttcaagcaaagccatggggattatgaacagtttcatcaacgacatattcgagaagctagctcaggaatcttcgaaactcgctaggtacaacaagaagccgaccattacatctcgcgagatccagacggctgtgagactcgtcctccccggtgaactcgctaaacacgccgtctctgaaggtaccaaggcggttaccaagtttactagctcttgaagagacccggttagggtttttagggatttcaatttcggtttggtttttagtacttgtaggaaattagatgcattattcgcttaacttcgtattttgtggctttgtaactctaggaagtagagaagattgttccttccttttatgaatttcaatgttggattatatatttttaacgatttttttttccatttcaatttcatttacctaatcactatattgaaatgtgtctctattgaagtatatgttatatgtgtgtgtttatattatttgatacgcgaaattggcctacttttccttcaatgatgttgctttcttaccttcttataacgaacagagtctaattatgatatgattggagtcattgaaatagataaaattgaagattagtagttgaattacctatcgttatcgttgtgccacaagcaggctataagcatcagatttaggtgaacccgcttaattttaatgaatagtttttggtgaacaacataaagcataaatcactccataatcatataatatagtttatgttctcctcctatatctgaattatggaggaacgagtctgaaatttcttaacaaccaactaatacagccgtcgattaaacaaaaattgatattgctgaaaacgtgggagtgtcaaaggggaaggagacgacccggaagggcaaaagaagaagagaagagttcaaagggaagggtaaattcgtaattaacaactctctgtgtgtgtgtatgggaaagaagagtagttagttaaacgtgcaaagaagcagcctttccattttcatttccgtttccaaacacataaaccgcaccaatcaaacaagctctggtttttgctcatcgatctcacaatcttttcgtttcctcgcaaaccaacacctaatttcttttgatccacgctaaaacaatccccatttcttctgatcaagatgtatcaccgtcttccatcgctaatggagccgtttctacggagtgtctctgaccgttggccggtcatcgctcaggctgccacgtggacggtgcttctaatgttcacggtggccgtcgcttcgtttgctccggagatggcttttgtgtctacggtgtcgtcttcgtgcggaggaggagatggtttcgtgaagattccgatggattttgcaggggagagtatatgcgtgccgtctaatatggtgaagagatcgcgttttgatttgtttgtgccttcgattttcgcggcggttatggtcactgcttcggcttgtttgatccgatcatgtattggcacggagaatgtggatgatttttaataaacacttgtaaattaattaataatcttgtattcagttactacataacatccaccattttgttattccaaatcacgacattatattaagctgcgtcgtagaatagttgacatttgtcagttttaacccaacaatttgatctgttatgttatccacgacccaaaatcacaactaaacaatttgacattccgttttgccatcgtccggttttaaatcaccatcaaattagtaaataacaaacttaaatatttattttgaatatttgatcaattatctatttttatgaattattgatcaagaaacaaaatttaaagaacatcggggacttgaaaaagtaatggaaatttcacaaaaccgaaaagcaaacggttaattcggttttacaaagaccaaacagaaaattcaataattcggtttggttcggtttaattacacctaacaaaaaagttgatacattcgtttttatttttccgccattcttgtcgatcttcttcagtcgtaaaaccgccgcgtctctgctgaccctcctcttctcatttcatcgacgggagaaaatctcataccatctaagatttccaacagtgaaattaagatg

SEQ ID NO: 28577 - DNA, 1099 bp, Unknown
  misc_feature (1)..( 1099): 2750-1469P.txt file - cDNA_ID_2997555; gDNA_ID_2926280; Annot_ID_143597
atcttctaaagaacacttcatgtctcagaaaaaagtatgagaggcttgagaatagtagggaaacgaattaggtttttttttttttttttttaaagtaatgttaaattagatttaaaagaaaattgcgtttttacaacgagtgcaacttataatttatacgagagagattgaaaacaggaagtagaaagagtaagctttgcgattaacttcgactttgaagccatcgttggaaggtggcctcatatcgatggtccttgtggcgttgaatggtggtgattctgttgcgcatttgtttgtcgatccattgaataagaatgagagcagattttggagcttcattatgacgtcttcgattcctctcatgccagatggtataaacggaggtttggaagatgtatttcaccaagaaacaagttaccttatccttgcgatgggctgagactaggttgagcagttggtgcctatcacttgtgtagtgatgctgaagcaatcctcgagcaagcgcttcccaaattccagctgtatagctgcaagaaaaaaagagatgatctctggactccaggcagttcgtacagaagtaacaatctcccactgcatctttgttccatttttgcatacggtcaccggtagcaagtcgatcatgagctgccaaccaaaccgagaaggagtgtttcggcgtttcatgtgtaaaccatacacctctatgccaagccactgtgttcgaggtagtgcgaatatgattccaagtatctttagtagagaacttttctttgttcgagttttttttttttaatcttctactgtatttgtgaagagcataaaggaacagaagcaatcatgacttctacggaactcgaagagttttatcgagtggaacaaaagattgaaagaacgtcgaatcgataataatgactaacgtaaattattattattttatttaacacaaaattgaatttaaaattaaatagtgattacgtcaccgttgtggcgactcatcaccgtcggttcgaatcagttgaactaatcttagaagtgagaacaccgttgcttccataattcccggtgaatcatttgttgttcgatttctccggcggagatg

SEQ ID NO: 28578 - DNA, 2472 bp, Unknown
  misc_feature (1)..( 2472): 2750-1469P.txt file - cDNA_ID_2997559; gDNA_ID_2926285; Annot_ID_143640
ccgaatctttcctttcgtctcctccgcacctctacgttgatacccagctgcaaactatatggtggtatgtggttattaaccattgccatgaatctaacaatattcataacatatacgcctatataacggaaactctttcttaccttcacaggttttgatagtgtattgtctttatcattgacaaaccgctgaacaagctttgatactgtttcccgaagttctttctctgtcaaaccacaagtagcttgaactgggaatatccgatggcaccagctgcatcaatgaatcataagttacttgtttcgacacaaagacatgcttacatcaagggaatctgagaagataatgaccaaaagttcctagcagagtggataaataactacatggtccaaaaagaatgaaataggtctgatatgtaacagataccactctttgggattataagacttgaaaaattattcgagactaaatcagaactctataagcatgcttatttcaaggtagagttgaattctaaggcaagtggcgataaaattctgattaatcaattgaccaaaggttcactaactagcattacaccagatagacttacattggtgccttcaaagctccagattccatagactggaagactcgtgatacgatattcgttgtattgggagagttttcaacagggaaagtaaagagaagcaagccactctttgttagcttaaccaatgacatgagagaattgtgttcttcatttgctaatttaagatcctcaacatttggattttcacctaaacaaggcacagaaagagaaaagaaagacaagaccataagccaaaaaaaaacaagaatttgaatatgctcaaatccgcaaatgaaagttacctgtttcctgcaaggcatcattctcaagaggtacagtcttctctccgccttcctctgtctcttgtgcacaaactttttgttttttggatgcagtagagtttagaacttcaggtttctcctcatgcatggacccaatatactgaacaaatcaaaagtttgatttccgtgagacaagctgaacattagagaacccccaccactgcacttataatcactttcgtttcaaatatagtgtttctctaccacaattggttatcaatcactctgagttatcttctaaatgaaggaacaaaaatccaaacttttgcctcactaatgatggagaattgtgacgatacctttccaaggatggacatgacctctttagtagcacttttctccctttctgataacaagtgaaaatcagaaatagtttaacttcaatccctcaattcgactctcgtttagtccaatacacagattccacaagtcataaactcggagacaataaaggaattcgagaaattgaaggtcatgtcgcaaaacgaaattaacacatagaaactaaaaaggatgatacaaaagagtattgtaaagaagatcatactgatgttgcaggtgacgaggaatccggaatgagaatgatgaagcagagaagagggagctttgtagtcgaatcgagggatgcttatgatgctggagtgttgctcccatggagtcaatgtttcagcttcctctcctctttctcttttttcacacacagtctcttcctctattgttcttccaacatcgtctacttcttctacagcagccatcgttactctctctacctctctgtctctctcaaagccagagttaggccaaaaaaaaaaaaaaaaaaagaaagacattgagccttatatgattcagcgattcggaaagtgcggtagcgttttaaaaccctgaaacgcgacgtttagagaacgcaacttcaaaacagctaaaccctgaagcttaccagaccagagacagaccaatagaacatcatacgaggtccaattcgatcctctcaagagtctgcgagtctgtgagggggaagagatgcagtttcttgcgcggaatctagttcggagagtatcgagaactcaggtaatgctcccaattcatgttttcttcgtaatttgcctcctccttgttgggattgttcattaccatactctgttcctgaagacttgtatatatttgaggattaaagatcgaattttttgggttccctccaagtgcatagatcttctgtaccataaagtttcatcttttgaatgggaattgactttctataaagtttgcagaaattttgagacttgatttcggagactacttcacctccgatgctaataacttgtgtttcatcaactgatactgtttctacatgtgctttaaaatctactgagagacatgttctttttaaaatggggtttcaggtcgttagtcgaaatgcatattcaacccaaacggtcagagacattggtcagccaactccagcatctcatcctcatgtaactctcatgtgctatatgttctcttggatttgcaaatgctatttatatgctcagatggttcgctcttccccatcagttaatg

SEQ ID NO: 28579 - DNA, 59 bp, Unknown
  misc_feature (1)..( 59): 2750-1469P.txt file - cDNA_ID_2997566; gDNA_ID_2926286; Annot_ID_143645
ttgaagagttaccaccaagactctttgctctacaccggtacccttccgagacgaagatg

SEQ ID NO: 28580 - DNA, 3003 bp, Unknown
  misc_feature (1)..( 3003): 2750-1469P.txt file - cDNA_ID_2997581; gDNA_ID_2926288; Annot_ID_143649
gctgatttaaacaaagcgtttacggttatgaatacggaagtttgctgaagcggacgattgtaatttcaagtgtcatgaaacattttgaaccattggtttaatggttcaaaattaaaacgtttgcaagagttatatgattggttaaccaggaggtgctattacggttaaactaaaataacaaaatattataatttataaattatacaaaatataaaataccaaaaatattatattattatgataaatgtgaaatttaaatataactaataataaaattaaattcttcctaattattcaaactaattaaattttatactcaaatatgcatttgcttcataaaaagaacatcatcaagtaatatggaaatgacaaaaaaaaaagattaggacaaattaaaaaaaatattttcaatttttgggtgttctggattaataatattattacaatacttagttagtatcttatcattcttcagtttgggttgatactatgattttgatagagaaaaaaactaacattttgtgaataaaaattaccaccatatattaaagttttgaggaagaagcttacactgaaaagatgacattgttgatgtaatgtgtaaacaagcaaaaaattattacaactaagatgtcatttttgttctttaaggtctaattaaatttatctttgaggtatggttactctcaaatctccaataatcaattcgatttttgtccctatatttttttgtttaagtgcatctattatctatttttttggttcaagagtttatttctgaactgaatgaaatcttagcataaggtaacatcgaagaaaaaggtcaatggaagaagaattttaaagaagagacattaaagatttttgagtttcttcctcaaaatattcaaggatcttatcagatttactaagtgtcattgtggattttaatcaataactaataatcatctgagtacgttttatactcccaataaaaaaatatttaattttcaaattctgaaaaacaaacaaacatagcttttacctttttatgcctcttcaacatatgaatcaagtatgcatgtggaacattaaaaatcaaagatgataactccatataacatattcttaaaaatctaaaatgactttaacctcaccagaattagcaaatggtgattttttaactcttttcatttttagtttcttaatgactcttctaaatagatgttcgtaaagcaaaaaattagcttccaaaacttataaaggctatatagatcttactaaacaaaaataaaaaaatgcattgtgtttccaatcacttttttaatgaatctttttgtctacatatatcatgaatcatgacaaataacattcaatacctacatacatcttaacaaaattatattaaaaaaaaagcccgcgacttggcgcgggttttgccctagtcactttaaaaacatgtaagagaaaaatttaaacatttactgagatatgcatgtgatgtgggagaggtgattgtggccgaagacaattatagattaaccaatgcatttaaaatcccttcataatttaattttaacttaatttcagacgacttcttctcaaaattttatcaaattcttcgaacctaccaactaaacgaaaccctaaattgtttggaattatctttcttttggattttcgtatttttttgaaatcagtatagatgataatttaatcaagttggtaaagacaattcaaatatttttaagatatagacatataaattaatgtaaatcgtttgtaaacatttaattatgataaattgtctacatgttgatagtaaagacaatttagaatattatattacttaaaacaatttttatcaagttagtaaaaaaatagtttaacatcaagttaacatatataaatcgtctttgttagttttcttatttggttaagaaaaaataaaataaaattttataagatataaggacatgtaaaattaatataaatattaataagtttaattcattttgatacatataaaatcggattgatagatttgacacgtgttacgatcatgcaactttgaaaaccatactatatataattattatatgtgatattttagatgatttcaactatgattttcttctcatgaaaatattatgataaaagtcaattttacattatcaataacaaaaattcactatattactatttaaaaaatggaaaatgcagcaaccaaataatatttatgtggttgttgaataattaaacgggaatatgtcattaaaatccccaacttattcaaaatattgatttaaatcctcaagtctcgatgcaacaaaataaatatcaaacttaaattgactttccaaataaatactcaacttttgttgattttctaaataaataccaaaagtttattgatctgacaatattaggcatgacgttatgtaggttaatagaccctgttatcagagtttattgtgttttaacagactcgttaattgaaaacgataacgttttctctaataataaaacattatctttttgtcataacgaatcaattaagtccctagtttcaaatcatatggggatttagggttagggattttgctcggtttaggggtcttagattgatttggggatttattttagtcattacaacacaacgacgtggctctgttgttggaaactataatacttcgaattaataagatttattaatttagttaacagtatttctaatatggccacaacaaaaataaagtatttatttagacagtaaacataaatttaatatttattcgttttgtcgagaattggagatttaaatcaacgttttcaatatgtcgaggatttaatgatattttttccagaattaaaccctataattggagattaatggtccaaattgattataaaataaagaaagaaaaaaaaaaactaaaccttagcaaaattgttaacttctcttcgtcttcttcttcctccgaccttggaaaatctctcgtgactcgctagtcttctctaatg

SEQ ID NO: 28581 - DNA, 3003 bp, Unknown
  misc_feature (1)..( 3003): 2750-1469P.txt file - cDNA_ID_2997593; gDNA_ID_2926288; Annot_ID_143653
acaagcaacatcactcttatcttcatcaaacggttctgtcaccttgtctatcatgttccaagctttatgaacctttagtgccctcttcatcctcatggcccataccgtgtagttgatagcgtttagcataggacattggattgaagaggatccactaacttctttcgttgttctagctgcgggaacgatatcactcatttcttcttatgattgattcaatagcctcacgctctgataccaaatctagagtttaagaaagattaagaactcaaaatataaagaattactctctttattactttaggaaaatagctcaaaacctaaagctctcaatctcacaatctctctcaaaagctcataagttataccacacattggtatctccttatataatagagattcaacattatcctaatcattagataactcctaatgaatattctagataactcctagaattacaaggaattccttttctcttaaataaataaatgacttattacttaagtcttcttcaagcttaatccaacatatattgccttcttggtgggataacatagttcaaaataccgagttattcattgttggaatgactggtagaggtgaagttgtgttgtcaccgtactgtctagtactagaaccatgttacattgattaattcaacctcgagaggaggagtttcacaagagttcaaatacaaggtcttgaagtgcttataagggtacgagagtttacacttctctagactatgctgagaatttgaaacttatgtagggttcaaatcttatttttaagcttttgtctagttttggataaaagaacaaaatatcaaaaatcttttgtatgttcatatatattttattttttttaattaatatttcattacttttctttagtatatggagtatttttatgaaacaagaattgtgagaattatgaatcttacctcttacaattcttacatatttttggattacaccaacaaaataagatattttgagctgagtgcctgtttttcttggcttttactctttttttttttttttaaacattctaggttagcttaacaaaaacaacaagcaaacaaaaccttaggatgggagttaagtcattacaaacttagcagcaacctatactctcaatactcactacaaataagccccatgattctccatcttcctcaaaccatttccacctcaagaaataaatcatcagagcctcacacatcaaacacaagtaatggcctccacggattcagtttaccgtcccacaccaactccagaccatgacactactgttgtagtagttgtgtttgtttctttgggttgtgtcatgttcttggcgtttctagcgtttgttatctggttcttgatcaagaagagatccaggaagcaccgtgagagatctgaagcggttcgcgtggatgaacactttaagatgaaggaagctatagtcgaaggacctaatggacaaaagtctgtggtgttatcagttgaggatgatgttaagatcgaagacgcgatcaagagagaagagaaagatctgaagaaagatggtggagttggatcatcagtcgtttcccgttcgtgaatgagctttcttcattcataatgttacctatctatttatttatattaaaattgtggttgtgtgtgaatcatttgtttggtgaaataaaaaaaaagcatctgaaatatttatttaaattctttggacaaagatggttcttcaaacttgggttggtgaatggtgatggtttttatgttctaggagcgaacttttatctctatctctctaagaaaagtaatctttcaaaaaaaactgtagagaaataaaatagatagttgtttttggttaaaacagataatttgtaactgtaactcgataagaatattaattaaaaaaaacatacaatgtcaaatgaaatcatacttaaaattggacatttttctatttgaaaacttggtattggtatactaacacatataccatgttaatcttctcattatagttctacttaatatttaccaaaacaaaacaaaaaaaacaattatacgtatttaattaacaaaacaaatacattaattctgaagatggagaaaaaaattgtgtcttgataatgctaacttaccaagtctccatacatgataagaaaattacacacacatatatatatatatatataaatatgtcatatataagtttatttttgagctaaatcttcaaaaagtttctattgtaatttctaagcttaaacaaaaattgatacattcattgtctaatactgttctggttgaattcaattttatattcaattaaaattaatattttcttaccaaacatcacattcatacataaaataaacattggaattatcattctgaaactaatacaacatttaaatattagaaatcctataaaataaaaattcgtcctttcttttctttgtcaaccataagatccaatggctcgttgaatacgtagttacgtacaactggcattctcgtgtacaaagtcactaaaacaaaaacaaaatccattatagatattaaaacgactaaatttaattatagcaataacaattgaacagcaagatcacaaatttagaattcaagagcttaaaaaattcattaaaagtagaaaaatacaaaaataatacattaaaattcaaagttcatataattggaagtaaaaagaaatttttttatcactctcaagttttgtcttaaatgggacaaatttaactttttaaacaaaacccacagaatctcaaaccagttagcaccccttgtttcaccccacggtttgtttaacgaacaacagccaaccaccaaattactattataccctcatcaccatttgactatttattagtccacactctatagtagttgttacattcaaagaactccaaagtaaattaaagtcttctctacttcaccataaaaaatgcttgcgcacaagtctcttctctcctttaccacccaatgggctacactaatg

SEQ ID NO: 28582 - DNA, 3003 bp, Unknown
  misc_feature (1)..( 3003): 2750-1469P.txt file - cDNA_ID_2997593; gDNA_ID_2926288; Annot_ID_205491
ttctccgatttgtaaagctaatgcttctgggattgattgaaacaacaaagcacaagcaacatcactcttatcttcatcaaacggttctgtcaccttgtctatcatgttccaagctttatgaacctttagtgccctcttcatcctcatggcccataccgtgtagttgatagcgtttagcataggacattggattgaagaggatccactaacttctttcgttgttctagctgcgggaacgatatcactcatttcttcttatgattgattcaatagcctcacgctctgataccaaatctagagtttaagaaagattaagaactcaaaatataaagaattactctctttattactttaggaaaatagctcaaaacctaaagctctcaatctcacaatctctctcaaaagctcataagttataccacacattggtatctccttatataatagagattcaacattatcctaatcattagataactcctaatgaatattctagataactcctagaattacaaggaattccttttctcttaaataaataaatgacttattacttaagtcttcttcaagcttaatccaacatatattgccttcttggtgggataacatagttcaaaataccgagttattcattgttggaatgactggtagaggtgaagttgtgttgtcaccgtactgtctagtactagaaccatgttacattgattaattcaacctcgagaggaggagtttcacaagagttcaaatacaaggtcttgaagtgcttataagggtacgagagtttacacttctctagactatgctgagaatttgaaacttatgtagggttcaaatcttatttttaagcttttgtctagttttggataaaagaacaaaatatcaaaaatcttttgtatgttcatatatattttattttttttaattaatatttcattacttttctttagtatatggagtatttttatgaaacaagaattgtgagaattatgaatcttacctcttacaattcttacatatttttggattacaccaacaaaataagatattttgagctgagtgcctgtttttcttggcttttactctttttttttttttttaaacattctaggttagcttaacaaaaacaacaagcaaacaaaaccttaggatgggagttaagtcattacaaacttagcagcaacctatactctcaatactcactacaaataagccccatgattctccatcttcctcaaaccatttccacctcaagaaataaatcatcagagcctcacacatcaaacacaagtaatggcctccacggattcagtttaccgtcccacaccaactccagaccatgacactactgttgtagtagttgtgtttgtttctttgggttgtgtcatgttcttggcgtttctagcgtttgttatctggttcttgatcaagaagagatccaggaagcaccgtgagagatctgaagcggttcgcgtggatgaacactttaagatgaaggaagctatagtcgaaggacctaatggacaaaagtctgtggtgttatcagttgaggatgatgttaagatcgaagacgcgatcaagagagaagagaaagatctgaagaaagatggtggagttggatcatcagtcgtttcccgttcgtgaatgagctttcttcattcataatgttacctatctatttatttatattaaaattgtggttgtgtgtgaatcatttgtttggtgaaataaaaaaaaagcatctgaaatatttatttaaattctttggacaaagatggttcttcaaacttgggttggtgaatggtgatggtttttatgttctaggagcgaacttttatctctatctctctaagaaaagtaatctttcaaaaaaaactgtagagaaataaaatagatagttgtttttggttaaaacagataatttgtaactgtaactcgataagaatattaattaaaaaaaacatacaatgtcaaatgaaatcatacttaaaattggacatttttctatttgaaaacttggtattggtatactaacacatataccatgttaatcttctcattatagttctacttaatatttaccaaaacaaaacaaaaaaaacaattatacgtatttaattaacaaaacaaatacattaattctgaagatggagaaaaaaattgtgtcttgataatgctaacttaccaagtctccatacatgataagaaaattacacacacatatatatatatatatataaatatgtcatatataagtttatttttgagctaaatcttcaaaaagtttctattgtaatttctaagcttaaacaaaaattgatacattcattgtctaatactgttctggttgaattcaattttatattcaattaaaattaatattttcttaccaaacatcacattcatacataaaataaacattggaattatcattctgaaactaatacaacatttaaatattagaaatcctataaaataaaaattcgtcctttcttttctttgtcaaccataagatccaatggctcgttgaatacgtagttacgtacaactggcattctcgtgtacaaagtcactaaaacaaaaacaaaatccattatagatattaaaacgactaaatttaattatagcaataacaattgaacagcaagatcacaaatttagaattcaagagcttaaaaaattcattaaaagtagaaaaatacaaaaataatacattaaaattcaaagttcatataattggaagtaaaaagaaatttttttatcactctcaagttttgtcttaaatgggacaaatttaactttttaaacaaaacccacagaatctcaaaccagttagcaccccttgtttcaccccacggtttgtttaacgaacaacagccaaccaccaaattactattataccctcatcaccatttgactatttattagtccacactctatagtagttgttacattcaaagaactccaaagtaaattaaagtcttctctacttcaccataaaaaatg

SEQ ID NO: 28583 - DNA, 3003 bp, Unknown
  misc_feature (1)..( 3003): 2750-1469P.txt file - cDNA_ID_2997605; gDNA_ID_2926288; Annot_ID_143656
cccactttctttcataatgaatttttacttgtaattttagggtgcaaattctgcgtttttgcgtttgttaatgtaattatgcagattttttcttgattgacaaacttcttgcataatcgcattagaaaacaccgttatgtcattatgcgtgttaccaatcaaaaaacaccttaagtaatagtatcataagtgttcgtaatactgtaagaatatgtgagattttctagtttaagattggaaatatctaagtgttgggtgaaaatcacaagaggaattattgtattagattgtgataataagtggaattattaatttgcatttgacatgatatatggatataaattgtaagacgacagattttttaaaaagttattctaatcaaacaagtcaccttcaataacaattgattagaacataccgcgtcatatagtaaaaaacctttaaatcatatgttaacattctcttcttctataaagtaacatcaaatagttactacaatgagatatacaacaatcaagtatggtatttagggtttaacgtaagatttgagagatatgatttatgcaatgacatccaaatttgatagatattgagaagatatagaaaaagccaataaaatattgatagtggctaaaatatttgatcattttcatataatgatatttgcattgtttagctttaaacttatacgtggataaggtaatctaaagtgtgagaaataataatttgctgataaatattttgtagagataatttgagtatagtgtttgatagaccagtttaagtctacaatcttctttctgtaaatgagttggaaacatatcaaaaagacgagtcagatatactcaaccatgttttaaggtagtaaaaataaatagatcaaaatattcaaccatgtttccaatggcaggagaagttcttgcaataccaatatctttggctatatatgagtctgtttttttaaccattagtgattgtaatttaaatcaatataaaagctatttggtttgtggtgttgttaaaccgggtgaagcactctctcaactctttatacatattttttctttttgttgactaataaatttaacattttaacacacaaaaaaatgcttttgacttaaaattggttacatgcattattaggttcagaaaaaatgaggtatttaagatttatattcagcaatggttcatatatatgctctcatgtctgattttttcttttaaatatatttatgttagaaaatgatctgcaacacatcagactaaaaaactgaattattttttttatatattttctaatattaatagaaaacggtttattaaacaaatgaatatgcaaatactctaaaccgtgagaattccttgtggagtttcatttgtatataatatttattttctttgctttataactttaaaataccatcatgattattatagttcagcttctatgtaatgaaaccatgtagacaataaaataaagaaaataagaagcagtttttattatctaaaaagcgtagacaaaaataattaagaaaacttgaacaaaagaaaaaagatagaaagttgagacgaaaaagaatatataaggggaatgggaaaaaaaaatcatctaagcaagggatgaagatcaaactcgagttgtttaatctcatacataaatccgctttcaaattaattttatgttgtcgttccataattatattttttcttaaaaatagtcttgttttccattctctctctcaaaccaaatttacacatttaaataaactttaaacagaaaaaccactattaatgtagtaatatattaaatattgatatatttctatatcaaatttaaaactaaaaccaaaaaaagaaagaaaaatttctatatcaaatttagaactaaaaacaaataaaaatagtgtcatttccattatgttcttttaaaccaaactttacattctaagaaaaaacactattgatgtgtatattaaacttttgatatctttctaaatcaaacttttcttaaggtatttaaaagtgatagtattctgaatggaaaaataacaatttaacactaaaaccaataaaataaagagaaaaatgtttgtggctaacaaaaaaaaaaaatccagattgtgattacaaaaaaaaaacatttctagggcatgtcattgacttcctttgaagaagaagaagaagagagagagagactgaaaaagaaaaagtaagaaagggaatgaaataaatccgatcgaatacaattttgacgtccgcaaggacactattctctctcttctcatcttcttctttctctcttctctctctctctctacagcgaagaacaggacacaaattactctgtgaagcttaaaaaggtataatttttaataaaacccagaaactacaatttctaggcggcagagaaaatttgtttctacttctttttgtttctctttgtcttctcgtctctttatccccaaacccatcaataaaaaaccctaaaagacttcaaatttcttcaagattttgttcatcggaagttttcagatttttagttgtgtaaagtctcttcctttttgttcgattctctttgttttgagtcttatcagagacttattcttcaattccacctctgggtaagtttctatagattctcactagtaatctctgttttttttctcaattagggtttgatcaaagtttcgtttttttctttctgggtttgttcttaacattatgcttttgttttgttaaggtggtgagagttggaaatggagtagatttgcttaatttagatctgtaagtaatcaacagacagtgttgtttggttctagaatgttcgatacggaatctcatcactcagattcatctctttccgtggtgtttacgactctgaagcttatcattgctcagaaagaatacgtctttgctcctacacagagctgagttttataaagtcgtcagttttgtttcttgctttctttgttgattgtggagttgtgaattagtaagagtatg

SEQ ID NO: 28584 - DNA, 3000 bp, Unknown
  misc_feature (1)..( 3000): 2750-1469P.txt file - cDNA_ID_2997609; gDNA_ID_2926288; Annot_ID_143657
gcggcggccttaggagtatcatatgtacctccaccggaacctggcatctcctccggaggtcgaccaggtcgctgtttatcatcggcgtgcctcccccttgcttggcagcctttttcttcttcggcttgtcggctctggttgacgacatacgaattggatccattccgcccagggttatgacgcgtctttgtactcgcggcggtgacgccaccgacctcgtctcggacgaacttaaatcgtcgccgtagctatggttgcttttattctgggaatcttcaaagtcgctcatctttggttttcgacagagaaggacgagagagatgaaagaaaagagcaaagaaggcagatcgagaaagagggaatagcagagaaacgaaggagatagcaaaaaaaataaagacgagatttttctacttctacaaaacaaagagcaataaataataaagaatgagagaagttaccttgagagttgtgtgagttgacgtgacgtcaaatggataggtgggaagttatttaaagccatcatcaccacgattttcgagattgcagagatctcttctccgcgcctgatctggaccgtcagatgcggtgcgctgaagagacgctccatctcagccgtccacatcagcagcgacttatctcgcgtatcctcctcgaaatctttcggttaagggaatctgaaattaaatcgaaattgttgagtttatcctcaaaactgagtgatctaatcacatttatcttctcatcaagaatattttcgcaatcttacctgacctatatgtccgctcatcgagttcgcttactcactcaatgggctggggggcaaatgttggagctggattcccctccaggaatccacctgcgaaaataccaagccagcccacaaaagcccaccaagcccaccaagtagaggacctatgcagctgacgagcccacatacgcgaatgggtacttgggccagataagcccagtcatctgatgaagggagataagcgaataatgacctaggaactgatgaggagatattcgcggagcggacctgatattttggaactgacctgatgaatatctaggaggatctccgcagatcccggacgaagctaccacgtgcgtagatctatataagggagcaaggacgacttggaagagacattcaatccagttcacattcgcacacacacacttttacacttgtaatctcttttcacattgtaaaagctttgtcataattaatacaaaagtccattcgttcttagcaatataactctcaaggtttcagttaagatctagccctcctttctcataatcttaaatacaaatctctagtgtggattttagaacccacatcatctaagtacatatcaaccagaatgggagaatctactaatgcgtctgctcaaagatgcccctaaattaaaaatccttaagccaatgggttgtttatcagaagctattaaaattagaaaacccggtctgaccggttagacaagtcgaatcagagtcaccgagtttcgatgtctaggccggttctcctaaccgctaaaaacctttcaatattttaagtttgggttgcctgaattttcagccctatactagttgaaatctcaacattcaccctaaacttttagccacttgaaaaaccttcagaaataattttaatctcgataaaactacatgtactttcggatttgttcttaaaactacgcctccaattgaaccgaccagttaaccgataattatacatccggtttgacttacccataatttaaccgaaactaatccgattttgactctatattagcctaattttgacccacacaaaatgtaaataaattgtcttattaagaagtaaaagtatttttattaatttgtatttgtgataaacaattaaaaatattaaattattacttaattttagcaaaacttaatatgacaaaatataccccaaattatatttttagctacattttgttataaaattttgataatatacaaacatatacattttccttttggcaatcatttatatttttttataaatttaaagctatgtctttttttaaacaaaaatattcatttttcttgaaattataatatatgacctttgaactctatatatgtaatgaaattcaaaatatatgccaaatttatttttatagatatccgtaaacaccacaatcaaagtatatattatggtatttataaatttatttttctttatagattcagttttctttttatatattcaagatgagttatatatgtatatatatatatatatatatttatatatgattatggtgtttttaaaaagaaaatgacctttgaattattaaatttagagtatataccaaatacatttatatataacaccattgtatttataaaaagaatttgttgtctattttgttatattattttgcggtatattttgtttattaccaaaatatatactaaaattttattatataattttgtgtggtatattttgttattttattattttggtaaaattaattaatttatttttaattttttataaaaataaatgaaaataaataaaatgtatttttcttctaaagaatatattttttggatataaattgggttaaaataaagtcaaaatcggattagttttggttaaattatgggtaagtcaaaccggatgtataattatcggttaactggtcggttcaattggaggcgtagttttaagaacaaatccgaaagtacatgtagttttatcgagattaaaattgtttatggtgatttttcaagtgactaaaagtttaggatggaatgttgaaattttaactagtatagggctgaaaattcaggcaaccctttaagttttagccaataactttttattttcttcacatttagccacgaacttaataaacaagtgaagacctatcacattttgcagtttcaacaaataaatatcccaaaatttagtggcggcgagagggaaaccaaaattcgcgagagagaagtatg

SEQ ID NO: 28585 - DNA, 3000 bp, Unknown; identical to SEQ ID NO: 28584
  misc_feature (1)..( 3000): 2750-1469P.txt file - cDNA_ID_2997609; gDNA_ID_2926288; Annot_ID_205500

SEQ ID NO: 28586 - DNA, 3000 bp, Unknown
  misc_feature (1)..( 3000): 2750-1469P.txt file - cDNA_ID_2997617; gDNA_ID_2926288; Annot_ID_143659
aactaaggctaaaacactaatctttgctcttaagtagtgttggtttggattgatttttgttagaaacaatgattggagcataagttttgttacatgtagttatggcacatcgaacaaggagatattatcttatagaagaatgcttccaagttagttgcttttgtgctatatcttgaggacttaaggcttatggttagtgttcatactttgttttcttgtttggtctataatagacactactggttgaattagaatctggaaccgacattagtgtttttgttggccaatattttgttactgcgatgaaatgaaaaaatcacgagctgatgatggctatgatgaagcttattgggtctgatgatttgggtattaataataaactccttagatttagtcaaactatgatcctacaggacctcctcatctcttagcaacaatgtaatctattactagggaagaacaaaaacaataatctattttatggtgattgatgcttgattggaacaattaggcaatgatgctttcagatttagaaagtcttgattttggatttagtcttggtggacgtaatatggtcggcgttaggagcagtggagactttgaatttcatgtgattaaattgtgattatgcaacatttccctatgctcttaagactgtgattaaacaaaactttactatagtagcgaaaagcaacggtcagtttcatacatgatagttgatgataactgtgtgtgtgaatgcatgtatattaatagcattccggtgaatcataacttcattctaccaccattcaagatttagcaaatacagacactaactacgaaatgagattcattggatataaccaaattccaagcactcctagtcctcttggctttgggacacttttaagctctgtcaatctttatttctgttttgaactgaacgtttgttgtcattggctgcaaaagctgtcatttggctaatgatcgaattgtggaaacaaaggataattatagaatggttcaaagaagttggtttcttcttggtttaaatcttgtttcttcaatgttcaaatacttttgatgtcttttattaatttttatgaaacaattttttttttcctaagaacctaattagagagactaaccattggactaagaaaacttaaaataaaaaacacaagttctcatctaacaaaatttcaaataatttatactaaaacaattggtgagagcccatgggggactctcaccgttggagatgctctaaagtttcttctacgtttgaaataatacattctgatttgtggacttctcctattcctagtctatccggaattcgttactatgttttgtttctcgatcaattctctcattttctatggatttatcctcttcgcaataagagtgatgtgttctcaaaatttctgcaatttcatacctatgtcaaaacacaattcgagaaacacattaaatctctacagtgtgataatggtggtgagtataaaaactcacagtttcatgatttctttgctaaacacgggatacagtttcgtttttcgtgtccatacacctctcaacaaaatggcagattggaacgcatgatacgaacccatcaacaatgctttttgcactatgctgcttcaagctcatcttcccaatacgttttgggtagaagctctaagggcatctccaatagtaatctctatattttcctctatttatagagatgactctattttaaagacattgtgctccaatggtcacctttaaaatagagtttcctctgaaatagaggaaaaaatagagatatatactttttgtctctataaatagagatctctacaattcatctctattttttcctttatttttgaggaaactctattttagaggtgaccactggagcacaatgcgtctaaaatagagttccctctaaaatagagaaaaatatagaggtgatcattggagatggtctaaataatgcagttcacattctcaatctccttccatccacttctatcgataacaaaattcatttctcagtgttattcaacaaaacaccatcttactctcatcttagagtttttggttctctttgttatcctcacacaaataatcaaaacaaacttgatccaaggtcatcaccatcagctttcctaagttatcctctacttgactcagggtatagatgttttgatttaaaaacacggaaaattgtgatatctcgtcatgtcacattttaagaggatatcttcccttaccaaatcaccaatgctaaaatcgactctgcttatgactttcttgaagcggatacagagccttctcaaattcaaaagcagcttttgcttacaccttctcttccagcgacaaatgaaacagatctagttttgactgctcttgctcctcatgtagcgactcaaccaccaccacagcgtatggtgactagatcgcagcagggcattcgtaaaccaaagaaaattctctcactaaatgctcaaacactttcccaaattccaaagggttataagcaagctctaatggatccgaattggaatccttcaatgacagaagagtatgatgctttgattaagacttacacttggagtttagtgcctaaacctgcaggtacaaacatcatcaattcgatttggttgtacaagcacaagtttaatgctgacggctcactctctagatagaaattcagacttgtctctaatggtaaatttttggaacaaggagtcaattttgatgaaacgtttagcccagtggttaagcctgctacaattcgtgcagtattgaactttgcggttgaacgacattgcctggtgcatcagttggatgtacaaaacgcctttttgcatggagagcttgaagaaacagttacatgtatccaccagcagggtttgttgacaataggaatccgggttatgtatgcaagctaaataaggcgttgtatggcctgaaacaagcaccacgggcttggaatgctcggtttgtagcttatgttaaaagatg

SEQ ID NO: 28587 - DNA, 3000 bp, Unknown
  misc_feature (1)..( 3000): 2750-1469P.txt file - cDNA_ID_2997621; gDNA_ID_2926288; Annot_ID_143660
attacgacatactcatatatcctcagaacaaaaatctagaagctagctgcaaaatttactaccttaagaacaagctcttcaaaacattgctcaacgttgactcgagtctttgcactacactccagaaacaaacatccgtactcccgagcaaagtctatgccttcttttttagaaacagctctttcactctcctggaaattacataaagatcaattgctatgcaacattatagacactcaacatgaggacggagagacgagatgatcttaccttatcaactttattcccgacaagcatcttaatgcaatcctgattagtcgaatagaggtcgatttccttagcccatatgtctgataggtttgtgaacgtgtctcttcgtgtcacatcatatactacacaattggagaattccaagtcacttatagggatcacggatgacaaataactgtgtttattaagagtgagacatacccataattataccctgagctcctctgtaatacgaacttgttagcgtcctaaatctctcttgcccagctgagtgatcataaacacccaaaaactgatcagtgatcacagaacaaccgacaaatcgcaagagactattctctcaactgttctaatatcaaaactattctaaatagatgagtctatcctaagcttattctagatacaagactaatcttaaaataattataagtaatactgttacttcatctataaactattctaaatacaagactaacctttaaaatattctaaagacaagactaatctctaaactattcaaatacaagatactaatctctaaaccattgcaaatccaagactcttcttcttcaccagtcacattagagcttaggcaacaatgactgactaagacacaacataaaaaaagattatcacacatcattgtgggagacattctcaaactctatattgttcaatgattcccctaaacatctaaattgaaaccacaagatgtgtgacatttacataaattccaaacaacaacaacaagagtattgatctctcacctgtatcccaaatcgcaagcttgagtttcttttctccaattgtcagatacttaaccttaaaatccacacctagacaaaacagatccaagatcaaaaaacaaaacacaaaagctaagatcggtactttaaagcttgatcaattaatctaaaactcaccaatcgttggagaaagatcatcaaaggtattagatgtgaaactcaacaaaagagagctctttccaacaccagaatctccgatcaataaaaccttaaacaagtaatcaaattcgggttgtcctgacgaagaacccatcgatcaaaatccaaccttttttaatttcctgagaacaaattttacaagggtcggaacaaaacaatcgaaagatacaaactttaacttaaaggatcgattttttttaagtttctctttaccttaaggctctctctcgagatctacgagaagaatgacacgaacagaggaaaaagtggaaagccgaagagaaaactcgtaagagagacttctttggttaagatgcctctttaatttcaccgactgacaattggggacgaatcttctacggttggtcttacggagttttatcgtacaccttcctttctgtttgttcataaccgttggatcgttaaacgtttttttattcgacgtcggccagattggtatgcatttcgtctagttgattttgctctgctaatgggccttggcccaattattctgctaatcaccggcaaggttcttttgctgcattatttagatgttgaatcaaagctgtttgatgaaaaaaaaaaaattaaaaaaaaaaaaaatcaaagctgtttattcacacatcattgccattacacaggctccggttctagaaagtttgagtataaaactaattagtcaaaagagtgatgcttatagagatattgaagtatgtgttggaaccgctattgaacgatgtgtgcgtgagctatgtttcgagagtgatacttgttctattgggtctgctctagtggtacttccaagtagcttgtgtacacgttcttcagacttcagtgcttgtgactttgatgctgtacaatgtggttcttatggatctgttttcattggtttcttttctgttattagaatgtcccacattaactgatctcaaaacctagttctagagttaaggattgtcaccttctttatatattgtccaaagatgttgatttcaaccaatatggatattctaataagcctcctcgagatgtgggtgtgaaacgatccaacagaaatcagtttaagcctaacatctcggaaatacaacaagacatgccacttgtatgggccacataggtgggaaaccattttttggaaattttgtttgttgagccaaccatgagctctgataccatattgggaatgtggcttaatttatcccaaaatgtaactttagagctaaggattgccacatcctttatatattgttcaaagatcttagtcccagccgatatgagacattctaatacacatctctaaaaaatttggctcttctatcattgaagtaccttagggataaatttgtcctcttgcttttatctggttgttatgttcttaaaacgatggtcatagaacaatgtccgggtgatagtgcgggccatttcatagttagaaaagcctctttaaagatgtttaattgcgtaaagaattaggagaccgatgctaagactacgggagggtattgggagataggatattcttctcaatattcttctcaatatgtttgttataagtttaattacgactttgttaatatcctcatgtacccagaatctaggaaagatctgaactcttgtaactgaatcatgtatatattcactctaatgcaaagctatctcctcaaggagacttacacaatcttacatggtatcagagcacatctctctttgattgcttcttctctcttatatctcttctctattctcttttccttactcaaaaatg

SEQ ID NO: 28588 - DNA, 2460 bp, Unknown
  misc_feature (1)..( 2460): 2750-1469P.txt file - cDNA_ID_2997629; gDNA_ID_2926290; Annot_ID_143664
acctcaaaattttattttgcacgtatccgtgctctaattttattccacttctaatttcacgacagattattctttgtggatatgctcctattttgttagaaaaaaatgttgttgctagattttagatacttttgaaatgttgttagataaattattgtctatcgtaaaatcccaaaaaagtagtattatatacttacttctcctatataatatttgtgatcatttcacttctcaaaaagaaaaacaaagatcatctcctaaaaccagtttgaagaaaaaccataatcatccttcgtaagtttctcgtatgcatttttatataataatctacactacaatttctcttgatccatatgaaagatttctttatgtttttattttctttttttctttagaatggaatcaggagaccaggcaggagagacgtcaaaaaagaaaaagaaaggcccatatatgtcatggtcagatcaagaatgttatgagttaacggctatattagttgatgctatcaaacgaggctggcgtgacaaaaatggtaccataagcaaaactacggtagagagaaaaatactacctcttctaaataaaaagtttaaatgtaataagacttacacaaattatttaagtcgaatgaagtctatgaaaaaggagtattctgtgtatgctgcacttttttggtttagttctggttttggatgggatcccatcacaaaacaatttacagctccagatgatgtgtgggcagcctatttgatggtaactctcttttggttaacttcaccaaatttagatattttctgtcattattgataactaataaatatataatattttctcaggggcatccaaatcatcatcacatgcgaaccagcactttcgaagattttgaggatttgcaactgattttcgaaagtgctatagcaaagggaaacaacgcgtttggacttggtggtgattcaaatgctgaaacttttgaagaagaagatgatcttcaagcaggggataatgtgaaccatatggagattaatgacgacgaggtaaatgaaacacttcctaaagaaaagctgcctactaggaaaagatctaaaactaatcgtaacggagatcggtcagattcaataaatcatggtgagtcttcagagaaggtgctatctgaaatgattggagttggcactaacatcataaatcttattcaacaaagagaagaaagacatcaaagagaagttgagtttagggaaactgagaaaaaaaagaacaatgtttgggatgctatcaaggagatcccggatctggaagatcacatccgctatgatgcagtgaccaagatccacacattgaatttgaaagacgtatttgtgagcatgtctgttgaagaacgcttgggttggattcgtcgtaacacttaattagctttttattttcgatgcccttaataaaacaatacttaatttagcatgaaagactagttaccagttatttttaccaatgtcctaaagatagtcacatgccactatcattttgccgtgtgggactaataaaaaaaatgtagtgttatagaatacacatacatgtgtcttcactttacattatatacattaaattttgattgattttttttcttttcttttctaaatcaattatgaatttctttgaatgcaattatagatataaacttttactttctcaataaaactttagagaagacattaatagaagaagttttatcttagccaaataagaaaacatatatgtacatttagatataaatctatataatataagataaaatgatgaaacaaagaaatgatgagattgtgattatatatgaacatgacattgaccttctgtcacggcgtcgtttaaagctgaaagttaaagaagcaaatccaacaaaaattctgacaaaaaggcgcccttttgtttctttgaaatttggtgggacccacatgcttttgcagactaataataattattttcttcatccgtttggcacacacactctcttcctttattgctttttgcgaaactcctcctctctctcacaattgaatcaggacgatccaattgaatcgctatttttcttctccttcgtatgcctgatccctgtgagtattctgcatttaacattcatcttcacaattgattctaattcctcttttgttgttttcgattgtttggagattttaactgatttgagtttttttttttctctttctgggggttgaattgtggttgggattgggaaagttgttttctcggtgaaaaattaattgaaaatctgagaagattgattgcatatgcagcaacttaagaaaacgtaaatgcaaatttatctctggtaacaacattgtttgttggtgatttaatgtttgctctctactctttggtttatgaaattgcaggattggtttattaagcgtcactgttgttggattttgaggaagatgaaagcaaacaatg

SEQ ID NO: 28589 - DNA, 3000 bp, Unknown
  misc_feature (1)..( 3000): 2750-1469P.txt file - cDNA_ID_2997641; gDNA_ID_2926292; Annot_ID_143673
gatttggattctaaatttaagtcaacttcactaattcttctggtaagaagtaagacataacacaaggcttcaacaacacatatagattgtttccggacataaaggaatctcttttataacagttggtgagaaataaaattaaaactaaaacataaaaacagagaagagagatagagattttgccttcgccacagccgagcttgacactcttgaaaggagtgttcaatcgcaagaactcaagtaaggtcgttgatggatcaacagaatcaatcttgaatcgttccccattaactgcaaactccaaatccatttttttcccagagcagtgacaccagaatttttccaattataaggttagatttttgagaaacccaggaaacgaatcaagaaaacacgaagtgggtgtggagatttaaccaattaaagagagaaataagtttgagggagatgtgatgaagagtttcatatcagcttctcttatagttgcgcctctttcacgcacatctataagtttgagtttcagacataactcataagtcataagtcataagtcattgactgtgcgccacgagtcagtcttatgggaaaagaatatttgactttggaagaaatctcaacctgatccaatcaaaatcttactaaattgaaatgaaatgttttttttttttttaatttgaatttattgctaaacaaataaatttttctgttcaagtggggaaagaagataaaacgcaaatttgtagaaaaaaaattagaaatctattaagttaaaaaaaaattagaaatctattttaaaaacctttttttttttttgctcaaatctatagcaaaaactaatgtagtcttttattgatcaagcttaccatggcctatataacttgtatttaactactagtgatgcgtcgacaaaaaaaaaaaaaaaaaaaaaactactagtgatgccgacaaaaaaaaaactactactagtgagatagagacttgatttttcttaactagtaaacaaaaaaatatctaaaacaatagtcttgattttgtataatcaaaataacgttgttttacttgtgtaaagtcgtctcgttaacactttttattttagtctcgttaacactctagagtctggacatgtgacatctgactccgtgcataaactacaagttgactaacaccgattcttcaatgataattttcactcacggctattcatgtacattattttaaaaataacatatgagatttgatattgtatgaatgtgtggctatatttgtttttttccttctttgtgaaatttcaatgtttttatttaaataggaaattgtgttacaacaacgaacgagtctacagctttcacataaagaatgagaaaaatatagaaattgtgtaaaaccgaaatttaaggagatagatagctcaagttagataagcttgaatgtgaggtacatagaaccttttttttttggtttaaggtacatagaacttcttaaaaaaaagtatatataggaggagtacactatgtaagttgtttatcactttcaaaacaccatcaattcattcataacacctatgatgaagaaccaatttcaactttcactcatcattctaacgtttttcatccttcttgagttaggtttgtatttacatttgaaattcgccttaatatattaaaaatatatatttcaactgtaaataataacgaatattgtgatatatatatattgacagtattgtgatacttcttcaaaaggtcattctgtcaactatacaattttgttaaaaatatcaattcagctatagtctatatatgttatgtaaaatctatgtaacaattgcttttcgatacataattatgtgatggtaacatttactaagacatgttctaaatatgacacaaacaggagtaatgggaaatgtgcaacaagtgaaacgagaacaatgccatactgttattcctaacaaatctggaaaatgtatttttacggaatgtaaatctgcatgtgagaagttgaagaagcccgtggctagtctttgcctgcctcctaagacctgccgctgctatcatttttgctcttaatttgtttctatttatgataaaacttgatttttatttaattaacaataagaatatacgtttgagaagttgtgaagctatagcattgattttaaacattgtaatatgcgtgtttaagtagtggtttaacaaaaaaaaatatatctttatcttatcaaaaaaagaagaagatatatctttatgatagaaatacgtaacttggaaatttgtaatgattccaactttgaatatgaagaatatatattgcttctgccttctagtgaaataaggactaatttgaatactatatttttggaataaaaaactattacggtatggctcacgcaagcttgaagatggtctgcgggtttggttcgacttaagaagctaatctctaagtgtcttcttctttttgctctaaagtctagttaaatttttataaacattcaaattaaggatgcatatattgtacaatggtttttttttggttgattaaatttaacattcatttaaaaaaaaaaacttaacaatatcttcttaatagtaaaatgcttgggagagacgtgaaattgggtttgttgttgtagatgttttttgcacgttgtctaataaacttaggagatacattaacaacaacataaacttgttatttgttctctacatgaagccatctccacaaagcaaagcatttctcctatttttaaaatttcatttacttcacttttttgagaattggaaaataaagttgtaaaaatgcatataaaaaggaaagaactttatagaaaggaatcataatagataggcaaagttaaggaataacccaatatcaaagaaaacaacttagaaaattcatcttttctttggtatataatgaaatcgcttagatactctcttgtatcaacatacacacaaaatcctcttattctacatcaaaccaagaaaattataaaagatg

SEQ ID NO: 28590 - DNA, 3000 bp, Unknown; identical to SEQ ID NO: 28589
  misc_feature (1)..( 3000): 2750-1469P.txt file - cDNA_ID_2997641; gDNA_ID_2926292; Annot_ID_205543

SEQ ID NO: 28591 - DNA, 3000 bp, Unknown
  misc_feature (1)..( 3000): 2750-1469P.txt file - cDNA_ID_2997665; gDNA_ID_2926295; Annot_ID_143682
aatcttcactaaattatacgcccggttttgttggatcgcttaattaaaccgtcttaaaatacaacaccaaaacgaatcttctgaatgagtggtaataaaaacattatagacggtttgagctagtcaataacagcttctcactgttaacgacatctactagtataccatgtaacttgtttcgatcaaattattttattgttttttcgatcaaattaaatatataccctaataaaaaaagtcgatgtttattgtgcttatattaataaagtgaaacgaatataaaaagcacgtatatgactaattatcagttacgatttgacgcattacttgttttttttaatgtacatatcgactcagcgaaacgataacacgaactgtatcgttttttttttaattgcttaataatacttttgttatcgtttgaactctttttgaataaacaaggtatggacccatgagtaaaggtcccgatacgaagtatatgctttcggagaaaagaaagaaaatgtggagaaattacgttagattacatacaacgtcatttgaaatttggtaggccgtcgattattagttcttcggttacacgataatgtaaacaaatccatatcatcacattaatgttactattcatattttataattagccaatgaattatcttgtttttcttttgctctaaaataacgaaaatatggaatcaaactgaatgaaatatttctaagtcattttcaaagcttcacaaaatagtgatcactgcagaaaatattaaaaaaatacactcgatcggataaaaataatcgtggaagttagttcgggaaaaaagaaggctcactatcgtatcgcgtggagttgtctagagcacatgggtcagacaattctttcgcaattatatattacgtatttgttatatatgtgtaacccatgtatgtgaatcacacaagtgcataatatataatatagtatttttctcaaacatctatattatctatctacacacgtaagtacgtaacacatccatagaacaattttcaacctctacaaatacacttttttataactacaaaatatacttttttctgggaccaatccaaaattatccgtacactaccaaaaaatatttcaaaaataccagcaagacacatatatatatatcataaaggtaagataaatggaagagtgggacatgcattcctcacgtataatatatagtttttttagttttagttggcctttactaatttaattactcttaagtctcttatgggtcatgtttaaaggagccaaattaaggctatgcgtgcgaaaccgcagccaaacatttgaaagacaacttttaaacgtatctgaatccaaatcctaacaagtaattatattaatttattttagtgaaaagttaatattaagttaatcgagtgaaaaagttaaattagttttaattaattggggatgggatagttaggtcaagtttgcttcttagttctttagattcttgtgtgtttggtcgacttcttactattgccacatcactgcatgattataaatatatacatgcataatatctgcagcatctactattttattacaactaattaatagaaaaatgtattctcatagtttttttttcctactttgcatgttgtatttaagttatattccccaaaaaaaatcctaatattgtatcaaaacgatttaatttttagcataaaatctaattcgaatcataactttagttaacaaagatgtctatcaagcgatagtttagacaacaaaagtaaacagaaatttacctcagagcataaattcagtggacacacacacatataaacggagtcattaataactagtaaaacgaaaatgataagagaagggtatcgattgagcaaataagattccaaaaatgcaagttgactaatttaattagagtaaagcaagatatcaaaactaaaaaaagaagatattatgaagcatttaaattggatattaaacagatccaaaacgaaaaactccaagcagacgcatgtcaatctcactcaccttggtttattgtttttttataattaaccttctttttatatatcccgagtttcaaaaacttattcccagttttcacgttctttttgtatatccgatccaactttctgaatattcatatccatactgtctcttaaatgctaaatttcatttactttctcgactattccaatgaatttaatcattttgttcattgattagatagttcttgaagcatatcaaatattttaacaattatatatttaattaaatcatcactatctgctttccctttacttattaagaagggatattattatactttgaccatttttcatataattgttttgcactacacaattaacaaaattaaagctttgatgatgttacaaaaagaagaaaaaaggtactagtattttttttaaaaatcattttctccaaaacgatcgcaaaattcacgcaattctctcgtcgctcctaaatcatcctctttttgttttcttccattttttctgctttagtatatgggtttcttttttttgttttctttatattaataaaataatgtaatttcattttgtttttttggagtaagcttatataaatggagattccttggtcttcttcttcgttgccagttgccaccagacatacataacacattgaaagcagcttattcatcgacataccaaactctcactctcgccctcgctctcgccctcgctctctttctttcttcatgtaaattgtttgttcttttccatgtatcgagattcgatcttcttcttcttcacacgaacctccttattgttttctcctgcattctctctattcttcgctaaaccttgaataaagacatgttctttaacatgggtttttccggtttaaagtagttgtatctttgtttcccctttaaaccgggtttaagctcaatcttttcttagaacaactccaactgtttgacgatttgactgagagaaaacagagtcatg

SEQ ID NO: 28592 - DNA, 3003 bp, Unknown
  misc_feature (1)..( 3003): 2750-1469P.txt file - cDNA_ID_2997687; gDNA_ID_2926305; Annot_ID_143691
aaggtattttacaagccgctaagatttgtttagcagctgtaatatattgactaaattgtgggttttgcaagtaatcacaaaaacatgaattttgttctttcaatttttcgcaacattgagttgatggttggcttccgtctatcaccgatggtaggcatggttgcaattctgtcacggtgcatgccactttcttctcgccccacgaaactttaacaatccctccatatattggagccaccaacgatagaacaaagaaaatgaatgctaatgttgtaaatttcatgtattctaatataataaaagactcttatctaactgtagttttttttgtgcttagaaaatatatgtttgagattttgatgataagatgtttttgagaaaggtgaagtatatagatggagtaatgttttgcaataagccaaatataggtagtgtattttgtcttttggattaaattttagtgcatttcgtatctatgtgacacataattattttcaatataatttataagtaataaaaaatgtttaaaactttttttagtgttaaatatttttcaattaaactaaataattataattaactatccaaatctaaaagcaaatcatttacataatttggaaatatttgtttataaaccatcaatgcacacctaattttggatatgagaaaaatgatttgaaactatcaatgattaattatagataaaaagtaattttgtaaagtgagaaaacaaacttatacaaacgaataaaaatatctgtaaatcaattttgttgggttagggttgaccggttgtttgggtttaaccaggattcagagtctgggacttgaaaacaaactggaggctaattggattgttctttaaccaattggggaagtagaggtgtaagtgtttaacaatggtgcctctcaaacatttgaagaaggaaaatccaatcatcgacgcatgttttaggatctacactacatcgttataaacatactctctccacttgaggcaaagggacggattcattgcttcaaggtggattccgtgagggttagtttacagaacttgtaagatgaacttcgtgttctagtaaaacacaagtatgtccctgttaggcatttctttatccatgtcttgtgtggggaaaaaaaattcttcatatatactatttttcaagccttacatacacattgtgaattgtttcatttcaaatttttaagctgcagccaagaatgtaaaacatagattgttcctagagaaaaaaagttttgtctttgcttagcctttttgtactctcttttcattgtgtgatttcttctcaatgaagagttttgcatacaagctattgcgagtgtggctgagtcttgtatttagacactagttttgttagagaatcatcttgacaataattttgcatgcaaaccagcggtgttactatcggaaacctacttttggcattctcatcagaacaatggcgattgagaaaaatctagaaaagccaaaaaaatattgtttacaaattttgtagggtttccaatagtaacaccgctggcttgtttttcaatatggaccaaggttaaataagtaattggaaacaccggagacacattgttgtattactgaaaatactgaatttctcatcgatgatagttactaaatgtttattgtttggttcgcgtcctattcctatccagctaaaaatgaaaattcaatttttttttgttggaatattaattttgttgaatgaatgatcatatatattttaaaacatttttgtggtgttagcttaagaagagttaaaattttttaatgttttagttaatacaaattataaataacacaaccaaaaaacatctcgtgtaaaatagaagtttcgtgtaactatcgactgctactacgatgccatagtcatgctaatcatatgcaatgcgtcaaaaaatgaccttaccaaaaggttatgcatacgcacaaaaatgaaccaggagaagttggactagatataaaaaaatatcgatggaaaaagattggaagaggtaataacggattatgcaaaggagaaacaatcaaaacaaagagttatgttcgagaaaaagctacaagtcatcatcgagaaggtaatcaataattatcaaggagattactaaaggctattgagaatgtcattacttgtcgagaatctttgtaggattgacaaagaagtaataagtactaacgttaatatctttttttttttataattttgagaaataaggagagtatatcaagataaaacagaccatctgtttttagcttaaattagatgaattaggactaagcaaaaaacctgggatcgattatccgaactgaaacagatcaaaaaaattagaccgaaaaccaaacctgaactcgaagattttttttatttgattttaaattcctctatccgaaaaacccgaatccaaacatgatccgaacctgaatctaaatacccaaatattttatttaaaatctaaattttacgtaaaaccccaaattttacccaaaaaatcgggtatcaatcccaaaaaagggcttaaaaattcatacccaaaccgatattttggatttattctattaaatccgacccgacccgcttctctgaatgaccacctttaatattttgatgaacttattttgctttataaaaaaaaaaggaaaaaaagagtacgtcaaaaactcaaagaagagaaaatgacgaatctttttcttaaagatgaggcaattgtatcaagatacgaggacgaggttggtttgtttaacattatcccaaacaaagtttacggccaaacccgtcactgccacgtgtcatccggatctccttttggcttcgtctgaagacgttcgatgctcaccggtcgcgtctttatcctctcatcatcatcctcgaaacgtgcaacacacaaaaaattgactataaaagattgcaaatttctctctaaatatctgattcaaacgcatttggtaggctgagagaaagaaagaaaaagataaagatg

SEQ ID NO: 28593 - DNA, 3003 bp, Unknown; identical to SEQ ID NO: 28592
  misc_feature (1)..( 3003): 2750-1469P.txt file - cDNA_ID_2997687; gDNA_ID_2926305; Annot_ID_205836

SEQ ID NO: 28594 - DNA, 3003 bp, Unknown
  misc_feature (1)..( 3003): 2750-1469P.txt file - cDNA_ID_2997702; gDNA_ID_2926305; Annot_ID_143695
tgattagaaaaatgcttagatgtttaggtcgttgactagtttggggccttgagagccttggggtcaatatgctctaggattgattagtaataaagcaagattttgattcctgatcttaacagaatcattgtggtagataattcatttcatttctctaggtcagctcgatggatctctcctttgtttcttatgtgtctattactgcctaaaatagcgttaatggataattttgtgatgaacaggattcagttcaagccgacagggatgatccaaacctccccctagtaactgcaccatttggacatgcctcccaggtaatagaacaaacacatttcagaatctagactggttaattgtttctcctacttctatcctgtgttttgagttctactgatttttctctatgcctctttttttattaggaaattgtaaacctgctgctgtgtggagaagcggttcctaatgtatttgatggacggatggatcttggaggcggcatgtttctgaaaggcatatctaagaatgtagatgtgggcttcctcacgttgctcgagtctctcaacttctgcaaagtcggtcagaatctcaaatgtcccaaatggccaatatgggttattggcagtgagtctcattacaccgtcttgtttgcacttgacccatccgtccaagaagaaaacgaacttgagctgagagagtctcagataagaagagctttcgatgcaagagaccaaagcggaggaggaggtttcataactgtggaggcctttcaccaagttgctcaggaaacaaacatcagactcccaatcaagaagctcgacgacatctgcgccacgggtttcatcgtgtggagcgagttatggcaagttatcttggaactagaccaaaatttgggagggataaaagatgcaacaggactgatgggaaagaaagtgtttgatatctatcacttcaacggaattgccaagtccgatataaacggtggtggtcaagcaatggctgtggaaggtgggatggttcctatgcaaaggccaaggctgacaaaactaaacgtatcggttcctccaaaatggacaccagaagagtacatgacatgtgcactgccgccgagcagctctgagaaagactcagaagtgaatcagccaaaaccggtccaacatgcaccactggtggattgtatcagaactcggtggtcgcgtgccgcttgtagctggtctggagatcctccaagtatagtctgaagaatgttgtattatgagaaagcttgagcgtttattctggctcattggattctaaagaaagaaaacggaaactgctgatctgatttggcggttaacacgcgtctgaactttctttgcgttgtccgtttttttcatgttgtgtattgatgtagaatttttgttatctattattgaacattattgagacaaatgaatatttcaattgttggataaaattgctttcaataacattgatcatattctgatttaagactaaggtcttgaaatggctaagaaactatggtttcatcccaatacttaaacaattacatataaattttactttttgatcatgtatatttacttttgttattatatcgcggtacagcatgcaccacaatagtagatagtattttatgtttggtaaacatcttttaatggatttggttatacgcacttctacaacatatccaccttcttaattttttttataataaaaaaaaagtgtttccaaacaattgctgcttatttccattcaattagatcaaaacactatttttttcatttgctagcaatcaaagtcactatttatagataagggtaggaataatatcaatgtttttaaacatcatccagaaggcaaactggactaccttccggaccatcgagtcgaaccgcaaatcaattgatatttttatattatgtatttatagagattatatagttttataaatgaaaaataaaaatgagtgtgtcatgtttaacaaaaaaattgaaatctaacgagaacagtaatgtaatcaaaaattttaaatccaactaaaagttaaaaatatatattaaaataataaaaaatcaccaatgataaaaataaactaataaagaaaaaagactctccacatctgtttgtttttatcttgatttagactttgtaaattttttttgttttttttgtgctatgagtctaggaagattggttcagattagtgtatttgtatgtttggggttttcccatttggtttgatcattgtctctggaagtctacatatattcgccggcttaagtttctggaaggtttgaataccttgccggctattgtattccgatcttgtatcaccaatataatctatatttctaatgacaaaaagaaaaaagaaattcttaagagactaaatattcataaaagacgagaaaggtatgttggctcgtatgtggccgcttgaaaagaattgaaaaggttttatacataactgatataaaacaaaactttaaatattttcaaaatcaaatagatttcgtaaacaatcatccaacccgtttaatcggttcaccggatcattgatcatggatcaaatagatttttttttttttttttgggatttcccgttttagaattactgaatattagcagtaatcatgagcggttgttaattgaagttcttgtgtctttatattcgattagttacataattccttcaacttttgatccttgtagacacatgttacaatgtacaaaatataatctgttgaagtaaaccgaaacattattcaatgtgagaaccggataagattattagtattatttatttatatatattgtttttttaaaagtaaataagttggtaaatatcgagaatataggttttcagaccaaacacatcactttggtcctacttagtacttacctgcccctctcgacaaaatttcttttgtactttcacatttctctgtaataaactcggtaggtttgcgaaaacctcgccgccgggaaaaaaaaaaatcaatg

SEQ ID NO: 28595 - DNA, 3003 bp, Unknown; identical to SEQ ID NO: 28594
  misc_feature (1)..( 3003): 2750-1469P.txt file - cDNA_ID_2997702; gDNA_ID_2926305; Annot_ID_205839

SEQ ID NO: 28596 - DNA, 3003 bp, Unknown
  misc_feature (1)..( 3003): 2750-1469P.txt file - cDNA_ID_2997738; gDNA_ID_2926232; Annot_ID_142677
atatgctcttttaagtgatgggaaatgttgttgcagatagaggcactaaaggcaattggagtggatgaagtcgtcttggccattaactacgagccagaggtaaaaagacttcaagtctttaaaactttcctttggaaagctatatttgatttttttaatagaagatcttaaaatattgttcaatgttgaataatcattcagcaactgctagtgatgtccaaattctcaaacgacgttgaggcaactctcgggatcaagatcacctgctcacaagagactgagcctttaggtacagctggtcctttggctttagccagggacaaactggttgatggctctggccaaccattctttgtccttaacagcgatgttattagcgactacccgcttgaagagatgattgcttttcacaatgctcatggaggagaggcctctataatggtgacaaaggtaaattatttttgatgaaacctttaagcatttgtgttcatgttttttttactcattatgatataattggtttaaaaggtagatgagccttcgaaatatggagttgttgttatggaagaagccacagggagagtggaaagattcgtcgaaaaaccgaaactatttgttggtaacaagatcaatgctgggatttatcttctaaatccttcagttcttgatcggattgagctaagaccaacatcaatagagaaagagatcttccctcaaatcgcagaagcggaaaagctctatgcaatgctacttcccggattctggatggacattggtcaaccacgagactacattactggtctaagactttacttagactctctgaggaagaaatctccttcaaagttagccactggtccacacattttgggaaatgttcttgtggatgaaaccgcagagattggtgaaggatgtttgattggccctaacgttgctataggccctggctgtgttgttgagtccggggttagactatcgcactgcacggtaatgcgtggggtacacgtgaagagatatgcgtgtatctcgagtagtatcattgggtggcactcgacggtcggacaatgggctcgggtcgagaacatgtccatacttgggaaaaatgtttacgtgtgcgatgagatatattgtaatggaggggttgtgttgcataacaaagagatcaaatcagacatcttgaaaccagatatagtgatgtgatgacaatttggttgatttgtccgtatttttcatttttttgtgcgaatacgatttctaatttaaagtcatgaaaaagtaaaattttcaatgttttataagagtctagctcctagtaagcctttcgacaagtttcctaagaatatcaaagacgctcttgagattgaaggttatattagtgatgtgtcaatcttgacatatgatgctgggaatatatgttgtttgaagttagatctaattaatttatgtgtgtctcttgagttaaaagatgtttgatctaagtgaaatcatgagaagaggtcgtgatcttgttcctcctttttgtacgtgccatggccttggtcgtgattctgaatttttcttaggtacattgctgacaattgaaggtcaggatgtagcaaatcaatgtatcatgcgatttggattacttaagaagtaaaagagatatcagtctcagcgagcagataaaacttttgttcaaaatgatccacagagcagacgtacgatttaatctttcaattaatcatacaaatactaggaaatgagaaatcattagcagagattataaaacctagggcattgatgggaaagggattaaaacagcaaaacactaaacagagtttaagagaacaaaaaccaaagtcttttggacagaagagattataaaagtgaaaaccacacgccctagcatagccttccccgcggtaagctcccaagcagtgggaggagccctgggcacccttctccacaatatggacaaggagtatcgtcgccctcgtcatcttcttcggatctgaaagtctcttgtttgacacgagatattaggctacgtaattggatccaataggctttcccaaaaccatacagtgtttacatacggaatttgcggcgcttctggtgaccagtcattagccacaactaagataacattgtaactcataaacatccaacaaactaagatgttcttcgaacttggtctctcctgggatgcttttggcgattaccatcagatttgtagatgtataatggggagcaggattttccactgaccaaaatgcaatttccactaacatcttgtttagtctctcactcttaccccctaaaaaaatgtatatatcagttatcaactaacatgtaaaattgcactgcacatacatatatatatatatatatatatataatatgtaataaaaaagaactagggtttaagtaaaggacaatcacttttgggttcgaagtcgattacatcatccagactgtcaggtttcttctcaccataagcagtgattgacacctcaccatgataacctacaaatcacagagatcgagatctctgggcatggtggtttcgacggagatcgagaaaacagaaaattagatttagaagtaagaggcctatcaatgttttacatttaagcacagtaaacatttaaagcccagcctagcccattaagaggtaaatctaatttgctacgaattcggttgttaattattaaaccatcggtttagttcatcaaacgcaaaccaaagccaataaccgaataatttctcgagaaaaaataatgactttccggtgaagatttttttttacgacggcttctcctgacaacggaaggtgttgagaaagtggcggaatttgattttgtttcctctcctctcctatctaaacaaggtctgttttcgtgagatccagatattcaatttggattcaaaatcgtgaattgggttttggattgatttctgttactggtctgtgtgctttgatctgaatgttgtttcattctctagttgtcagatttactgatg

SEQ ID NO: 28597 - DNA, 3000 bp, Unknown
  misc_feature (1)..( 3000): 2750-1469P.txt file - cDNA_ID_2997742; gDNA_ID_2926232; Annot_ID_142678
taatagttaaaatacatatatagataatcataatcgtacacataaatattcgtttgctttctttttttgttttgcacgtcggccaaattgttaattttgcatgatccatagaagaaaccatgggccagattacgacactacgttcttcgaattctctttgtggttaaggaacgtgatccaatatattcagcatttatacaagaatttcaaaactagtagtaagagaaagaattgcttcttctttataaaggtttatagtatctaaattgtttaaatattcattttaattgtaaaaaactattgttaaatcattttcacatagtttttagtagtacatcatttgccatcatttttggttggtgacaaaaatggtatcatggcaaacgactagcagaagaagaatattaccgattataatcatttactgccgtgtgaaattgtttattcgtagcgtacgtaatctagataacggatcctgttaaaaagtgatggagattggacaagagttggagcttgaaagacgtacgtatattgataattgacatgagtttggacaattgttatataggcttatactgtttggctcttagcctcacaagcgaaattttttgggctagaattatagaggaagacgcgtgtgtcccataacttttcatatagaagaaaacttctgaagatatgttttttgtgaattactatcaaccacaacatgttagttatataaaaaaaaaaaaaaaaaacgaaaaaaaacatgcgtgtctaagatttacatgtgttatacactactacaagtaattggattcagtattagcgaaagtaacaactttataagagactgtcgtcatgagtccgatacatgattactaagaaaaacgaattgattaagaaaaagttaagtataaatatgggatacatgatttcactatgtgtgtggtaccgatagtattagatctaagactaattcgtgtagcttgcctatgtatataaatattatgtgtgaaccatttgatcatttagatgaaatatctgtggactgtggtagactcttcatcaaataatagattcaagttatttgatgtgcagaaaactcttcatcaaataacagattcatctttgaattagtcggacacttggccgaagactcagatttctagtgctaaaatctaaaaaacatatggattacatgattatagatttttgtatatataaatgaatacttcatcattacccgcacatatagattactaggaaacaaaactagtaagcgttacgtaatattttaaagagaactaaataaataactgaaacttgtgcgaaagactaattagactcgacactcgaggcatttagatggacccttggacctttaaaaagatttataaataaaaaactttgggaggcaactgaccttttagtgattaccgtgggatctaccaatgactatagaaaattaaaattaagaataaactgatgaaaacaaaagacaaaacacaagtgctcgtctctaaatacactgaaattctccatatctataaaataaacatttccttgtaaatatatggacgattgttattattactaaatagagcaaatgtcacatattgtgtcaaaatcatatgaaatttggacttaacgataacaaattaaaaaactaatgatgataaagaaatgttgtggcgccgcgtatgaattaggaatatattgataagtttcatggagatattgccaagtaaacttgctttgttgtccaaaaacctttgtgttgttcacgttcacgaagctctctcagccgccaatttttaaattacccaaaataccccaccaccatagagttaatccactgcgccacaccctgattcttttagcctgcaccaccacacgtcatcacgtggcgccatgtggttggaaaaatttagttaaaaacatgaataataatataaagtaaacctaaaggcatctccatcaaggagaaaccttttggtttctcaaacaaaaaaaatattagtattttactaaatttttattatataattaaatttttattttaatgaaaaaattgaaccaattgagataagagaaatataatgatggcttgtagagagtatctcatagtttctcacttgagaaactttctacactctctctctcttctctttttattatttttattatattagtagtgagaaactcttttgagagattaccaatggagatgatctaagtattttataaaaggttcttatccaaaaaaaaaagtattttataaaaggttcagaaaaatacaaaatgaatcttaacttataactattttacaattcggccatataatttgttaaaacttctaaccttaacaaattttactgagtaaagtgcaaatgattttacaaagaattaaaaacaattttgccacaaattttagtttgaaattagtgctattgcgatgagtttttgaatttttgatactaagaataattaaggtatataataaacactttacagacaaaaaatatcaaataaataaccacaacagatttctgatacatttctatataggcacaataccatatacattataatctttgtattttagtcataagtaacacaaaataaattgtttacatggtagttggcaatcatttgctaagaacaaccgacaacaaaataatcacacaagacaaaatgcagacaattctcaaatccacaaaaaaaaaactatagacgttatctattgataattggaatctttaacataaaccactatgattaggacttaaatgttagttttaacaacttgggtattattacttgatgattacaaagattaaggacttatttgactattttgacaagttgtcctacgctcttaaaaacccgttcgcttcctcacagtagaatctctccacaccggattatccaatattctccacgtccgcttcttccttcaactgagtccgactaagttgactcgttctctcgtgttttcgatagacacaaactatg

SEQ ID NO: 28598 - DNA, 3003 bp, Unknown
  misc_feature (1)..( 3003): 2750-1469P.txt file - cDNA_ID_2997746; gDNA_ID_2926232; Annot_ID_142680
acccaactttaatgacttttgattgccacttaaaacatctctacaatacctcattttacatgctccaattccccattaccaactataatcttactccatctcttattcaccacttacatttttccaaatcacattctcaccaaaaaaaaactgatttcattataaaaactctcaacatttttttccaaatataatcaaaatagttttcaaaagtagtcttgactttcaacattacttttttttttttttaacatcttcattttattgatattgtactttcaacattccttttcctccaaggctttcaaacaagataatttgtcttcttttttttttaatttatttaaaatctttttttaatgatgtataattggagcctcctttaaattagggcccaaacggtggcttcttttagattataacccagggccggcgcaacccttcttcttaacaaaaaccttttgattccaattgttcttctctcttcttcttcttcttcttcttcttcttcttcgccgcttcttctctctcgaattcaccccatctcaagtaagcttctcctatttccttgttataccaaacaaacaccatcttcaagtcaattgattttgttaccctaattgttcccgtccccgtcttgtaatataatcgaaaaatcgaaactttctgttttagagacatggattttgtgaaccctaattgttaacgaatcgttgatatctgtgacgtatataaaccctaatttcgttttcatgtttctttatctacgcaggtgtacgttagcctcctccctctaatggcgactcgtaagttttctgcagagcttacttatgatattgttgtgtttactcttctgtgtatttgaccttaatgggatttgtgggtaatacgcaggtcttcagtttgagaacaactgcgaagttggtgtcttttccaaactcactaatgcctattgcttagtcgctataggaggctctgagaacttttacaggtaccttttttttttttctctgtaaagttttcagtattgtttttgcttcttctatttcacttttttgatgtttttggtttgatgatttgtgtagtgcttttgagtcggagttagcagatgttatccctattgttaagacctctattggaggaacacgaattattgggcgtctttgtgctggttagctttctcaactagctgttatattttcttgcttcaaatcatcgtgattatttcattactttagcgtagtgaatgtggttttgtgtttcttcgtataggaaacaagaatgggcttcttgtacctcatacaacaactgaccaaggtaattttatacttctttcctcagatcgtttctcataacaattaagaattgattgtttaataccagcatgatccagttgtctgagatagagattgtagagtttttggtgaatatcttttatgtaacttgcctgaagcatctactctgcgcctctgcccatacctgtttcatttcagtttatgagtggactttttataactgaataagcttttggtgaagatgattttcctccttaacttgttgatgattttgtaatgttgcaatatttattgagtctcttgttcttttatattagaaatctatataggttttaggtctgtaattggttgcatctcctgagtcctgcttatttttttatgtttactcgtccagagcttcaacacttaaggaacagtctacctgatcaagttgtggtccagcgaattgatgaacgtctgtctgctcttggaaattgcattgcctgcaatgactatgtagctcttgcccacaccgatcttgataaggtaaagattcatgtcatactttatttttctaatgaaaccttttcaaaaacatatactcttttcatgactggcaagaaatggtgaaagaataagtgcgcatttttacaaaagttagcagaaatgtaattaagcctttgtaatcaccatgaatcttatatcttctgatgatgatgataacgataacagagttgtacgtatggcgtttggtttgatgcctctggttcttgtgtttttattttgctttgataggaaaccgaggaaataatagcggatgtacttggcgttgaagttttccgtcagacaattgcaggcaacattctcgtgggcagttactgtgccctatccaacaaaggtggaatggtaagagaatgaaaaacataacttcccttcggaaatggatggcattggcattggtctctcattagaatttgaatgtcttttctcaaataggtccatcctcacacctcagtggaagacttggaagaactctcaacacttcttcaagtccctctcgttgcaggaaccgtgaaccgtggtagtgaagttatcgctgcgggtatgaccgttaatgattggacctctttctgcggttcagacacaactgcgactgagctctctgtcatagacagcatcttcaagctaagggaagcccaacccagctctatcgtcgatgagatgaggaagtcattgatcgatacctatgtttaaattttgtttgtttggatgacacacacatcccaacatcgccaatgtgtcaatgtcagaaaattttcatactctactgtttgcaagaattagctgttttattttatttttgtgtggtttttaacagtttaaaggaaatctgttgatgtctctttgaatctttctgagtaagtgataagaaaattctccttaatactacacacattttcaattttcaatttggggtccacattaggttcaaattttagtggagaagaaaccattggtgaatggataacggttttgttcggtacaaatccgaattctgcaattatatgtgtgtagataaagttaacacctttttcgtttagatagtttgaagattaaactgaaagttaggacctttcatttccaatctctaaacccatttctctacgattagagaagctgacatcaaaattgaaacttgggaaatttttggatttgttcttcttctatg

SEQ ID NO: 28599 - DNA, 3003 bp, Unknown
  misc_feature (1)..( 3003): 2750-1469P.txt file - cDNA_ID_2997756; gDNA_ID_2926232; Annot_ID_142686
cttatcttttttacttttattgtatttactttagcattagatttatcaaatgttgcagcagaagcaccagacggcttgttacctctgtccaaaaagcacgttttaattcgcaacactgttcagaacggacaagttttgaatatacattgcaaatccagtgaggatgatttggggcatatccgtcttaaacatggggatacttggggtttcagatttcgtgttaacatggcactaactacgagatttcgttgtcacttttggtggtatgcacgcgaccatctaggccattatagttactggtttgatatatttactgtatacagagacgataatccatttggaaaatatccaatttgcgatgaatgcgtttggaatatgtacgaattaagtgaaaactttatttgtcgtataaatcgtgatcaatctggatggtgttttaaaatggacagagaaaattaagaagaaaacacattatcgttcgatgtatcttatcctaatacaatcattaaaattgattgaataaaataaaatcgttgatactattcaagctctctttatttgaagtgtttatatccacaaaagcaaattttgtcgtttattttgatgaatctattgcaaactaagtttctaactctaccaaccttttggaatgtcgttgcagtttatcggatctaatttacagctatcatatgacaaataatgtctatgaaacgtgatgagcgaacgaatctatccacattctcaaaaaacactaggaaacaaccacatctactgtctatctgcactaagaaaactatacttattataaaagaaaaagctatatcttatctaataaatgttaccatcatatctaatttacatatattaggtacaatcaaaacttctaattggtgttagcctcaagtcgctactaccagaacttctaattgatcagttcagttgaacaaccatcaaacgagaacttagacttatgtaagcacttaacgattttgacaacgcgaaaactggaaatataaattaattagtacgtaactagttcagaattgtatgctatgtagacttaattaatgccggatttgtatagaacattgtacttcgagtccaacattggaccatccttgaaatgtctcagctttgtaccctgatgagatctttcagaattccaccaacgcatctcactatctcattcgtgaattaggattttaaaactcctttaagcaaaacatagttcaaatacttagcttgattagcttgttgccaaatgtatatactaaaagaaaatacatatacacgttttgtaataaataaatgtttcattaattgttgagcggaagaatggtgaaatcttacttatctttataaaaaaaacgtagaaaaattgaatatctaaaagcatataaattgtgataaacatcgatccaaccctagcagattttatttcttaccattattttgtctaaatgtatatattttctataagacttaaaacatcttgtttttcacacacttataatcctaactaaccaaaaacttcaagaaatttcaattcatttaaccaataagtattacaaaaaaaacaattctataattagacgaagaggaaccaaattaataaacgaataataacataagtaaatcgaatttcagtaactagccatacatcttttcgataataacctgaatgattgataacaattcgacaacatttgtataatagaaagtgaaaggagacttttgtatcggtccattatttttccattcatcttcgcatttgaacatatagtgtgagccatccactgcagaaagctgagctatggactcgagcccttcttcttgtgcttcttcataagccttttggaagaaagcagacgctaaacagtagtgctttccgcaaaaatagagtcgtcgagtcccaatcggaccactaaacttttggcgaactttgttgatttgtttggttgccttggtcaattggatttggcattgagaaatctgataataaattccaataagaaatcaatactttttacgtatgaacaatacataataattaaaggaattacaaacttactgcaataacaagcacatcatggaggtcgcgtgcggctaagatacgtatgtccgttccaatgtatttcaagcagaagttgacgtcatctgtatccttgcaaaatgcgtacatgtccttgatagacatcgcatctgcgactgtaaacgcaaagaacacgaatactaacaacgacgaaggcaaagttaagtgtttgatgagcattgaggccatactgagaagataccaatgtgtttgttatttttctttttgtaagtcaaaacatttcatttataatgacattgaaatctaagaacgttacttcataaatcacggaaagttatggctttgaatggaaatatatcaatttagtaataactaagaagagtaaaaatcgcaatggcagtaaatgtctggaataatttactaccacaacttggaaacgcatttgaatttcataaaagacttggccgacaaacacatggtgatgttgccctaaaatttgcattcttctactctatttcatcagatatcttagcataacgggcttctttttgtcgaagcccaaatcgaataagaagcccatctggaatttgctctctcccactttgatcaatcgttaactctaagaagtaggattaactaaaaccctagatttagtgggaaatccactatagtgtgtgagcactattacctacgattttctgttctcatttgcgttttttttttctggtcaaccatttgggtttttctttcaaattgtcgggcaggaattacggattttaataaaacttaggaataaataaataattaaaaaaaaaacagaaacaatattataataaatttatcttttgagctgtgtcctcaatgaaaccttaataaagagaaccctctctgcaacatttaatactcataacaaaacctatctctctctgtctttactcattgtcgttatg

SEQ ID NO: 28600 - DNA, 3003 bp, Unknown; identical to SEQ ID NO: 28599
  misc_feature (1)..( 3003): 2750-1469P.txt file - cDNA_ID_2997756; gDNA_ID_2926232; Annot_ID_203736

SEQ ID NO: 28601 - DNA, 3000 bp, Unknown
  misc_feature (1)..( 3000): 2750-1469P.txt file - cDNA_ID_2997791; gDNA_ID_2926234; Annot_ID_142709
agcgtgaaggtgaagaggatctaaactgcctcattaaaggagagaagtgataaagttaagaaccaatttagaagctaaaaccttttattagaataatagaaaacaataaagcaaaacaacgattttattcttgaggaaaatttattgatttgactcagatactctcgacgagtttgaaaaaggctttcactaacaaggagaagaaaagattttcaaagaagaaatatggagcatgtgaaaagtttggaaggtagggtatgtactgcttagacaaaatcataagatgatggaaagagacaccgtaggaaagaagtatgtgaaatatgtgtttcaaaacaaaatgaagtgaagagagattaaggtgtgtttggtctgtgaagcgttaaagcaacaaggacatgttttgatggtggtgttttctaatcgtatcaatttgaatcaagttctcaaagatataagatgaggtcttttagtctgggaaacgtgaaggtgaagagaatctaaaatgcaacatcaaaggagagaagtgatggagttaaccaatttagaagttaaaaccttttattagaataataaaaaaaaaaacaatatagagcaagaaaaaaaatttcatagaaattcaaacgaagagtttattgacttgacttaactacctctcgacgagctcaaaagaaaattactaatgaagaaagggatggattttcgaagaagaaatatgaagcatgtgaaaattttggaaggtatgacacgtactgcatagacaaaatcataagaggatggaaagagacaccgtatgtgatataaccctatttttagtgttttaaactatgttttaaatatagagttttgagtctttttgttatttctagagtctttttagagtcttttcaggtattctatggagaaggacaacaatgaagatgagaagacattttggagcaaaagctgaagaaaagaagctaaaggacgaattcactttcagatccagttgatagtgtcgatccacagactcttcgtgtcgatcgacaccagttgcggccgaaagaagttcatgacgcttttaagtttgaagaattagaaatttgccccagaagacttctctatttttattattagtccctacatgttttttaggtcatatatatagttttaaaggtcattgtttagacctatcaagtttcctagcaaccaagttattttccagagtactttcataagctattcatcccctgttttcagagttttatcagagatttcattactagtgaagagatcttttctaactcttttctctattgatttgtttatactttcttattcatacatgttgtttgtttcatctatcatgtctaagttgttgcttgttagagttaagatttctcactagggattcatatgatttagtagattgctccttttctaggttatctgtagaattcttcatctttagttgttcttaatactagttctagagtaattaactagaacttgattcgagataatagatatacccaccataggtatctgttactagaactactatttgatgagcctggtttataggtgtgtaataagaatcggcttatctactaaggtgaacttatcgaactcgtttagcatgcgtgttaaggtataggatttcacggcacaacaccgggaattttagctctaggcatagtgagtttcacggaacatcaccagttattctgatattagaatttgagtttaagaacggtttgataacaacctagctatatctagatctactaatcaattgtttaatgagaataccctaaacccaagcatcttattagcttgatttacaaccaaccaatcctgctatttgcttatttactatgtttttattttcttacactcatctagcttaatctcaatacttaggttcattttgtgaacaaaagaactttgtgaaattctatccttaagtacaattgacgatctcttatttgagagagtggtcttagggtaatttgatatacgtcaacatgaaagaagaaaacaaataaatgagtccttgcaaaaagatagaaagagtgatagctctttcgaaaaagatgtgaagacggaattattgaaaaaacatgtgaaaaagtatagttgttaaaaaacgtatagataagcttatgaatatattttgtatagaatcttatttttagaaaaggtatactaatcatatcttaagtcgaccaattttttcgtaccattcactaacaaaagcttcagaaatatcctccatgatccaattattgaggttattctcttggcttcctccaccggcgccggtaaagcttatgcttgccggcgtcaggatctttgtttctctgctttcattggctcttctaaatcccctgtatctcgctattgttggcctttatctcagtcagccccattattcccctttaatccaaagctctttgatgtttcttcggatgttgaagctaagagacgtttcccggcaaccccgttcccttgccaagctcaacccacgatctatccatcgcttttgaacctcgaggagccatcctttatcagcgagactccatactcgcaactgtgacgatttgctccggcctgcccagatgtgctatggttggatctctctcgtcttcccatgaagccgtttctcaccggaaactgcaaccagggggcggcgcaaccctaacatatgaagatgcctctggattggatcttgtttctcgcctattgggctcaagcccatattttcgttcattgagacccacccctttaaggtgctttccacgccttcttctgcaaaagaccaggttctgctttatctcttctccgattcctcactgcaaattgttgtgtcgatctatggaaccaattgttcatggacgccgattggatcctaatcacactttgttgcaatgtgggttcaaactttgtctgataacctggccattagaatcacctaggggttttacttttgtttttagcaaccatgtttaaggccaaatg

SEQ ID NO: 28602 - DNA, 3000 bp, Unknown
  misc_feature (1)..( 3000): 2750-1469P.txt file - cDNA_ID_2997803; gDNA_ID_2926234; Annot_ID_142713
gatgcatttaactttactttatatgaataaacattatataaaacaatttgtaaatagtaatatataaacccgcacgtagtgcggatactcatctagtacaaaataaaagcaagtagtgatatcaaattcagcttgtaaactgaaggattaaattttaaaactgtatcaatattcgatgccaaattagtggatatgatgttcgaattttacatggataaaattttaagtaaaataagtacaaggttcaaatattaagtattctaaatatatatcattatgagtgtttaatttatgttgaattttgttgttttatctctaataaatggaaaaatacaaaatatttcgatttatattcgaaatatatatattgatgctgaatattaagtttggaagccccattggcccaatggttgaccaatggttcattaatacttctacaccgagaggtctggggttcgaatcccagttactccgatttattaacagatttgcatattaatcgaggcaagtgtgtaggagatctacaacgatgtacaattatagccgttcgccaggattttacgcagagaagatattgaagattttcatcaagcgcatggaaaatgagaaagaattttcgtatgtcgtggatctaataagggtcagaaggaattgtccgttatctagttgtactagttgttaattacctaattacccatgcaaacaatcatttacttagtcttaaactactctcatgaggttgtatttcacaaaatgtttccaattaatagtatagattatcatgtcatcttatttaccaacctacttgcatgttaacaagaaactattattcacaaaataatattattttatgtaaatttttttttttgcaaaacaaaatattataaaaaaaaatatatatattttaaacttcttttatgaaataaaatatttagcataaaacaaagataatttttatttttatttttaccttcgttaatatcaaatcaagactataaagtcattgtacaaaacatcgaacgaaaattataacgtaagcaccataaaatgagaaaaatacacaaactatagtgattgacgatgcttttgacatataagtcttactcgttaacagattattaaatctatttttttcgtatttgatcttacgcttatgcaaattatgtttctggatagcatttcttgcttaaacttccatatcgcataccgtatttaaaaccatatgcttctgataacagttatgaaatatcaacattatgataccaaaacttccgtatcataatcactttaactatctttgactttgttttctctcaccattatatcccgagaataaattatgacgtctcagtatagtatgagccatcttctgattgcaattatatatatatcacattgttctccacatcatccaatgatagcatgtatccccaacatccatgtgtatctcttccaacaaatctatctggatcatataactcctacttttatgtgtcttggtttttagagccacacaatcctcaactagagagtttcccaaatcttcaaaaaatccgaaataagtatcaaacaatatctcaatttgattttcttctataagtaaaagaaagatgaaatgtcagtagtgatgacaccaaacaattttgggttgaggaacttcaaaatgttttcaagataacaccaatcaattgaagggatggtgaagaaaacattcggacctgagtaatccttattataaatcccagagaagatggtaaaatcagtgatgatcaaattacttaccaatatgacgctctctaaagatgaagagaaagaaaccgtcatcgttttcaaccaacaaattgctataaccacgaatgtgttctttagagacaaaaccaattgatggagatagagtttgtgagaacgataaagaagatcggcgaccaagggacacacgatggagagcactttgatcgatcgcgttagtagtgaagatagaatcgatagaaaatcgtaacaaaacttgggaatccagaacctcatcttgatagttagagagaagtgtgatggtgagcgatcgagtaagcggataataaaatctataaaaatcaaagttcaatcgctagtgtcaccttttacagttgtaactccgacaatacaaattatttactttagaagagaattaagaaaaaaaagaaaaaaagagtcgccgacgaaccgacaattgtcagtgactctaaaaacaaatatacaaagataaaaaaccaaacaaaaaaataacaaaattaaatttctttcacgaaatatatttttctaaattatcaaatgaaaaaatatttttttacgctctttaacaaaactctaataattagtttttttttgtgaatcgattgtaaaattttttagttatgttgagaagaataacacaatttttttttcttttacataaaaaacttatgtgagttttataaaaagtaacgtgagttacataaaactcatgtagttttataatttgttattatgttgctcgtataaaaatttatttacttaatattgtaacaaaacaaaacaaatttttttgaaaaaaatcgtcataaaaaaaaagtcaatataatcttttttttgtcaaacaagtcaatataatcttagtagtcgttgttgtacaacaaacatctacaatatacttttctgtctacccaaataatataattttcctcttttgtattcaaaaaaataataatttatctctacatgttggaaatatcaaatatagtaataatgtttttaagagaaaaaaaggaaaaaagaaagtaataaaacattctagagagttccaaactccacaaaacctcaaacaaaagcaaacgcaatttagcctcttcataagagagaagtcctctcagagaaacggcagccacatcaaccaacccaaacatcgaaagagagacacttttctctctctctttctctatctccttccaatctctctagggttttcgttacaacggcgaaaagatg

SEQ ID NO: 28603 - DNA, 3000 bp, Unknown; identical to SEQ ID NO: 28602
  misc_feature (1)..( 3000): 2750-1469P.txt file - cDNA_ID_2997803; gDNA_ID_2926234; Annot_ID_203794

SEQ ID NO: 28604 - DNA, 3000 bp, Unknown
  misc_feature (1)..( 3000): 2750-1469P.txt file - cDNA_ID_2997813; gDNA_ID_2926234; Annot_ID_142718
gggttttgtgattcatcctcattatgtttttttttttccaattattatttgttctacataaattatcttcgatgttacaactttttgggatttattatatataaatatttttttggaaactgtttttctcgttaatacgtttctgttaacttagttggtgcactaaatagagggaaaacagctataacggacggtgctcctttactcatatatatacaatctcttcatttgtttctttcgtctgtttctttcccttcctggttggtactaaagaggtataaacaatctactaaaaatagaaatatggtttatgtacatgtgcttctagaaattatacgtctacttagctatatataaacaccagctactagcagtgagcacggaactctatgaattactttgattcaccggatttcataaaaaataatgcttttacaatcttttgcgggacattcccacatcttttcttctctccctccattcctaattaaggtctctctcttttaatttttttccgttttgacaccatttgggtttacaacccataaccaatcccaacaacgtctctctgtttttattttatttttaatcaaccacacattaattaaaatataatttcatgaccagaatcgttcaaaacattttaagtttcatgtacaaacttaaaaggaaattggccctcaaacttagtcaaattctgttttgaccatcaaatttatacaaatatttatttatggccctcaaatttactcaaattttttattttgggcctcaaatttactcaaatactttttagaccctgcatatttactctagttgcacatcccaaaaactgttcatgctccattattggttgcccaatttgaaagataagagtttacacaagttacttcagaaaataataatttagaaaactgtgttaaacaatccaccttagtattactcaatcgaaaaatagaaaagatcaaaaaaggaaaataagcatagagcaaaccaaactcatctaaaagattagagaaagcaagacattctttaggtgactgcaccatcgaagttagccttgtgcaatcaatttcgaatgtttgagagtcgatccttcttgaaaaaatattcttcataccccaaattaaagctttcagctccaagtaaagaggggaaagacacatgcggagacactttgcaccacgaagtaccgtctctctggctttttacaaactgaattaggttttatttttcctatgtatatttttatagttttccatattgtggctccactagtaacacatgttattaacgttgaatcccactcaatgttgtaatttgatgtgaattatattaaaatatgtggtataaaatgcatattgatgtaatgacggttattgttttccgtttatttcgttttaacgcaatcttcttttaaaatattaacggttatttttgggttgtgtctttttattgtataatttggttaaaatatttacggttattttgtttcgttgtatctttttattgtaactttccgttcatatattgacggttattgttttttttgtgtcattttatcgtaactttttgttgaaatacagacagttatttttttaggttatgtctttttatcaaaatttctgttaaaatattgatggttatttttcccaattgtttcttttcatcgcatcttttcgttgaaatatttaaggttattgttttaacttattttgtttggttatgtattttttattgcaagtttttatttatatattgacggttattttttttcttttactttatcgtaacttttccgtttaaatactaatgattactttttctagttgtacttttgtatcgtaatttttcgtcaaaatattgatgatttattttttccctgttgtatatttttaatcgcatctttttttaaaaatatttacggttatttttccaataattatattgttcaattatagttgtattttttactttatggttgtgtatttatagttgcatctattcatttaatgttacgtctctttactatatttctttcatttttacatcacaatttttgtatattcaaatattgaatatatcatcataataatttaatatataaacacaatcaaatttttgtttttgtaatttaatccataaatacaaaaatttgttgaaaataagttctcccgcgatattgctgggttcattacctagtaactatagtaatatttattaaaagtttatgaattatcttaaataatataagaaagtaatactaacttaaacatatctaaaatttcagcatttttttaaacaaaaaaaaaatcagcattttcatatatgtctacaaataggatttgattttaaccaaaatagaaaacataaattcaaaaattcaaaaatgttacaaatatataagacattataaactattttttatgatatgttattgaataaaattcagataataacaacattttttctcccattattatttttttttttcgtcaacaatttttctcccattattcaaattgatttaagacaaagaaaatattcttcttagaagttgcatgtgtttttttggttaagttttaacttaacaattttacaaaaatataactcaaaaagataagcgaatcataactcatcagacctcaatctcaaacagctaaactcaagttttaaaaaacaaatgatgatgattagtaatatttttcataactcatggtaatgtgtttttgacagttgtagatcaggcccacgtggataaaagcccaaaaaggaataaagacgaaagagataaaacataaacccaaacttgctttcttctctaaaaatatccaaagcatcaaatccttaacctctctgctaattcattcactcctgaagaagaagaaagaagaaataagtaaataaaaattcctcctttttctggtcattgcttgtctaatgccaattcctaaattgggttctcttcatggttgattcttctctcattccatcgccatg

SEQ ID NO: 28605 - DNA, 3003 bp, Unknown
  misc_feature (1)..( 3003): 2750-1469P.txt file - cDNA_ID_2997821; gDNA_ID_2926234; Annot_ID_142722
agaaagtaagaaatgtgattggatttcagtttttttaggggacaatcccattaaaaaaaaatctaacaaaaccaacaaatcataattgcaacgaattattaacaaaatattctaactaattcatacatttctcatttaaacgtactcgtacctagtaatattatagtaaaccaataaattaccattgcaactataattagtctgtttgtttcgtcaccgtatgcgacaacggtaaattttaccacagattattgttcgtttcgtcgctgctgacgtataatttatttttgtttgatgatgctgacgccgactctgccgttgccgcagatgtttatgttaagggcaatgcaaatctaaatccaattaactccaatggttatataaagagtagagaacaacatatgatttaaagcaagtaagcattagtgatttagaaccatatagtgaaaaagaccgtaagtattagttccaaacattcagacccattatacagaaacagacatagaatttggaaatttagaataaacccaccaaactaagagtagctaaaaaaacacaaatcaaaaagaaactcaaaattcccaagagatttgaatcagtgaataacaaaagtacctcggaatagatatttaacgtcgtatcagaagtaactaacgacgggagatctaattgagctaaaatcaccgaaaaagcgagattgagacggcggagagagattagtttcaaagaacttgagatcgatgactataagaaagaaatgatgaaagaagaagaaaaaataaggttaggtttgtttgtagtttcccaaacatagtaaggatagtcttgtcatttaccacatataacgcagcttttaatcgtttaacgctgattttaattagcgataataatttttagccgcaacgacttacgtttactgcatcggcatgcatccaccaaacgaacatcaccatttgtgtctgccgctgcaacttacgacgaccaaacgaacacactaaatttatcaagttataaaatacaacacctaagattctctgttctagattgatagttcgtagaggtggcaatgacttgctagctctcttttgttttccaaaattatttaccacctcaaaatcttgaaaacttttaaaccacaagatgtatgtataagaagtgtctctaagtttagcaagtggtatgaatgattaagtatccttttactcaacgcttacattttttttttcgttttttttttccttttttctgtttccaaaacttttaatggtatatcttaaactaagttttttcgtaatttatggtacttttttcgttgattttacattttaaaaaaaaaacagaactttcaatactaaataataatatttgagattttaaaaatgataaatgtatgagttgacctataatgctaaaaacctacaagtctacaaaaacacatgaatcaatatgcataagctataaaacctatatggacttgaccttaaaacctatatatcttgaccctatcctaaaatttaggtttcaatcaccatatgacatatctatcacatttcgagcagaatctaaaaaacatatcctatttatatgattttgatttttggccttaaaacccaaacacatcctaaactttaggtttcaatcaccattgacatatctacaatgttctatcgcatttcgagaagaatctaaaaagaaaaaactgatttgaagctttaatttattatacaattaaataatttgttagacttttaaaggatttagtcacgttgagggatcggccacgtcatttataagaataaaataatatcaaatcattatagttattattagtaacagtggtatagagggacaaggagataagcaggtatcgtttccattaaaacagctggatttgtcggcactcattcccattattgtatttatttcaccatatctgtcttatgaccaaaactacaataaacatataaataaaataatacgcaaataaaacaaataatcctcaacattttctgatttttaacaaaatctgtcttaaattataatttattttaaaatgttgatcacactcaatttaaaagtattacaattttcacaattggaaaattgttattagtgaaagtactacattatataaaataccccaattacgtcttgaataacctaaaagaatacaacaaaaaatagtttgaagaaactcattattgtttttaattaaaaaattgaaaacttgcttacaacagatttgatttgaaaatgtcacataaattttatgttcactttgtttataagcaaatgtattataatcaaattaatatggaaactctttaaactatatctgattagctatcttattatatactaataaataaatttaattagtaataaaaacacgttgcataattactttaacagaattttgtataaagttctcatttatattaatggtacttaaagaggtattttataaaaacaattatagggaaaatctttaaattgattatattgaataaattgaattattaagaaaacacgttgattaattagtttaactacacaaaaacttaaattgacttaaaactactctcctaatctttgttaaaccaaacaacccaaataatttactctgaatctttttttgccgtctagattcgtactctgcaacaagtgaactaaacacagaagaagaagaagaagaagacgagacgacgaatccagaaacagagagagagggagagagctttgaatatcttattgtacacaatcttcttcgcatggaagatttctgtttctcgtcactctgatatccaaaaatgtctggatctgattttgatttcgcggcgtttcgagttcaatgctaaaacatcgaagcggtttcgaatctctgagaatcgaaggaaaacgaagcgtgtaggttagggaacttaagattacgttgaagagaagcaagttctcttaaatcgcaactttggagaagtttcgttgttggtttttggtaaagcgatg

SEQ ID NO: 28606 - DNA, 3000 bp, Unknown
  misc_feature (1)..( 3000): 2750-1469P.txt file - cDNA_ID_2997832; gDNA_ID_2926235; Annot_ID_142725
ttttcttcgtcaatatccaacggttctccaaagtcgttggagtccctttgtctgatctcagattccatttcctctccatctaacagcctcgacaaaaccgaatcaagatcctctttttcgtcccaaagggtttgaccttctctccatacaaagtcccagtcaacgaaatcatcagccatcgtttcgatatttttgtgcccaactgacatccctccatatggctcagagttttttacgttgttcgactcacatgaggacacgtggacagcatgagagtcgtccaatagaaaacaagaatcgaaaatgtcgtcattgagacacaaagctccatcgtcgccattaatgcttgggttacaatcgccatcgtctccataaccacatggtcctaaaccgggttcctctgctccacttaagctactacttgacaacaccattaatgcgtcttctttgtctccctctccattctctattgtcgtagttggcaaaacgatgtcacttttgtttgctttaaaagaattaggggttttgtggtttttagggtttaggataaatttgggtttcatggcggatctgctggttcttccaggtctacgcttaggaggcggaggcgcattctcgacggtattggcgacagttggttttctgaagtaaccgtggagtttacggctgagatgagaattccaatagttttttatttcgttgtctgttcttcccggtagattgctcgcaattgttgaccacctgcaatttaattagcgttgacgctattcttattttttgttgtaaaaacgttttttttcacgacgttacacagcaacagtttgatttatgatttcacgtgatagtgtactttttctattggaaatatatcgacattaataaacttttgttcaaatgaaaaagttacctggttcccaaagtggaatgcagtttaacaatgacgtcctcttcttcgggagttatgtttcctctcttgatgtctgatctcaaatagtttatccatctcaatctacagctctttccacatctctttagccctttttaaaatgtacgtcagattttaattaaggcataataatgcctgcagcgattactcatcttttcctaaatattgaaataaattatcgttttatttgtgatgttacagtccatatatacatgtaaataaaacaagaaggcaatttggtctgaattatcaataaacactttatgtactttaaaatattatgcattccttatagaaactgatacattaaatagaaaaaaaaaaaatcaagtctctattttaattttttttacaactcatggtgtataattgaaccgtacgtaagattaattaacttctcgatgcatatagattctcttataaattttgaccaaacaaaaaaactatcttatgagatgcatgcgatagtcgagagacagagtactgtatagataaaaaaaactttaccggcatttttgggaagagaacgccatgatccttcgccgttggactgaatgtagtcggagagagtccggtcttcctccgccgtccagcgccccttcttaattcctaccttctcacagcacggcgcccttcccattctctcggccggcgattattaaaaatcactcacttcacttgttcctaaagtcaatcactagagaaagagattatttaaagagaagtaaagtgacgacacaacaaaaagtgattggtttagtattaaatatttataggagtgacatgcaagaatagagaggagtgggttatatattcaggtgatagaacgagccacgtttgtctatgttgaaacaaaagtcgtaggcgctcatcataggtcgagagctactaaccagctgtccagctgggtcgtcctagtgtctctaattagatgctaactatagtttttaaatactagttatacattttttttttttttaaatactagttatacatttattatttctgacttgtttctaatcatactgctcaattcggattcagttaatcatctaacaattaataaaatcataagcgtaatactttctcaatattttacttcgtatcgtggaaaatatgtaaacaccaattttatttagtttactattgtcagcaacgtttctttatttttcaatggacagtaaaatggtattagtgggggatcgggaccactcgtgtgagatgtctagttattattgtatgtctagtaaataatgtttcgtcgaagatgcgaagaatcaagagacctgacatatgacatgattgtccaaaccagtctatgtttctttgcatgtaattaataagcaacaaaatatgtatttattacttaaccacctttttttgttttatactccagtagtgtttaaccaatgcacaacgtaatgtgtgactaagatagtctagattatataaagattaaagaaataaattttctcatagcagcggttttgtcattatattaacaagtttaatatggtaggtacaaaatccataatgcataaatatgcaaaactagtttggatctggcctccccagatcggtttacataaaacaatctcgattttgtatgggcccagtaacctagggtttttaatcgggttaggccacatttattgaataacaatcgtaggggagttacaggcccgcttcattattaatgcgccttgtatagattatatgagtataacgacgtcgtactcattaaagtcgacgaaaagaacagtcagcgattcgacgttggtttatccacgtggctaatatttattggttacgatcgtcagagacttaatcctgattggttaagcattgcagtgtacacgtaacccgaccacgaggctcgagttttggaatcgtttccacgaaaacaagtagagagagtgattcgagttttccaatcataaaaatcagcgaagaagatcttcgttcttgttcattctgtgaggtttcattgttaaaatcgaaacgaatctcaggttggagtaatccttgggagagatccgatttccgtttccatg

SEQ ID NO: 28607 - DNA, 3000 bp, Unknown; identical to SEQ ID NO: 28606
  misc_feature (1)..( 3000): 2750-1469P.txt file - cDNA_ID_2997832; gDNA_ID_2926235; Annot_ID_203818

SEQ ID NO: 28608 - DNA, 3003 bp, Unknown
  misc_feature (1)..( 3003): 2750-1469P.txt file - cDNA_ID_2997836; gDNA_ID_2926235; Annot_ID_142727
atagacaaacgtggctcgttctatcacctgaatatataacccactcctctctattcttgcatgtcactcctataaatatttaatactaaaccaatcactttttgttgtgtcgtcactttacttctctttaaataatctctttctctagtgattgactttaggaacaagtgaagtgagtgatttttaataatcgccggccgagagaatgggaagggcgccgtgctgtgagaaggtaggaattaagaaggggcgctggacggcggaggaagaccggactctctccgactacattcagtccaacggcgaaggatcatggcgttctcttcccaaaaatgccggtaaagttttttttatctatacagtactctgtctctcgactatcgcatgcatctcataagatagtttttttgtttggtcaaaatttataagagaatctatatgcatcgagaagttaattaatcttacgtacggttcaattatacaccatgagttgtaaaaaaaattaaaatagagacttgattttttttttttctatttaatgtatcagtttctataaggaatgcataatattttaaagtacataaagtgtttattgataattcagaccaaattgccttcttgttttatttacatgtatatatggactgtaacatcacaaataaaacgataatttatttcaatatttaggaaaagatgagtaatcgctgcaggcattattatgccttaattaaaatctgacgtacattttaaaaagggctaaagagatgtggaaagagctgtagattgagatggataaactatttgagatcagacatcaagagaggaaacataactcccgaagaagaggacgtcattgttaaactgcattccactttgggaaccaggtaactttttcatttgaacaaaagtttattaatgtcgatatatttccaatagaaaaagtacactatcacgtgaaatcataaatcaaactgttgctgtgtaacgtcgtgaaaaaaaacgtttttacaacaaaaaataagaatagcgtcaacgctaattaaattgcaggtggtcaacaattgcgagcaatctaccgggaagaacagacaacgaaataaaaaactattggaattctcatctcagccgtaaactccacggttacttcagaaaaccaactgtcgccaataccgtcgagaatgcgcctccgcctcctaagcgtagacctggaagaaccagcagatccgccatgaaacccaaatttatcctaaaccctaaaaaccacaaaacccctaattcttttaaagcaaacaaaagtgacatcgttttgccaactacgacaatagagaatggagagggagacaaagaagacgcattaatggtgttgtcaagtagtagcttaagtggagcagaggaacccggtttaggaccatgtggttatggagacgatggcgattgtaacccaagcattaatggcgacgatggagctttgtgtctcaatgacgacattttcgattcttgttttctattggacgactctcatgctgtccacgtgtcctcatgtgagtcgaacaacgtaaaaaactctgagccatatggagggatgtcagttgggcacaaaaatatcgaaacgatggctgatgatttcgttgactgggactttgtatggagagaaggtcaaaccctttgggacgaaaaagaggatcttgattcggttttgtcgaggctgttagatggagaggaaatggaatctgagatcagacaaagggactccaacgactttggagaaccgttggatattgacgaagaaaacaagatggctgcttggcttttgtcttgaaagatttgacaccatgcatatgcctttttctccgttagattttagcaaagaccccacgtggcaggatctggtcggtttgtcaatagaacatgtttgtcccctagcgttcgttttttagttttaaatgtatttatattcttttttatttcttttcatgtgtaaatacgattttggcggtggcaaataaacaaaataaagtcgatcttcttagttcaattacatataagcgatccattgatgattacaccattgatagccaacttaagtaatctttcgactttcgtatatatgtatacaaatataataagaaatttaaaatacaaaaaaaatataaataaaattcagttccatattgtgaatcagcaattctcactattggtacatagtccaacacttgctagttgcattctaggtggaagtatttcaaagaaacaagtttctctgatagactaataatagaccaaaacccgagcaaatttcaaagcatgtcgccaaccacaactcttttttgtgtgtaaatgttcactggtaaagtggtaattaatgaacgttttgaattttgattaaaagctataagaccatctccaacgagaggatgtaatcaaaaaattgttgggctctcttgtttaatgacaataaaaataaattaaaactgataaaaatcaagagagtcggctttctggagagagttttgagaatttgagagaaccgtcgatgtggcaacatgtgattgggttttcaatttcaacaaaaaaataaatgtgtgcgcgttctgttctatcttctttctcctctctgcccaaacgaaattgaccaaaagatgcaaagcccaatcatcgtttcttctgaaaacttttcgcatttgatatcttttctttgaaactgaaatcaagatacacaaactgaaaccaatttgttcaccaaaagaaaataaaaatgcgtgggtttcgatttcaaagatattcaggaaaagatctccgatagctttcgtctatggcaacactcttttcaattctgggttcgagcttcgtggttttaaaagcttgtaatttcgtgtgatcaagctcctgcgacgccgtttgatgcgattcaactttgaaaatttgatgaaaagcctcttggttatgcttctattgctcaggtattatagattatggtggaaacttaacaattaagtaaacatg

SEQ ID NO: 28609 - DNA, 3000 bp, Unknown
  misc_feature (1)..( 3000): 2750-1469P.txt file - cDNA_ID_2997851; gDNA_ID_2926235; Annot_ID_142735
tcgtcttacttacctaactatatatgctttaataatacaatgttgtaggctcatcgagaagtagggagagaggcggtgaggaaatcaatggtgcttctaaagaacggaaagacagacgccgataaaattgtgccgctcccgaagaaggtgaaaaagatcgttgtcgcgggacgacacgctaacgacatgggatggcaatgcggtggctttagtctcacttggcaaggatttaacggaaccggtgaagatatgcccactaacacgaaacatggactccctaccggtaaaataaaaggtaatttagaatgtcagagaatattaatccgtcacacatgcatgcattataatatcttggtttcccggatctttccaaaaaaaaccttgatggaatcaaatacacattaaatctttccaaacttgatggtggcccggatctttccaattatattcaaggtttaactatattgacatattcgttctaaaatgttatttcgaaacatatatatgtaggaaccaccatattggaagccatccagaaagcagtagatcccactactgaggttgtctacgtggaggaaccaaaccaagatacagcgaagcttcacgccgacgcagcatacacaattgtggtcgtcggagaaaccccttacgcagagacatttggggacagccccacgctgggtataaccaagccaggtccagacacgctcagccacacgtgtggtagtgggatgaagtgtctagtgatcctagtcactggacgtccgctcgtgatcgaaccttacattgatatgctcgatgctcttgcagtcgcatggcttcccggaaccgaaggacaaggagttgctgatgtcttgtttggtgatcatcccttcaccggcacgttgcctcgcacgtggatgaagcatgttacccagcttccgatgaacgttggcgacaagaactacgaccctctctaccccttcggatacggaatcaaaacctaaatcaataacgtacgataaccatgtatttatatgaacaatgtaactgtaacactttcccgatcaatattaattaaatttctgttacatatatgcaatcctatgttagaaattccatatcaaaattgaaagaaacctacaacaatatacataatgtggactatggccatgaaacgtaacatttaacttgttcacgatttgatgaccgatcatgcctatctcattatgggcttgagcccactccttcacctttgtttgcttcgaagatgtgaaagcaagaagattctcattttgagttaaaaaatccataagtctttaaggtttttgtgaaaatggagagaagacaagaaagaccacgtgacggcgaaacaggtcctacctagcaccatgcaatgtcggatgctgagatgcgttgatatttcatggaaaaggtgctttttataataataaaaagatagctaactgtttgataaatggtacagagtataagatttgtgtaattaaaacgttaagtttgctctcctaaatctattaatttttaaaccaaaaaaaaaaatctattaattttgggatgactttcataaataagaattaatgaaaaatatcccattacgagggaacatatagtcgctctcagtcctattttcattcatacgcagaagggaaacggatatacaaaaagagacaagtcggcttttcatataatgtgatcaacaacgatgatgatgattaatatcatgtgtttaattgaatatcctgaactgtagtaaatcaaacgagagcaataatatgtagatttgttggtgtcgtagatgtttttaaagagaatgtgcatttcaaaatcactagctaggccataggtgatatataggtccaaaaaacttctaggttatagacaaaacaatggtagcaataatgcataaccttttgtccgatgacagaaacgtttggtgattcttcaggatcttaaacacgtgaggaaattattttgtaattcactaaaattctctacaattttcacttggttcgaggtttgttgttgagataataattaatcaatttctatgtacaaagcatattctctactccaatgtcatttttcttttcttaatttagtaaaattttaaaataggattagagcaatagagctcataagagaatctatgttcgtttccataaatacataagcatagatccaaggacatatgcattggttccattcatgataaggtcacgcatgaactaccatttttatacgattacattgatcgaacaaaaacaccttacctcattttagagttcaagcttaatcttccaacgggagatgtattgggactttaggattgttatatttgttaaaaaaatttgaataatgttaagttttcaattagtcaaaaatagctaacaaagcaaggctaagaagataattgaccatgctatgatcagaatgtcgttagtatcaagctattaaacactctttaatggattgtcaattttaataacaaaaagaaaaacccaagagactgaaactaaacgtcacatgactcacatggtccttggatacgagttatcaaacaaggagagatctcaacacttgagtccaaactaatcttgtatagaaagtgacatccattttctctactcccactctctcaagtccaagttaattattcgtttccactcaattttcataactgatttcctcacacgtgtcatgcagagacaatacattcacatcattaaattactaatttagctactgattagagtcgtatttttgtcttctttttctagtcggctataagtaatcaatatgaaagcagcctttgattgatatcattatcaatcttttcaaatgtttaatacttgtaaaacaattaataataaaatacaagttcttcttgcatcacacaaaacattaaagttgataacaaaccaagaacgatcataaatactagtaataaattcagagagatagtattatcttcaagtttatcatcttcagagagagacgatg

SEQ ID NO: 28610 - DNA, 3000 bp, Unknown; identical to SEQ ID NO: 28609
  misc_feature (1)..( 3000): 2750-1469P.txt file - cDNA_ID_2997851; gDNA_ID_2926235; Annot_ID_203830

SEQ ID NO: 28611 - DNA, 3003 bp, Unknown
  misc_feature (1)..( 3003): 2750-1469P.txt file - cDNA_ID_2997863; gDNA_ID_2926235; Annot_ID_142739
ccactagctgatatacattaatatcttaataatcactaatagaaaattattatgtcgatcgtgtatatagtgtagcttaacgtgtaccttagtataatttgtaacgtgtatatatataacatgtaaatgttttgttataacatgtatttttgcattagcctgtttttttatagagtttagtaaagcttttactatgcgtaagctattagaactattttaaatctaaactaatttgaaagtaagattatgaatatatttctttcaactacttttagttttgatacatattatatagtatggtttttgggttgccagaattttcaaatataaatccgtaaatagcagtagcaccatattactcttctcctgcgaaaatatatatacacaatcatagttgattacctttttgatattgaagtagacaaggtaagggatggttccgacataaccggtaaggccaacataagggatataatatgaagctaagagatagttgagtgagttggcgtaaggatcaaaccgcggattagatttgcgtccaaccgctctatccataaacactgcgaaattctctctcgtcagatttattagcggacgtggaattcctcccgtcatatccgtaatcgcccttcaatatcatcgtaacttattttaaaattttaaaggtcatgcacaacaactattgaaggaaaatttgaatttgattgttttacctaagatgaccgatttcttgataaccaaactcctcgatgattcgattagttataggatcaaggttggctttcttggcccctatcggcggtggtccgcctttagcaagtgtcgcgttataggcatcaagtccttttccggtagccccttttaagaagaactcggcctcggtgaactccaagttcatcgcgaaatgaactcgatcgacatcgctcgctgatatattcccggagcaactacaagaaccggacttagccggatttgcatctactgcaataaccaagacgagaacgagacagagtttaaacatgcttttcctttcgtctctctaataatttatgtctacaaagcatgtacgcaagaacttagcaatttatatagggttcaaattttattttcgtctaacaattcaacgatattaagttataatgttggttagaattgaattgtttaggacattacgtgaatactaagttgatagcttatttaggtatcaatggaatattaacaagtttttctatattgctaactaccatacaacatttgacatttgtcattacgtaaggtaattaacatgatatacctgattcagtgaaatatatattattatcacacgttactatatgcccttgactccttgttatgttatatgtttactctcaaccgatccaagtaggtgtatggaagataaggcaaaagaagaagaagacgtggtaacttatgatggtgactaaatgaaaatatcgataccgtaccttaataagttaagcgatatctgcattataacttgtggtcaatgaaattacaaccacctgtcaagaaagtaaaatcaagagtgtggtcatttataacaaccaatctatgtatgaatgtatctaacttactaactcaaatcaaacttatatttagtttatctatctaagaaaaatgtgtttgacagcatttcgacatgaaattgaaaactagagtcttttcctgaatgaaaaatatttcattggaaaaatataatttatgctttcgcatggtcaatgaactgtacttggtcctgatgattcaagaggtttttttaccttttagattgagggtaaatattatgatcgtatagtatatgattaacacctattaatattcttggtcgtatttgtacaacatttttgaataatattaaaatataaacagaaatcattacagttttatatacgtttttataagtacattattataaatttataattgattttcagacacattttgtatcgtacatatttcttttaaatctgcgttaacagactagcatgagaaactagtgggccttatcttggaatggactgcgtttctgatgctcatgggcctaatcttggagtggactttaatttagtcaatgaaggcttaatttgtgaccagaagataacatctcgattaaacataattgtttgttttgtttactaactaattctaaatcatcccaaagcccatgatgtatctggatttactctgtttaattttgtacggaacataaatctgaatatttgcgactagtaaaaacaatctcaaaaccgtttgaggtaacgcatgcggaagcgcatctggtgtagtggtatcatagtaccctcccacggtactgaccagggttcgattccctggatgcgcaaatttttattttaaaacttatcacttgccaaaacgagttatataattgagcatttgacttttgctggagatttgtaaccatgaatcatgtggcagctctccttttggaaagggtccactgtcttgtcttcaccaactttagtacaaagagatgaatccagaagtaaccacaaaactccactcactcttctcttctctttctttattattaattttttcaccaaaccaaatacattagttgggcttaggcttgcaattacaaaacagataaaattagggtaaacgtgaacacacactctttctctttcaatctactacatacaaattatcttagcatgaagcgaaaggggtaaaaactcttaatccaccaattagaatttttattccaaaaatgaaagattagttaacgtttataattacagaaatttggaaatgtatgtcggtcacacatcataaagactatacaatactgaaaagaagataaacttttagtcatctgtcacagatattgtcgctttttacgagtggaaaatggaatagaaaagatccacctatcactcactacttaaacagtccaagaacacgactaaacactaaacatgtcttgtaattaatcaaagacgaaaggaggaaacaaaaatg

SEQ ID NO: 28612 - DNA, 3003 bp, Unknown
  misc_feature (1)..( 3003): 2750-1469P.txt file - cDNA_ID_2997867; gDNA_ID_2926235; Annot_ID_142740
catgtcttgtaattaatcaaagacgaaaggaggaaacaaaaatgaaacctttctctcaatttttcgtatttgtggttaccgtttccgcgacaagctacattgatgccttcactagaaacgattttccaaatgatttcctcttcggagccgccacttctgcttaccaagttcgactctgtttctgtgttttgtattgattataaaattaagttttttttttggttctctgaatgatgttggtggaaatagtgggaaggagcttttgatgaagacggaaaatctcctagcgtctgggatacaacctcccactgtggtaagctttttttgtttcaattagtttaaaattctttgtatacgaaatatttatagatccttgttcaaaaattgcagatagtggaagtaataatggagatatagcatgtgatgggtatcacaaatacaaggttagtttcttttctttgccgtttacttgtctaacaagttatcgtaagtctctggccctgcattcatagatgttattgtccaggaagatgttatgttgatggcagaaatgggcttagaatcattcagattctctatctcctggtcaagacttatacctagtaacgcctattcttggtttcttaatttccaagtaactaataatgttgtctctgacctcttatattagaccctttttgtctgtgtcatgtttcagatggaagaggacgcattaacccaaaaggtctattgttttacaagaatctcatcaaagagctacgaagccatggtgaggtttttgtcttttactttatcgcaactaaaaccaattcatagcttttgggttctgatagacatattggtaaaccttttaacaggaattgaaccacaggttacactttaccattatgatcttcctcagtctctggaagatgagtatggaggatggatcaaccgcaaaatcatgtaaaaggacaattaaagattctgatataaaaaatatggctagaaaataaagaatatttgttatattgcagagaagacttcactgcttttgcagatgtatgcttcagagagtttggggaggatgtgaagttatggactaaaatcaacgaagctactttattcgccattggttcttatggcgacggaatgaggtatggacattgtcctcctatgaattactctaccgcaaatgtttgtacggaaacatatattgcaggccataacatgttgctagctcactcctctgcttcaaatttgtataaactgaagtacaaggtatacacatttatctctgtttcgctcttaaagccctaaacccatatgaacataaacagtatgatggtacagactaagcaaagaggatccgtaggccttagtatatatgcttatgggctatctccttatacggactccaaggacgatgaaaccgcaactgaaagagctgaagctttcctctttggctggtgagaaaaatgctttctttgtttcagtaacttgaggataaaatctgatgactaaattggtaatccaggatgttaaagcctttggtagttggggattatccggatataatgaagagaaccttggggtcgagattaccggttttctcagaagaagagtcaaaacaagtgaaaggatcatctgactttgtaggagttgtacactacaacacattctatgtcacaaaccgacccgcaccttctctcgttaccagcattaacaaactcttctttgcagacattggcgcatatctgatcggtaagcctagtttcttttcattcgatcgaactcttttagttgatatataactcttcttcattggacagccgctgggaatgcttcattattcgaggtaaggaccaataaatccgcagaacacacaatacatatattcaggccaaaagctctggtttgatccttcttgctttcttgaagtttgatgctgttccatggggtctggaaggtattcttcagcatataaagcagagctataacaatcctccaatctacattcttgaaaatggtacaaacttcattctcttttgtctacttgctctgtttttgatcttaagattcttcaattcacaccaaaaaaacacacaaaaaaaaaaacaggtaaaccgatgaaacatggttcaacgctacaagacacaccaagagctgaattcattcaagcttacattggtgctgtgcacaacgccatcacgtaaaagaactctccttcttcatcttcaagttcatcatactagcattgatcgactttattcctgacaaatattttgactgatcaggaatggatcggacacgagaggttactttgtatggtcgatgattgatttgtatgagttaataggtagatatatgaccagctatggaatgtactatgtgaatttcagtgatcctggtcgcaagaggtctccaaagctctctgcttcttggtacactggtttcctcaatggtactattgatgttgcttctcaagatactattcagttgcagagaaaatgctcaggctcttcgtccttgtaatctatttaactaaatcatcctagttttgtttggttttcatttcatctatcgtatgaaaaaaaactcagtggtttgataagatttggatatgaataatgaaactgtcttgtgatttttgtcggtcatcataagatttggatatgaatattgttttgttattttccgaaatttgtttttaaactacaaccgaaccattatgatgtgttacctatattggcaatttggcatgtaggtagagtcagtacatggcaaggattacacacttcaccaaaaaaaagatatttctatagtcgttttcagatgtttatttgtcgcgtattacgagtggaagataatagaaaagatatagactatagtcctcacaattcaccaaaatacacttcactcaatatatgtatttctttttaaatggtccaagaaaacgacagaaccggactcttcaattatttgttcatttggactcaaaccggaggaggaaaatcaaaaatg

SEQ ID NO: 28613 - DNA, 3000 bp, Unknown
  misc_feature (1)..( 3000): 2750-1469P.txt file - cDNA_ID_2997871; gDNA_ID_2926235; Annot_ID_142742
gaagactacctcgagtgtcttcaccattccaaagaggttaggtttcgcctttttcctttttttagggtttctttcaattatcgttcctgtgttgttgtatgtgtcatcaattcacgcttttgattgcttgatctgtttcattgatgattcgtcctgttatcggtcgtctgtacgatcatcgatagtttctggatcacgagtttaagtcattcctagatccgttggaacaatctctcagtctggtcgtttcgtttgctacatgtataaaaacataagctttctttttgcttgaaactagaaaagttgaattgcaatctcccaagtatatatgtggatgctttcactaggttgcttgtagggattaggttaatataataccacttcccttatctgagatttagtttcatggccatgaattgtttagctgttaagtttggaagttgagacttactctttatctcttgtctctgtttgatctttcaaatggaacgatattgtctctcttctctatgtgttgaaatcataaatttgaatgaaactgaatgtataggcttgcgtgtgaacttttgagggaatcaaaagctttattattgttgtctccaatattgtttctttcttctttgcttagtataagcctatggtagatgaactgataaggagcgcatatttgtgtattttgatctagttccaacgaagaaacaggatatacaaagaagaacaacgtaaactaagagctgcatcaaggaaaggcgaagaaaccggggatgggactcatactcatcactagtcgagattttcctcctatctccaaagtttgcatctttcgaagaataaacaaaagtttcttgaagatttctgtatcttgtgtgccaaacttcatttgatcgtattcagtttgcttttgcaatggatttttttgtctttgctttgtctattacctttgaccgagttgtaatatgcctttggctactcgtcaaacacagactccttctttaatggtaataattactcctacagttatattaaaatcattattcgagagacattaaaaacagaacagtgggtggaataatgaaaaggtcctctataaatagttgtcattgactttcacttagtcttctctgcaactcctatatgtaatgtgtctagagagaaccagctttttcattgggtaatatcaaaatggggacgagatctctagaaataaatgtgacatcagcaaaagggcttaagaaagtgtcgaagatggatgtttttgtggccgtgaagttatccggtgatccaaaatgctctgaccaccgtgagcagcggacacaagcggcaagagacggtggaaccagccccaaatggagcaatgatgtcatgaagttcatcctcgaccaaaacttagcagaggctaaccgccttgtgatcactttcaagatcaagtgcgagcaacgtggaggagtagataaagacatcggcgaggttcatgttcaggtgaaagaacttctggatcatcttggaaacgataagaccggtcaaagatacgtcacatatcaaatcgggaaatccaaagccgatattagtttcacttattcgttcacaggtccggtggaggtcccgaccggtggcggctgctcacggtacgcagctcaagcgccggtgcgtcctgtatcgacctaccggcccgttttgaacggacccatgttgagtcagttgaacggacccgtgttgagccagttgaacggtcccgtgttgagtcagttgaatggtcccgtgttgagtcagttgcagggacccgtgttgagccagttgaacggacccgtgttgagtcagttgctaccaagtgttggatcgtttagttacaaccacgttccttgtcagccaccgatttatccaccacttgctcagcctgagattcttccaccggtatgcttccccggattgtatccgccgagtaacatgccgggaagtccacccacaatgtatcaatctatatttcctggcttatcatgtccaccagaaggttattcaacggtggctccgccgctgacacaaccgggactatatccaccgatgagtccttacagatattaattgattgtcaacgtctggaagcctagtcgtcggtttggagatttgttgattttatttaactaatgatgtcatcaattcccccaacttgtgtgtgtgttctttttcttcgaactcaacataaaaattgttgtgtgtttttttctctctttctaacaaaatcacaccctaaattgttacgttctttacttagacgtttttggtttgtaaaatgctctatctgtatcatgtttgtactgtcttgtactctccaaaaatggttcaccattgatgaatgatgcacctggttaatatatataacaaacctttttggaaaaagaataaaaattgttgcgttttttttatttttgaaaaatcttcttcataatattatttctacatttttttagttggcatagataaatgcgagatttatgtaacaatcaattaattatccttcaaaataaacaataggaagaaaaaaaaaaaatgatttttaatgaaataacacatttttttattgtattttcatttataaaaattcaaatatattttataacctaatggtaatagtatattatagttatacactatagtaggatctatgatatctatatctggagtttatctgaatcgtaaagcaaagaatctaatttttttaaaaattgtcttaataaaaataaaaaatctggtgttattcacaaagaaataatatttctgaactgtaaaaaaaaaagaatcagttaaaaattccctgtaaaatttgatattatccaattatttgttaaataaagaagtcgagtagccgcctgaaagatatatgacggcaggcaacaagcaaagcacgaagtcatcttcttcctatttcttctattcctccttctccacgcttcttcttcttcttcctcaatctctcttacgattccttcaaatcattcttccatg

SEQ ID NO: 28614 - DNA, 3003 bp, Unknown
  misc_feature (1)..( 3003): 2750-1469P.txt file - cDNA_ID_2997883; gDNA_ID_2926235; Annot_ID_142746
ttgggttgttttttcaaatttaatagttaattttccacttttaaagaaaacaattgcttttcattgttttggagaaggtagttcacgcccatggctgtttctaagctagggaatcttttcttatgtgagagtgagaaaaggttgttcaaatattacccagagacagactacctttgttgcctctccagacttttgtgttataacttctttcgtcgaaaatttagtctcacttcgttccaggcccgactcaatattattttgggttctgtgctaaaaaaaaaaatatcccctttaaacctttaaatccaaaaaattttagtttacgtggcagtgtttactgtctcttgtaaacgtaatacacttgtagttctattcaaccattgtaattttatctagaaaaataaaaattcctataaattaggaccctaaaatttaagagagaaaataaggactctgtgccttggcactgctggcacaccctgcttcgttcacaaccaggatctgttcggaaaatcagcacttgtgggtaccaatatggacttagctatgtacaacctgaatgtcttccgaaaatcatcagcacatctccgcaccggtctcgaatatctaatatcgtgatggaattgctgttcccaaatattttgcttacctctactctagtgtctctaattatattcggttatcgttacaaatattctacttgaagcggttacttatctagctggttttgcttatgtctacatcttactatttaatatttattctgttaagcttttccataatctattaacatttaatctcgccttgtttctaataaacacaatgctttaaaacaaaaattagtcattacacagtatacatactacatagcatattgcttaagaaaaccagagacgagaagcattctatttctacaaacagatgagatatagcttaccttaacattctatctctacacttattatgcatcaaagatgatgatgtcgttatggcttcacaagacgataggctataaatttatcatctctaaagagcatctccgcgtcttgaggaagagttatctcggggttccatgggcgacaaactacatgttggccagttggtatactcaggtggccagttcccattatgagcttctttttctcactctcatctactacacatgatgatgtttcactaccatcgtttgtgggattctgaggcatccacgaagaacaagcagcaatgttcctcttgataccattggcagctggtgcattaagagtaataacgtttgtaggattgtgaggtataggcaaagaagaagaagcaatgttcatcttcataccatcagtagttagtgcactaagagtaccatcgtttgtaggattctcaggctcattcaaagcaacgttaatctccttagcattactggctggtgcatcatgaagatctggaaattctgcacagaatcaagactgtagagcatgagttttgaatgaattaaccatcttgaccatttagcattaaactgaaattggaatccatttcatgcagttaaagtaaggttggctttcttatttcatagctgtttcctacctatctcaggaaaatacgtccctctgattggaccacaagttataacaaagaaagagagtttttcctttaacaaacaaaccaacggattattcatgtagtgtagtattcaaagaaaactaaccatcttcattcactttaatcccctttgatggggtatcaggggtcatcaccaccttggaagaaggttgagaatggatctcttgtggactgctcttcacatttgaatttacatcttcttgtctctcactaggcaaagtaggcgatccggtctggttcgagttcccatttttgatactcatgaatgcaactttagcagcgctcatttcagccaactttttggttttcgcctcttctccactgaaaactttaccagcaaactcaacagttgaagtaaaagtaggcgcatgcgatggaccagatgtagcagttgcataaaatggtaacagagaactctctttctgtgcaatttcttgtaacaggttcttgtaggcaacatcaattccctgaaacaacaaaaatttgaaaatcaaaatttaaacaaatgttgaaaaagcacataacttgtagtccaaaaagagtgtgaggaactagcctctggactttgtggcgtcaaagaagcaactgcaatttttgcagcggcatgttcagccgattttagtgtcggaaagaattcagagctctggaaagtctgtccacagaatgtaacattacatctaaatctaggagcatgaggaggcccttctctctcattcgcatacactggtagctccagattatgttgcagggcatacgcttgcagttgacctttgtatacatgatccatctctatctaaactggcaggaattaaccaaacataaagagatcaacgtgtatcagaatttctcaaacataaatggcaaacgaagagacgaatttcagatttcagaattggtcaaccaaacataaagagatcaacatgacaacatgtatcagaatttctcaaacataaatggcaaacgaagagacgaatttcagaattggtcagactcaatgatctagggtttcgtacagatcgataacatcaaaacagcgaaaggaatctacgattataaacacaaaatcgtacctctttgaaatggtgaagacacttcgagggaggaagtgaacaatcagacaaagcattcgctgattgaaactcatcgagaaaccataataagtatacacatgtaaattgtctcaaggatacgaaagattcgggttaacccagcttgaacgggtatgatccgaaataatccattaatgggccaaaattgggcttattcatgaaagttgtaaaggcccaatgaaactcgaagttgatcagaaggttgtcggcgaccaaatttctaaatccaattttgggagggagacgacggcggaggttgaaaggggaaagagcagaaatg

SEQ ID NO: 28615 - DNA, 3003 bp, Unknown; identical to SEQ ID NO: 28614
  misc_feature (1)..( 3003): 2750-1469P.txt file - cDNA_ID_2997883; gDNA_ID_2926235; Annot_ID_203842

SEQ ID NO: 28616 - DNA, 3000 bp, Unknown
  misc_feature (1)..( 3000): 2750-1469P.txt file - cDNA_ID_2997887; gDNA_ID_2926235; Annot_ID_142749
ggtggacgtcgtttggtccatagatcttctatgtaatgataaactaaacagagaagaatctgttttattttgtacttcagattcgttttcctaaatcaaaccaccatcgtgtccaaactaaaatacatagacttcttgtaagttgtaacgaaacacaaaacagctacacgatctttctttacatgtttgaaggaagagaatctctggacttatatatgaatatttaatgggctttagtctcctcaggcccaataaataagtgggcttaaatttacccctcttaaaccgccattgtaccacttgattttctcgagtcccttcttcatcacgaaagcgggatttagcgttagcaggtaaaaccctaatttcttcaagaaacatatcttgttgaataagttaggtttctttgtaaaaatcattgactcttgtgtctgtgaatttagtttaggttgagaggatgtatacgccgggagcggcgaagcctgagtacgcgagagctaaaatagctgtgtggtgggacatgaaggactgtccgattccagagggttatgatgctcgtctggtccgtccgagcatagaagcggcgttcaatgaactaggctactctggtcctatctccatcaccggctatggtgaccaaagagaaaccccttgtcagatcctgcgagggctctcttccaccggagtcgctgtagcacaaatcatacccggttagtccaattgctatcgatctctttgaatgaatttagtgctagcttggtttaaatttgaacaacatctcaagtcaatttcaacagaaagcagatgctcactcatgtattcgagtatgctggagtggcgagatcttaatcctcctccggctacaatgatgctcgtatccgatcagtggcagcatgtcttcgcttgggatctgtcccgtctacaacaacacacgaaatacaacctttttctggcttattcaactgagcctttcgcaggttcggcactgagaccttgtggagagtggatctggagaaatttacttgagaccaaaagggaatttgttcaggacaagtgcagcagcagttgtgaggtatctcccatgttttattgcaaatcttgctcttaccagggccaaagcgtggagggtttcaggaggcatgtctcgagtggaaagcatgcagtgaaagtaagtaaacatcctcctctagacccagtcaactataatgttgaataaaaatatagattttgatctctaaaatataaattctcgcaggaggttacaaaccgtatacatccagaacttgactatttgacgaggacgtgggcaaagaactacactgcgaagcctgagtacgcgacagctccaatagtggtgtggtgggacatgaaggactgtccgattccagagggttatgatgctcgtcaggtccgtccgagtttagaaggggcgttcaagaaactaggctactctggtcctgtctccatcaccggatgtggcgaccacaacaaaacccctgatcacatcctgcgagagctctcttccactggagtcgatcttgcacattccatcgacggttagtccattcggttaattatatccatctctctggaatttctactgaaatgcttttctgttactgtctgaaacagaagtcatatacagtcgcatgtttataaatatgaagcagtggaaagctcgtaatcctcctccggctacaatcatgctcatatccgatggtgtggtgatgatgttcgaaaatttaatcgccgacttactacaagagacgaagtacaacctttttctggcttattcgtacaggccttacaaaatgtctgtcctgctcacttctgcagagtggctttggaaaagcttacttgttgcaggtgtttttttctcctctccttatcatcatcatccactaatgactctgtttctgagctatataattacgctctctgtttcagagacaagaaaccacgttcttcgcaagtgcagtcaaagtcaaaggggtgaaccgtctaccaaaatgttttcttgcatgttgtgtctttgtgattgcaaaagccttgaagatttgaggacgcatctctcaagtgaagaccatgcagtgtgtgtaagcatcctcctctgtatcatcatttgagcaacaaaacctgtttaactctttccatttgttgtcaagcaggagcgttattttcctgagagaattcgaatgagaaaccgctgtagaaagcaatatcagaaggcaagtttttctaatgattgattaaatattttcaaacatgggatttcttcttattaacagttacatatatatcttgtagacccaagtactagaagattttcgaaagagcaaacgtatgaggaaagcataccggacgggttttggtcatcttcataatcagttacgtcttactaatcgttgagctcaaacctgtcctggaagttgttacttcattttataagttacaaattgctcaaaccctacttaagaaatgtaacgaaagggaccttgtactttgaacaacccatccaatgagaagagctgaccaggctaaaccacgaatctgagcatttttatttcatgtaaaaggtgaaaccattttgaaaagtcaaaatctctgtactcctgtgaatatttgaatgggctatgaaaataataactaaactgaaatttattccaattaggccttaatttataaacaaaaaacatatgaggatatttaatgggctttagtatcttaaggcccaataattagataggcctcaattcagccctcttaaaccgccactgagtttgtttacacttgatttctcgagtacacctcatcattcttcttcgtgtgagagagatctttttggaaaacgaaagcgggatttagcgtatagcaggtaaaaccctaatttcttcgatctgcgtttctatgaaaatctcttgatagtttctaaattcatcgttttcctccttttcagcttccaccgtttcgccgaatttcatcgagcttcaagtgaacatg

SEQ ID NO: 28617 - DNA, 3000 bp, Unknown
  misc_feature (1)..( 3000): 2750-1469P.txt file - cDNA_ID_2997895; gDNA_ID_2926235; Annot_ID_142751
ggctccataggcatagatgctataaagctctctgcttctttgatcaaaccagatcttccgtagagatcaaccatacaaccataatgctggattgatggcgtgataccaaattcctcaatcatcattttaaagtaagattttccttcgtttattagacctcgatgtacacaagcaccgagaatgcccacaaatgtcacagagtttgggtttatgttgtcactcgtggtcatctcagagaacagttggaagcactcatctgtgagaccgtacattgctaagcaacatatcatagcactgtaagctttgacatctttcttggatcccaaggcattgaaaacccttttcgccctctcgaggctcccacatttggcgtacatatcaatgagagctgtgcctaagacaatgtcaatctcaacgtggtacttatcgatgtaagcgtgaacccatttcccttgctcgagcgcacccaatcgcccacaagccgagagtacagtcgacattgtaaactcgttgggtctgacgaatgcttcgtttggtttaggtaattgcatctcccggaacaaatcaagcgcttctttgtatttcccacacataacgtagccgttaatcaagcagctccaggaaatcacgtttctttcaggcatttcgtcgaacagtttccgcgcatcatcgatcaacccagctttggcataagcattgaccacagagttccaggccggtaaatccttcgagcccgagtcatcgaaaactcgctgagctgatctcaagtcgccacaggaagaatacatgttgagcagtgaagttcggacaaatgggtctttgtcaagtccaaaaagaagaatctgagcatgagttcgttgcccaagaggaagatgaagcggattgtggaaagaagggagaagaaacggaaaggtatgaaaatcgggagagacgcgatggttgcgcatacggaggtagactgagatcggagaatgtcgttgaggcgacgaaacattgtgaacaatggcacgaatgatgatgttccacaagaaagattcaagctttagatgtcgaatatgaaagatgggatttgcataagctattattgccgcccccttgctcattgtctcaatctaacaagtgtatcagaaatcgattttaaatatcaagtacggttttgacaaaaccgaattgaaccggtatttaaatgaatatttggtttcttaatcaatgtacggacggagaggtaacaaaacaaaagggttttgtcctaattcaattttgcagagatggaggaagaattgctctccgccgtgccgtgctcttccctaaccgtcgagtcagttctccgtgtcgcgacggtaatcactagtatccaattgaaattcatgtttgtgttagtgtgtgtatagatagatgtctgagatttttgttgaagctcaggccggtggattatatgggttatgcgccggacctcgtgacgctcgtaaaataggtattgaaattagctttgatttagagagtttttacacttttcaattcattaatctgtgctttgttgctgatttgcttcgccaggtttaagcggcgtttctcaggcttcctttgtggcgaaatccattggcagattcggatttcaatgcggtaatttgcttcctctattgtttttccacccaaattaatcttcaatgactatggaatttgggtataaatctgtaattttggacttaagataattctcttctttgtcactagaagaagaatgctgcatatactttttttttgttttgaaagatcataattctctgttttgcttgccatgtaataatatataatgcagatttcttttagttgtaattttttttggattagttgctctgctcttctttaacttagatctaaattcttcaagtagtgattgcttctttagattttggtatatgcatcaagaattcatttttgtttcaggtcttgtaagtggtgtgtttactatgacacattgtgggcttcaacgatatcgaggcaagaatgattgggtgaatgctttggtaggaggagctgtggcgggagcagctgttgccattagcacaagaaactggacacaggttgttggcatggctggcctcgtctctgcttttagtgttttggctaattgcaccaggacagaaaacccaaacaacactaattaaggtgatatttagaacactgaattttgctaataatgcgagtgtctgtcgcagccacattcaccggatattgaaactatcttataagcttgcaggtctttgacaagtccattcaagaaactgtatggaattggaacttgaagatcaatacactgactctccggttcgatcctatttagttggctgaacccgtggatggttcttcttttctatagaccacacttttggtcttgtctctctgtagtcatcatgtacacacaaagtccctcgaacccgaaaccgtatttgcatcaatgcttattactgtataatgttatttacaagatagagatagtcatagaaaaattaaaacatcaaaactgatttttaataaagtgtatgttaatagccatgctgtttcttaggaaagccagtttattcacgaatccaccatttttctacttcaaaatttataaatgtatttcactctttttgatatgattctttttgttctatatgcttttttgaatactaaaagctatcagatcgttcgttgtgtaatttttttctataaaaaatatcgttgatttaataaaaaaatatagaaagtaagatataaagatcatgaatatataattttcttgacgaaaaattattttcttgatattcagaaaatctatattgagagagcaatacgtgtccaaaaacgtaattttctcatctgggcttctgaggaaaaaaaatatttgtatcatttgggcttcagtgtctttataaatagtgaaaacacaaaaccctaagagtcgctcttgctctcagccgtctgtcttacctccagaagtcgacgacaacaatg

SEQ ID NO: 28618 - DNA, 3000 bp, Unknown; identical to SEQ ID NO: 28617
  misc_feature (1)..( 3000): 2750-1469P.txt file - cDNA_ID_2997895; gDNA_ID_2926235; Annot_ID_203846

SEQ ID NO: 28619 - DNA, 3000 bp, Unknown
  misc_feature (1)..( 3000): 2750-1469P.txt file - cDNA_ID_2997897; gDNA_ID_2926235; Annot_ID_142752
gagtccaccctgacgaggtttctggtagaccaaggaaggaacttggcatttgagtttttcagatgcttcttttattctaccaaaggaacaattcacaatggcaacattataacaagctactttcccatctaattatccaagaaacatgtatggattatacagagcaaccaagatgtaacttctggtaccggaatttctatttctcgatcccgtgacagtgacagatagtcccccagtatcaggtcagtaattgatacatcaatttcaatatctttttgtttcaacaagctcttgttttgtctgtgctaacctactttgaatgtgtgtctgcagattctaaactgttctcattcaaaataagccatttagggtattacaaagaaaatatataataatattacaagatttggagttatagtagcttttcctgtagtggtgataggctttctaagttttaggaggtaagaaaaagttgcatctattcttttgcaattttaatttgttgaagttatcttatatttactcaaactcaactctgatgtccttttgttgctctttctcttggcagtgttgtcttttttgtagataagaaagtaaaagttacaaatagagttttgccgtcttgctttgccggaggagctttcttagtcactggtaacttctcgatctgattttcaggtgcagtcttccggcaaagttcttaattaggctttggttcgtgtaagctaaaacaatatgttatgtttttgactggaaattctcgactgagtctatatgtatatatgtatgccgcctctgatttcaagggccttctaaatgtataaactgtgcattgtccatcaaaaatgatggatattatctttaatacaaaaaacatatatgagtgagagaattttactgtcctctgatcagacactatatatatggctattttagttcttttattattttattcttttatttcaaaacctccaaaattcagtaatgtgtttattcaatccaacacaaacattgctgcaattgttatcaccaaaaatctctgcaagagcaagacccgtctctaaaatggtgaaatctattacaatctctcacaacaatttctctactaaaaagcttcgagatcatcttcattacaagatgacaatctccacagattctgaggttcttgatgattctcactggagttccaggccttgtcttcatcaaacagaacgcaatagccagtttctcactgtggtaagacaaagctatctctttatctttctcgttaagatcaagtaaaacctccttagtgtctgtaacatatccagcttctctcagcctctgcattatctcatcgagcatagcatagatcctttcgctctcttgttgagattcgtctcctacaacaaactcgtgaaccactccctctacttcaacatagctacatcccggaactttattaatgccctttacctgtagagagaatctgtatttacttcagaaactgtgcaacagttaagaaaagagttggaaaagagggaaatagttttgcattgcctccatttcgtgtctgatacacttgacttccatccacctccctgttttggcatagacgttagagagaagcacatatgctccactgttcataggatctagctcgatgagtcgcttgagggcaccttcacaagtcttgatatccccaagcattcttgatccgcttaagagagacccccaaataagtacatcaggctccataggcatagatgctataaagctctctgcttctttgatcaaaccagatcttccgtagagatcaaccatacaaccataatgctggattgatggcgtgataccaaattcctcaatcatcattttaaagtaagattttccttcgtttattagacctcgatgtacacaagcaccgagaatgcccacaaatgtcacagagtttgggtttatgttgtcactcgtggtcatctcagagaacagttggaagcactcatctgtgagaccgtacattgctaagcaacatatcatagcactgtaagctttgacatctttcttggatcccaaggcattgaaaacccttttcgccctctcgaggctcccacatttggcgtacatatcaatgagagctgtgcctaagacaatgtcaatctcaacgtggtacttatcgatgtaagcgtgaacccatttcccttgctcgagcgcacccaatcgcccacaagccgagagtacagtcgacattgtaaactcgttgggtctgacgaatgcttcgtttggtttaggtaattgcatctcccggaacaaatcaagcgcttctttgtatttcccacacataacgtagccgttaatcaagcagctccaggaaatcacgtttctttcaggcatttcgtcgaacagtttccgcgcatcatcgatcaacccagctttggcataagcattgaccacagagttccaggccggtaaatccttcgagcccgagtcatcgaaaactcgctgagctgatctcaagtcgccacaggaagaatacatgttgagcagtgaagttcggacaaatgggtctttgtcaagtccaaaaagaagaatctgagcatgagttcgttgcccaagaggaagatgaagcggattgtggaaagaagggagaagaaacggaaaggtatgaaaatcgggagagacgcgatggttgcgcatacggaggtagactgagatcggagaatgtcgttgaggcgacgaaacattgtgaacaatggcacgaatgatgatgttccacaagaaagattcaagctttagatgtcgaatatgaaagatgggatttgcataagctattattgccgcccccttgctcattgtctcaatctaacaagtgtatcagaaatcgattttaaatatcaagtacggttttgacaaaaccgaattgaaccggtatttaaatgaatatttggtttcttaatcaatgtacggacggagaggtaacaaaacaaaagggttttgtcctaattcaattttgcagagatg

SEQ ID NO: 28620 - DNA, 3003 bp, Unknown
  misc_feature (1)..( 3003): 2750-1469P.txt file - cDNA_ID_2997899; gDNA_ID_2926235; Annot_ID_142753
gcagcagtcttctggtgaacgacctggagagtagaagcaggaaatgaacataaattagggtgaaaacattaaagtaagaaaaactcttaatggaagtttacatccatggagtggtgaattatttaccgctccaagacgagattttcccttaacaatgcagtaagggacttccattttcctgcagagtgcaggtaaccagaccaccaactcgatagggtcaacatcgtgtgcaatgaccacaagctgtgccttgttctgctcgatgaggtaagtcacatggttgagaccatacttaacaacaatgggcttcttggattcagcaggctttccttctgcctcagcttgagccttgttcaaaaggcgttccttctttgcggctttgtcctctggcctatacttcagaagaatcttgaagaggctggtggctgcaattacatgacacacattaagcaactgatcatacaaacatatagatttctgaataaccataagaaaaagagactaaccgagattcttatcaagggtcttggtgaactggttaagagctggaggaaccttcaacctctgcttaaggatacgcttctgcctttgaagacggattgacttaggccatttgatgtaacgagaaagatccttcttaggaggcaaagcgccaccaataccgaattgctttgggcgtctctcaaacaatgggttggtaactttctcctaaaatacacacaacaacaaatctaatgagaaactccaccaagactaataataatactcagagaaaaacaaacaatgcttaaaggaaaagctaagagagcataccggcttcttctttgaagccactttaactcccttcttcggtgcctatgaatcaacaacaaacggcgataagcatcagaaacaagagtcacatatcaccatagcatcgatgcattcactatacaaactacgaaatcaaacaaagccagaatcctcagggacataagtataagccagattccaatatagatttgacgaaagaagctcaaattcgaggaaacaaagagctaatacagatcctaaacaaacgaaagtggcaatgaaagctgcaaaatggtgtaaaagcggcgtaccattgttgtcgtcgacttctggaggtaagacagacggctgagagcaagagcgactcttagggttttgtgttttcactatttataaagacactgaagcccaaatgatacaaatattttttttcctcagaagcccagatgagaaaattacgtttttggacacgtattgctctctcaatatagattttctgaatatcaagaaaataatttttcgtcaagaaaattatatattcatgatctttatatcttactttctatatttttttattaaatcaacgatattttttatagaaaaaaattacacaacgaacgatctgatagcttttagtattcaaaaaagcatatagaacaaaaagaatcatatcaaaaagagtgaaatacatttataaattttgaagtagaaaaatggtggattcgtgaataaactggctttcctaagaaacagcatggctattaacatacactttattaaaaatcagttttgatgttttaatttttctatgactatctctatcttgtaaataacattatacagtaataagcattgatgcaaatacggtttcgggttcgagggactttgtgtgtacatgatgactacagagagacaagaccaaaagtgtggtctatagaaaagaagaaccatccacgggttcagccaactaaataggatcgaaccggagagtcagtgtattgatcttcaagttccaattccatacagtttcttgaatggacttgtcaaagacctgcaagcttataagatagtttcaatatccggtgaatgtggctgcgacagacactcgcattattagcaaaattcagtgttctaaatatcaccttaattagtgttgtttgggttttctgtcctggtgcaattagccaaaacactaaaagcagagacgaggccagccatgccaacaacctgtgtccagtttcttgtgctaatggcaacagctgctcccgccacagctcctcctaccaaagcattcacccaatcattcttgcctcgatatcgttgaagcccacaatgtgtcatagtaaacacaccacttacaagacctgaaacaaaaatgaattcttgatgcatataccaaaatctaaagaagcaatcactacttgaagaatttagatctaagttaaagaagagcagagcaactaatccaaaaaaaattacaactaaaagaaatctgcattatatattattacatggcaagcaaaacagagaattatgatctttcaaaacaaaaaaaaagtatatgcagcattcttcttctagtgacaaagaagagaattatcttaagtccaaaattacagatttatacccaaattccatagtcattgaagattaatttgggtggaaaaacaatagaggaagcaaattaccgcattgaaatccgaatctgccaatggatttcgccacaaaggaagcctgagaaacgccgcttaaacctggcgaagcaaatcagcaacaaagcacagattaatgaattgaaaagtgtaaaaactctctaaatcaaagctaatttcaatacctattttacgagcgtcacgaggtccggcgcataacccatataatccaccggcctgagcttcaacaaaaatctcagacatctatctatacacacactaacacaaacatgaatttcaattggatactagtgattaccgtcgcgacacggagaactgactcgacggttagggaagagcacggcacggcggagagcaattcttcctccatctctgcaaaattgaattaggacaaaacccttttgttttgttacctctccgtccgtacattgattaagaaaccaaatattcatttaaataccggttcaattcggttttgtcaaaaccgtacttgatatttaaaatcgatttctgatacacttgttagattgagacaatg

SEQ ID NO: 28621 - DNA, 2473 bp, Unknown
  misc_feature (1)..( 2473): 2750-1469P.txt file - cDNA_ID_2997903; gDNA_ID_2926235; Annot_ID_142754
ttcaaagtttggcactaagcaaacatcctgcaagtctgaagcctaatctgaccataatctgaaaactgcagaggtacaaagaacaagccctttgtttaaccgtatgcaacaactagttctgagaatttcataagagtcttgaagaggcacaaaagataataagctttggtgtcattagtagcagaatttttgacatgagaaacattatgattttcacagcatcaatcaaaaaacagatgacaatgtagtaaataattcacaacaacaataaataagagaacatatggcaaccctgaattaatgagagtctctcatccctgatgctaaccctaaatttttcttctccagttcactctctctctcagttaaccatgggcaattatggagtcaaagttcctgttagagatcctctttgttctaaagaaggtaggtagtaatatttttatatattttcactatttaaaaaaaaatgattcaatttaatattagattagtatttgctctcatttttattttctatcttatattttaattaagtttaattgaagtttatagtgctatttgtgaaattagaaatgttgtgctaattttgaaagatatttttttttggtgctatttttgtcaattccccatagatattttgtttcattttatgtcaattcgcattttaattatacgttatttttctctgttaagagatgatcttcttgttaatttttcatcttaaattattttgtttaaatatatctcaatttgcatgtcattttttttttggtttgtctgtccagatttggatacaaaagacacttgtgagtgttgattttaggctctctcataaacgaactattcttgcagagattcacatgctagaaaatgtggaaattgcatatatttttttttttcttaagaacccaccattgcttattaccaaaattttaatcttttaaccaaactcttaacatcaaaatttttaaaattaattatatatattcataagaactatcctaagactactgccaataatgatgctttaagatcatccttattgatgagttcttagacaaaattcttaacatttttgatgtagaatataataattaaatattagggaatttttaagtggaagacagagtgtatcaaaaatctcttatttaagaactaattttactcttctaaaaaccttttttttttattttttattcatattttattttatctaatattttaagaaattatctaaatttttcttagaacccatggataatgatgctctaagtctacaaataaaaataatggcaactatggaaagacgaattaggttccattttactctctgagacactctctactatttaaaatgaaaatatattttctcataatgccatattaacgacacatactttataattatgataatattatcaactaattttttttaattttgagttggtattaacaaaattagttgctatataaccaatttctttgtgtttttgatatgtaactaaaattgttgcatttttttaatcaaaaaaatataatataccgtaataaatatagattgacatgaatattgaatatcttgtaattatatcacataaatgcatagtaaatggaattaagatgtcgaaatcaatgagaatgtgggtacatttacatttactttataaaatttcgttacattggtagcagtctttcatctcacaaaattttaattactactaatgtagtgaatgacaagtatatgaaaatattaacagaaaaaatataaaaaaaaataacagaaaaaactgagtttaaaacacgcgccatcataactctatcacgcaccttgtatagttcagaccaccgcaaagctagtgaaaccgagacgcaaggtatagcgatttatctcgcggtcataaaagtaaaattaaaggtgaaaaaatcatttattattattgtccctcatttttcttacacgtagagaagaaaaaatggataaagtaaattaaaaaacaaacaaaccgcggctgccctataccaaaacccgggagattgtacgatttcttaattggtttgggcctttggctttgggggtggtggcttgtacttaattgatttacccatcgaaagagatcgaaacacattttttgatcattcggcggaggaaatcgggaaaactcaattctgctttcattcgatcggattgtttccttcaattgaattcgtcgatactcaattgcaattttccactttctgtgtttcttactttgtctgttgtattcgctgatccgatttctaatttgatcaagctagggctaatacatcaaacgatttggggttgggtttcactgttccgttgatcgctggggttgatttttaggaggatttgtgtaccttgattgattttgagggtctgttgattgcaatgttagaaagggcctagggttaagtctagggttttgaggttaagatcgaatatatagttatg

SEQ ID NO: 28622 - DNA, 3003 bp, Unknown
  misc_feature (1)..( 3003): 2750-1469P.txt file - cDNA_ID_2997909; gDNA_ID_2926236; Annot_ID_142757
atacttgagcccaatatcgccctttgtggcccatttaccaaatcccaaacattgacccgtttgtcgaacgtcccctcggacaacaaatgtccagttcatttgtctgtagctggtgacttaaattagtgacaatcatcggcgagtagcaaccacaattttcagtcgctaaactttttagcgatcagtcgctgaatcaatcgataagtaaacgaataatttaacgatcataaatataaattactaatgattaaaataaaataaaataaattatttaaattaaacttaattaaataaatctgaattaaattcaaataaatcttataaaattaagttaaaataaaataaaatataataaaattaaatgaaatcttatttaattaaatgaaaataattcaaataaatcaaaataagtatagtcaaattaaatttgaaaaaaattaaagtaaataaatgtattaattttcttttgatggtgtataatatatataatttacatttttagtttaaattataaattatcataaaaaataatttaaaatttaaaaaatatagcgatttagagcgacagtcaaacgaacaatacaacaattactagcgacagttgttgttgcaattagttgctgaatccaacgacaaccaaacgaagaatacatattgtcgttggtcgaggatcgttgtcgctggattcaactacatacaaacgaacatgacctaatatttacgagagacatggaaatgtgttgttcaacttctctttttaataggtacaataattaagtaattcagttaatacttcccctccaaaaagtaaaccacctaattgatcacataagagatcacctaactttctactactaagagcaagctttattatatacacaatgaatctagtaattctctcataactaaatacaaaaatcacctaacttttgacaatataatgcgtatatgttcagttcaaaatgtatgattcgacgtatcaacttaaaattgaaatcacacattgtaagtcttttttttttataaaccttataccaatatatttgacaatttttaaaatttttgttactcgtgatgtgatgtctataaatcagtgaagactattttcacactttacattcaataaacaacaaagttttttttgtatccatatttcatgtactaagtctccacaaattatagccaaattcacacgtgttaatattttatcaatgaagttaatttaaatttacatttatttggtttttagtgcggaaaattcagctttttgttattgttttgtcaacgcattatgttttatctcttcaaatgatagtaaaaaataatattttaattaaaattaaaattaaaaatttggcttaaaaaagtttgttgagttttttggggtgaccacctgaaacctctctttgcacattgaccggaaaaaaagttttttgattgagtaacgagataaacttaatgagttgtcgaatttacccctaagacatagcgtaatttactaatcaagtactttaaccagactctttcactaatacaaaatctctatattttttttttctttctttaatttccaatttattttttgattacacatagtttctcttcattcatctctttctctccccgtcttttcttgttcctataatcatgtccgtccaataaaaccctaattttatctttccttgcgtcgtttcactccattacagagttgtagaatttagcttgccaaaaagtgtgaagattagggtttgttctagatgtcctacaatcaatccagacccgacagaagcgagactcaatatcgtagaactggtcgatccaccggtaaccaacaacaacaacaacaacaccgatcttcttccgccgccggttacggtaagggcgccggcgctcctggttctgcgcctgccccttccacttatcctgataattcttccttgtcttccaatcgcaggttttcatttcaaattcgacttttttttttttggatgattctctgagccattattggacatgattaattatgcaaagtttgatcctttattgttatttatgacagttttaagaagcccggcaatgctcaaggaggagggcagcctcgggtgaatctgccacctgtgaatcatcctaataatcacaacaatggtcccaatgctcactctcgctctcaaggtatgatcgttattcacggagtgccgcaaagtctttaaatttgtataatttcagattaatttggtcagtgtgtgagtgatcgtttggtttagttcaatctatcttacactgttagttacaggagaaccgggtgttggtggaccaaccaatccaactgaatcgttcaacagaaacaccggacctattccaaaggctccaacttctcagtctaccgtcatgagttccaagatcaatgagacgcccaacacagctaaaggtaggtttttgttgcatcgtctatttttttgtatgcatactgagctttgaagttgaactaaattcctctgtaattccataaaggtataagttttataatgtttattttgttttgtttagtggcagcctctggagacgcttctcaggcatttcctctccagtttgggtcacttggtcctgatttgatggtaatgctgttgttccttcctttgtttgtttgatttttccatcaacacctgaataatcttccctgttggttttctaggttcctgctcgaactacctcagcacctccgaatatggatgaccagaaacgtgcccaggtggaacaccttttagtattatgcatctgccgttactgtgattgttgcctacataaataattctttcttataggatgatgaatagtctgtgtctcgaactttgcttctgacttttaaatgctctatcatttgtcttgtattgcgatttgctggcctgattgcttgatctttaactcaaattggtttaaagaatatatactgaaacttaagatgtcttttattcactttgttctgaacttgacctttcgtttatg

SEQ ID NO: 28623 - DNA, 3003 bp, Unknown
  misc_feature (1)..( 3003): 2750-1469P.txt file - cDNA_ID_2997913; gDNA_ID_2926236; Annot_ID_142763
tagtcatacacccttcacagatacctttcaatccaatgtggaatatctttaaaccaaatgggaattctttatttcgggaaatcatctaaccattcatttaatgttttgtgtatatgaacacaagcaggtagtttccaaaaccgtattcaaagagaaaagcagaaatgttgaccttttctaaaaccaggttatcttcatgcgtatataaaaacggactttgcatgtttgcttactataacttaggacagagtggaatcccaagtaccaaaacagatttcttgcaaaaaaacaatggaggaaacaaataagagtgtggttaatgattactttaccagtgctatggaacttacagagtcaggtgaccctcacgtgcctacccgttacattcttccaccttcacaacgaccaatgctcggtccaagcattggcaccagtaccatcaatcttcctgtcattgatctctccttcttacacgatcctttgcttagactatgtgtcatccatgagattgaattggcctgcaagggatttggtttctttcaggtaacactcgtgttttggctacatacactacacatgtctgttaggtaagacacatggcaagttctgcgactcagattcatgcattgttacaatccaaacaaagagaagtttgatgcttaactgtcctattcatgtgtctatatttctcagatcatcaaactcagccatgagtttcatttctcaggtcactaggactagtatggaatgtacttatcacatctaccaatcatgcttgatatatgacttatgagaaatgcagtttttatcttttgcatttctatcatacccaacaaagtcccttatcaaaaattaaataaatgaaaaagacaaagtccttggtttctgtctttattgaggataaaacaagtagagagccatgtgaagatgcttatcttcattttctacacagatgtcaagtatactgcccagtttctttaaaaacactacactagtgtcattttcatccctcttattaattacattactctgatcttctctacaggttataaaccatggaatatcatcagcagtggtgaaagatgcacaagattcagctacaaggttctttgacttacctgccgatgagaagatgcatctggtttctgataattttcaggagccagtaaggtatggtaccagcataaaccattcaacagacagagttcattactggagagatttcataaaacattactcccatcctctctcaaactggatcaatttgtggccttccaatcctccctgctacaagtaagtaaacctatctaggccaacttcactatctgataataactcaaatttgttctctttttactggtctaagaatccaatttctcaatagatgtttcagaatttgcaagaaatttgtatctaaagaatgtgactcagaactgatttgatcatctcgaaatatcattttcctatcagggaaaaggtggggaaatacgcagaagcaacgcatgttttacataagcaactaattgaagctatctcagaaagtctaggactggagaaaaattacttacaggaagaaatagaagaaggctcacaagtcatggcggtaaactgctatccagcttgtcctgaacccgagattgccttgggaatgccaccacactcggactatggctcgctgacaatcttactccagagtagcgaagggctgcagataaaggactgcaacaacaactgggtttgtgtgccgtatattgaaggagctctgatagtccagttgggagatcaggtagaagtgatgagcaatggcatatacaagagtgtggttcatcgtgtaacagtgaacaaagattacaagcggctctcttttgcaagtcttcacagtctacctatgcacaagaaaataagtccagcaactcagctcgtcaatgaaaataaaccagctgcatatggagaattcagcttcaacgattttcttgattatatatccagaaacgatattacacagaaaagattcattgatacactcagaaagaaaaacctctgaagatggtgtcatataactcgacacggcaattccgatggttgattatttggacctagttgcatgcatcttgtatttaatctatgactatcttgtgcaagtgaatagtccttgtttatatcacataaaagtatatttagttgtcatataagtgtatccttatgctagattcatattagtttctcatctaagagcaaagtttgataaatggatcaaaacagtaagggttaagacttatcaaatctcaaataagttccaagacattcttcaaactctatataaacatgaattgtcctgaagcttatagagagaacaaaaaaaaaaaaaatcaaccagataacacagacaatgaaatgagatgtgaacaattaccaaacatttaacagcttaaattctccatctttacaatacagggaatcaaacatgttcacaaaccagccacgtatcgaaacaaggaagtaaaatgctcgattcaacgacataaatcgtacaaaatctgttaaataagcttgatttcgttccaacaaacacagaaaaataaaacttctcagaattaaaaacagcttaccgtcaagttctctaagtatgtacggccacagcctcttggtcccccgtcggcagattcccggtaaaatttaactccggcatcgcttacgtcttttttttatatttgttttattcctaatctttttcatatttactctttttaacagatatgttttaacatttacttatcgagaatgtagaaacttcggggattagaagttagggaaaaagggtgaatttgagaaaaaactatttaatttggacaaaatcagaattattatatagtattgggccgtttcagatattttaggaagctacaataaaatatataatgaaaactattagtgaaaaaacaaaagtctgcttcttcttcgccgtctctgtgcggcctcttcctcttcctcttctaaacaatg

SEQ ID NO: 28624 - DNA, 3000 bp, Unknown
  misc_feature (1)..( 3000): 2750-1469P.txt file - cDNA_ID_2997917; gDNA_ID_2926236; Annot_ID_142765
cattgaaatctacagcttctggttttggcattacaactcaaggaaaacataggcatttcactctactttctaagactccaagagtttctcgaactcatagtatataaataaataaaagaaactaaaatcagcaaaaatcatttgaagatgtaagcatgaagttcattgaaacactggtgttttgagaagttcatgtggacattttgacgaacaactggtgcgcaagtcaagtaaacatgttctgcgagatgttcgaataatgagactacacttaaaaacgaacttggtcattacgaaattggattgaaacttaaagtaacaatccagtttaatcttcaaatataagtgtttcacgtcctattgcttagctacttcaaagttttcaggaagccgtttatatacttcagatgaatgtattttgttgctttttattgggctatgtggccgtcatgggcttttaaggcttgtaattttcgttttaatggaagtgtaaaggaaaaaaaaaaaaattgttcatgttggtcgtcacgtcacggtcacttgcccaattcacttatctttattccagcttttggatttgagattgttataaaaaattctatgaaaatggaattaaaactgaatagtttccaattgatatatatggcaaactgctctttatattttttgttttttcttttcaacaattggagctattacattacgagattatcttgtattgtcaatataacacttatatctttctttctttttggctatatttatctacaaaacatgccaaatgaaagatagaaaacacacaaaaaatttctttacacatgaaaaaaaagagaagttaaaacatgggtggagattatttctgtcggtactggtaaccaagttgtgatccactctatatattacgtacatataataaaactatataagagtcatgcgatatatttttctcaaccaaaatatgactacttcaaagaatgagtcattttcttaagtggtgaggcctccacttcttggactcagtcaaatcattttacggccaccaggaccccaactaataactttatttcctgttttgcctagctagttgtaatatatattgcaacatttttgtgcacttacaaagtaaaccattgctattcatttgttctttataactcaatatactcataaaacaaaaaagccacatgtagtgaagtgaaatgaatacacataatcgtagatgctctttggtacttatagttatataataagcagggtctccaccagagaatatctgattaataaaaagcatctagattttggtgttgtttttgacagggcggtgatgatgagtcttttggaacaaagtgattggtaaagaaactagaaagctcaaaaaaaaggaagaatgcatgtggtttccttttgttctattcactaataaagactttttccaaagaggaaagtaaaacttttcaccgttttcagcttcagcttttcaccatcttgccgttttcctctctatcggtgcttttttcatcttctaccttagctcgtaagcctcagatccacgagccacgaggaccacgacccatttttttttttttgcttcgcattacttatttcacaatatttcatttaattaattaaagagctactagtaactaaaaaatgactttttaaaacgttaatgactagggttcttttgatcaactatttaatattgtgattaaccgtattattgtaatgttggttctggtaaccgttaataattgtgtcagaaaatgtctctttttttttaaattctaatttgtttttactaaaaaacaaactgaaaaagaaaccgaaaggtaaaattaatcgaggttaatgccaccatttgaaaatgattatttaacttttttttgttgtcggttataattttgtttttccgataaatatgagaaaattgagagtacagtgaagtagtatagtgtagtgggaaagtctggaaacagctgtatctaactttttcccttttctctatgattctgttgtgaataatgcagagccgccgtgagctcaggcgccaccgtaacgaagaacaaacctgaaggagaaaaataagccatgggatgtgcggcgtccaagctcgataacgaagatgctgtacggcgttgtaaggatcgccgccgtctgatgaaagaagctgtctacgctcgtcatcatctcgccgccgctcacgccgattactgccgatcgcttcgtatcactggatctgctctttcctcattcgcctccggtgagcctctctctgtatctgatcaaactccggctgttttcctccatactccccctcctccgctttctgaacaatctccggctaaatttgtccctccacgtttttcgccgtcgcctgctccttcttctgtttatcctccttcgacgtctccttccgtcgccagttctaagcagccttcagtcatgtccacctcttccaatcgacgccggaaacagcaaccaaaacctagactgcctcatattctctcggagtcaagtccttcttcttctccgagaagtgagagatccaatttcatgcccaatttgtatcccagtgcttatcagaactctacttactccgctactccttctcatgcctcctccgtctggaactgggagaatttctaccctccttctcctcccgattccgaattcttcaacaggaaggctcaagagaagaaacataactccgataatcgattcaacgacgaggatacggaaacagtgaggtcagagtatgatttcttcgacacgaggaagcaaaagcagaagcagttcgaatcaatgagaaatcaggtggaggaagagacggagacggagagagaggaagtacagtgtagtgaatgggaggatcacgatcattacagcaccacgagctcctcggacgcagcggaggaagaggaagaagatgatgatagagaatcaatttccgaggtcgggacacgctccgagtttggatctacggtgagaagtaattcgatg

SEQ ID NO: 28625 - DNA, 3003 bp, Unknown
  misc_feature (1)..( 3003): 2750-1469P.txt file - cDNA_ID_2997921; gDNA_ID_2926236; Annot_ID_142766
ctcgtggatctgaggcttacgagctaaggtagaagatgaaaaaagcaccgatagagaggaaaacggcaagatggtgaaaagctgaagctgaaaacggtgaaaagttttactttcctctttggaaaaagtctttattagtgaatagaacaaaaggaaaccacatgcattcttccttttttttgagctttctagtttctttaccaatcactttgttccaaaagactcatcatcaccgccctgtcaaaaacaacaccaaaatctagatgctttttattaatcagatattctctggtggagaccctgcttattatataactataagtaccaaagagcatctacgattatgtgtattcatttcacttcactacatgtggcttttttgttttatgagtatattgagttataaagaacaaatgaatagcaatggtttactttgtaagtgcacaaaaatgttgcaatatatattacaactagctaggcaaaacaggaaataaagttattagttggggtcctggtggccgtaaaatgatttgactgagtccaagaagtggaggcctcaccacttaagaaaatgactcattctttgaagtagtcatattttggttgagaaaaatatatcgcatgactcttatatagttttattatatgtacgtaatatatagagtggatcacaacttggttaccagtaccgacagaaataatctccacccatgttttaacttctcttttttttcatgtgtaaagaaattttttgtgtgttttctatctttcatttggcatgttttgtagataaatatagccaaaaagaaagaaagatataagtgttatattgacaatacaagataatctcgtaatgtaatagctccaattgttgaaaagaaaaaacaaaaaatataaagagcagtttgccatatatatcaattggaaactattcagttttaattccattttcatagaattttttataacaatctcaaatccaaaagctggaataaagataagtgaattgggcaagtgaccgtgacgtgacgaccaacatgaacaatttttttttttttcctttacacttccattaaaacgaaaattacaagccttaaaagcccatgacggccacatagcccaataaaaagcaacaaaatacattcatctgaagtatataaacggcttcctgaaaactttgaagtagctaagcaataggacgtgaaacacttatatttgaagattaaactggattgttactttaagtttcaatccaatttcgtaatgaccaagttcgtttttaagtgtagtctcattattcgaacatctcgcagaacatgtttacttgacttgcgcaccagttgttcgtcaaaatgtccacatgaacttctcaaaacaccagtgtttcaatgaacttcatgcttacatcttcaaatgatttttgctgattttagtttcttttatttatttatatactatgagttcgagaaactcttggagtcttagaaagtagagtgaaatgcctatgttttccttgagttgtaatgccaaaaccagaagctgtagatttcaatggagaaaactacaggaccatggaagctttatttttacaggctttcgcaatctgaagatgcactttgatgcctatggatacttcttgaccagttgcatgatgtcacatccaacaaggtaccacaaatttcacccttattttattatcttccgtaattggtacgggcatggatcttgctctcattaaacaataagaaaacagaattaaacaaggcaagaaacttgtcgtcgaaaagacgtccggctaaattgttgttgtccactaaatggttcttttgtcttctgaagatttatatggtcataaacttgtcatacatatttttaattattgattttgctataatggacggtgttaagctctcaagaatctcggaatatcctgattagcgtagaaaatataaaaatcccaacattatggatcaccactatcttgaattgtttattatagattttttacattttctgagagttttctttctttcacgttctaagaataggaccgtgctaaataatgcgattaagggagaattttgatcgaattatttgacgcgtgtgccaattgtttttttttgttttgtttgtccctctaaccttttcaatagacaaaaacagaggtcaatgctttgattagctcgaccttagacattaacaacttagtcagatttgttttttgacttttgtgaattttcttctcctgattactaggattaggagttacaattaatctaggattcttacggaggtaaaatgttagtcaaaagaagaaacctaatgcagtttagtttagatttcttactaccctaatgccattagatgctgagaggggctacaattttctacgtcttcaaatgtacattggtaaaggaatatctgttttctcagatctttttttttcatccttattttaattacattttgcggtaacaatagtgacaataaaaaaagaagaagaagagttagttgcattttgaatgagtcagctttcttctgcattgggttaatctggccggcaaaatctttgaattcgttattatatagaccttcttgtcttctttatatattgcttgcattacacatttgtctcaacttccagatttgcccctggtttaaaacgattgtcctgtttcctttgtgaaggtcaagctttgaagggctaacgggtgatgctttggtgaaggttttttctggtccaggtttgtgcttattttgcattgcttctctttgattcacgtctgcataaacatcaaataattcatttatgtttgagttgattatgtagaaaaaattattaggggagatgctttatgataagaaaaaaaagtggtcttgtggtatcttaaggcagaaggaaaatatttagtgtcttaatgagtaatagatttatctgtctatccagattttataactgagttttagtaacttccggctcaagcaaaaaggaagttcgatatg

SEQ ID NO: 28626 - DNA, 3003 bp, Unknown
  misc_feature (1)..( 3003): 2750-1469P.txt file - cDNA_ID_2997925; gDNA_ID_2926236; Annot_ID_142767
ctactccaccttggattcttgtgtattcataaaatgtcaaaaatctcaatacttgcaggtgaccagcttgcaattgccaaagaaacaggaagaaggcttggaatgggcacaaacatgtacccatcttcatctttgctttctgataacaacactgaaggagtttctgtcgatgaacttatcgagaacgcagatggttttgcaggagtctttcctggtaatgctacttacttgtaaacttcatttgtaactatgatctttgagagatatctgacattgacaaccccctttttctgatttttagagcataagtatgagattgtgaagagattacaatcccgaaaacacatatgtggtatgactggtgatggagtgaatgacgcacctgccttgaagaaagctgatattggaattgctgtggatgatgccactgatgctgctcggggtgcttctgatattgtcttaacagaacctggacttagtgttatcatcagtgctgtcttgactagccgtgcaattttccagagaatgaaaaattacacggtacataaatgcttctgcctcattggctattacctgataaagtttaaattgaatgcttatattgaatttttttggtttaccttcattttgcagatatatgctgtttctatcactatacgtattgtcgtaagtttctcagtcgaaattgcatcagattttcacaaatacttggtcttattttctatacctttgtgttacagatgggtttcatgcttctatgtgtcttctgggagtttgacttccctccattcatggttcttgtaattgcaatccttaacgatggttagtaactgttaactccctcgatgatttagcttacggcttttgctggtgcttgaagcattcaccctgctaaatttgctttcctgttgaaaaggtactataatgaccatatccaaggacagagtcaagccttctccaactccagattgttggaaactcaaagaaatttttgctactggtgttgtgcttggagcttacttggcgatcatgactgttgtgtttttctgggcagcatacgaaaccaacttcttccatgtaagctacacactatccctctccttgtttactctaatttcaactgtcagcaaaatataactatacttttttcccttttgtggtagaacattttccatgtgagaaacttcaaccagcaccatttcaaaatgaaagacaagaaagtggctgcacatttgaatgaacagatggcttccgcggtctaccttcaagtcagcacgatcagccaagcgttgatcttcgtgacccgttccaggagctggtcatttgttgagcgtcccggttttcttcttgtaattgctttcctaatagctcagctggtaaagagatttccgtcacctatctcattattttccttagttacttacctctttgtttatagtttgttaatagaatccaactctgtattattttgataggttgcatcggtgatatcggcaatggcaaattggccttttgctggaatcagaagcattggatggggttggactggagttatctggatattcaacatagtaacttacatgttacttgatcctatcaaattcctagtccgttatgctctaagtggcaaatcatgggaccgaatggtcgaggggagggtacgtagaccaaaaaaaagacagaatcacttaactctaaattcggtacttcacaattacgttggcctaactagaactcgtgatttgtttgcagactgcactcacaggaaagaagaattttggccaagaagaaagaatggctgcgtgggccaccgagaagcgtacacagcacggtttagagacgggtcaaaagccagtttatgagagaaatagcgcaacggaacttaacaatatggctgaggaagctaaaaggcgtgcagaaattgcaaggttagttttttttttatattagagatcgttagtctctgtcatgtttgagagatgatctcatttctagtatgctgatgaattttgcagaatgagagagcttcagacattgaaggggaaggttgaatcagctgcaaagctgaaaggctatgatcttgaggatcctaacagcaacaactacacaatctgagacagtctcaatctctgcttagttcattttgtcttttattttcgatgtattattattaattcttcttgatatattgacattagttttgatatctttgtggaagatgtctcacatgttgtaatctttcaattgatgcctgtaactttcttactttttatttgatgaaaattcttatttgattggttttgttcggttctttactgaaataaaaccaaaccgagtcaaaccaaactagactaaaccgtctgaacacaactcgaaccaaactaactatggttgaggacactcgaaccaaactaactatggttgaggtccgctagagttttattacaaccgaattaaccgaaccgaaaataaaccgaaatgcaccccctaactacacctaacgcaaaagaatatactccacagagatgtttgtttttttaaccagaccggtttaaatttgtttcttttcagatagaacagaagtatccaagtcttttaaagttttaattctcgcaaaccaacaattactgtttgactaattacttctcacgcgccaaattcgcacgtgtaagacaacccaactaaaagttaactaactcacaagtgcgtgctccacacgtgcctatctgttgataagaatgccacaattttcatctcatattctcattgaacaaaaataataaattctcagtgatccttcgagagattgattataaaatccggtcggcgacgagacttactttcgccgcaaaatttgttctccggtaccggatatttacgtatctgttctcaaattttaccattcccaccactaaaaccctagattaaaagcttcaattaccggaaaaagtctctacttaagagatttatctgtttgttgtcttaaatcacaggaagagaatg

SEQ ID NO: 28627 - DNA, 3003 bp, Unknown; identical to SEQ ID NO: 28626
  misc_feature (1)..( 3003): 2750-1469P.txt file - cDNA_ID_2997925; gDNA_ID_2926236; Annot_ID_203886

SEQ ID NO: 28628 - DNA, 3003 bp, Unknown
  misc_feature (1)..( 3003): 2750-1469P.txt file - cDNA_ID_2997951; gDNA_ID_2926237; Annot_ID_142783
gacctgcttacaagttacacctatgtgtttataactggttatactataccaatcatagttttaggtttcgattagtgtcataaacataatgatgtcgaatgaagtttttggaccatagaaaagatgatagttcataggaattaaaaaaaggaggataaagtaaaattagagaaggaaggccacacctgattacagaacaaatggtacaattctcatcacccaacaaaaatcagagcctagtatgcagatcacgtacgatcagtccaagtacagataaagtggacgcctataaaaacctagggcttcaatcactagcccacaaatctgtggaagaatcttatactgggccttttctttactaaataaaaagtaatttataacgttctggactttatttgagtataggtttctttctgcagttattaaatttactgggttaagagttcatacgtgttatgtgcatttcgctttaaaaagtcttagctcctgagatgatcgacaaatgagttgcggccaatattgggtcattagaaactattgggctataactttgggtccattgggccgaagtagcagctagaagctagtttctgttttctctaaaattaggcctaattcaggttactcaaaaatctagaataaccttatattactgtaaaatttgagaaatctggttgcataattctttatcatagtttctgtagagaacagaagcccacatgttatataaaactaggggttcaatggttacgacttacgatgtacgtggttctcaggcgtgagacccagcaagagcaaaggagatcgaaattattagttattagatgaaatttaaagtaatgagtttcaacttccctttacattgggaggcatttgtctcccgatccattaccaaaaaaaaaaaaaacttccctttacattttatcttaacctccttttgaactgttgtttagttagactcaaaacggtgtaatctatcaattatttttccattataatgactgtactttatccatttaattagtcttttttatttacccaagtggaaataagaaataacctaaaaaattcgattagtgcatggggatacagcaactttgaaaggtccaacaaaactgacctttgttgatcatattgatattccggtcataatattatttggtctttctaaggacatctcaatcatattaattgtgttttttttttggcagtccaaaatttgacttaatgaaaaaactcttgtggaaaaatcatagaggaaaaccccaataattcgaagatttgcattagataaattagaataatgcttttgaccccaagatgcagtatttattgctccaagttttgactcttcaaccaacttatatacgtatgacaatatgaccccaactcccaagttgcccaaagtccatagattctcccccacaaagtaataaagatcgcattaacaaatgaaaagaacaaaagaaaaataacaatcatgttttgtgtgatcgattactattaaaaattaaaaaaagatgaagaaagatttgggttgtataataatggcaaataaagtgaagccaaagagaagacattttttttttttttgtcgcacacccaaagggaacgaagattagagaacgcgtcattcactctctcgtcacgcacctctcacacaacatgactctcctccttggtttagcctaatttgctttgttttatttttcctgattctatttgtattttatttattaaatttgtattttgtaatgtcaaatttttattatgcttctcttttccctttttcacagaagttgatcgtttactgttttatgattttctaaaatttctcacaacatcaatacttttttttaatctcctaatggtatggtatttgcttgataatctttctgcctccattaattttgagtttggctaggatttttgatggaaatagacagcttaattaaaatcatgtaaacaaaataaaaacaggcgaagcaagcaagtggtaaagttgactggtaaaagtctctttcacgtgctcttgaaaagcgcgtgctagttgtgtgtgggtggatcacgcacacgcgtattgaagtgttaccgtcttaatcggtcagaattttgagtcgagaaattaaaagtggtgaattcttcttttaactccccccaactacaaaatttaccatttccacccccaactatttccataatcgaattattagacttcaaacctaataatttaaaacgaacaaacatattttcttaaatgaaaggagaatttaatagcataatcaattgtttgaccaaaaaaagagaagcataatcagctgttttccttgtatacgagtagaagagtcagcacaagagcgacaatggctcacctttgaaagtttggtttcaaccttttgacttttgacctaaaacatatccatattcgtcaagaagaacaaagaaagtattccaaaaaaaatataataaaaaaaaaaagaccaagaaaaataaaatggaaagaggaaacaaagaaggcagcttcctctctccttcttcattgcaaagaaagcaccaccttttaaagaatcctcctcacactccattcttcttaaaaaacccaccacaacacaattcccacttgtttcttcatcatcacctacttcaatcaaaaaacattccaactttcttctcaatttcattccaggtttgtgccctttcttcttgaatcttcttctatggaacttccaatttcgtctacttatgggcttaatttggtttacaagtcttgctatttctagaaaactcgtcttatcttgagtttcttggacagaaattcttgagtttcttgatttatctttgacttgtttcttgaaaaaaaaaaggaaaaaattttggttggaatatttcaacggagaagagtagaaacggtcgttggcttgtcttagtagaaagtagtttactttttttatatccgcaaaaattgcggcttcaaattctgcttcagaagactcttagaaaatg

SEQ ID NO: 28629 - DNA, 3003 bp, Unknown
  misc_feature (1)..( 3003): 2750-1469P.txt file - cDNA_ID_2997955; gDNA_ID_2926237; Annot_ID_142784
aagagatcaagattgtctctaagtatccagctgatgcttctttaccggatataaacgaaggggtttatggaagtgatgagtttaggatgtatagctttaaggttaagccatgttctagggcttattctcatgattggaccgagtgtgcttttgttcatccgggagaaaatgcgaggaggagagatccgaggaagtatccttacacttgtgtcccctgtcccgagttccgtaaaggatcatgcccgaaaggagattcttgcgagtatgctcacggggttttcgagtcgtggcttcaccccgcgcagtataaaacccggctttgtaaagatgaaacgggttgtgcaaggaaagtttgtttctttgctcataaacgcgaagagatgagacctgttaatgcttcaactggctctgccgtggctcagtctccgtttagcagcttggagatgatgccagggttgtctcctcttgcttattcttcaggagtttcgactcctccggtttctccaatggctaatggtgttccttcctctccaagaaacggcggatcatggcagaacagagtcaatacccttactccaccggctttgcagctcaatggtggaagcagattgaagtccacactgagcgctagagatatcgatatggagatggagatggaattgagactccgcggttttggcaacaatgtggaagagacgttcgggtcttatgtttcctctccaagtaggaattctcaaatgggtcaaaacatgaaccaacattatccatcttccccggtgagacaaccgccatctcaacacgggttcgaatcttcagcagctgcagcggttgcagtgatgaaagcgagatcaaccgcctttgcgaaacgtagcttgagcttcaaaccagctactcaagcagcaccacagtcgaatctctcggattggggatctccaaacgggaagctggaatggggaatgaaaggagaagagctgaataagatgagaagaagtgtttcctttggaatccatggaaacaacaacaataacgcagctagagactacagggacgagccagatgtgtcatgggttaactctttagttaaagacagtactgtggtgtctgagagaagctttggaatgaatgagagggttcggataatgtcgtgggctgagcaaatgtacagagagaaggagcagactgtggtgtaaacacacacaaagatggtttcttatatatattgcttttgggccatctctgcaaatttgattctttaatttttgtgactttctttagttgttactgttattagtagtatatggtttgttgtcactacgagtctacgtgatgaaaagatagaagttaattgcattagtttctatattcgtttctcatcctcttgtaatttatcaaaccatgaaatggctaagcaatccaaaccgtaatatggctgaaacaaatataccatgtcatcaacacgaaacatgcacaacgccacctcaatgagcttcaaaacaggctttaggctatactcaacaacggtacataacataagtcatcagaggcttcgcatacttcccaaattggtgatgttttaacaaagtcttactttaaaatttcattaaaatagtagaattttcttagattgacatactatacagtataagctttttcatagaaaatatgtcaaagatgttatgggacgcacgtgtgcctcagacacatcactgcgcacgtggtgaacttcaagtaaaattcttattatataaataaaggtatgagtacgtatgatatatccgatgtgtatctgactcactcatactaacaaaatacagaggtttgggttgggttactttggctttggttcaaagcaaaactgttgaacgaacaactaaaagtctaaaaccaaatggagtcataataaagtatacaaattctgccaagaaaataaataaatttacatatatatatatatgtagtaagatgatgtaaataaaatggattggtaatggcaatggttggtgccgtatacatatatgtgtgtatgagattccttagcctttacttctctcaaacagaaagcttcatactattatcattttgagtatttgacctgtctttttaattttcatttgattttgcaaaacatatatacatctatttctctcttaacgaacactgatgcttcaccctcaacatgcgatggaaacatgattgttacagaaaacgaaagattagtttcttatcccaaaacgtaagattaatttggtactaatctacttttagatttggtgattaggaggagtaaacttgtgtttaatataaaactgatctttgttgctttaatatgcatgtttggtgaattacacccggaaacataatcagatcaactggcacatgagacattaaattcatgttggatccttatgtttcatagaacattatgtttatgaaacaaaaatgtaaatcaatcggaaactttggtggtatacaagtaaataatttggaaaaatacatgtttaagcaaaagtaattgttactaatatcctaatttctacaattgttgtttcgatggtccctttctttaggtgaggattgagacaatcttttagaatctttgattccactcttcgctccaaactctactttgctataacaacaacttcaaaatagattagttaagcgaatcaggttacattttaaagaaaacgatatagagagagcaactttgtatataattttaaaattcttcacctgaaagcctttaaaaaccagttcaagataaacccatctcaccaaactttagtaatcacaaaactaattaacgtcaaacaataacaattttttcacaaatttaattcttttattcctttattcgttgctcttatatttccatcgatctttctccttgtctcacaaacattctgacattttagagagcctcgacagagaattatttttttcttttttattttcgtttacaagtttcaattcttctctatatattaaaaaaacaaacagatg

SEQ ID NO: 28630 - DNA, 3003 bp, Unknown
  misc_feature (1)..( 3003): 2750-1469P.txt file - cDNA_ID_2997955; gDNA_ID_2926237; Annot_ID_203919
atataaacgaaggggtttatggaagtgatgagtttaggatgtatagctttaaggttaagccatgttctagggcttattctcatgattggaccgagtgtgcttttgttcatccgggagaaaatgcgaggaggagagatccgaggaagtatccttacacttgtgtcccctgtcccgagttccgtaaaggatcatgcccgaaaggagattcttgcgagtatgctcacggggttttcgagtcgtggcttcaccccgcgcagtataaaacccggctttgtaaagatgaaacgggttgtgcaaggaaagtttgtttctttgctcataaacgcgaagagatgagacctgttaatgcttcaactggctctgccgtggctcagtctccgtttagcagcttggagatgatgccagggttgtctcctcttgcttattcttcaggagtttcgactcctccggtttctccaatggctaatggtgttccttcctctccaagaaacggcggatcatggcagaacagagtcaatacccttactccaccggctttgcagctcaatggtggaagcagattgaagtccacactgagcgctagagatatcgatatggagatggagatggaattgagactccgcggttttggcaacaatgtggaagagacgttcgggtcttatgtttcctctccaagtaggaattctcaaatgggtcaaaacatgaaccaacattatccatcttccccggtgagacaaccgccatctcaacacgggttcgaatcttcagcagctgcagcggttgcagtgatgaaagcgagatcaaccgcctttgcgaaacgtagcttgagcttcaaaccagctactcaagcagcaccacagtcgaatctctcggattggggatctccaaacgggaagctggaatggggaatgaaaggagaagagctgaataagatgagaagaagtgtttcctttggaatccatggaaacaacaacaataacgcagctagagactacagggacgagccagatgtgtcatgggttaactctttagttaaagacagtactgtggtgtctgagagaagctttggaatgaatgagagggttcggataatgtcgtgggctgagcaaatgtacagagagaaggagcagactgtggtgtaaacacacacaaagatggtttcttatatatattgcttttgggccatctctgcaaatttgattctttaatttttgtgactttctttagttgttactgttattagtagtatatggtttgttgtcactacgagtctacgtgatgaaaagatagaagttaattgcattagtttctatattcgtttctcatcctcttgtaatttatcaaaccatgaaatggctaagcaatccaaaccgtaatatggctgaaacaaatataccatgtcatcaacacgaaacatgcacaacgccacctcaatgagcttcaaaacaggctttaggctatactcaacaacggtacataacataagtcatcagaggcttcgcatacttcccaaattggtgatgttttaacaaagtcttactttaaaatttcattaaaatagtagaattttcttagattgacatactatacagtataagctttttcatagaaaatatgtcaaagatgttatgggacgcacgtgtgcctcagacacatcactgcgcacgtggtgaacttcaagtaaaattcttattatataaataaaggtatgagtacgtatgatatatccgatgtgtatctgactcactcatactaacaaaatacagaggtttgggttgggttactttggctttggttcaaagcaaaactgttgaacgaacaactaaaagtctaaaaccaaatggagtcataataaagtatacaaattctgccaagaaaataaataaatttacatatatatatatatgtagtaagatgatgtaaataaaatggattggtaatggcaatggttggtgccgtatacatatatgtgtgtatgagattccttagcctttacttctctcaaacagaaagcttcatactattatcattttgagtatttgacctgtctttttaattttcatttgattttgcaaaacatatatacatctatttctctcttaacgaacactgatgcttcaccctcaacatgcgatggaaacatgattgttacagaaaacgaaagattagtttcttatcccaaaacgtaagattaatttggtactaatctacttttagatttggtgattaggaggagtaaacttgtgtttaatataaaactgatctttgttgctttaatatgcatgtttggtgaattacacccggaaacataatcagatcaactggcacatgagacattaaattcatgttggatccttatgtttcatagaacattatgtttatgaaacaaaaatgtaaatcaatcggaaactttggtggtatacaagtaaataatttggaaaaatacatgtttaagcaaaagtaattgttactaatatcctaatttctacaattgttgtttcgatggtccctttctttaggtgaggattgagacaatcttttagaatctttgattccactcttcgctccaaactctactttgctataacaacaacttcaaaatagattagttaagcgaatcaggttacattttaaagaaaacgatatagagagagcaactttgtatataattttaaaattcttcacctgaaagcctttaaaaaccagttcaagataaacccatctcaccaaactttagtaatcacaaaactaattaacgtcaaacaataacaattttttcacaaatttaattcttttattcctttattcgttgctcttatatttccatcgatctttctccttgtctcacaaacattctgacattttagagagcctcgacagagaattatttttttcttttttattttcgtttacaagtttcaattcttctctatatattaaaaaaacaaacagatgcaaccttggagaagaaaatttccattgttcgaaacaggagttacaatg

SEQ ID NO: 28631 - DNA, 3000 bp, Unknown
  misc_feature (1)..( 3000): 2750-1469P.txt file - cDNA_ID_2997963; gDNA_ID_2926237; Annot_ID_142787
ttgtctttctctagccacttgtttagtctttctttgcctattcctttgtcttcttgcattgatttggcattcaatggaacgaaaatctttattcagcttgatttaacttaactttcaaacttttctctctctttgcagactccagatggtgcattgttggatatactccggaatggatatgacctccttacggagtgtgatatcaaactccccatggttagttcatagatacacatcttttgcatgccagtgtgaccttaaaattgataattaacatttttattctactcctccagattgaagctaatgataaatatgttgattccccacctccgtatctcattcttctgcatcctgccctcggccctctttgggaagtttcgagacagaaagtaagtcagtagaagatgcctgtcttcttttgtttcttgattcacaaattctagcatatcatttattatgactaaaatcatatatgaatcgttgttacagttcaagggagggtccatttccagttgctcagaactgcaactagagattgcagagttctcatggaacaatgttcaggttctcaatattttcattctgccaacaagattttgcatagctttcatcgcgttgagtttcttaatcaacttcatgtcccataggttgatggtagcttgatcgttactgctgaaaatgccatgggttcaacaacacctaatgataatggtgaaccaatattgcaatacgggttaaggtagaatagagtgttgtacttgactatctccgtaagatacgtgtctattggtttgcacttgggaattcacagaaaaacttgatttgtaggtgtggtaagtgtaaactgcataacgtgaacgtagtgaaccgaggaatcgattggaacagtaaatcaaatgtttactggagaaacgatgtgaacaggcttgagacctgtaaaatcatactgcacggaaatgcagaattcgaagccagcaatgtaactatagaggtaaagtaaagtaacatggaagtttgtgatggattagagtatcttctccttaaaatcaagtggtatatactctttttgcagggacaccatgtttttgaagtacccgacggtcacaaactgaagatcacatcaggaaatgcaggtcagtgaatcttatctaaagcaatgatagataaaaaaaatcgaccaattgacactattattgattgattgcattattttggtgttaaatttaggtttaagcatcaacttggaagcactgaaagaagaggtaatggaaacaggaagctggtattggaactaccaactcaatggatcccatattcatcttcaacaagtagaggtttcacaaagctaacccaacccgaataatttggagctaagcctcccaaagtagaaaaaagtttattacctctccttgtccatgaaaataaaaatagaaagtgtaatttgctgtaaatgtttgctcctctgtaaattaaacaaaacagttcaccatctatctgatgtgttctctttcatgaaaaaagctcgacaattgtacaattcataaattcatacttgcacagcaatacttgaacttgaagccacaagtcaaaacattcttaatggaaacaaaaaaactctgcatgtgaaaaaaaaaaacgcagagaagctaactgtttacacttacctccttcaaagttcatttttatgtctgtaacaatggtgatctcattcttagaatcaaaatcatgattgtaacacatttttctcatgaaattcacgcaaagcatcacccattctcaatcctctaacactcatctccttcaaaaccatcttagcttctttaaacctcttcctcttgataagcttactagccaaacttcccaaattctcttcatctaatctcttatctttccccgcgtacgccatcacaaactccacacttagcgcataatagccactctccaccatttctcctataacgtgcgcatgcgtggcgtacaataccgataacccttcttcctccatcctcctcagaatcgccatcgccgcttcaactctccctgacttacacgcgcctaacacaagcgcgtcgtaagtacgcgtgtctggcgacataactccttcctcctcttcctccatcttcctcaacaccctgctcgcctccgccacgtcaccgtcgtaacaatgcgaagttaaaaaataattgtatgaagtcacgtccaccggaatcgcgtgagatctcatcaattccaccacgcgccaagcttcttcgattctgttcttcttcgtgagcgtgtttaagatcggatgaaatacgcaggttgagagtccgaattctccgatcgccatatcgttgatcaagaccagagcgtcgtcgatccggccgagtttgcagagacgagcgatgagagtttcgtaggagtgtttccgagtgtagccggcgtcggtctgaggcaaaatacggcggagatcttctaaggaggaggagtaagagtctgtgtttgttaggaatttgaaagtagctgtcgtgttgaaacacgcgtttacgacgcggctgttgaggagacgacgtacggcttcgaaatcgccggagcttccggctttgaagatgaggttatcgaattcgacgcaagtacgacgaccaggtgaagcagttggattgggatttacggtggagaatgaacgtcccgagattgattgaagcagaaatctggaattgttcgcttctttaacgaatcgtcggagaagagacatcgtctgattcaggtcaacggagattaggggtttaagccggaacattagaaatgtagaatacagtgtagagatatactgcgcttgagattattgggctacactagttttgggagaatagatgggccttaaaggcccaatataaaaaggctacatgtttatttgtctcgtttcattgtctagggtttgtagaatatatataccatctttcatcctcaagtagtctctctcaccgcgattagggttttgagcaaaaaggagtgatg

SEQ ID NO: 28632 - DNA, 3000 bp, Unknown
  misc_feature (1)..( 3000): 2750-1469P.txt file - cDNA_ID_2997964; gDNA_ID_2926237; Annot_ID_142789
ctatggtcagatatagatgctgaggatttgtaagtatcagctttcgatttttgttctgtgaatgtttttagtttgttgaatttttaacgcagctgcttgataaagattaaatagctcttgttgattttcagttttagaacttgttgctagttcttgagctgaggtgtttgttggtgtatttacttttgcaatttaggtttctgagcttgctaagatctaatgttgtagtaaatgtataatgaatagttttgctaacatgatttgtaaaatgaattttggctgagtatcaacatcaatgtagttggtatagtagatctatgaatttttttagtgaactaatactatttctgagtggtaacaacatgaataccgacactgtgttttatgcattttgtattctaagacttgctaaatttactttgatagtgctgtagcataatcattttttccatttgagttagaaacatgtttctatttcctctcccttttgtactcaaattcattatacctcgtgtcttttttgcaggagagcagttggttttcacaggaaattacttggccgttttcgtaacccgtacacccatttgaatgcgttcagggaccgccctgtggcaagagctacacctccgtcatcttcggtttctacgagacctgatgccaaaagatcctctacattgcctccgccacaaaaaagtcctcctgcgcaacatgtttctgctccacctccttttgtgcaccatgtgactttacctagtctaacaagcagctccaaaacttcttcaaacagcacaattcctatagtggctggctgcatagcgggtgctgtgtttatcctccttttagctactggtgttttcttttttaaaagtaaggctgggaaatctgtgaatccctggcgtacaggtcttagtggacaacttcagaaagtgttcataactggtaattgcctttctactccctgatacaaaaatgtgaagtggcattgttggttctagaagatgagatttaatagtcgctccactttttttcttttcgatattaatgatgtatgatttgttactcaggtgtccccaaactcaaaagatctgagattgaagctgcctgtgaagattttagtaatgtcattgggtcttgccccattggtacattgttcaaagggacgctatcaagtggggtggagatagctgtggcttctgttgctactgcgtctgccaaagaatggacaaataatatagaaatgcagttcagaaagaaggtatttccggtcaaccagttttcttatattttaaggattttgatttctatcaccttatcgattatggtttcgatgatttcagatcgaaatgttatccaagataaaccacaagaattttgtcaaccttcttggttactgtgaagaagaagaacctttcactaggatcttggtctttgaatatgcatcaaacggaacagtctttgaacatttacactgtaagtaacaaagctctttagtcatatgagtcattattacactgtaagttgtcagattaaaagtgggaaaacaatatttacttttgctgcagataaagaatcagaacacttggactgggtaatgcggctaagaatagcaatgggcatagcttattgccttgaccatatgcacggactcaagccacctatagtccacagcaatcttctctcatcatcagttcaactcacagaggactacgcagtcaaaattgcggatttcaattttggatatttaaaaggcccatccgagacagaaagcagcaccaatgcactcatagatacaaacatctcagaaacaacacaagaagacaatgttcacagcttcgggttgctgttgtttgaactgatgacaggaaaactcccagagtcagttcaaaaaggtgactcgatagataccggattggctgtcttcttgagaggaaagacattaagggagatggtggatccgacaattgaaagctttgacgagaagattgagaatataggtgaagtgatcaaaagctgcataagagcagacgcgaaacagagaccgataatgaaggaagtcacagggagattacgagagatcactggattatcaccagacgacactatcccaaaactttcaccactctggtgggcagagctggaagttctgtccactgcgtgaagagacaactactgaacttcacaaaaaaatctgtaagtattaatatgaagatttgagtgaggtttttgagtctcttagaagctcttggcttctctttaggctactttcatctatctatctatatataagtatggaacttagtttatataacggctttaaaattcggtggatctatttggtcgtttatgtcgtaaacagaaaatgtcctaatcacggtaatacccctttttggtgtgcataatgttggtgggtggttactgtctttgtaaattagtgttactatgttcttgatatgtttaatcatcaggttctgaagtataattcacaaattctgctcgttcaaatttatttagttgaagatggtgctaccaattcaatgaataatttaaaaatgttttcgtttgtactccactatttaacactccacctcctaaatccacatgcaaatatcgtagctaataatcaaaacataatcaatcacaaaaacaaaattaatatcgctttgtgtcacatattatgctaaaaatgttggagtcgacatgaacaatgaagatggcccatcggtgtaatccaaaatggtgtcgtctgaaccgtcagattaaagattgcaacacacgacaatcacacatcatcttctacacaatcaaatcccttcgatcgaagctcattggattatattttttttccttcacattaaagacaaaaaaaaaaagcgaaagaaaagaagcaatcgtagagagtgattctgggcatatgcttggagtatctctccttatccctccttggggttctcttcaaaaccccttcttccttctccttctgtaaccatcttcttcaccatg

SEQ ID NO: 28633 - DNA, 3000 bp, Unknown
  misc_feature (1)..( 3000): 2750-1469P.txt file - cDNA_ID_2997968; gDNA_ID_2926238; Annot_ID_142793
atttatgggtctgtagtaactgtttgctgccaaattttgtgagtatgatgtgtttatgtctagatttaatgatgggaatatgtatttaaacctctggatatttttctgaaattagacgattacgaaaggggtgtgacgtaacgagaaattacactggatatgtatgtagttggcgtatattaaataatttaaatgtatataataaagagaaaaaaaagtggagacttggtgagtagagattagagaagggaataaaaagtggattcaacaactctgcttcggtgttgaagtgtaccgtggtaggtgaatctcttggtaggcgacttccttactaatcatccttaatttcttttatttattaaaaaacaaaataaaagagaaagaaaaatagtattggtatgaaaaaattaatgaatattgcaatagcggaaccttcgaattgatataacatttgccataacataacacactagtttggtatatatatatatatactaatttatctacttcacataaaaaataaaatttggagaaaatgagaattaaacgtttcatgtcaggatctttcgtttgccctttagatcatattgatacattgtgtggtaacaaggcttgtctagtgaaagaaatgtgatattttccgaacaaatttttttaaaattatattaaatggcgttgacctatatttgaaaaaaatatatatgcatatggttatttacatgtataggagtatagagtataatgtatttgaaaagctattttactttgatggaatgaaaggccaataaataaatgttgtgtgaagaagccatccaatttgcataaacatttaaacattttaaatggtgattataaattaaaaacagtgtcccatatgatattctatggagttgaacacttaatatgtgcgtgggatgggccgtctatattatcaacggaccctaacataattcgaatgactttgtgtttacacaatgacgaacaaaaccaattcagccgtactatatattaataaatggctcgtttttgttcgagaaagtggaacaaatggttgccttttaaaaatcctttgaccctaatgtcggaagttcgaagtatacacttgaaccatcccatctttaatttcccactctttttagttgggccatagcccatttcataggtttcatcgaaatttatttttctatttgtcaatgttgtcaagttgtcacaaagaaaaaaactttgtaacggacaacaacttagacaaaaatttttttaagtattttagacaaatctaaacctaccgctatgaagtgcgtaatgcgaatggttgagtatgtttctagcttatttaattgagagagaggacacgtttatagtttctattagctagatggattaataggaagggcttgagaggggtctctgttttggactttaatagcccaaaaacagaatacaagtcaagccatatgggtccactaaaactgcatgagagctacgtgtacacaactgttacacaataatattataccatttcacgtctcaattaactttctattataaacaattactttatatagtaatcaaacgtctttaagtttttaaacggtccatttttcacatttattacaaacaccaaaaaaaaaagtgaaaaaaatctaacgtaggagaagaaaattggtaaagcaccatcaagcaacgtcatgaataaataaataaaaactctttacaataaattatgtctgcctgtttcaatttaccaaacttcttttgattaaaatctttggaaccaaattaaattttaattacacgaaaatgtgtttgtaagaaaagatagtatcattcatcacatgtaatctctacgcctcttaatcctctcttccctcatccactgcttctttttttaataacccatttcatctctttccccttttacgctcttttctttcttcattttctgtggaaattttcagagcttttctgtgtaaattaaagagttcttttttgaaggaaataggcaatctcatcctgagaatcaaacaaccggaaaattcaataaatgaaacgcctttaattgttttttcttacaaaacttctaagcagattactttggcggagacccatctgattggtatttttgcaggtacacagtttcttcaattctctgtctttgttttgtttactttctctaccgctcgacgatcggtcttgaatctatttcatttactggatcgtttttttttatgtggaaatggtttttgttttaatgtgttgattcaattgcaatagctgtgaatctaaaggatcgggattctctaaccttagggtttctttctttatgattggagcctctttagtgcttaactgttttttgtttgtgatgaatcggaatgtataaagatgcaatcttgtaattcgctttagttatctgtagctacattctctcttttctctatttccgacaagattttgagataatgttgcaaggactttgatttttctttccgtatatttcagtgagtcccctaatgaagtttactgagttaagcagaagtgttggtttcttagttaactgctaaagtcatggttttgcaaatgtttctgttgtttgcttactaatggagttcttccagatgaagtttttagtgtgttttagcagtttctcttatatgaaattgatacttgtgaaatatgatggatgttttgaaactaatggtttactcgctgacgtttcagatattccgttcttggagtaccaactggcctggagctacattccttagcctggagtaaataataggctgaccctttgaaatcaacatggtaaaccgggaatatgtttctcagtcctgtgttatatctttccaaactctcatcaatggattgtttgttcaatttttgtgtctccttctttttgtctggctttaggtttcctcaagaacttaataacttttcgctggtttctgtcctggagcgttgttgtgtgtttggtcagaggtattaataagtccaatg

SEQ ID NO: 28634 - DNA, 3000 bp, Unknown; identical to SEQ ID NO: 28633
  misc_feature (1)..( 3000): 2750-1469P.txt file - cDNA_ID_2997968; gDNA_ID_2926206; Annot_ID_141753

SEQ ID NO: 28635 - DNA, 3003 bp, Unknown
  misc_feature (1)..( 3003): 2750-1469P.txt file - cDNA_ID_2997972; gDNA_ID_2926238; Annot_ID_142795
tttaaatacatattcccatcattaaatctagacataaacacatcatactcacaaaatttggcagcaaacagttactacagacccataaatgaaaaaacgtattcacttgttttcaattttcacataaccacttccctgagtttggtctcaatttgattgccccgccgaggcattactacgccaagtgcgattaaggtcccatacagtgtaacgggacccactataagacagcgaccgaccaattgcgtgttaggagagtttcaccaaccccggaccggtttttaccggatataacagaaccggtacgaaccggtctcattatcttccatcttctttatatagacctcatgccatgtgtgtgactcaccaagaaaaacacaatcgtttaatctcacccaagaagacaaaaacacagagagagaaagagagagaaatggcgacgacaacaacagaagcaacgaagacatcatcgaccaatggagaagatcagaagcagtctcagaatcttcgacatcaagaagttggtcacaagagtctcttacagagcgatgatctctaccaggtctgtttttttgttttactcaaaaactctgcttttcaattcaatttcagcaatctaaatctcaattaaaaaaatcaacacagtatatactggagacaagtgtgtatcctagagaaccagaatcaatgaaggaactcagggaagtgacagcaaaacatccatggaacataatgaccacatcagctgatgaaggacagttcttaaacatgcttatcaagctcgttaacgccaagaacacaatggagatcggagtttacactggctactctcttctcgccaccgctcttgctctccctgaagacggcaaagtaaatcaatctcttcatcctcctctgttttttggtgggttttgtcgaacttgggaattgaaagtttcatcctttttatcatcagattctggctatggatgtcaacagagagaattacgaattgggtttaccgatcattgagaaagccggcgttgctcacaagatcgacttcagggaaggccctgctcttcccgttcttgatgaaatcgttgctgacgtaagcattcttctttctgacgtaattaacaaaaaagatgatgaagataatgaaataattaaaaactcatggcctaattaggttgatttaatatcttgatgagaatttctgtatacgcaaatttgtttcctttttcatagaagaaagtgtggtaactgattattgtgtgtggttgggtgcaggagaagaaccatggaacatatgactttatattcgttgatgctgacaaagacaactacatcaactaccacaagcgtttgatcgatcttgtgaaaattggaggagtgattggctacgacaacactctgtggaatggttctgtcgtggctcctcctgatgcaccaatgaggaagtacgttcgttactacagagactttgttcttgagcttaacaaggctcttgctgctgaccctcggatcgagatctgtatgctccctgttggtgatggaatcactatctgccgtcggatcagttgatttgactcctccctactctgagtttgtccacagtggattactttccatcttcttatacctttcaatcgcattttcaccaaccactaaaatggacctttttatgtatttgtgttaagtaatatctccattgtccttgttttgctttcttctgaacaaagaaataatatgtaccttacttttcttcttggtctcgttcttttgtttttctccatgatacaacatctaaagaaattatttgtgtcacagcaacgtaagtcgataaaattagttgaacatattgagaaaaagttatcatagaccttcaattgttgaaagtcgatgttggtatttgtcaattgatattagattaccaaataaatattagacagtaagaaacgaacaaagtaggaagatgtaggtcaccggtctttgaaaatttatcagatagaattcataatacacagttaggtagtttcagttgagagttaaaagggaaaaatatgtaattgtgtgtgataaatacgtcaaaaattagttgatgagcaaaatcgtaaacaaaaatacttttttgcattagttttgttggattccctataaatacgggttcccatatctaactcgtagttagcataattataagcaacaaataaacacaaaatactgaatttagaaattttccagaaaattaattagagattttacattatttttacaaactttagtgaattatttcttaaacgtatgttagttatttattaactgaagtttcacatatttgatagaataacatttaaataaaaaaatttgaagtaaggttagaatgttcttataatactttataacttttttaaaaggtacaagccaaaattatcgcaaatgtaaataataaatcattgtaaaaatcttaaactaattaaaagatctaacgcaatctaaacaaagatttggtatcatcgcccatttatgttttgatataatcaaaactggttaataattaaattaaattatcaatttcttaattagttagaattcttgttaatgtaatcaactcaccattattttaattatttaaaatatgggttaatatctcttaatcatatctaagatgatattttcttccatttatgaaaagaaaaatatgttaattaagcattaaaaagaaggaaaaaataatttaaataatattaaatatatatacatcgtttttagagttcgagttcttccgtatttacagtttctcttttttccaaagcagggtttggattggtagtttttctggattaattttgtctcaaattctttcttctttttatttttttttgtgaaattctttgttttaattggtgtgacatcgtttccaaaatattttcaaatttgattgcttttgaagttttttttttttttctatgttttggaattcattatactagcgttgttgtttttctttctgcaagagtaatg

SEQ ID NO: 28636 - DNA, 3003 bp, Unknown; identical to SEQ ID NO: 28635
  misc_feature (1)..( 3003): 2750-1469P.txt file - cDNA_ID_2997972; gDNA_ID_2926206; Annot_ID_141755

SEQ ID NO: 28637 - DNA, 3000 bp, Unknown
  misc_feature (1)..( 3000): 2750-1469P.txt file - cDNA_ID_2997976; gDNA_ID_2926238; Annot_ID_142796
aagagaaagatagagagataagaagaagccatgggttcgatttcgatgcacataactccctctactgctctccctatacgccatttcagagctagagtctcttgttgctcttctggtaatttcgtttttcctccgtttgtgagaattgcatgtgattgtcgaattatagtaattgtcgattgtttgatggcttttcaaatcgagaaaatgcttgagcttatatctttgttgagtattttagaacaatcttttgtaggaaaatgcagtgactatgactgtctttttgattattcttggtggagacaacaaattaacaaaagaatgtgtaataattcttccaaagagacacattgggattgacttaagattagcgttgttgtgtagggcatgtatcatttatcaaagatgttgctgccactgaacctccaatgcatcttcatcacttactcaaagtgcttcaaacaagaggtaaaataatgctcaattttgttcctcatttatgtccaaacttatgtattcgtttcttttcatcacttattctggatttgtaataatggagaaagggaaacttatggttcttaaagtctcagttgcttcatatatcttctgcaggtgagacaatcatatctcctggagctaagcagggactgatccctcttgctattccgctttcgaagaattcgtcaggtaagaccacactttcgatagaatccattagctttttccaggagcttgtctttagttttgtttttctggtttttttttttgtctaagtaggctctgttactgcgcttttgagatggcctactgctccaccagggtaagagatttggatctctttcttggtaactcttgcagtagtaaaaatatgttgttgggttattcttggtttttaacttttttgtattcgagaacagaatggatatgccggttgtggaagtttggaggagtggagtcaggcttatagctagaaatgtaaagacttctcattctgtttatacgtagcttatccttttaagaggatttatgtcttttttgtgttaccaagaaacaatcttacattttttgatattcaggtagatgaatacattcaccggattctagttgaagaagatgcacaagagttgacagaactatatcgtgcttcgggagaggcaggtgaaaaactttacgaaaagggtgcttttgctgaatctgaaattgacaatctcgatgtctatgttttgaaaaaggcaagactgaaaaactcatgacttatagataaaaggttatgtacaccacaataaacagtatttgcttttgttttgtatcgtctaggttggactgtttccagatttgttggagcggaaagtattacggcattttgatgaaggagatcatgtaagacatttgacgcatatgatatgacattctattatcatgaatctctcttctgtgacactttttcaggacattttcttctttttgtctatggaaggtttcagctatggtgacaggagaattttacacaaagaaagacctctttccaggatttggacgaccttttgtatattatgcaaacatactacagaagtttgtaaactttacatacctaaaacatatctccattttattttcgtagagaaagatgtagccacttatcttcagattcttattcgcagggtagggcggaatgtagaagcaaaagatgcggctagggtagcattgagatcaccgtggtggacattaggatgtccgtatgaggtatgacaaaagtttttttgttcttctttttcggttgtactgagttttaaagcatagagacatattcatggtcatggtatcttgaaaacatgcaggaggttgctagtatagcacaatgggaagacgagcagatcgaattcataagggaaaaagtgagtgatgaaggtcgttttgaagatttgcataaaggcaaagctccaatccaagttgcgttggatgttgcggcttttctcttggatttggcttctatcgaaggaacttggtccgaatctttaaaccatattgctaaatgttatgaggaagctggattacaccatatctctaatttcgttttgtacacagattgaatccatattaatgtatgttcttcacaacactttccatgtatgaatcagagaactcactaccctttttcacttggaagatctttgcagctggatcaaaagagtaagcaagcttgtgcaagatccatatcgactttgcaagttttaagaaggcctggtaaaatgcagtcctcgggtggccacctcctgtcacgtagtcacgctggtctagatttccaaagaaagaagcttccatctttgggtggactaagaggagctacttgctcctgcagaatataccaaagttggaatcagggtttgtacctagagcatctagtggatccatgtccttgagagcaagaaactggcggaaaaaggtgtctgtgtcatcatcggccataaccgtagcactctctgagtttactgagaagttcttctgctgaaacccactgaacatcctttggcatatgtatgattcaaatgcatattccttgtgaggcctcttggcgtaaacaacatcaggctcaatagaattggctgcagtatcaagatcccatcctgctgctttcatcatgttgattagcggcttggagaaatcatgcacaactttagcagcagcttcgtaagtagatacaaagagttcagtagtcaagtcaggaaactgtaaatttccatctccaccagaaccttggtttgtagacattcctcttaacttaagattcttctcaagcttaagccgtttctggtttgcttcctcaatcttctgcagcatctgcgtgatctcggaatccttgttctgaatctcagactgaaacttcttcaccatgacctcataagtcttcaacaaactctgctgctcttgaatctctgcagctaaacgagagtcttgtggagagacacatacaggcttggggttattctctctgtaaaaatg

SEQ ID NO: 28638 - DNA, 3000 bp, Unknown; identical to SEQ ID NO: 28637
  misc_feature (1)..( 3000): 2750-1469P.txt file - cDNA_ID_2997976; gDNA_ID_2926206; Annot_ID_141756

SEQ ID NO: 28639 - DNA, 3003 bp, Unknown
  misc_feature (1)..( 3003): 2750-1469P.txt file - cDNA_ID_2997984; gDNA_ID_2926238; Annot_ID_142799
tgcatttgaatcatacatatgccaaaggatgttcagtgggtttcagcagaagaacttctcagtaaactcagagagtgctacggttatggccgatgatgacacagacacctttttccgccagtttcttgctctcaaggacatggatccactagatgctctaggtacaaaccctgattccaactttggtatattctgcaggagcaagtagctcctcttagtccacccaaagatggaagcttctttctttggaaatctagaccagcgtgactacgtgacaggaggtggccacccgaggactgcattttaccaggccttcttaaaacttgcaaagtcgatatggatcttgcacaagcttgcttactcttttgatccagctgcaaagatcttccaagtgaaaaagggtagtgagttctctgattcatacatggaaagtgttgtgaagaacatacattaatatggattcaatctgtgtacaaaacgaaattagagatatggtgtaatccagcttcctcataacatttagcaatatggtttaaagattcggaccaagttccttcgatagaagccaaatccaagagaaaagccgcaacatccaacgcaacttggattggagctttgcctttatgcaaatcttcaaaacgaccttcatcactcactttttcccttatgaattcgatctgctcgtcttcccattgtgctatactagcaacctcctgcatgttttcaagataccatgaccatgaatatgtctctatgctttaaaactcagtacaaccgaaaaagaagaacaaaaaaacttttgtcatacctcatacggacatcctaatgtccaccacggtgatctcaatgctaccctagccgcatcttttgcttctacattccgccctaccctgcgaataagaatctgaagataagtggctacatctttctctacgaaaataaaatggagatatgttttaggtatgtaaagtttacaaacttctgtagtatgtttgcataatatacaaaaggtcgtccaaatcctggaaagaggtctttctttgtgtaaaattctcctgtcaccatagctgaaaccttccatagacaaaaagaagaaaatgtcctgaaaaagtgtcacagaagagagattcatgataatagaatgtcatatcatatgcgtcaaatgtcttacatgatctccttcatcaaaatgccgtaatactttccgctccaacaaatctggaaacagtccaacctagacgatacaaaacaaaagcaaatactgtttattgtggtgtacataaccttttatctataagtcatgagtttttcagtcttgcctttttcaaaacatagacatcgagattgtcaatttcagattcagcaaaagcacccttttcgtaaagtttttcacctgcctctcccgaagcacgatatagttctgtcaactcttgtgcatcttcttcaactagaatccggtgaatgtattcatctacctgaatatcaaaaaatgtaagattgtttcttggtaacacaaaaaagacataaatcctcttaaaaggataagctacgtataaacagaatgagaagtctttacatttctagctataagcctgactccactcctccaaacttccacaaccggcatatccattctgttctcgaatacaaaaaagttaaaaaccaagaataacccaacaacatatttttactactgcaagagttaccaagaaagagatccaaatctcttaccctggtggagcagtaggccatctcaaaagcgcagtaacagagcctacttagacaaaaaaaaaaaccagaaaaacaaaactaaagacaagctcctggaaaaagctaatggattctatcgaaagtgtggtcttacctgacgaattcttcgaaagcggaatagcaagagggatcagtccctgcttagctccaggagatatgattgtctcacctgcagaagatatatgaagcaactgagactttaagaaccataagtttccctttctccattattacaaatccagaataagtgatgaaaagaaacgaatacataagtttggacataaatgaggaacaaaattgagcattattttacctcttgtttgaagcactttgagtaagtgatgaagatgcattggaggttcagtggcagcaacatctttgataaatgatacatgccctacacaacaacgctaatcttaagtcaatcccaatgtgtctctttggaagaattattacacattcttttgttaatttgttgtctccaccaagaataatcaaaaagacagtcatagtcactgcattttcctacaaaagattgttctaaaatactcaacaaagatataagctcaagcattttctcgatttgaaaagccatcaaacaatcgacaattactataattcgacaatcacatgcaattctcacaaacggaggaaaaacgaaattaccagaagagcaacaagagactctagctctgaaatggcgtatagggagagcagtagagggagttatgtgcatcgaaatcgaacccatggcttcttcttatctctctatctttctcttcactctgcttcctcaacctcacagaattttcgtaattcagcagtagcagcaaaagatagccattgattttgtttctgattcagcaaaaaaaaaagaaaaaaaaatgagatgggcttagtctgttacaatttaaggcccaaacccaacaaagactaaagacgcgtaaccgacaaaaaccgtcattaaatgtgcaagagggaaggtcaatttcgtcaactaccggtttacaagacccggttaggcctaccatataatcaattttctcggtgtctttgattttttttccgatctttttctattttaattctcgaggataataattattcgcgatagacgacgcctttcctcttagctcggcgttatcagactcaccgagtcgactcgctccgccgttgccgtctccgttaccaccgtctgcgcaatacgtaattcatagcccggatttctctatg

SEQ ID NO: 28640 - DNA, 3003 bp, Unknown; identical to SEQ ID NO: 28639
  misc_feature (1)..( 3003): 2750-1469P.txt file - cDNA_ID_2997984; gDNA_ID_2926206; Annot_ID_141759

SEQ ID NO: 28641 - DNA, 3003 bp, Unknown
  misc_feature (1)..( 3003): 2750-1469P.txt file - cDNA_ID_2997988; gDNA_ID_2926238; Annot_ID_142801
aggttcaatgtccctctctctctctctttatttgtagtgagttgactctcctagttcattatttaagaagttcttttattaaatattacaggtgatgcgggatcctaatggaacaagcaaaggctcaggttttgttgctttcgcaactcccgaagaagcaactgaagctgtaagtcagttgtatcgtcttgttgattgtatttatgaggactttgattgttagtaacagtggaatactgtacagatgtcacagttgagcggtaaaatgatcgaaagcaagccactctatgtggctattgcacagcggaaggaagacagaagggtcagactacaggtttgcttctcttggaatcacctcgtcttgtgatacacttactactcctactttgcctgttggagtttcaactctaaacaattggacccatcatgtacaagtcttagaatgtcccactgcgtataattatcaatactgatgctgattcttctttataatcaagtgcaacaatatataaagcataaacaacatatgtcctagtatttttgtatcacagaaaaatctcttttttctcctgctgctgagtatttgcattgatgtgaataggctcagttttcccaagtgaggccagttgcaatgcagccgtctgttggtccccgcatgccagtgtatcccccgggtggtcctggtattggacaacaaatgttctatggtcaggcccctcctgccatgattcctccccaggtaatcttcatgttactctactttaagtagccgtgtacgattttacacaaagatatgcacatgtttattttctaccttgggtataatgaattacaagctgacagatgcttttaagtcacatgaaaagtttttaaattctttagctctatagttgctatactcatacttgagcctttccaaatctattttgaaactgctgggataatattaacctgtacttatgcaatgccacagcctgggtatggataccaacagcagcttgttcctggaatgagacctggtgggggtcctgtacccagtttcttcatgcctatggttcagccacagcagcagcgtcctggaggaggaagacgtcctgggggaatccaacactcccagcagcaaaatcccatgatgcagcaacaggttcttctcttttccttatttaattgcaataaaggctgctttgcttgcttggctctcttttaatagttgatcgtatggtttttctgtttggatggtggttagatgcatccaaggggtcggatgttccggtatccccaagggcgtggtggtagtggtgatgtgcctccatatgatatgggcaacaacatgccattgactattggagctttggcttcaaatctgtctaatgctactccagagcaacagaggacggtgagagaatctcttaaaaaccaaatagagagactggttttgcttggattataataatgtgaccctttgggtgtgtttgtacagatgctgggtgaggtgctgtacccgttggtggagcaggttgaggcagagtctgcagccaaagtgactgggatgcttttggagatggaccagactgaagtgctccatctgttggagtcaccagaagctctcaaggccaaagttgcagaggctatggatgttctcaggagtgtcgctgctggtggtgcaaccgagcagctcgcttccttgaacctctcttaaattgctttttatcatttgatctttggcttttgtctctcccatacaattggagttgtttctttgctattcgttttctccctgggaatttggattcctccacataactgcgtttgtgttattttaaaccttcgtttttaaaccacaaaggaaaaacctatctgctttgttcttttgatttagttgcgtgttctagcttgttcgatctagtgttcacggaagatgaatttgattaccaataaggccaatgctggtgatccccctctttggccttttgactgttggtggttgttgcttctagtcattttttttaccagtttttcaagctctattttatggtaaaaaggtgtcctggtaaaaatggatgaatgggtctcattctcagcagacaatgtttgaatgagaaagaaatacattttaaactttttatacactttgcttctagattgattgggactagtcgaatagaaatcttagtagaggtctaaggaaacatgatacacatcttgtttggttgaaatcttaccattgtttttggtttcagttattgatctggtttttggactactttttctgcaactatttgagaatgagaaattacttaccaaaaaaaagaaagtcttcatctacgccaaggatttagaatattcgtacatgaattttgatttccagtacattgcgtcatgaactatatagtctacttgtttttttttgtatctatttgacatgcagcaaagccagcaacacatcttttattgagtctgatgatatttgtgaactaattcgaaaatatttaaaagattcgagtgtatgaaaggtttaactattatcaaaatctctagatatttcaactgatggcaacactcaacaatctcacaatcacgacataaaaatccaataacacttgaaaccaaaagagggttcaaattagggtttcttgttaaatcgaaattggacttttatttatttattaacatctgacttttgagttttgaccaaaaaaaaagatggaaaatatcgctttgaaattgaggacccaaaggaaacgtaaatatgccgaccaatcaaccatataccaaaaattgatatgtggctatgtccccaccaccaccacctatcatatcacaagttctctctacttttctccgaattttaccacccaatcaaaacgcttctctcttcttctacttcttcacttctctctccttcaacaaaattttctacctttgtttcttctctcagatttcataaagaaaagatttaatctttcattggaatctgtgagtaacagaggataagcgaatatg

SEQ ID NO: 28642 - DNA, 3003 bp, Unknown; identical to SEQ ID NO: 28641
  misc_feature (1)..( 3003): 2750-1469P.txt file - cDNA_ID_2997988; gDNA_ID_2926206; Annot_ID_141761

SEQ ID NO: 28643 - DNA, 3000 bp, Unknown
  misc_feature (1)..( 3000): 2750-1469P.txt file - cDNA_ID_2997992; gDNA_ID_2926238; Annot_ID_142802
aattcccaatcttttgttgggttggaggcgtcatatactgacaaggatgcaaggtatttggcactaggatttcgaagtttatagacctgacctggaataaatcatttgaaaatcaaattcgttttctacgtttccccatataacagagcacaccaggttaacaaaaatcgattgcagcaacacaatatttattcacatttcacaggaacaaggctcggttagaaggaaaatggtaaacctgtcctaactcgcactaggtgaagccgagcttcacaaattggggcagtttttaaaagtgtgccaccagaaaccacagatggatgaaggttcgccgactgtctgaccagcctccctactaacctagccacctgttcattgtcagcttctctggtttcacatacaagtttccaatcccacaaatcaacagacgggatctcaggcagggtcttcccaggggattcgatgacttgaccatattgtgctagccatctttcttcctcgcttgaaggagcagctagaaatgaaacagtgagcatgaaagctatgaatatgagccgaagaaaacacatcatcgaagtaataagatccccctaaacagcactacgggggttagttaattatttcaaattttaagatcagcttacgagagaaaaatactatccaccatgaggaataaggatttatttagcttcatatatcaaaaaccatgaccaagaaagctgatatggagcggaaataaagcaaatgaaaagaacagaagagataaaaaccttcaccaaagttctcttcttgtggatcaaaatcttcttcaggaatccattctccctcttcaagttcctcagcatcatcatctcctggagaacaaacacaatttgtagcttctctccttaaattccaaacttgaagagcaaattcattccaacgtatgcaatataaaattctaataagcattatcccaggcaaagaccattagctgacaacatctgacaatcctgattattttccccagaagccctctcatagctggaagcactgggatgttgattataaccatccagataaagttcaattagtgtatcttccaccctgataaaaaagtttcataaaccatttgatgaaaaaacatatattaatctccatgatctactaaaggatataaccaccaaccatgaggaaggtcgttgacgatgttcaggttcctggtcatttgggcaccctgttgactctttcgagcaaataacgtgtctatcagtatcagttaaatattatagatgctactcaataatccaccggaacactagatgaaaatttacctgaaggagtttctccaggattactcagagaaacttcacatccattttcaacattctcagcctgagaaaatgcacattttctgcctaagtcatcttcagatggctcataggtgacaatatctccaggagggttcaccgaagactcgtcgtattccaagggaacatattcgccattttcatgcttgtagtaacgaccatccttgctacaataataccaaccagcatttgggtcatggtaaaacccactactgcaattcacaaatcgaaacaaaagttagcatgcaaaaatgaatagagtccttagttcaatggaattaagcatcaatctcaataaagtctctgcctttttcatcactctttatagttaaaaacgataaatagcagataaagcttttaacactaagacaatcaaacctaaacacaatggacaatttctgcttatattcaatcaaaactaaagcaaactaaggaaattaggctatagaatcgatagatttgggaagagacgtagcctgtgatggatatatagctgcgtatcgctgtcccaaacgtaggagtcttcttccttgggttcctgcaactctttatcgtcgtcgggcatgaggattgattgctggaatctcaacgaaacaaccaaagattgcaaccaaagattgctgaaactagatcctggacaatcaaattgagcaaaagatcattactttgacgatgatgattcaatcaataatcgcttttcaaattttggtttcaaaaactggaatctacagttctgttgaagagaaacgaggaggagggtaactcggaaaaccatctctcgtttccgaatccaatttacggtttactgttaaaaaaccggagtgttacggtttaggcccagtaaggtttaggcccatcaagtagaaacccaagtcaatgacagaagcttttattagtgaagtctttctaactgtattgttttctcattcaccatctcatgttatcgtcaaagggaatgtgattgcaagaagttattaccagaatcatacactgaatataagaatcaatgaagctaagtcctaattcctaacaaattattgttgttgaaagagaaaaaaacaatagaagataactcaaagaagtatgtagagagaaagagtgagaaaagggaagaagaatgacgaatgcaatgacgtgagattcaactcctaccaaaattcctatcaactgtttttgttgtaattagacatgtcattgtcattgctgacaaaataaggaagacaaaacaaatccgacttggagataagcccgtttagatttattcaactcctatcataaggatatcaaatttttcccatatcatcaactttagaaagtttctcaaatatctgcaacgattgatctctttacttctttaaaaaacattaggttatgggtccgttttgtgattgtaaaagcgacacgtgattgattagcaacatttaaatccatatcttgttgaacaaaacggtgcagtttcggactttcgttaccatatattgtagttgttttgttatactgtatatataaagcaagcgttatctcccaaacttcactctcttaccttgcctcttgcttcaacctcctaagcacattcttatctctttctgaaacgagttcccaaattagctctacaaaaaccaggatcttgatttctcatcagttaaacatg

SEQ ID NO: 28644 - DNA, 3000 bp, Unknown; identical to SEQ ID NO: 28643
  misc_feature (1)..( 3000): 2750-1469P.txt file - cDNA_ID_2997992; gDNA_ID_2926206; Annot_ID_141762

SEQ ID NO: 28645 - DNA, 3003 bp, Unknown
  misc_feature (1)..( 3003): 2750-1469P.txt file - cDNA_ID_2997996; gDNA_ID_2926238; Annot_ID_142803
tttttagccgtatatatcgatgtgactgatcgaaagaacaaaccaaaaaaactcttaatggagttgtaatacataaataagacaagttgttagaagaaaaactgaagtcgataagcataaaagtgatgttatataatatcatggagtcacccaacagatatgtttcttctagaaatagtttgacgatgctaatcaaataaaatgtcttgtaatttaaatttcttttaaaattattttactttttagaaagaattaaaggttaggtatttgatattggtgtgtaccaaatcttagtagacttttatggtttttgttctttcttttaacagaacgaacaaatctaaacggaactaatgttgggtttgcgtcctgatggctcaagaacctaacttcacattcacttaccaatactacaaactaaaagatcatccattgtaaatttgaatgaacaaatacaatcttttactgttgtaactcaaaccatcagaattacaaaaacattattgttccataacttgcaatacattcaacttctttataccttctctttttgcagtttaactaacgtaagctcttccatcaacctatctacctctagatctgaagatcctccttctttcaccgcatttttcgccatttctgctaactccttggcccgtttcctcctctcttctccaaccatcacttccctcaccgctccctccactttctctctgctaatgaagtctccaactacttgcatcatcttcttcactcccacactcactcctgttttcaacacttgtgtcaccaatttctcgttgtagaactgctcggctcccacgggccatgtcaccattggcaggcccgctgccaccccttctaataacgagttccatccacaatgcgtcaaaaatccgccaattgctttgtgctcaagtatcagcacttgtggcgcccaccctcggattatcaatccttttcccttggtcttctcttcaaacccctctggtaaccaatcttccttctcaactatttatatgtaatgcaaacgcaaaagttagagtttgaaacagtagaatcctaattagatcattggtttttctctaaaacaaaaacagaggattttgctgcaaagagagtgatgtctatggtaccttggctgccttttctgttaaccacccagacaaaatcatgtcctgacatatctaaaccagctgcaatctctatcagctgctcgtttttaaagctagacatggttccaaaggccatgtaaatcactgaatcacatttcttggagtcgagccatttcaaacattcatgctcatcaatgcttgcctttttgcctctttctgctttctcctcgaactttctatttcctaaggaaagcggaccgatatgccacgctcttttcgccacaaagctcttgaaataatctgagtaagcctgttcaagctcgtagaagctgttcaccaacacgccaaagctatctctctctgagtctcttattgccttcataaacctccccattacagactcttcttctgtctccatgacctgttcctctgtaatcaaaatgtctcccgggagatcaggaatcacaaagggctcagaacttgttgccacattcttagggagccttatgcaatgagaagcacataaagagaagtagcctgtgccgtggaacacaagtctcggtactccgaacttctcagcaactttagtggaccaagggaagaacatgttaccgacaagacagtctggtctcattgtcacgaggagctcctctagtggctcttcgaaatatttcattgcgagtaaaaacttttgactcaagtcacctacgtttaggtcaggtgtggagaagatgaaatcagtattctcacagccatcaggcaaaccaagctctgtgcaagggaaattaaggatctggatggtgatgtcttcgagtcccgggttgtcttggttgaatgatttgatgggtttctcgaagaagagcttggcattgagaggtgtagtgaggatagtggatttagctcctttggtggcaaagagcttagccatgtctagagttggtatcatatggccatgagccatgaaagggaagagcaagaaatggagcttagagacttcgacaggagttcccatgtttaactgatgagaaatcaagatcctggtttttgtagagctaatttgggaactcgtttcagaaagagataagaatgtgcttaggaggttgaagcaagaggcaaggtaagagagtgaagtttgggagataacgcttgctttatatatacagtataacaaaacaactacaatatatggtaacgaaagtccgaaactgcaccgttttgttcaacaagatatggatttaaatgttgctaatcaatcacgtgtcgcttttacaatcacaaaacggacccataacctaatgttttttaaagaagtaaagagatcaatcgttgcagatatttgagaaactttctaaagttgatgatatgggaaaaatttgatatccttatgataggagttgaataaatctaaacgggcttatctccaagtcggatttgttttgtcttccttattttgtcagcaatgacaatgacatgtctaattacaacaaaaacagttgataggaattttggtaggagttgaatctcacgtcattgcattcgtcattcttcttcccttttctcactctttctctctacatacttctttgagttatcttctattgtttttttctctttcaacaacaataatttgttaggaattaggacttagcttcattgattcttatattcagtgtatgattctggtaataacttcttgcaatcacattccctttgacgataacatgagatggtgaatgagaaaacaatacagttagaaagacttcactaataaaagcttctgtcattgacttgggtttctacttgatgggcctaaaccttactgggcctaaaccgtaacactccggttttttaacagtaaaccgtaaattggattcggaaacgagagatg

SEQ ID NO: 28646 - DNA, 3003 bp, Unknown; identical to SEQ ID NO: 28645
  misc_feature (1)..( 3003): 2750-1469P.txt file - cDNA_ID_2997996; gDNA_ID_2926206; Annot_ID_141763

SEQ ID NO: 28647 - DNA, 3003 bp, Unknown
  misc_feature (1)..( 3003): 2750-1469P.txt file - cDNA_ID_2997998; gDNA_ID_2926238; Annot_ID_142804
aatggattcctgaagaagattttgatccacaagaagagaactttggtgaaggtttttatctcttctgttcttttcatttgctttatttccgctccatatcagctttcttggtcatggtttttgatatatgaagctaaataaatccttattcctcatggtggatagtatttttctctcgtaagctgatcttaaaatttgaaataattaactaacccccgtagtgctgtttagggggatcttattacttcgatgatgtgttttcttcggctcatattcatagctttcatgctcactgtttcatttctagctgctccttcaagcgaggaagaaagatggctagcacaatatggtcaagtcatcgaatcccctgggaagaccctgcctgagatcccgtctgttgatttgtgggattggaaacttgtatgtgaaaccagagaagctgacaatgaacaggtggctaggttagtagggaggctggtcagacagtcggcgaaccttcatccatctgtggtttctggtggcacacttttaaaaactgccccaatttgtgaagctcggcttcacctagtgcgagttaggacaggtttaccattttccttctaaccgagccttgttcctgtgaaatgtgaataaatattgtgttgctgcaatcgatttttgttaacctggtgtgctctgttatatggggaaacgtagaaaacgaatttgattttcaaatgatttattccaggtcaggtctataaacttcgaaatcctagtgccaaataccttgcatccttgtcagtatatgacgcctccaacccaacaaaagattgggaattccctgatatttcaactgaatggcaaaatcctgatacaaaacgcaaagccaagaaggggaaaccaaaaagggccagcaaacttacagtgaagcctagtgaagtagacatgattgaagaggtactccaaatccaccttcatggctgaattcttgtattttatgtttgaaaatgtttgtgaaggatgtaaacacctcttgagattctgtcaaatatctagcagaagacaaaacgcaaagctaagaaggtaaaaccaaaagctgactgcaaacttacggtgaagccttgtgaagtcgacatgtttgaagaggtactgcaaatccatcttcatggctgaattcttctattttttgtttcaaactgtttgtgaaggatattaacaccctgcttcttgaatttttgccaaatatctagcaagagacaaaacgcgaagctaagaaggtgaaaccaaaaactgactgcaaactcacagtgaagccacgagatgaagtcaacatgattgaagaggtactcggacctcaccttcatggctggattcttgtattttatgtttcagaatgtttgtgaaggatgtaaacatcctgctgcttgaacttctgcacaatatctagcaggagacatttttctaaagctctgtgtatggggaaattcagtgagaaacttaaatctgttaagagtatttcgaaggcatagtttagtgttattagaaccctagtaagctagtattttcattgttgctccttgttgtttatcagcagagaagctgttcatacagagatagagccgctgagagaagaaatttgcatggtggatatggtgttggaccaggtcaaaaaggaacaacagtggaccataacacggacgagcattcagttcccgacactggttctgaagaggatactgtagcagaagcattggagctatcatttggatctggaagttatgcaaggaggataatgggaaacatgggttggaaggaggtaacttgtggatcttatcacttgtgagttgtgatgttatttggtgtcaccgtaatttatgattactggggaaatgctaatgcagggtgagacgctagggaagaatacaaaaggtttggttgaaccgatacaagcagtgggcaacactgggaatgtagggctaggatttcctcaaaggagaaggaaataatatgaggtacaagatattcagtttaagggactcttagtgttcatatattacttgagaaattgagttactatataaacttggattggcttataacaagagaggttgcaataggtagctaaatttcatctagacttgtaagagttgagaatcatttacttgctgattttgagaaatagaatgagaaatcgaagtaccaagcaatagacaagttggtttcgatttttattggaccaagcaatagaactgtatcaagaaaacaacatatcggatttatggtccattttctcttggtcgacaattttttgaaatggcgcgacgttgaacaaaaattatacgaacaaagaaagctatttccaggttactgcctttatatttggatgacttgttccaaggggaaactttttttttttttgtctgtcatctgatgatattagaactttcaaaggaaccaagatgattgcaacagctacactgtaatctataaccatcatgccattggacgcatcctagtaaatacataagaaagacactccctttattttggtctccgttcttcagccacaccttataatatcatccacaagataataagtggtgtctagcaaataacaaagcgaagctatatctatatttatttacttattgattgtcgtgaatctatctttaatggtgacatgccatagaattatcactattgtgtggttgtgcttgtaattgtttgtaaaaattttgattttatgaatcaaagattatcaacatctagactttaatagttaaggaaataataatatttaaaaaacgcgtacctaaatctaatgaaaagtcaaaattacggtcaacgccttacgagacgcgtctggttcttgaaagcaagttctgcgttatttcatcatcaatcaaagtcgccattttatttttatttaaagtctcacgtcacggaattatctctctgaattcatcatcttcatcattaccttctttttctcaatctcgattgttttcttccaaattcatg

SEQ ID NO: 28648 - DNA, 3003 bp, Unknown; identical to SEQ ID NO: 28647
  misc_feature (1)..( 3003): 2750-1469P.txt file - cDNA_ID_2997998; gDNA_ID_2926206; Annot_ID_141764

SEQ ID NO: 28649 - DNA, 3000 bp, Unknown; identical to SEQ ID NO: 2981
  misc_feature (1)..( 3000): 2750-1469P.txt file - cDNA_ID_2998006; gDNA_ID_2926238; Annot_ID_142807

SEQ ID NO: 28650 - DNA, 3000 bp, Unknown; identical to SEQ ID NO: 2981
  misc_feature (1)..( 3000): 2750-1469P.txt file - cDNA_ID_2998006; gDNA_ID_2926207; Annot_ID_141767

SEQ ID NO: 28651 - DNA, 3000 bp, Unknown
  misc_feature (1)..( 3000): 2750-1469P.txt file - cDNA_ID_2998013; gDNA_ID_2926239; Annot_ID_142818
ctgggtaagtgttacatttctctgtcacgtcaatagcaataaatcagtctgtttgtttttaactatactaataaaagcctgcagattgtgtaaatgatgatcttgtctctttgattgacactaaaaaagttatgaactttgtgagaaaaccaaaccaagcttctttccttatcaggttcattgttggattgatctctctcttcaacaatgtcgatggaaacgaacattgttcgtggtgtcattatctttcatgtgttccaacatctaaatggagctgtaaccgagaaccagcctcttgcacggtaaaaaccttaagctcttttatttcgttcctcggtttctctagcctagtatcaaacctccttccattgtatctaatcacaaagcatctcttcttgttttttctgcagacgactcaattaggtaaccaattgagcatgacttgtttgaggaatgggaaatcagcatcttacattttggcaaatccctcggattcacggattaatagcttatgtgttcagctttgccgttgatttactgatttttagaaatattattatgtacacaaacacactctacactgtatctatcatatttttttcttgcttattatgtgtatgttttatagaggcccttgttcaataaataatacaatgttttcctaaattactataacggtgctttgctacaattttagaagagaatccatgatacaactttgctcttttggtggtaaaaactcgttgtaagatcaatcaactccaatgtttgtgtctgtcttcttttaaagaaggaaaaaaataaaaaataaatcgccgtctgtggggatcgaacccacggccacgtggttaaaagccacgcgctctaccactgagctaagacggctttgatgcttatgttctcttctaacttcaatatattacttaatagatatctctctcgttttaatttgttactaaggtcaatttacatcgtaaattcgtaatgtttgtttttttatagaaagaccactcgtaaaatgaaaaataaattaagaatatgtagatatattttttgtaatactctctcaaacaatttttattgattagaatctgaaaatggaaatttggcatggagatctttcatttggtaaaatatataacagaaatttggaatggaattttttatatagataactaatagtaatacgtgacaacttgtttttaaaaagattcaccagataaaacccaacatttggaagcaaccttgaacaaatcatgttgtttgataaagtcaacatgactaaacaatgatgcgtctcgcgttagaaaaataagaactaagaagcaatgaggcaaacaaataatttgccaaaaccttattacgagttctcacttcaaatcaatgtaccagaagttttttattttatttaaccacacatgcatgtagagataatttagctcactacgtacgtcttttgattcttgttgaagtgcaaagaccgtagctcaactgcgtcaagctctctggcaaaattgtctggtctatagtatccggtctgaggatcaggcatccaccataactcttctcctctcatcattttaccttgaacttgagaggtttttgcaatgtatggatctaactcttttgcagcggtctcgggtctaaagtatccggtatcagggtctgatgcccacgatggcttctcttgactacttccaattgtatatgccctttgagaggcttttgtgatcacaatgtatcttctcctagaataatatttataaaaaaaaaagaattctcatttagtttacaacgcaacatattcaaaagaattaaccaatatacagtattttctaaaaccataaggtttatacaaatggatagacttacattctgattgtgttgttgatcgagcgagataaacttttgagattgaaaagtgattgagacattaatcctctcaaatctcctatgaagaagattaagtgtaagaggatttttgtatagactattttatgaacgcgcgagttggtttatgtacgtttggaagatatagctttatatataggtatatagggaatttgttaatcataacaattttgttgttgttggaataaactaatactttgactttgtaatgttgatcagactttggaacaaaataaaaaattaaagtattggtaggttctgttaaaaaaaaaaaaaaaaattatagtgtaaagagaagtagtagtcccttgctcgacctgaagtcagattaaatcatcgaaaaatatacaaccaggacaatgacctaatcatgcttcaatttttaaagagttttaagcgtacgtgctaatttttaaatcaaatttattgatttaataacggtgaactaactaaacataaaacaatttttgaattggtctatacatattatgtgaaaaggtctgagacgatcaagattcaatggtttctctgaacggtcaaattatttgaagggtcaatcgagataatggcttttcttcgaataatataatttagcatcatttttgttggctcaactagaagtgtagcaaaaaagaattttgacttaatcaagcttagcttaactacctttgttccctacaattggtcaagtaaattgtttttttctccacttgccgggtgccggttagtggttacacgagcaagtttggtttcgactacggttcttaaaacatagtcggattttattttttctctaattcggtttcatatcggatttttagatagagttttggtttggttaaccatatcgaattggtgttgattggaaagaccaaaccgaataaagggtctttcgagtggacccgagacaagagaaaaagagactctctaaattagcaaaacacctttgttttctcatgaaattacaccatttgccactgaactacaccggtaaaccaacaagtccggcgacagtgacggcatttggattttcaatttccctcccccaaaaaatatttagcagtttcgtctttcgtgaatttcccaatg

SEQ ID NO: 28652 - DNA, 3000 bp, Unknown
  misc_feature (1)..( 3000): 2750-1469P.txt file - cDNA_ID_2998020; gDNA_ID_2926239; Annot_ID_142820
tgttattgttgttgtttctgatttttgcggttctagcatgaatcccaaagaaccgaggttttcgtcatcgtcatcatcgtatgggatcccaatctgaagaagcgttttggagtcatcaacgatggttttaccttgaaagagcactccaatgtttaatccacccttgagaatctgcgttaccgcctccaataccgctagtttcagtgagccaaccgtggctgattcgggaacgtctaccaatagctccgagatattcaacgacttaataccgaatttcactgaaaatgcaacaagagaatgttatataaataacaatttttcatatagatttgatctcaaatagatatacataccggtacatggagtatcatgtgattcagatgaatgattttggtaaaacagctttcgtttcttcaaaggatacatattctgcgattcttggctaatacacgaacctcgctcttttaagtgactcacctttcttttactatctacataaatccaaggaaatacaaaaaaaaaaaaaaagaaggtcaataatattcttcatttctctgtaaaaaagctttccttatatataagtaaagttcgcgagtgatatgatgacttgatcttaccgatcttggaacgtgaatcaaagttttcttcttgtgtgattggcgagttaggcatggaagggccaagagctaaccagtccttagacaataacacctgagaaaggttctccagaccaggttgcggcttaacctcaacttccattgtctccaagaagttattgacgacgacattatcgtccttcgtctcctttgtttcgtgagccaacgagccgataacaattcggtttttacgctcacctgagaatcttccagccacttgggctaaaacctcgaactccgatctttgttttctcataatttttagcctgcgtccctggataaaaaataaaagatgcaatcgagtgagccaaaatgtatgtaacttatggcaaaataaatcatgttcgaatgtatatgcgtactctgggtgatctacatgccctaggaacaacaggaagttggtaaatatcgacaccacagtccaccatgttccttgcaacacacacaactgcaaattgcttacgttaagcctgagcctgcgcaatctcggtttatcaaacattcatatatccgatatatgagacacaaaaatgatgaggataattggaaaaacaaacattcgtcacaaatctcatacaaattcacaaaccttttgattatctgaaacgattttgattttgtgcgagaaagaaaagtgagatttatgttggaatttgtttgtgtggaagtaaaatatatagaaagatatgagccgtataaaaacatccgcctttaaagttgggtttgtgtctgaacaaaaaccccatgaaaccacaaaaattctttacaaaaaaactccaatgttttaagaaaatttgaactcaattttaacaacacatgtcaacatctgagtagtctgaaattatcagtaaatttaaaacgttttctgaattatatttttctctaaagacatgtttttttttgggggctaaaactaaccaacgttttttttagcttttagacctaaaaccctcctccgaacagtttggaccagttcttcgttcccatgacttctcaacatcgatccttcttttaacacgtggacgactctacattattcatggataaatctcttctcattcactaatattttcttgttgtggaggaatttctttgcgagtactttttggataaataacgtggcaaaatggagtacatattttgttccattcggaagcattttaggatgtaactggcaatcagttaaagaaacgtgttgaataaggtgtatatataatagaaatcaagtcaaatgaatttgaatggaaaatgtgattgcagaacaataaattaaattgataatgtttaaaattaatgttgaatgatacttaattttaagtaaaactttggatttaatctttttcgctaacgtagctcccaagttaacgacaatatatggtcaacaaatttaaagttgccaaagcaatctaaggttatatatattattggtagttaattctcatatctagcgaaaaccataaaacaataatcattcttaagaaagcttcaacttcgtcactttcattaactatttatgttttaactgtttcaaatcaaactgataatgataggttggattttttagtagacaattcggattccaaatgccaaatggtatgtaggtacataaacaatatagagaaagagtaggtcaccgatagaaagcacgaccaaaagcgtcgatgtcaaagctcgatgcttacgtactaaagatacaagtagacgagtcaattacaataaaaagaaacccctggacgacggagcggttgaactacttaacaagtcagtcctaattcggatgataagcaaattaagcaaaagactcggttctcttttttctttttagggccacttttatttagggtaataaataactattatccttatgatcacaaaatttatttatttttcttactaaaacttttgtttataaattagtttgtaaacaattttgagacacgaaataacataacttttcctttttttgttttgatgattgttttttaggaaccatgtgtgatgcatatttggtaaagaccattgacttatttaactctttcctttttttcttgttttcagactcaaaaactccaaccaaaatttgcttattgttgtatagattgaactttgcacttagctcccaaagtccaacacccgattaaaaactcccataaagagctaaacacgaaacctaatttctccctacacacatctcaaatctctccaattttgttcaaagctcgaattctgttcaaagctcggatttttaattgcttcaatgggtgagaaagattcagaaacagctccgatttgggggaaaactcgagagagagagaggagcaacaacaacaatatacagccaatg

SEQ ID NO: 28653 - DNA, 3003 bp, Unknown
  misc_feature (1)..( 3003): 2750-1469P.txt file - cDNA_ID_2998039; gDNA_ID_2926239; Annot_ID_142829
tggtgttgcatacccaatcaccaacgacgaataagctaaccaagatagggttttggagatctttctttcccctgagagcataaacatcaagacatgctagcccaaagctccacaacaattgaagacccattgacgcaatcaagtagctgaaaccaaccccaaaatcataatcaacatcaacgagacttgtactactactaataaacaccaaaattgcttgcagaaattccactaccatttctactaaatccgacaactaaacgaacaaaacaaggttaaaggaaacaaatcaaaacttgaagaaagcgaaaccgtaccaaaaagcagtgtgaacagagaactctttagcagagaccataacgccgattgaagcagcagctgaagcacattgtccgattctcagtaacagaccacacacagttcccggacctcctaaaagcttcttcatttcaatcaataacgactccaatttctcttcccaaacccagaaattccgacaaaatcagcgaggaaagaggaacaaaatcgaacaaaaccctagttcagcaagtaaaaagctacatttgcttcaggagaaattttggcggggaaaaaaagaaattgcagaggaaattcatagctaagaataaccctataagaggattttgtcacctacaaacagaatttcccgaaacggcttagattcgattataagctaagcttcttccttgtttctcctttgacattctctttttcttgctttgctttttagtggactgagataagtgagataagcatcctacgtggcagcacaaactaactttttttttttttttttgtctttttttttttttagcgattgtatttggtcgttaagaatctgaagtattatttgttgtatttttgagttctaaaaatgtgtatgcaaatgcaatgcctttttgcctgtctctatgtggctattagaccattacataagttttcgtagtaactcgtaaaattgatcaaaattgcaacaaaacagagttaaattgagttccaacacaagttaagtgtttgtgcttatggatcaaatatcatcatcttatcaagtctttacaaacagtggaatcatcatctcaataactccactgtaattagacctatcttaagctaccctacattgtaccaaaacctgttcttaatagctcagtgctgataaaagatccgataccaacactgtaacaaatccatcgctagtcaaatctactcacaagaactgaaagagatggatctctagaagatatagtaagccaatatattatttctgggaacgcggcttgactcagcttgtcatttcttcctttactacacttttaagtttaccctccttatgtggattttttctttgtgcttgaatgtgatgcacaaatgcagctactataacatggagctttgggggaggcttgcttgttgaagagacattgtgaccagcatcttttaaagctttggcaacattcttctgtgctttctggtagtgcacgttacacagtacaggaacagtcgatgctagtgttggttttccacaaagtaatggtcctgctggagatctgaatgtacaaagcaaacaaatgcagagttagtagagaaccgctcaaataatcatcatgtgctaattacaaaccagcatgaaaaagtacatatctatgaaatctggattgtaacaaaccgaatctgataataacagtgtatcaatctgaaaccaggttaatgttgtattccaagtcacttacattttcaaagagctcatctcaatgttcagttggaacacattttcaaagatgacataataatgctaataatactcataaccctacctcgtttgcaaagataccttaatagagacatctttgtcacttatgtatatcaacgcagcacatcaatcaaggttatgaaacaagtcaaagtaccgaatctatatacggttaccaaagctaaaattttctcccaatccctacggaaatctttgaaacagagcaaagtctcaatcctaaaacctttccgcaggctcaaagaagaaagaaactatttcttggcacaaacattgctttgcagtttcaattcatcatcactacaacatcttaaaccgactatacaatataaaagaacacaacttgaagcaaacctgttgatgacgtttgtgcaaccagtgtagagcttctgcttactatccttgagaatatgcaattgacagtatttggtaagcgccatagctttagctttgcatccatacatacagaacccggaattgctgtttgcatactgatcaccatcattacccttatctccactaccttctggatcaagcctccgtctcttattcgattgattttgttcgtctttaaactgactaaccccatacttacaccaataatccctgtgttgcgccttgagatcctccattaaagcccaataatggtttttataacacttggccagctgctttaggttgtctgctcggcgtcggagaagctctgggcgtgtgaggtgactagagcttgcgaggatttcatcttcttgtaacatcgtaatcggtgaattcgaggtcgatggtaagacgtttgtgctaggtttagggttccgaatttggggttcaactgaagtggaagccacagcggtggaagatgcagcgttggaggaagacggaggtcttgggggtttcaaggagaaagggttttgctcagtgttcttggcagctgacgccattgtcgtcgccggaaaatgatgacagagaagattcaaaatgcgagatttttttttctcttaattacttgattgaaaacatccatgggcccaaaccaattatttaactattttatcaatgtatgggccaaattattcaacaaataggcccaaaggaaattggatgtgaaacctgattttctgaattaggtcaagtataagtactaatagcatctctttcgagattacgccgctcatttttagggtttcagatataggcagattctcacatttgcaaacatg

SEQ ID NO: 28654 - DNA, 3003 bp, Unknown; identical to SEQ ID NO: 28653
  misc_feature (1)..( 3003): 2750-1469P.txt file - cDNA_ID_2998039; gDNA_ID_2926239; Annot_ID_203999

SEQ ID NO: 28655 - DNA, 3003 bp, Unknown
  misc_feature (1)..( 3003): 2750-1469P.txt file - cDNA_ID_2998042; gDNA_ID_2926239; Annot_ID_142835
gagaattcaaagaaagagaagaagagagcgtcatcgggctaccagcatactattggtagaggtcatagacgatgttaaactcgatcgcactaaaatacgtggccgagaagtagaggaggacgacgaagaagaagaaccaacaatctatcatccgaaaaataaaaacacacagagaaatcagctcgagagtggacgcacgcgtgtctatacgattgatatgtacatgtaaggagagacaacaaacctgtttgggaatggggaacgaattgaaggaagccattgagacgcagatgggagcggaggaaggagatgattggagtcagtggagagatatagtttgtgtgcaaattgtatggtctacgacttctctcttctaatttgcctaattccctctctccgtttcgttgccactcttttttttttttttttttttttttttactcagttgtaaatttttatacacaaaatatctaaacccaaatccaaattttatgcaaccataactgaataaaccgacgttttcattcaatgtatatgtttatagcaatatcctaatcactagaacatgaaatgcaaacgtaaagaaatataaacttggtctatattaaaagagaagacaaaataatgctttgtgtaattatgaaaaagataagccatgaggattctatgttgtacaaatctaccagaggaccaaaaaagaaaagtgaaagaaacagaggatcatcgactaaaatccggcatgccctccgtcgcaggcggcacaaccagtatcatcatcatcattttcgcgattaggtttagtgctgatgcagcaacacacgagagccgccagcaagatgaatccccaaacaaatgcaaatgattgtgccagcttcaagaatttctccatttttgtgttcatacaattcctcttcttgtcatgatcacatctctaataaaccacccaaaagccttgaaaatttcattttaatatcggcagaaataaaagaatggaacattgtagatatgcatatcgagaaagatgtgaacaagtgttttaatttatagagaaagaggaatcaagaccaacatgttcgagagtataaaatgacctgtgactcctttatatattaaaccatgatgggatatgatgttgaatgatctgtgggcatgtgtgggatttattatatgttttaatgaccttttttgccagatcgaataattttgttggttgattctttttttatgttatttatcattatgtatgcgtatatgactattacaacctcattttaattacctttaatggaataaatgatacataactgaattattcagccatgaaccaaacacgaggaataaagaagaagaaaaaaaagacaaagcattcaagttttttaaaaggaaggtaagttttctgtttgtttttatgctggagattaaaagtgaattactgtacatagatggtttggttgaattatgaaaataatgctatgtttttgttatttatttaagaaaactgtcacaagtgtaatatattatacattgccaaagttcttcatttatatattgccacaagtgtaagaattccttgaatcatttttattttgatttagtgtatcatctaagtttttctgtctcttgactcacatatggttctaagtctaagtggatgcatatgaatccctactgggccaaaaataaagagaagtccatggagattataaaaaaagttttatggcccactggacaagaagacaagttcatacatggttccgctaatatatgaaaaagcacaaatttggtccggtatggttaacaattttgatcaaattgtcagcattttcttatatccaaagagttccagatcatttgaaagaccatttgaagattatgaatgttgtactatccgagttaagaacaaaaaaaatctgattttcaaaggaaacacatgtgagaatcatagacataaacatgcaacattgcaacaaatgaccaatcatgagagagtttgccaaataccatgctaaagattcgaaccaggacctttaggtatttagtttgagtatattatctcccaaatttgaaactgaaacgtaaggattatggaaagaaataaacggctggaaagagttagcaaaagcggctaaagtcacaatcaagcagaaaaagctagtgggcttttcacaacggcacgctatataggctgctctggatcctacaaattaaaattcttgtgtgactacttaacgctatttcctactatttatttatacgtttatatcaatatacacgtaatcccattttcacacttcatataaaacgtttatactccatctttatttttattttatcgacaaatttgtttctgtgaattgtttcaaatcttcaatccaaaagcagttcatacagaagtttgttttggaaatgtaaacacaaaaaatatttgtaacggacaccaataatttcaatagatattaattaatctgatcaaggaacaacagattttttgttttgtttaaggtagtaatgtttacaattcgaaaatatttgaagatttgtagtaacgacgcgtagaaacataagttcgtagttatttcataactttaaattgttatgattggtgtagcttgtagcgatgacttcatagtttaagaccactaatcatgctgtcattatgtccactcaaagccgtaattttaaataaaaccatactattaaaatttaatacaaatcatcatcatctccgatcgtataaatcagaagcgtcattttacaagttgattcctttgctctaataatattagtaaaaaaaaactttgcattgaattcaattcaaaataaacctttctttctttctttctttcttctctatcattttatctgaatccgcctcccaaattcaatcctttaattttcaactccaaatcgatccttcaatcaatttctgaaacttttagtcatcatcagctcaatttcggatctccggagttgtatttttactcctttgtcggaggtaaaatg

SEQ ID NO: 28656 - DNA, 3003 bp, Unknown
  misc_feature (1)..( 3003): 2750-1469P.txt file - cDNA_ID_2998049; gDNA_ID_2926239; Annot_ID_142842
atttgatattctcaatcgtgaaattgttattgtcaccgaaatcaaaatggactccaccaccccacccagaaaaaaaaaaaaaaacaagataacgagaagtaataattaaaacaaaaaatcattggttaaattatatagtcaagatctcttgttcggttcagacagtctcgtgttgtccatgtgatgtggctttaatcctctgtatgtcaaataacatcaaaccctttcaatattgtcgaatgttttcatgttctttaggaaacaaatgtttttctctagacatcttttaaaatgttttcatgatcatattaactggccacaaaattctaggcctgctatagagaaactcaagttatatcttaagaaacaattacgagtcctgtcttttagatgtcatatcagaatgtaattagtatagttcgatgagtcttttatttatttatttttgaatgaatgttcgatgatcagtcttacattcctagctcacatcattattatagtattacataatgtgtttattttaaatattcgtttttggcattctcttaaattgggtgtttgccaatttaaaactagaatgcattgtaaaataaactagaataataatcaccatctacaactaaaagaaatcacctaactagtacttaaatatatgaatgatcatcaatctaatccttgttttgagttggaacccataacccctagaaaacaatttctaatttcttaacatacaactacgaaagtagttaagtacacaaacaagaaccattaataatagtttttccacttattataaaattttgcaacctaatgagcaaagacgggcaaaacaactttgctgaaccaattttatgttaaggtgtgtttttgcaaaagaaataataattctttgggatcgatcgacggcgtcttcgactttattatcaacatacaaagacaagaaagcatgtcatgcacgttttatgggccgggaataatgatctatccacaattatatatgtatatttgggtcacacataacggtgtatattgtaatattttcttattaaaggttcgaagactgatttaattgtatcacaaaactaagtttaagagcctttttttttatggtttaaggctaacatacgataatggagtgggagtattcacactaattaaaaagcatggtcaacaataatatgtgatttagtgagtataaatagttgttattatcgtgataagtcaaggaagtagaaaacgatgttgtaataacttcgtttatctttcggcgaaaaagagaaattgttagcatttaggggaaattcaaaatcgaagctctctctttctgctttcacttttttttatttgcggaaaatgtgttctatgatttcggaaagtttgtggaaggccaatcatagtaacattcattctcccgtcagcacaatccaacacatcatctactctaaaagctttaagcaatttaggtatgaagaatttaatacatcatatgcataatgcatcttttatctttctttttttgtcacacatacattataccaaattacatgtatttggattatccaaagctaacccacatagctaagaaacttataattgatgtctatgatgtaaaataaataaaacatggaaacatttttgccgtaaatgtagagagtatgactagtaggaacataaaagttcgtagtgaaattgatatttttagggaagtggtaaagaaatacagtactcttttgcatagacatgatattgacatgcagatgtaaaacgcatgtaaattcctctctattattatgtttcatacgtacataaaacataccatccaactagataaacatgggaataaattgcaattttcattttcctctcgcaattttgtgactatcttataaaaactaaaaaaaattctcgtgacatctcaagtttatctcatgtcttagaggactaaaaacttttatccatcaccgaataaatataaatttaacaaaatgattattcatattagctttcttaaactagtgggaaaataggagataacttgtacgcgaagtatcacaactcgttctctggttatgccaagtggatattagatggggcaaatgtcgccttacgacactcaacaaatcaaactttgccacgtcacaccatcgtacagtgcagttgagttgtttttattttcggcaccgttattaaacccaacagaatttttgtaacttacaatgggtaaacccgtcatttgcacccgtctcgagaaagtatccattaaaaacttgaaagaaacgcgctttccacgacggtatgtgttaatccttacttaaatgacaataatagccctgtctctctctgctaatcatttcagttattagactttcatcatttaaatcacaataattgttccacgtacctaaagaaagatccgacttgtgtatcttaaataggaaataaaacatcgtatactacgtatcaaaaacattcacgcttcacattaaatgctaactaaaattacaaaagggataaaatcacaattgaatcctaaactccaagttgtaaggataattaagtaaaataaaacaaggcacgtgccagtcaaatgacggttataaccctatcacgtggtagtcaactcgctttacagatattccgagagtgaggtcccacaaagtcacttgccattaccctctctgtattagttagtcgtagtagtctagtagtagttggtagcgcgtcaacttcactttctaactgtaagcgcgtgaagaacgaaaccttttccccaccaccaccaccaccacctctctatactacttcttcttcttcttcttccttctacaaatacatgacagtctctttccctcgtcttctagtatttttttgttttctgttatttttcgcctgagactgggtccctgagatttcacaaaactcgttattgaaacttaacaaaacagcaacctccgttattaaagttcccttctcgatttccgtgaaaatttcactttagccatg

SEQ ID NO: 28657 - DNA, 3003 bp, Unknown
  misc_feature (1)..( 3003): 2750-1469P.txt file - cDNA_ID_2998053; gDNA_ID_2926240; Annot_ID_142847
tcgattcttaactaatgtttcccttaatcaattgaatttgatgggtggacggaaaaaaaaactgtatttcatttgtagtataatatgtggggaaattagtgaagaaaagaacatagaatcaatattggcattttctttcaaaaatggggcaataagaaaagaactattaattagaactgagacgatcacacacataaagaatcgcattcttgctttgccgtgagaaagtttgaaatgaaaataaattgtgatactttgcctgtgtacatacataaagagtcttgggcattgcatatacttactatagcttcagccaattgttgtgacagctaaacattaaatcttttcacacaaaaaaaaaaaaaaaagggaaagacttgtaagccttgaatctgtaacccatgcatcatcttgaccacactccttccgatcgtctcttatgcccagtagaacgaattcaaaaagataaagatggcaaagtgacaacaattagtgggggaatccattacataatcaaaagttcctatttcatttctaacgctgaagacgaaaagcctgttcatctcctctccttgattcttcgcaaccgaaaagaagacaaggtactatcttttactttttgctatgtttgtcagatagcactattaggtgaagcctattacgtttacttctgcagctattgccccaattactaccacaaagaatgtgttgagtctccttccgtgtttcattcctctgatcatccaaaacatcctcttcaacttctctggattcccgacatgtctttagaagaagaacgtgataaacgatgttgttcttgtaaacgtggcgtagacgcactattttactattgctctatttgcgattttgcagtccatatggcatgtgcgggaaatccaacatccccaaccattgacaatccaaaaaggcataagcatacccttcattactttcccaggaaatccggtctgttttgcgatgtttgtgcgttggtggacgattctgattacttatatgtatgtctcctatgtgatttcattgtccataaacgatgtgtctacttaccatatgtcataaaggtgtctcgtcacaatcatcgtctcacttttactcccaatcttccttacgaagaaccaacggtgacggattgtggagtttgtcatgcaaagataaacgaaaattacggagaatactcttgcactaagaagggatgcgtttatgcagtgcattccagatgtgctatgcaaagtgatgtgtgtgacgggaaaaaacttgaaggagagcctgaagaagtatatgaagacactaaaatgtttgaggagaaaggcgatgggattatacagcatcagagtcatccacgtcaccaattgagacttgaaaaaatattccacgatgaaagccatcattgtcaagcgtgcagacgtccttcttatgatcatggtggtaatgtgtatcgatgtatgcaatgtgatgatttcatttttcatgaatcgtgtgcatatcttcctcgtactaaacaatttatgctacatgttcatccattgactctagatcccagttacaatttcatagattggttccaatgtgggaaatgttatcgttactcttgcggtttccggtgcatgtgttcgtgtgccgtgtgacttttttccggtgttggacacactttgtgcttctatatgtgagccgtttgatcatcactctcatccacattccttgttcattactagtggtgaacacgaaagcaaaatctgttccatctgtcaatcatcggagccacaacctttaaattgtttgaaatgcgattttgttttgtgcttttattgtgccactcttcctcataaagcaaggtacaaacatgatgagcatttcctcactttttcttatgaagaagatgcaaatgatgagctttatggttgtgaaatatgcgaggaagatataaatccaaagaatgggttatatgcatgcaacgagtgcggagtcacactccacatcgaatgtttactagggagagatccgaatacgacgcctggatcattttcaaattcggtaggaacgttgtatattcttcccaacacttattcaactcgacctatatgcacaacatgcagaagacgttgtccgtaccaaataaagataaattcatcgggcggtccctatatattctgctcttttgattgctatcaaagattgtgtcgtagcgaagactggtcctaatgcttgggaggcctaaagcaaatcactaaatatgtggtcttctcgtaaaagaatttgtatatgtatttgttttttttacttatatattttgagctgtatcaaggatggtgtcagaatcattcatgtgattattttaaggttttcttgatttagacatcaaatatttctagaaatttcgagcgtgtttcgcaagttcaagacataaactcatgtttttagttgtttatagaacgatgattatatatattcgtaaatttcttgggggataagacacgtaaagaccaacacaacttaattagatgagtcaacaatcatcgtgcataactccaaatttctactttttcacttatttgaccgtcatcgatattttatttcattagtaaaaacacaggaagattactcaaaagtcttgaagtctttgatcgttaaaaatgaacatgtgcaaggagacacacaaaaattccaaatcaattatataattgcaacttgcaaagatcgaagcgatttcttcttatatacgagttattatatgtataaaaatgataagacatagtaaatgacagacgcaaaaacattgaccaaaagttgtaaaaatgatatagaaagacgtcaacaccaacaaaaaaatgatatagagagaaacgttcgtttacacgcgtttttgtctatataaagtatacatttatacatccctggaaatttttcagattttcaaaaatcagattcaaaggaaacagaacacaaagttttgtggggtttgaccaaagagagtcaacgaagaagatg

SEQ ID NO: 28658 - DNA, 3003 bp, Unknown
  misc_feature (1)..( 3003): 2750-1469P.txt file - cDNA_ID_2998057; gDNA_ID_2926240; Annot_ID_142848
acacctttggccgaacgtatcagttttctcaccgagtaatttattcttctttgttttcttcttttaccatttatttgctttctatctaaaataacgttattagttcatttacaaacatatattttgattttcttcttaaacaggcaaattgctttccataccggtccaacaggtgatcatttagatttcgttgactttatatttgttgccatgtgaatcgaaccgggttattcgcagcacaaaaccgaattcttaaattaaatcaacgcattatttttgtggtttaatctaggtgtcttttatagtgcattgatctttgataacttgacatgcaagctatatacatgaaggaaattggatttttgattctgtgaaagtgtttgcattttctctcacttatgaaaattaatgaaaataattgaatgaatgaatgaagttggaggattaatgaacgccacatgtggaaacgcaacggagatgataatagcgattctagcggttgggcaaaggaagatgagaatagtgaaactctcacttcttggctctattctctccaatcttctcttcgtcttaggcacttctctattccttggtggcatctctaatctccgcaaacaccaatctttcgacccagtacgttattgtctcctctcaatcaacattcaagatatatgtatcatatcttatagattgacaacaacgtacaacaaaaaaatcaaaatgtgtatcgatcatctaatcatgtgtgtaattctgcaagaacagagacagggagatatgaacagcatgttgttgtatctggcgctgttatgtcagacactaccaatgataatgagattcacaatggaggctgaagaatacgatgggtcagatgtagttgtgttgtcaagagcaagcagcttcgtgatgctcattgcttacttggcttttctcatctttcacctcttctcttctcatctctctcctcctcctcctcctcttcctcaggttctctctcactctctcttataccatactcttcacgatatgaatcatcttgtgctgcttcttatctatgtgtgcttcggttaaatgtataaaagagggaggacgtgcatgacgatgacgtgagtgacaaggaagaagaaggagccgtgattggaatgtggagtgcgattttttggcttattataatgacacttctcgttgctttgctctcagactaccttgtctccactatccaggtgtgtgttgactagagctttttggaaaaatatgttatcaaaaatataatattttcttcaaaacgtataaaaaatatgaaatggacaggacgcagcagactcgtggggattatcagtgggattcataggaataatattattaccaattgttggtaatgcagctgagcatgctggtgctgtcatcttcgccttccgtaacaaactcgtatgttttacttcttctttttttccctagttaattacaacaaataaataacatcaccatattaatcctggttttgaacaaaatatgaaaatgtacaggatataactcttggaattgctcttggatctgcaacacaaattgctttgttcgtggtaagcataatattagtattgatttctgtaaaattagggaaaacaaatatttcttataatatattcctcttagtttataagcttggctcaattatcaagtttaggtgtaaacttaaatatatggagaatatctttcttacaacctggtgctaactgagaaaatatttcattatggttcagttttcttacaacaatataattttgacaaactcaaatttgaatgtaggtaccagtgacagtgttagtggcatggacaatgggaatagaaatggaccttaacttcaaccttcttgagaccgcttgttttgccttgtccattcttgttacttccttagtattacaggtgccatttcactcattacattatttattgaatcttgaggttgtgttagttttattaatatatatgttattatatgattaataggatgggacttcgaactatatgaaaggcttggttctcctcttgtgttatgttgtcatagcggcctgcttctttgtctctaactcaccctcaagtaagcttctcttttgattatgatgactgttttctacgatgaataaatacactatgatattcatttgctttgtatttctccaattgcagccgaaaccaatacaactaatcatacaataacgaaaaggtaagttatgtttaagggtatcaattagtgcaccatagtaaacaaaaatgtaacattttaagaaatctatcaaatatattgatgaatgttagttttaactgtcaactggcaatcatgataatcatagaaacctaacttctagaaagttaaatcatttttagattctcggactacattatatattatgatatatggttcttgtttattttttttaattgcaggtaactcgaatattgttttgtctttcttttagtgtattgttgttttctttgattacatatttagtttttgaattattgtgtaagtatatatatttttaagaatttgttttttacatcattttttataaggaatatgtaaattaaacgtaatagataattctaacataatcaaaccttgttcatacatgtcagaactgcatgtctatataggaatacaattaaattaaaactaaaaatataaatgccttctcatggaattttttgattcgtatcagaagatatttggcaggaatttattttcttagtgattaaaaaacaaaaaacaaatgttcgaagtatcggagaaggcccaactgagcccactagtttaaattgtactttgtgattcccttgggccttgtggatcccattaagtactaactgttatttacaagaatgccatcatcggaggccatttataaattttggactcaattttgttgcaaataaaaatctgaaattctcaggcgagattccggaagcaaaacattcctaaatttcgccaagtgatccgccatg

SEQ ID NO: 28659 - DNA, 3003 bp, Unknown; identical to SEQ ID NO: 28658
  misc_feature (1)..( 3003): 2750-1469P.txt file - cDNA_ID_2998057; gDNA_ID_2926240; Annot_ID_204038

SEQ ID NO: 28660 - DNA, 3003 bp, Unknown
  misc_feature (1)..( 3003): 2750-1469P.txt file - cDNA_ID_2998060; gDNA_ID_2926240; Annot_ID_142849
tattttcttagtgattaaaaaacaaaaaacaaatgttcgaagtatcggagaaggcccaactgagcccactagtttaaattgtactttgtgattcccttgggccttgtggatcccattaagtactaactgttatttacaagaatgccatcatcggaggccatttataaattttggactcaattttgttgcaaataaaaatctgaaattctcaggcgagattccggaagcaaaacattcctaaatttcgccaagtgatccgccatgggagaagagaagtctctgcttcagttccgtagttttccttcactcaagacctctgatttcgctctcaccgaagaaccttcatggaggctggagaacaacgtgtcgtcgaatcgccggagaggaaacaagagaagcggtggcgtttttaccaattttgcgtccctttccgtagcgattaggagagatcggagagaatctacatttaacggtcgtaatggcggcggaggcggagcgttcgcatcggtttcggtggtgattccgaaggaagaggatgaattcgcgcctacctcggcccagctgttgaaaaaccccattgctttactgtcgatagtaccgaaagacgccgcactattcttcgccggagcgttcgccggagccgccgcaaagtcagtgacggcaccgcttgaccgaataaagctcctaatgcaggtaagggctctctctcctctccttctcaacaacttttaaggttttctggcacgtgtgttttctccattttaaaaagtaaaataaaaataaaactggtgactggtgagcacaacgaatacgctgtcgtttcggctagttgttgcttgtgggacattgttgattttcctcttcttttttcttttcctaagagactcttccatgacatggtctatgataaaattgatcatgtatttatatctcattatttcaagccaagaaccttgaggggaatctatggagtatttgtgattgtgttcttgttacaggcttgtagtaatgtacattgattcttaaatgatgtcttattaattcatagacacatggtgttcgagctgggcaacaaagtgctaagaaggctattggtttcattgaggtatatatactctcaatcgtgtaatttttaagaggattagttagttgttcttattgtaaaagtcttgttgatttggttttgtttgggatgactacaggccattactcttatcggaaaggaagaaggtattaaaggttattggaaaggaaatctacctcaggtacgtcacacaatttcttgcatccttttggaaagaatggtgttgaattttgtagagtttgattgcacataatcttagtctgaatgttccaggtgataaggattgtaccttatagcgcagtccagttgtttgcatatgaaacatacaaggtatataatctttctatatctgattctggtttcgtttcgaaagtttttgaaaccgtgtctaatcagtaatcactttgttctgtacattctgccttttttatgttgtttagaaactcttcagggggaaagacggtcaattgtcagtcctcggaaggctcggtgctggtgcttgtgctggcatgacgtctactctggtaagtaacgttgtttataggcctgagtgagtttgtctaatcgtaaagtaacttaagactcttactacttaatgcagattacataccctttagatgtgctgagattgaggttagctgttgaaccaggttatcgaaccatgtcccaggtatattcatcgcattatacaccaactttctcttccataaattaatcaggttttaaagcagacatgtcatatctaggttgccttgaacatgctgcgggaggaaggagttgcatcattctacaacggtctaggtccttcgcttttaagtatagctccttacattgccatcaacttctgcgtctttgatctgtaagtctactaacagttcaaacattacccctgaatatttttaactagattgtttacatattcgataatacaatatatgcacagggtaaagaaatctctgccagagaagtatcaacaaaagacacaatcatctttgttaacagcagtagtagctgctgctattgctaccggtacttgctatccattggataccattagaaggcagatgcaattgaagggtactccatataaatcggtattagacgctttctcaggtaggaacaaaaacatcattatctgcttttattcttccagtttccggtgactgaccttattaaacccttaaaccgttgtgcaggtatcattgcgcgtgaaggagttgttggcttgtaccgtggctttgtccccaatgcactcaaaagcatgccaaacagcaggtagttatagttttgataaaacaagttcatttttttcatttttcttgtttcagtattaacattttggaatcctctttttgtattgtttcagtattaagcttacaacattcgacatcgtcaagaaactcatagcagcgagtgagaaggagatccaaagaatcgcggatgataaccgcaagaaagcaagtcctaacacaatcgatgaacaaacctgaagacgcaattttggatttccacaaggtcatttttgcccgttatcttatgacctttgtttgtgtgttttgtaatttggaatgtaataagttgtatgttctcctcataattcaaaatgtgcttgaattgaatcctgaagccagagagggtaataaatggctgtttgtgttacgtttggtcgcgctggttttgtataaaccgaatttaaccgggttgctacactcgaaattatatcgttttctggaattgggtcatctatctatttcgcggttgcagagagaagttgtcgacgacggtgtcttttgtatcctcctcctccagaccaacaaactcagaaccctaagccctaactccgtaaaatcattttcgtcgccatgtactgtactttgcgatttcctttgcctcttcacattccccaaactcgaacaatg

SEQ ID NO: 28661 - DNA, 3003 bp, Unknown
  misc_feature (1)..( 3003): 2750-1469P.txt file - cDNA_ID_2998064; gDNA_ID_2926240; Annot_ID_142857
aaagttaaaccaaatctagataatttttccctctgattttgaatttttctgacggtttggggatattagcgcagaattggagctaggttagtggattgttcattgtccggtgtcggagatgagagatcagtcgaggaatttcgaaatggtaatttcatggggagatgaattgatccatgttttggatgataggaaaggatttgacgtgttggtacaaactctcgagcaactgagagctattccattctcctgcgacgaagattttaaagagatacatgaatctctccaaggttgaatgccttcttaaattgggttgatgtgtgtttgattaagtggtgaatttaattttgttgcgcagatttgcagaagaaactcgatgtttgcaaggagaagacagatgaggcaaattcagagattgcggatgaagaagaaattgagcgtcttcagaaagagcttgatgaagagctagaactagagtgcaagctgaaggaggagcttagatacgtatttcactgaactgagcttaaacatctcgtccgttgattcaatgtcatgactaattttggtttttgtcgacacattcatagctgatgaactcaaagacctgaattctcaggaggcattatttgaagagcacagattagctataaagaggaacaagcgggaccagttgagaaccgagtaagattttgacgaatccgctttttagtcttttttgggcttcatatttccgtctttatgttgtttgaatgttcatatttacttgttagatttaacaagtagtgattttgcttatgctctattttttgttctttgcaggacaaagcttcctatgtatgcttctgtcactcgagttataccaaacattgatgattcattgaagacctcaggctgtatccttttgctttaaacaaatttctatctactttgtgaactttctaaatttaaatctcgttcaaccttgtcctaagggtttttaatccttaatacgacagatatggttggtcgagacaaaaggctaatggacaagttcgaattcgattcaaacaagagtacttctgtctacgagacatgtaatggtatttgggatattataaacaggcaatagacagccttaacaaccaaaccgcctttgtttatgattcgttagatgtaaaaagcttcatggcctctgtactatgaacaatatctgatgttatgagttccttttttgttcttgttgaatacctctctgtaggtatcagtgcttaactttttttttttttttatctactgtaacctttagcctccaaaatcttcagaaacatatctaaatattggatgttgaaaaagaatgcatcttatatttatctatttgtgcagattgttgcaaatccagtcttaacgtgtagaacgaattggagaggagcaaattctgactggtaagcagtttctgatttcccatacatttcagtgcattgaattatcttaggaattctaaggataattcctaaggatttttgattcaaatcttagtgattggaatagcaaacttggggactgttacttagcttctccactgaactattggacctgcttagtgtctccaccgaactgttgaggatcctgcacgcttctggtacttggttacttccataagcattgcatacatacatgacaaagttctggtagttctgttcaccaaagacatataaatgaaaagttttctttctcctttgatcttgaaagttattagcttaatttataggactaacctcttgaagtggtaggttattcacaaccacccatggtacaaatctatgtgctggataaagttcagaagtttcttcagcatacctctgttcaagctgcacattgtcacatagatgtcattttttcttgcttattatatgtttagctttcctgttgtggctgtataagttaactaatgttctctcctctgagcaggatttacctggtttccgtatccgttaatgtaacaatcaaccgctgctctgctcaatccaaccatttctaaacaatcagcccatttttcaagtttgttctccaagactagctgttccgtacagtagatgtatccaaaatgcttcatctgcaagtgacataggcagagcacatataattcacattaacagtcaaagcctctatatggtaatcttactgcataaatccaagaagattttggtagcttttaccgtttaagagacttaccacatcagggtatgcgtttattgcacaggcatgaattgcgttgagcgcacactcagcttctccgtgctgaaaacaaagcaacagtcaaatgctatgtcctaattctatgatgtacaatgcaagtgagacatagcaagaagagtccaagacctggcagagaatggttccatctggtctgatagcggcgttgccccatggaacgagctggagatcaatggatgagattaagccggtttcgaagatcttaggcaagcggttgacgatgaattctgcacagaaggggcatagagcttcgtagtataaacttagtgtaactttctggcttgaagacagagataagaggcagaagaagattgtgcaacttgtgatgcaaagcctctgatatgatgccattggtggaaacaagaagaagaggaagattgcagagaattgtttttgactcttgctttattcttgtgtctcattaaacaaggaaagtaagacataaaactgtttcttattactttcagtgattcgttgatgctttattattgtttaaaggcatcttgggcgttttggcgttgaaacaattgttgcggcgttgtttgatttaactgaaaacggcacgtagttagttttcggaatatcaaaacgacatgatgtttaatcgctgggttgggtcagtcacacttcgtcttccacatctaatccacctgagcttactgagtcggaacaacatcagccaataaagccctgaaccctaattttcttttggctttggctggagaacgactgtatgtgtgttcaacaatg

SEQ ID NO: 28662 - DNA, 3000 bp, Unknown
  misc_feature (1)..( 3000): 2750-1469P.txt file - cDNA_ID_2998068; gDNA_ID_2926240; Annot_ID_142858
ttttttaataaatccttttgtttctttcttttaaaaaatttcacacttctccttttttcttctttttaattcagttttttgcaaagaaaaatggatggattcttttgggcatgtgagatcaaacacgcttcaattgcgagtgtgatttattctcaaatctgactattataaatgctgttaagccaaaagtagagtaataatgttccatattttaggcttatcataatcaattcttttaacttatgtacaaaaacttttttaaacacctttagttacctctttaaatgtacatcaaaatgattatcatctcatgcttctactttttttggtgtgagtgtcaaattcattttgaatatatgagagaacataaattaacccaagtaaaaaattgtaagaccaaatcattgagcacacgaatagtagttctttacaattggaaaaaaaaaagaacaaagtagaattgctccggccatattgaagttatgatcagatttataaataagttgatgtatactcacagtaggaggctttaaatcaaaaccaaaacgtaaatggaaaagcttgaaactttggaaccagacagaacacagacaggtgttagaatttatcgactcggagaccatttctttgaacctcataagcatctctgcttctgctcttcttcattcctgcagtgaaatagacctttgatgcatctgtagatatgcttgtcacttttacccatatcattacttttgtcttgattccttccacatctgttagctttcctttctcaagatgtcctgttactgttgttgtgaacttcaacactgatgaatccttgtatccaacttcgcatatcgatgggatcaaaacggttagtttctttgtctcttcatcgaactcgtagtttgtagcatctcccgggaagattccaatcggcaaatcatattcttttagtaactcaggcaacggcttctgcattttccctgtcaacatgatgacaaatggggaatttcaaaaaaacaaaaaattgaaagatgcagtcagaagaagaataaaaaaaagcaaacctttgattttgttgaccaaccattttgttcctccttcaatgctcgttgacaccgactggcataaacaaaaacattgttttatatgttagaaaagatcacagtttcaaacaaaataatctaaccacatgagcaagaagagaagacattataggatcatatatttgaatcatttcttaagatatcatggttttggtaattagatgttcttccttatgtgacgtgatttacctaacaatgaactcaaaacattcgtacaactgcatgataccaaaattacgataaaggtggttgattatatcggaaccacgtcaatagatcaaaatcgattaggaaaacagatgaatcagattctataggatgggtcaaaaaaagacgtacgttgagatcgttgccgacggagtcaaactgcttgttagccttttggcctaaccagtaggatccaaccttgttgaagatctgatccatattctctcgagaaaggatagagaagattttgagaaaacgaaggacgactttctttctttttcttccgggaaagaattttgggaacccaccactctcgcaccgttggattcgttatttgtgcactattcctgcagccaattaacttatgacatgtggcaaatacataaacaccaatatatttattgaagcaagcaggcagcattatactgtacaaattacaaaaaaaagtacttgcctatcactcctccttgggactgactatctatctattgggccttcaatgaaaatcagattaaataggtgcaacacaacttgggaactgaagaaccacatggcacaaaacagagtaaaattaaagactacaatcaatcctttttttttgccattcctcccatgattttacttgtctattagacgaacctcagctaaatttgtaattacagtcgaaaatattattaagctctttaacacttttatagcctacccttgtctttgtgcattccagagtaatacgaatcgattcaaatcaagccaataaaataaaaccaagcctaactacactttatttaatgcttaatttttgtccttgccaacattacaactttttagaaaaaccatttgatatgattttttaacttgggccgtgacattactaatgaggcccacaatgtacttactccgacgtgtaattgtctccgataaagacaaggaaccatttggaacctctcacgcgctttagctggaaattacgtggagttgagctactcgcgactctatcctatgtataattgtatatcagttttccgtctccatcaaatatcctagagagccacgaatttttccttctttgttgtaaattatgaatattaggccacataatacggaaagtcttaaagggtttggaccattctcaatcttatgttctagtagcttgatgattttttataaaaacaatatggaaatacttttatctctatccgatttcctatgtcaatatgtgtcacaggattttacacgtctaacttatgttggaaacgctatcatcttttctttttttttttttatagtaaacaattgtatttgttatcatctacaactctaaaaaatacatttcgaaaaataggagagagcgagtaggaaataagaaagtggcaacgcgagagtaggaaccggaaatggtaaaaagattctgaggataaaagagaaagcagagaaacagacaaactttatttggagagatgttaacgtggatcgaatatcctcacgttcacactatcccattggatgtagcacgaggccgccacacgcccctacatctggctttcatatccaccctccacgtggatctcaatccaacggtgaccacacgccttttccctcttatataaacccttcctccttcctctttcttatcatcatcaccatctcttacaacaaatctcaggcggctcaacactatcctcttctacattttccaacgatg

SEQ ID NO: 28663 - DNA, 3000 bp, Unknown; identical to SEQ ID NO: 28662
  misc_feature (1)..( 3000): 2750-1469P.txt file - cDNA_ID_2998068; gDNA_ID_2926240; Annot_ID_204050

SEQ ID NO: 28664 - DNA, 3003 bp, Unknown
  misc_feature (1)..( 3003): 2750-1469P.txt file - cDNA_ID_2998072; gDNA_ID_2926240; Annot_ID_142860
tcagaatctttttaccatttccggttcctactctcgcgttgccactttcttatttcctactcgctctctcctatttttcgaaatgtattttttagagttgtagatgataacaaatacaattgtttactataaaaaaaaaaaaagaaaagatgatagcgtttccaacataagttagacgtgtaaaatcctgtgacacatattgacataggaaatcggatagagataaaagtatttccatattgtttttataaaaaatcatcaagctactagaacataagattgagaatggtccaaaccctttaagactttccgtattatgtggcctaatattcataatttacaacaaagaaggaaaaattcgtggctctctaggatatttgatggagacggaaaactgatatacaattatacataggatagagtcgcgagtagctcaactccacgtaatttccagctaaagcgcgtgagaggttccaaatggttccttgtctttatcggagacaattacacgtcggagtaagtacattgtgggcctcattagtaatgtcacggcccaagttaaaaaatcatatcaaatggtttttctaaaaagttgtaatgttggcaaggacaaaaattaagcattaaataaagtgtagttaggcttggttttattttattggcttgatttgaatcgattcgtattactctggaatgcacaaagacaagggtaggctataaaagtgttaaagagcttaataatattttcgactgtaattacaaatttagctgaggttcgtctaatagacaagtaaaatcatgggaggaatggcaaaaaaaaaggattgattgtagtctttaattttactctgttttgtgccatgtggttcttcagttcccaagttgtgttgcacctatttaatctgattttcattgaaggcccaatagatagatagtcagtcccaaggaggagtgataggcaagtacttttttttgtaatttgtacagtataatgctgcctgcttgcttcaataaatatattggtgtttatgtatttgccacatgtcataagttaattggctgcaggaatagtgcacaaataacgaatccaacggtgcgagagtggtgggttcccaaaattctttcccggaagaaaaagaaagaaagtcgtccttcgttttctcaaaatcttctctatcctttctcgagagaatatggatcagatcttcaacaaggttggatcctactggttaggccaaaaggctaacaagcagtttgactccgtcggcaacgatctcaacgtacgtctttttttgacccatcctatagaatctgattcatctgttttcctaatcgattttgatctattgacgtggttccgatataatcaaccacctttatcgtaattttggtatcatgcagttgtacgaatgttttgagttcattgttaggtaaatcacgtcacataaggaagaacatctaattaccaaaaccatgatatcttaagaaatgattcaaatatatgatcctataatgtcttctcttcttgctcatgtggttagattattttgtttgaaactgtgatcttttctaacatataaaacaatgtttttgtttatgccagtcggtgtcaacgagcattgaaggaggaacaaaatggttggtcaacaaaatcaaaggtttgcttttttttattcttcttctgactgcatctttcaattttttgtttttttgaaattccccatttgtcatcatgttgacagggaaaatgcagaagccgttgcctgagttactaaaagaatatgatttgccgattggaatcttcccgggagatgctacaaactacgagttcgatgaagagacaaagaaactaaccgttttgatcccatcgatatgcgaagttggatacaaggattcatcagtgttgaagttcacaacaacagtaacaggacatcttgagaaaggaaagctaacagatgtggaaggaatcaagacaaaagtaatgatatgggtaaaagtgacaagcatatctacagatgcatcaaaggtctatttcactgcaggaatgaagaagagcagaagcagagatgcttatgaggttcaaagaaatggtctccgagtcgataaattctaacacctgtctgtgttctgtctggttccaaagtttcaagcttttccatttacgttttggttttgatttaaagcctcctactgtgagtatacatcaacttatttataaatctgatcataacttcaatatggccggagcaattctactttgttcttttttttttccaattgtaaagaactactattcgtgtgctcaatgatttggtcttacaattttttacttgggttaatttatgttctctcatatattcaaaatgaatttgacactcacaccaaaaaaagtagaagcatgagatgataatcattttgatgtacatttaaagaggtaactaaaggtgtttaaaaaagtttttgtacataagttaaaagaattgattatgataagcctaaaatatggaacattattactctacttttggcttaacagcatttataatagtcagatttgagaataaatcacactcgcaattgaagcgtgtttgatctcacatgcccaaaagaatccatccatttttctttgcaaaaaactgaattaaaaagaagaaaaaaggagaagtgtgaaattttttaaaagaaagaaacaaaaggatttattaaaaaaaaaaaaaaagagatgaagacagctcgagggatgcaatagagccaagaggaggagaaagatgggatctggtaaacaaaacacgtcaaagtcaaattacaaatttatattttataaaacagataacaacaacaaattaaacttttattaatctctctctgcctctactcactggatcatcatagctccaaacttgtaccagtcgcatcaaagcaagttttggtgaagaagaagagacgaggtcttcctcttactgtggtggtgacattttctctaaaaagaaagtctccgatatg

SEQ ID NO: 28665 - DNA, 3000 bp, Unknown
  misc_feature (1)..( 3000): 2750-1469P.txt file - cDNA_ID_2998076; gDNA_ID_2926240; Annot_ID_142861
tctctcgatttaacctctagttcgtttcgttctgttcgaattttgtttcgattcttcgttttctcctgagatttgccttgtgtgcgtctttatctcttaatcattttcttctccttattgaataacagcgattcgagtgttgttttcttcacatgcatgatatagaaaccctaagcaattttatctcgttgctccgttctattctagtggttcacatttccggagtcttctcttgacttatttgtacaatcttcgttggggttcttcttttttattttaccacgatttctaggccattcctggcccttgaatttctcattgctgaagtttgttttcaaaaacaatattggtctgctttgacgattgcttgtttatgttagtgatgtttaaatatttttgtcctgtaatgttgtttcttagatcattatctgattgcattgttcattgtggtaatttgcagtatgtgatgattgtcttgaaaggctcagtgcctatgtcatttggcgggaccgaggatcctgcagcttatggtgaattagtttctatcggtggccttaatgcggatgtgaacaagaagctaagcgctgctgtttccgccattcttgagactaagctatcggtgcccaagtctcgattcttcctcaagttttatgacaccaaggcaagcaattccctctctctgataacttttttgatgtagtgacataacatatgcaaatgtgttaatgatttcatatgcccgatatgcgtccatgtctcattttcattgttcgttgtctctctaggaccatcaaagtcaagaatatgcacaatgtttacacgctttacaccagcactactaggtcatgaatagggaacaaatacatcttatgtgtgtaagttcatcatcataagacggacctataacttttactcataaactaggcattataaacaattaaatcaaatgcataaaccgttccactactcgaattcaatctttacacccacactgttgagttatttaggagattcgttcaacttctctaaatccgttgtctaactggcttagagggtcatccatcatctggagtgtttatgcctataaccacctgatatatcaattatacatttcttttctcgtgtggttcttcttgcagggatccttctttggttggaacggggcgactctttaattccgtggtaggtgattagtgtgattgtcttgaaatgtatgatctactctcatcgatcaagtaactttgaactacttcgtattgtaaacatatctaaggtttgatggagttgcattaagaaataacatttatgctatatatgatgctacaacttactatcagggtaaacaatggttatttagtctttgtctactcgttagatataattatgtttagaattcgaagatgaatgttatcaaagaaaaaaggatttgacattgtcaagtctactactccatatgacagatcaacattgtgttaaaaatattttctattagggaaacttcctgtgactggaacattaatggtcaaatgcactttgcctaagtaatcaagaattattgtataaactacgttaagcaaaaaaataacctgagttataatatcaggaggttatttttatttttattttagcaaatgaatatagattagctatcagatgaagcaaggtgtataatcaaagttgaaagacgcgtaattgtgatcctatatatacataacactaccgcaacttcagcaacctctaaatcattcgtctcctaaaattttccaatctcaaaatcccaaaagaacaaaatcgaatggtgtcaacaaatccccctgttcttccaatttccaccaccgcaacagacaccaccaatcagcctccgattgtaaccgctgtggtggaatcgcaacctccagtcgtccgtgcatttgtcaacggtgtgaccgagacggtctgtggtggtctatctcgtagccgtccgtggtcagagctcctcgatcgatccgctttcacaaagcctgactctctctccgaggccgggacgcgattccggaaaaattcctcttatttcagggtgaattacgtttgcattgtcgctctgatccttggtttctctcttctcgcccacccattctctctcatcctcctcctatgtctcgccgcttcctggctcttcctctacctcttccgtccatcagatcgtcctcttatcctcttcggccgatctttctccgaatacgaaactctcggtggcctaatcctctccacgatcgcagtgatcttcttcacaagcgtcggatctgtattgatatccgctctcatgatcggaatagcaacaatctgtgtccatggcgcctttagagctcccgatgatctcttcctcgacgaacaagatcatgccgcctccggattcctctcattcatcggtgttcccgcgatcccctctgtagcaccctctgcctcctcagcggcttcccccgtgtaaattatagttctcagaatctggcgtgtttagagatttgaaggtggagattgttgcaatgtaattttctgtgatacttgaccattgttgcaatgtaattttcattgaagtcagtcaccaatcacattgaacagatgttttaaaatgtccacgtaagcaattattgtttggaacgatttcgggttagcattcgtgccgttagttaccgcaataaaaggccgtggcaatatcacacttgtcttggaacgctatgtccgtaaaaaccaagcccaaagttaaaataaaaccacgcgtctcataatttcggcccaaatctttttcaactttcccgcctttgtcagaacttttaactttttggatttttggtgatgattttggtttggggaaagaaaataaaacaataaaaataaaaattccgcactcccgactcctccctcttggcgtggtaggcaattctgaatcgcgaggtttagttctccggctgaatcatataacgacgaatcggaaaacttggaaaccctagaactgaataaatg

SEQ ID NO: 28666 - DNA, 3000 bp, Unknown
  misc_feature (1)..( 3000): 2750-1469P.txt file - cDNA_ID_2998082; gDNA_ID_2926240; Annot_ID_142864
accctattttcataaaatcaaaaggggaattggcaaaactaaccaacaaaaagtttataattaagaaactaacattaaaaaaagaaaaaaatgatatcctctatattttgtatattaattccaagtttacccctctatctatttctctcatctctctttatgtgtacctctctcttccgttctctctcccttctctctttctctctctccccctctctctttctctctctttctttttccctccccctctctttctccccagtaaagtcctcacacctacatcgttacttgtttttgttttcaaatcagagtctcttaattacttttgggtgagatttgatttgggggtttcgaattacagagagaggaacacaatttggattcagggaatcgactttcgttgttgcgcttggtgtcttggttatgaaattgagttttgttgttgcaagttgagagatactattctatttgtaaatatactatttacgtataccttgttttatatacgttttaaaatgaattatttgttttgattaaggatgttaagtgatttaattattggtttagatttaaacccttgggttccctatatattatcccttagggtttaatatctttccataaaaaaatattgtgtatctatacagaacgttatgttattcattgacaacactattcacatctaaattattttgtgtctgttttaaaaaatttaagtcatgatatatgtagaaaactatacaactttttaattgatatatcatgaacttgaattaattttttaaagattagataatatgaattacaattgggaaggggtaaagaaaaaagaaagagaaaaaggaacttctctcataccacctgatttcttttctcacctcaacactaataataaagccacgtcaccacattttccttcctcgctgacaaacgtaacaccaggacagtgatgtcttttcacaccccttgaaggttatttattacatttacaaatttatggtgttagttagttaattatttagtgaaaaaatgttatatctgcaaatcacccaaatcaaaatactgtcataagaaaatgggatcaagaacattcattctctcaacccatttacgatcctacgtacttaggtaatacgtaccatggctataaaacaaatatttctatcacgcaaccacacttaagtacaaaactagcgattattataatgtctgtttctctttgtttagttgagcatttatataatgtttagtacaacttttactgtttggcttatgcaacattgcatgtccacatctaataaaatctaaaaagggtaaaagtataaaagaggaagatgtgtctcctttttcatttgtttgatagaagtattatagttttcacggtttacatttttccatttaagttagctactattagtaataagtcttaatgtctcacttcattagaaacaatcataataacttaatatctccctacatatatttcttcggagacaaacaatattttatcaacaaaagaaacaatattcttattaattagtttatgaccatgcctatatgctaaaaggtatattgaattgtgttattgtattcatgttttcattgcatgatttgacaacacatgattttttatagataatattatatttacttcttctttttcttttaatatgaccaattattgtttttcttcaaattcatcgaggaaattcattgttacgcgcattttatatgcaaaggataattttttcttaaaaatgataaattaatagatatatattttttaaaaatattttgcatcgatgtctatttttccgcagaaggaaatacttgtaaacagtttgactaatgtctaatttctttcaaaatttaccgtagaaaaagtaaaaaggagaaagttgtatattagaaagcagaagaaattgaaaaaaaagaagaagaagaaggtatatttaaaatttgcagcttaaaaggctctaaaaattccgtcgctcagtttccgtcgctcctccggctttgtcatcgtcttttgcattgccatcagtcatgatggcctaagcttcttctccctctctctctctttctctctgagacctcgtcttcttcgatttttcaccgctctcactcaacttctctgttgatcaagctccgattccagtttaagtgagcatttaggtttcagtcgttgccttttgcttattttcctagggttttgtcatcgcatggttcttatcgtgtttcgatttcacgaggagttgagatgtaaggttggaatttcgttgtttactgatttggaaactctgctctgcgcttttgtttcagaattatctgtttgttgatttcgctcctggttgggtttttgtgtgttaagttatatggccttgttcgttagctgactgaaaattgtatacatttgtgtttcgtatttcatcatgtgaatttcttcgtgattttgtaatttcacatcaatggctgcctcataagctacctcttgagtgtcttaataatgcacaccatgtgtttgaaggttttcatccttctgttgtctagttagtaaaaccgtacgaaaaatctggagactgtgtctgtcttgattacatgcttgagcaataagacccgtttcaatcattggaaggactggatttgttgttacactgtaaatcctttgatattctttccttttacccaatcaatgtcaggatggctcaaaggaggggaaagttttccttcagaaacctgacgaaaagtcaactaggtggtgttgtctttggctgcactaagaataccatcaaagaatgtatgtcgaaacagttgtttggtgagtcttcttgaatagcttattcttttcccatgcttgtttttgcttctgctgaatgtagctgtttgtttgctgtctactttgattctttgcttgctcattgtcgtatgctgttgcatttttttgtttctaaactctatttcgcaatgtttgtatgtatatgcttcttgaatccgctgatg

SEQ ID NO: 28667 - DNA, 3003 bp, Unknown
  misc_feature (1)..( 3003): 2750-1469P.txt file - cDNA_ID_2998086; gDNA_ID_2926240; Annot_ID_142865
gatcaacagagaagttgagtgagagcggtgaaaaatcgaagaagacgaggtctcagagagaaagagagagagagggagaagaagcttaggccatcatgactgatggcaatgcaaaagacgatgacaaagccggaggagcgacggaaactgagcgacggaatttttagagccttttaagctgcaaattttaaatataccttcttcttcttcttttttttcaatttcttctgctttctaatatacaactttctcctttttactttttctacggtaaattttgaaagaaattagacattagtcaaactgtttacaagtatttccttctgcggaaaaatagacatcgatgcaaaatatttttaaaaaatatatatctattaatttatcatttttaagaaaaaattatcctttgcatataaaatgcgcgtaacaatgaatttcctcgatgaatttgaagaaaaacaataattggtcatattaaaagaaaaagaagaagtaaatataatattatctataaaaaatcatgtgttgtcaaatcatgcaatgaaaacatgaatacaataacacaattcaatataccttttagcatataggcatggtcataaactaattaataagaatattgtttcttttgttgataaaatattgtttgtctccgaagaaatatatgtagggagatattaagttattatgattgtttctaatgaagtgagacattaagacttattactaatagtagctaacttaaatggaaaaatgtaaaccgtgaaaactataatacttctatcaaacaaatgaaaaaggagacacatcttcctcttttatacttttaccctttttagattttattagatgtggacatgcaatgttgcataagccaaacagtaaaagttgtactaaacattatataaatgctcaactaaacaaagagaaacagacattataataatcgctagttttgtacttaagtgtggttgcgtgatagaaatatttgttttatagccatggtacgtattacctaagtacgtaggatcgtaaatgggttgagagaatgaatgttcttgatcccattttcttatgacagtattttgatttgggtgatttgcagatataacattttttcactaaataattaactaactaacaccataaatttgtaaatgtaataaataaccttcaaggggtgtgaaaagacatcactgtcctggtgttacgtttgtcagcgaggaaggaaaatgtggtgacgtggctttattattagtgttgaggtgagaaaagaaatcaggtggtatgagagaagttcctttttctctttcttttttctttaccccttcccaattgtaattcatattatctaatctttaaaaaattaattcaagttcatgatatatcaattaaaaagttgtatagttttctacatatatcatgacttaaattttttaaaacagacacaaaataatttagatgtgaatagtgttgtcaatgaataacataacgttctgtatagatacacaatatttttttatggaaagatattaaaccctaagggataatatatagggaacccaagggtttaaatctaaaccaataattaaatcacttaacatccttaatcaaaacaaataattcattttaaaacgtatataaaacaaggtatacgtaaatagtatatttacaaatagaatagtatctctcaacttgcaacaacaaaactcaatttcataaccaagacaccaagcgcaacaacgaaagtcgattccctgaatccaaattgtgttcctctctctgtaattcgaaacccccaaatcaaatctcacccaaaagtaattaagagactctgatttgaaaacaaaaacaagtaacgatgtaggtgtgaggactttactggggagaaagagagggggagggaaaaagaaagagagagaaagagagagggggagagagagaaagagagaagggagagagaacggaagagagaggtacacataaagagagatgagagaaatagatagaggggtaaacttggaattaatatacaaaatatagaggatatcatttttttctttttttaatgttagtttcttaattataaactttttgttggttagttttgccaattccccttttgattttatgaaaatagggttttctcaataattaagttggtatcatgagtaaaaaatcatttcaagcataaacaatcttaaactcttaaattgtttacgactaaagctttttttgttttcgtaaacacatcagatttatcacaagatgcaaccaaaagatttgccaaatcctcaaaaaaaaaaatcgatcaaagcgtttgcgttttttcttttcttttattttttttaatgaaaaataatgaagaaaacaatttcatgcaataattacgttggaagcctttttgggctcgaaattcgaatgctttatctatgatgggattgcaagaattttttattaaaaaaaaaaagttatggcgtttcggttaaactcagaaactctaatcgagttagaaaactcacgatcgagttttggagctttggttaggattgaactacaccagttattgcaaactccgaaaagaaatcaaggtccgcataaccacgaaccaaacaagaccggaattaaatccccaaaagattaaatgttccaatttggaccggtccacagaaacacaaaaccaggaccggaccaagcaaataacaaaagataaaattggtcaacgaaaagtcagctataatctctgctctccacaacaaattaacaatgaagctagaggtgtgtgggagaatgggttggcacacacgggtcacagtttcacagacacgcggctcctcgatggttgtcttccgccgacagccgccgcgtgtatgtccttcccatacggaatctgccacgttgcgtttgtataatctgcctgactagggctttagcagtgtataagagacgagacgagacgcgattcaccggagagtcaaagaggcaaggaggagaaagccaatg

SEQ ID NO: 28668 - DNA, 3000 bp, Unknown
  misc_feature (1)..( 3000): 2750-1469P.txt file - cDNA_ID_2998102; gDNA_ID_2926241; Annot_ID_142879
ctgttgcctgcttctaccaagttttaaacgctcagataatcttgatttaagtttatatatatgtttcttgtcaaatatcagagggtatatatctacatgaaacaattttttttaatgtttcattaaataagtctatatgaaatgaaaatagcgttgataatttgaaagaaaaataaaaggaaaagttagaattttttgcttaatattgattagttttaatgctaatcatgattatttattcccatctgacttgatccaaaaaaccagaaatagattaccaagttgatatgaatatattttcaaaccgaccaagtttttcttttgtgtggaaattttatttacgaaatttatatttttcatttatagtatatattcatgaattgctttttacgaatttagtgacaaccaattcgaaacctaaaagaaaataaaaaattaaacggttgtaatatttggagtcgatatgttttcatttggatttatattgtaatatctggagtatatgtttttcgtttggatttttgttgtatttactttcttactttttggcttattcaagacatgcgattgtgttagtctttactctttatatacttagtgatcgttccattttgacattcactttcttacaaattttttcaagtttcaggactactaataggaaaattctcttaatcatcttcaaaattggggattcgaccattttttacataattttgttatatattgccataatttgagattttgttattgaattttatttaattccaatatttatgaaatgtcttgaatcaagctttgtttttcgactaagttatttgcttcttttttggggggttttggtaaaaactttgtttacttttcgacttattttgcttcttttgtgctgtgttttaagttttatttagtgtttcgactaacattataatattttttagtgtggtttttatttagtgtttcgactggcattttaaggtgtttcgaatgacattttcgtgtttttgtcatttaatggtttattctccttctttttttggggctttgataaaaaatttatttactgtttttcgacttattttactgtttttcgatttatttagtgtttcgaaactaacatttttgtttctttccttttttgttactaaaaaatttgtttactgtttttcgacttattttgctgtttttgtgctgcgatttaagatttatttagtgtttcgtttgttttccttttttgttactaaaaaatttgtttactgtttttagacttattttgctgtttttgtgcttttaagatttatttaatgtttcgactaccatttttgttactaaaaaactttctttattcttttagttgtgtgtgtaagttttatttcgagtatttcggattcacgtttttcgtgtttagttatttaaaataaactaagatttcgggtcaggttcaaattcattaaataggggcttcgggtacctgtcatttgggcgactgtcattccaaggtttgtttgtttttgttattttagagtggttgttattttcttgtgtgtgtctagcgatttgttgtaggttgctgtaggaactacactagtcacgcattgggcgctatgctcactcacacgcccatctatacaacctatacatacaactatacaatctccccctatttatacatctatacaatcacaccctaataatacatctatactatcacaccctaacatacatctaaaccatcgcaccctaaacattcatctatttatacattcacaccctaaacatacatctatatactcacaccctatcatacatctacacattcacaccctaaacattatcattcacatctacatacatacatgtatctttatccggaaagaaagaggaaaatacaaaatattgcacagtcttgtcaacttcaaaggctggcacagcagaaaatggaaaatactggatatagtcccaaggcttcgttttcccttcttcaaccttctgcaaaattaattaatcaaaatcagtatttcgttttttccgttgcacatgcatttacatacaaatcaaacatttcagtcaaaaattaaaacccattcttcctatgttttacataaaaactaaaatcttcattctatgttttcctagacagaacataaatatatctagcttaatttcaacagcaacaaaaagaacatatatctagatataaaatttcagtttatttaagacacatatgtagctaaaaatcagtgtatgtcatagttcatagatgaagtcaagacagcaatgtatataaaacagaacattaatttaaattccaagttcaactccataaaagatgttaaaaagatgaagaacatatctataagctaacaagaaccgtttatatgattaaaaaaaaaactagaataactaagacaagagtatttttaccttgtaagagaggatgcttatgtttgtttctctcggctaatgagcaatgtagacaagtttgactacgagaactcctaaagtagaagaacggaattttttaaaaaaaaagactgtattcgacatttgtaagaaaataaccaagtaaagaggattcagatttctgattcaagaaaggagtatttatagagaggcattatctgaatctctttccaataaaatattataatttcaaacgggaagaaaaatgttaccgtttcacaacgttcatattttttccactgtcaacaagtcaaatcaaactatacgttagaacaatagtaaaaatcgtaaacgcacttaagactctttgatccgtttactgagtaaaaaatctctgaaagcttaaggcccaaaattaaggcccattatatgttaccgtttcacaacgctcatattttttcactccaacaagtcaagagcaaaatattggaaacctaaattatgactcttaaggcccaaaagtaaggcccattaagtgtgatataacgacgttaaaataaatgaattgccaaaaacaaattagaagaagaaaaatcgatg

SEQ ID NO: 28669 - DNA, 3000 bp, Unknown
  misc_feature (1)..( 3000): 2750-1469P.txt file - cDNA_ID_2998114; gDNA_ID_2926241; Annot_ID_142887
tctcttcctttgctctcaaccagcagtattggtgatgaaattgaatcctctggtattctgaaaaagcttggatactacatcgactctgcagatggtcttctactctgcggccgccatccaaaagcttactacttgtgggatccgagtacacagaagcagcagcaacttccacgtcccagagttcatttcgaagaactttgtatgtctttgatttctgaggatagtcctgatcaagggtttagctacaaggtggtccgggcagagtgtgtagcctttcctgttaacagtacaaaggtgaaggtagagactttttcctcaaaaacttctacgtggagctactcagagcttatttgtctcgagcctctatctctcagcccgtggactccagggagagtgattaaaggcgttgtttattggcatgctagaggaggtaaaattgccatatatgactcaaacagtgaggagaaacggattgatgtgataaagcttccgaaaacatatgactatgatgaacaggttctgggagaaaccgatgatgggtctttacaatacggatggagcaataagtcggtaatggaggtatggaagcttgaaaaggtaggcaatgtgcttgaatggaacctgctgtttaaggtgaatttcaaggcgatgtggaaaatgaaccaagcggtagctacaagattcagcacttggactaaagaaacgcagctgcttgcgctcttcaatcagaagtcggacttggtgtacatcagatgtgatacacaaatcttcatctatcacacagagactaaaagggtcgaagtagttcagtaccaaggacgaaaatcgacactcgtttgggatttcaacaaagtggtgccttactttcgacgtacctggccttgttctcctctgtttgaaaacaatgccatgatgatcgacactcctcaatgcaacgcctcttccgcaggaagtaactaagtagtttatgcttttaatcagtttatgtatgtaggctattcaactatcttttatgttttgatgctgaaggtttttggttttggccattgatgaacctctcatggttttgatgtattctctcatgggtgtcattaaagactctgcctttttgcatttgcgttttggatctgcgttttgtggttgactccgtttgtagctaatttatgataatttacacatagaacaaatggttcaatctaacaaattataaaacagatcaatttatttacacagataatcgatgtcacttgtctacatagttcttaagttataggttgatccaaatagtttcaatattataagttgaattaatgggtcacttggagaatgtccacattctttgaaatgtaatgacgaatgtttgttctttcaattttctaaaaaacgaataaacataataataattataaagtcatgtagtgatctaagaaacagatcatagtttctctctatgtaatcttaggtacagataataactttatgatctcattattggtacattgattttttttctattttctttttgcttgcaacctttttcttcccttttatctttttatgaatgatgaaaatgttatgttaagatatttgtaaagatcattgatttgaataaatagagacccgtctaaatatgcaccaacaattctgacttcaagtgagatttacatttcaaaattatgcattatgcctagaaaaaagatgatcactaatattgttggatttgaagggaaaaagaagctggtgttaaaagagtggtgggacattatgacaactcaaaaggatctttaactgtgttgagaaactccaatgcattatttataaaggcctaaacaaaacctataggtcgctctctatatatgttcatatcatatatatggctcacatggctcatcattgtttcaatgacatgataactaaagttgtaatgatctactcaacaacgaattttggtctatatggaccaccaccatcaactaatttttattgatattcatccgattacgagatttgtgaatctttgataaatttagctcattattatgaaacttttaaagtaataaatatgtgcatgttttgagtttctaccaagtttgggtgttaaaactcagtttcataattaaaactccgttactgctatttcgtataatgtcattttagtgagttataaacatttagtgactaatactttttagcattctcaacaagacaacaatcacccctaactacaagaaaatgaaacccaaaatagtctttgattaaaaatctccaaagtttgatgtatctaattttatttctctattaatgattaaactgtactatcactcattgtcgtcattattcttttctcccaaagctataataatttacgagtccaatgtatatagttttcaagcgatataatggttacattaaaatatgtataatctactttaacatactttcatatatattttggaggcatagatattagatacgttgacaagccacatgttcttttatcacaagccaaaagtaggaagaaagaaaagaatgtatgaatttataaagtgattggttaagaagcaaaagaaaaaggagagttaggggtttgaacaagtcagtaatcatatagatagtgaaagtgacagttggaaaaggtgagagagagagaggatcatcactatatttagacatcacttgaaatcatctcttcacaagtgtctgaatctcccacatcatctttcttcctgattctcatcatttggtttgtgttcgttcataggtaaagtaagattcttccatacctattagacactaatgtgttgttacatcattatatcgtttgttctattgatgtgatttatatattgatgagtctaatgatcttgaaacacaaaatctgtggatatatacctattttggttcgatctttaatggatcttctttagatgtttgttctgttttcttgatcaacttaataagaggattttatcatttgttaccagagaactccatctaatg

SEQ ID NO: 28670 - DNA, 3003 bp, Unknown
  misc_feature (1)..( 3003): 2750-1469P.txt file - cDNA_ID_2998138; gDNA_ID_2926241; Annot_ID_142897
agttctacagtctcgttaaaaacgccgtttctctgccttgtgtccttctcgccgcctgtcagaatctgtctctctccgccaattcgtccggagatttagccgatcgtgtctcccggaggttctcaatcgaagaaatggggcgcgagatacgcgaaggcaggtttgatattcgttcatgttgcgtcgaattcatctcttcaagtcttgttcttcccaatttaaaactcaaagtgttgatagaagctattagaatggttcttgagattgtgtatgatgatcgattcgctacgttttcgtatggtggacgtgttggtatgggtaggcatacagcgattcgttacctgaaaaactcggttgagaatccacggtggtggtttcgtgtttcgtttgctcgagaaatgtttgaagaacgtaatgtggatatactgtgtggctttgttggagagaagatcaacgatgttatgttgattgagatgatcaagaagctgtttgagtttgggattctgaagattgagcttggtggatgtaatagtggaagaggttttccacaagagtgtggcttgtgttcgattttgatcaatgtttactttgatggacttgacaaagagattcaagatttgaggctaaagatgaaagttaagaatcctcgcgttggtacaggagatgaggaatcaacaggtaatgttttctttaagccagtgaatatttatgcagttaggtatttggatgagatacttgtgataacatcaggctcgaaaatgctgacgatggatttgaagaagcggattgttgacattttggaacagagactagagttgagagtagatagattgaacacatcgattcatagtgcagtgtcagagaagattaactttttagggatgtatcttcaggctgttccaccttcggttttgcgcccgcctaagtctgagaaggcggtcagagcaatgaagaagtatcagaggcagaaagacgttaggaagttggagttaagaaatgctagggagaggaatcgtaagacactggggcttaaaatatttagacatgtcttgaagaaaatcaagcagagcaatgggtttaaatttgaaggtgagatagagaatgaggttagggatattttccagagctggggagaggaagttatgcaagactttatgggttctctcgaagagcgatggaaatggcactggctgctcactagaggagattttctctctttgagacatattagagagaaattaccacaagacctgattgatgcttatgatgaatttcaggagcaggtggacaaacatttggctccgacccaggctaaaaaggtacttgaggatgaggagaggagagtagaagaagaagaggaacagagatatgctgaaaggacagttgaggatttgactaagttatgcatgaaggtgtcagctccggaggaacttgtcagaaaggctattaagttagttgggttcacaaacagcatgggacgaccacggcctatcattcacctcggtgactctcgaggattctgatatcatcaaatggtatgcacgggtagggcgtaaatggcttgatttcttctgctgttgccacaattataagatcggtaaaatcattggtacgtatcatatgaggttctcatgtatttgacactagcatgagaagcatggatccactaaaaagcttattagacactacacgaaagatctcagagtatcagatcttgacgggagggaagaggcccattttccatcggaaagagaggttaagatgatgggagacaagaacctttcagaccctaaacctgtggatggcacactatcgttgcttttgatcaggctcgcatctgatgagcccttgcatcactgtgctgctagtttttgtgaacgatcagatacaattatgcaccgtgtacatctactgcaaaaccgtttacatatcaacccactagacgaagagaaatgggttcctggcatgggcaccatccactcagctttgaatcggaaatgtctccctttgtgctccactcacatcagtgatgtatacttgggtaaaataacccttcaggatgttgatagtagttcattcatcgatctcaggtgatgtctgttactctcttctacaattggttataacatctgcacgagagtaagaagtaaaaatggccattgctgagatcaggcgaaaatgcgtgccaacagggtgtatcacatacacattttgtcttgatttcatcatgataggaaaatgaatgaatacttcataagcaactgtctggctgcgcaatggcatagtaagcttcataattgtcagggggtttggttcttctcaggatcaggaaacaaagatttgagcattagttacctgaaaaacgcaatgatcatctgcatacacctgagctgtaccttgcacggagcgaacatgtttgttcctttacggtcgtcagtatcacgctcagcattgtgatctcatttgacacaccaaaagcagttgacacgatggatatttgtcgaattggcggttggcaattgacagttgtataactataattttgcaatcgtgtaatgtatgaatctacattttagtattgtagtagtaagagggacacttttcttctgtatcatgtaaagaaagaagtgaggtcaattactgttctggtaaactcgcgaggacgtctagtataattgcgaaaatgtaggagtggatatgtgaatacaagaagttttgaggggccaatttgcaaaaagacatgaaaaagaaaaatgtgtcgcgtgtccctcacatggattgccgacgggaagcattaggggtaaagtcgtaaataaatttgagatcttcatcttctctgtctcctctgttcgaagctgagctttttttggttgcttcagtcactcaatagattcacatggtttcagacagaaaagtataaagaaagatttgaatagcaagcgtgcgagagttgaagaagaggaaggattgttttaagagcaagaaaggaatttgaaaaccatg

SEQ ID NO: 28671 - DNA, 3003 bp, Unknown
  misc_feature (1)..( 3003): 2750-1469P.txt file - cDNA_ID_2998145; gDNA_ID_2926242; Annot_ID_142899
tgtagtagggtacgcaaggtgaattcccgagagtgcccttttctgcgcagccgaactcacatctcgaccaggccgggtttcggcccggcgggccggctcgagttctaaagtgatggtcggggctgggtcgatattccttgaaatgggccggttgatcactgaggcccaattgatgtatcaacacatatctaagattattcaacttcatgtgaatgagcaagcaccttttttctgttttattagacttagacatttttaattgtctccaaaaattgtatacttaacaaaaaattgaagctcgaatttcatcaaatcatgtttatttattggattattttagtatgtaggagttgtcttatcctggttactctaattaacatattaatggtagtggctggtgatcgagaaacaatataaactaattcaagtgcacattattttcacgatattacgctagttatatctgggactgcaaaaaaacaattagatattttcatgtgtttcgtaattaacggagagattatttaaccacaaaaatgatggccatgtgtcaaacaatgaacaagtgataaagacgagaaagagtaaaacaagtaatctgatggaacgtgcgaagatgtagaacatgaaccatgtcatctggccacgttgcttagttaatctggtcctaacgaatatgctttatggatctttcctaattctgaatagaaaatacaaataaatgatttatgagttacgtattttagataagccgtgtacggacgacggactttttcttatggatattgaaatcgaaatagcatatgcttttgacacaataataagaaggatagcgaattatggtgtaacattttggcaaaatataaaatagcgccaattatccaccaagtccactattttcgtccttttcaacatatacactattttaaaaatttatattctaatttgcattttatatttttaaatcagagtctattaacatatagttatatttggcatgagatattgatttaaaagattgaacttgtgcaactcaccagttcaagaaataattaaaaaaaaggagatacatgattcatccctgtttaagttttaattgacttagacgtctgtttatcaattcggcaatatggcttgagataaactaaaatgttagtgttttcaaccaaaaaaaagaaaaaacacaaaaactttaggtcaaccattttaatctcttaaacgcaataaatctaatcgcctgataggtgaggagaaaatgctcaagtgtaatgttcatatcatctgggttggtctatctgagaattcatgggccaattaaattcaccagcccaatacatagataaccaaaagccgaaaaaggaaatgttgttagcgcccaaaagcccaaatgattactttttagaactttagacgaattaaatctttaattgacatttaataataaattacaataactaaatactaattatattagttcaattaaattttagttaatggacacaaaataaaaaatgtaaccggaactctttggtcgaaaacggactcttcaagtgctttggaatagacggacgcaaaatgaatatcatcaagtgcagtttaatttgtaaacaaattctctctacgcaaacaaaaaaatcactggtgaatgtcatttaattatctattcatttatttcccgtaaaagaaagtgcgtaaaggttttcttgttgaaaacatgtgtgtgatgaatgattaataaaccagaaaatgttatgtctggtctgttcttatccttgacgatacagacatacgtggatttcactagacatatatagtcacacagacgactaaaattaattgatccttatttttgcattattttcgaccttttttttctttgttaaatacattcgatctattgaaaagatagttaccatttttctaatgaacttatccgatttgcttcgaaataaccttacttaatttcaatcaaactcgaataaggtgatttactttataagttataaccatacaaattttattagactgatacagttcttaatgacttgattgtcggcatatttcaaccaataatttaacacatttttgcggctttttctttattttcaccaaaaaagtctatattcgggggaggtttcggtaactataaaatctgaattaccaaaacaaaagaatgtacatactgtatatgaatctgagacttttagaatggggcatatagctttccatcatctgtcttgcaattaaacttgtaaactttcaatatgttttacctacttagattacatcacggaccacacaacttgcactgatcagtaagtatctcatttttttcaaagttttattttactcaattaactgttcatatctatatggttttcttaaggtgttgtatatatatatattgtttaaggtgtcgtattttcctttaattctggtatattgattgacaacaatgtaacgtcgccgaaccatattcgtaaatgacatttccgttgtaaggcataaaccataaagatatctaatagtggagttcatcactattacataaaattttgagccaaaaaacaaaaggttacattttatatattacaaaatatagtaaaatgattatagaggtgaaaaaacaaaatagatatacaaattttttaaaaagaaaggttactaaaaataatatacaatataacaaaacaaaacaaaaatcaaaagaaatagatatatgaaaaatcataaaattggtagggcacaaagttttaatatcatccgctcaaaaaaccagagagatagggtcccattataattttcctcattttcatatgcattcaataatctatctatatgtacagtgacataagtgtcagcctttacatctatgtacatatagcttctagattctcattcattccaatcacagagctgataatttcagcagaatatttactattttttataaagaaacaaaaaaacatagaaaggtttggtttttcaaagaacgtgaaaatg

SEQ ID NO: 28672 - DNA, 3003 bp, Unknown
  misc_feature (1)..( 3003): 2750-1469P.txt file - cDNA_ID_2998149; gDNA_ID_2926242; Annot_ID_142900
ttattttttggcagaacgctggtgtgcattatgagacttggaatactggtattctagggccagtcacattgaagggagtaaactctggaacatgggacatgtctaaatggaagtggtcttacaaggttctcttgaacatgtgtttgataaaaacaattttaccaaccacaacaatactaaactaaatgtgtttctttttatttgtgatgagtagattggtcttagaggtgaagctatgagccttcacaccttagctggaagttcagctgtgaaatggtggatcaaaggattcgtggtcaagaagcaacccttgacctggtacaaggtaagaaatattctctcattttcttcaaaatagatcttttaagcttaaatttgtgtttcgaaacacaaatgaaatggtttaaaatctatgccaaactatatgatattttcatatacctacctatacgtacaaaattattggttaatgaattttcaaaaatggcaaatgaattaaaaggtttatatatgagatgttgaatgtttttttaatacatgtgtaaaacactttaaacatacattttacattagttaggaatgtagctaacattcttaatctggtttttgtgatgaattataactatggatgttattgaaattatgaacataatataagatatagattcatatcggattcttgttgtctctatttgtagtcttcttttgatacaccgagaggcaacgaaccactggctttggacatgaacacaatggggaaaggtcaagtttgggtaaatggacataacattggacgccactggcctgcctacacggctcgtgggaactgtggacgttgcaactatgctggaatttacaacgagaagaaatgtctcagtcactgtggtgaaccttctcaaagatggtgagaaaaaagaaacaatatccttctcttcttcttatttggtctaaaatctaattcacatgattgatttattaatgttttaggtaccatgtacctcgttcatggctaaaaccgtttgggaaccttctagttatatttgaggaatggggtggtgatccaagtggaatctctcttgttaaaaggacagccaaatgaagcttcttacttcaaattttttccggaagcatgcagagattgtcatgtacagatatagttgcattcattggctcattgtggaagaatattatatatatatgtatcctgctctaaaaatgtattacaattgtataaaataatatttatacaatagaccaaaacaagccaatctcaatcaccccataagaggggttcttcttcaggcttgatcaactaccccttcctgattgctctaacgtaactaataatcattttagcctcccattttgaaaggatgaaccttggattgggttctgcacttgagagtggatgtattgcatcatcccatttgaaccaatcaacataaagctggcaccaagagaatcaatcaaaaggtcacattttaagtgacatattagtagaaaaacggctagacttaaaccacataacgtaccacatatggataaaagttagcatgttccatcattctacgaatggtctttctctcctcttcagtcagctccacttcctcgtcattatattcatcatgaatcttgcccctaagccccataaattgcatcaccataatgcaactaaataacaaactatatataaaaataaacagaaaagtcttcaaactgaccaattcttggagtcatcattagtttatctcgcatttctttcttggtaatcttcttcccaatgatgtcataatcaatatgtttctcatccttataccactccaagggaacatccccaaatctatttcttggagcaacctacacatcaaagatttcgtttggaaatggagaaaagatagttacaaaatctagaatgaatagataaagcatcaacctcatcggcgacttcatcttgctcagaaccttggtcacttccatattcctcaccatctacttgttcaccatcatcatcatcattatcatctgatccctcatgacctaatacatgtagatgccggcacaattactcgctctctctctattacttgcaacatactagagctagaatccctatcaccccataaatgttcattataatctcccacaagtatcaaactataataaacctatatttgatgaatgtggtggtggtgacccaagtgggatctctcttgtaaaaagaacagccaattgaagcaagcatttgtgtggtttacaaaatcatgcatagattgtcatgtatagatatagtcacatttattggctcattgtggaagaatgttacatgtatccatgctctaataatgtattcctagtgtatgaaataactattcacaaaataaaccaaaacatcaaatcttttttaccaatcttttgaatagttatttcacttgagctctgatcaacattttttatggtatggtaaaaaatccacctctcagataaagcatcacatcagatgaaacacgaattttctttttcagtaccgtcagattaaaagattgcccacacgtgtttcccgtttactcttcttagattcttattcaatttgtacaaactctttttttacatatccacgtttccggaaacgacaaagaagaacaattcaataaagtgataaacccttctccattcctaaattaaaataattaattaactcttaacattcatgaatctctaatcctaatcaccattaataatttatccattagattaaatcttctttcttctcttccttaacttagaagactcttaaatctaataactctgttcacttccttcacacgaatcaaaaacaaaaagcttcgtacatttcgcctagctttcttcgttctagggtttcggatcttacttaattacccaaaacccttgaatccattactctgtgtgagcttaaatctcttaccttttatcactttcaatcgattgggtattaagttgtaaaggaaggaacttggaatcatg

SEQ ID NO: 28673 - DNA, 3003 bp, Unknown; identical to SEQ ID NO: 28672
  misc_feature (1)..( 3003): 2750-1469P.txt file - cDNA_ID_2998149; gDNA_ID_2926242; Annot_ID_204114

SEQ ID NO: 28674 - DNA, 3000 bp, Unknown
  misc_feature (1)..( 3000): 2750-1469P.txt file - cDNA_ID_2998156; gDNA_ID_2926242; Annot_ID_142902
catgcttcttccgactactttctacgtttcttcgtaaatcgtcgtaacacttcaaccaaacaatttttttatatatcatttctttttgtaggcatccgtcaataatcaatattaatgtaatgatcactttagatactatagaaaaacctaaaaagaataggttcatgcatgattcgtgtcgattacgaatatctatattttaggaggattattatcaattcgattggatttagcaaaatgttctgaaattaatggttttaccggttacaatattaagtacaccaaactttaaactctgacaactctagcattgaagattagtagtaactctgacaaacgtatcattacttcacatatgacaacgacgtctaaaccacaacagtttaattaatttgtcagtataaaattagacaaaattgaaactaatcgacgacggattagttcctacatgccgatcatgtcaacgtacgttacatacattaatcatgggctgtatgaaaaaataagttatactgtagatataactaaacaacccaaattttactaatttctcttaacacgattttaggtaatgtattgaaactcaatttctttcaactagatctaccttggaaccaaagtcaacttagccaacctccacgaacaaatccaacgtacgtgcatttaggtcaggactagtttgactaatttagcgtatgcacattcgattaatatttattcaaatatactttgattataacaaatataaaatatgataacacaaatttcggtaatagcgctgttggtggtaagtttcattattaggtatccactacttataacatgacacatggagttggattcacgtcatccattagataatttgaatgacaaattgtccaaaatacaaattttaaaaaatttatgcaaatgtcattccattgtcacagctagaaagttcataggtccctaaatctaacacttcaagcataaatcccgaataaaaacgttgaagaattaattactccaattatgcttttaaagatgtagtttggttacgcgcggtcgattatttttgttgacgtatttgtccctttttgacaattctttcatgacatatatttagtccacatgatgaatacaaatgttgtgattttcctttacatttcatcgaaatcagatggtgaaaccaattatataacatatggactttgagtctttaacagcttaaactaggcttcgttttagataggttttcgatagactttgacacattaaaatttaaaactatatacataaattagaataggtgattataattagattattattttgtgttagctagaataagatcgacgagaaaaagaagctagaataagatcttataatataatgtataaagatatatgtgaaatatagataaaatataactgcatgtgtatgtcggtatattctaaaatttcgtaataaagatcagtcattaaaatgaatcatgtggatgtaattctcgtcgtctctattccgaacatcgcaagtattgttttccttttgcatagtgcattttttaaatgtcatattccaataataatctatagtgatactcgaccactatttccggtttgacgctagtcatttccacacgcgtgattaactattacatgtcgttgttaggtggtgtcagattaactatgaacagaaaacaaaagaaggaacataatgaatgaacataatgaaactgcagaaatcttttattataggaaacgaataatctcttctgattctatactagaattaagcctgacatcgcatgatttctgatgcacttgtattatgtaacaagacccatttgcaattgataagtcatttggagacccactaaacagaaaaagtgaatattccttctttttattgttctttctcttttgacatagtgaatatttatacttaataaatcagtaatattcgatgatcaaatgttttaatgtgtggattctagtgatcctactaataaaagtgttaaatttcttttacgacacatggaatttatatacttttagtagtccgttcatgacttaagcaaaataatagtatacagaaaaatacggaatgatgatcgtcactgacacagtcacaattatacggagtatataacttgttggtagatagagtgagccagacatgtgtatttatgaagcttttacgtatagtgtagtcattcaagttattttcgcatacgtgttatagtatttcatatgcattaatgagctttcatctacatttttttttgttaagcttttcatctacattaatagttaagagtaaaatatactgtcttgttctttctagacaagatataggagacattgagacaatattataaagaggcacatgtttttactttcatttgaggtttgggaacttaataaaaatgctcgagtaaatgacgatcgtcatgtctccatcttttttcttttcttacatcattacaacattttgtaacttggctaagaattaaaatgcttgatccaaatgcctccaccacttacattaggcacttaacctacgttgattttctttatatcagctaaattgaatcaatgaagtatatattttaaaatatgttttttaaacagctaagtacctaacctgcaagatttattagcagaataaatcagtgacatgtatattaatactatactccaataatcacaatcaaaaataaaatcgcaatcttacctgtctatttaggaaaacagaattaaaaaagaactttgtcaaaatgagaaaaagaaacaaaattagaaaataaagaagtaattcggatatataaagaaatgggccatttattttctatatataaaaaatacatacagagatgacacaacactgatagcagaacaaacacttttggatcttcttcttcttcttctctctcaatactcacaaatcctccattttctctgagtttagtttcttcttcagacactaagattcaagtcctctctttggtcggagaagatg

SEQ ID NO: 28675 - DNA, 3000 bp, Unknown; identical to SEQ ID NO: 28674
  misc_feature (1)..( 3000): 2750-1469P.txt file - cDNA_ID_2998156; gDNA_ID_2926242; Annot_ID_204116

SEQ ID NO: 28676 - DNA, 3000 bp, Unknown
  misc_feature (1)..( 3000): 2750-1469P.txt file - cDNA_ID_2998160; gDNA_ID_2926242; Annot_ID_142903
atcaataatatattatagaactttattaaatagtttctttttttttttttgggcaaaactaaattgaaaaaataatagggaaaaattgaggaaaaacccctttacaatcagaaatcccataagaaagattatcttgatgaaaagattagtttagtgtaatcaataaaaataaataattacagtatttcgatcgtcgtatgtcttaatttactgcgaacacatggtagtaggtaagattggtgagaagataaaaatagatgtgaatgcttttaaaatataacggtggagcaatattgtcagaataagacaggtagccaatgcgcagttcttttcaaaatgttttttcgacaacacttctttcgaagaaataacgtttttattttgtagattcatataatttagcaaacaaaaaaagaacactgtagattgatatgtattttgaatatatatttttaatcagtctttcaaattcataactatggaactatactagtaccattttacctcaaagttcagacatcagatcataagataaaagtattgaacatacaattaagaattaggcctgttactaacttaggaaacattaatgattaacgaacgatatgttcaaatttaagcagacgaaaatactacaaatcagtctaatgtataaaatatttctgatagaatgactatcagaaagataataaaaagtggaaggtgactgcatttttatagccaagccgagactttttcgtgggttacttaactagtttatagtatttatatttagttttagttttagtttggttttatcaattgtatgtgaagcggtaatagattaacatgatcataatcatttttaggtgtgttgactttgtgtatgatggtaggtcaatgggtcatatatagattactttggatctcgttgataaagcttatacacacgcaggcaaatcgatccttttcctcggtacaatatacaatgcgattgcaatttacaagaaattagaatacgtttttccacgtaaaacagtaaattatatgcatcattaattacaaatatctcaaataaaaactaaaaaccattattgcttcattagccacccaagacaaatgaattaaaaaaataagaaagaatgaactagaatctaatagaagatgcataggaaaaatcaaatagagtctaatggaaaatgcataggaaaaatcaaataatatacaaccgtaaccataagatcaagaaacataacttaatgatacatgatcgagattaataacaacaaagtacttttgaatctggcaaaaaagcctaaatcatacagttggaacgtggtgttaggaaataatagagacttgataggtctttgagaaccctttgagcctaggattcctctttctgcgcctttaatctcttccctcatgcttttaatccccattaaatatattgtaaacactaaactaacacaaaaattagatgtgttacgtccgcttctgatttcttatttaacttaaaccaaccatcaacatcaaaagattttattatacaaacatatgcatgcgcatatttaaatatatcaatggtcctgctaattattttattcgatttttaaaaatattttgcatcttttcaagaaaaacgattgatggaacccagattttttcgtttaagatcaatttgaaccatcattcaattttattttttaaaatgtgaattttcattaatagtgtacaaaatacaaaaagtacccatacttttatatatattaatttaaaaaataaattattttcgcggtgtaccgcggattaaactctattatatatatatatatatacttatttttgtatctcaaacatttataccaagttatgatgcaatgactgcactaatactatgagccactagattaaatgtctttgtcgcaatatttcatgatgtgtatatataaaatttaggtatggatgtttataattattgcgtggacggcgaacaagaaacaacggtgcacaacgacaaatgattcgagttatgtatattcttgataactactattaaacaaaacaatatcaataagaactaagatctgagaaatgagaatccgaggaagatgagatatatagggtaatcaaattagatttggtaaaagaaaaaaataaaaagaaagagaacaagctagagaataaggcaacaagtataggtttcacatgtttgtgtcgacaggccacacccccataaaaggcttgcttggcttttttgtcattgtatgcatctaatccactccaccaattttttctccttcacttattaattcgattttttagctatacacagtattttgaaatttgaacaattaaaaataaaaatgagcattcatccaaatgggttattgtgactgcctatagtcttggatgggaatgtgtaaattttagttccttcaaagattgatacttattacgtacagattgtagtaataaacctatttacaaatataattgctgataaatcaaaatttatggttgttttagtcgaattgttaatcatgtgatggtcaaatgggttatcatgtgggtcgaaggactaagcttcatgtttcttgaattttgttattttgggccttaagaggtcaggaaaagaagcccaataatctaaaacccatcatttgtggacttttccacaacttatccaataacgtggcacatttgtgacttttccaccaactatttttcgggttaattaaaaaagacttaagaatcaatcagtcctttatttccgtccttaattctttttactttccacatatagcatgaaccacgacggttggataaattcaacggtcacaatattgccacgtgtaagctttgtatctacatcctccaatcaacggccaagtcttggttaagttttagccaattagagtcactcagctcatattagcctttttgctctttctttgcttctctaacaaaccaacttcagcgacaagataacaaaacgctttcacacgatcggataaaatg

SEQ ID NO: 28677 - DNA, 3000 bp, Unknown; identical to SEQ ID NO: 28676
  misc_feature (1)..( 3000): 2750-1469P.txt file - cDNA_ID_2998160; gDNA_ID_2926242; Annot_ID_204117

SEQ ID NO: 28678 - DNA, 3003 bp, Unknown
  misc_feature (1)..( 3003): 2750-1469P.txt file - cDNA_ID_2998164; gDNA_ID_2926242; Annot_ID_142905
aaaacagtacggaaggtaacaagaatgattccacgtcccaaacaaccgaaaaagaaaattttgcttaagaagaagttaaaaatcggggttgtgtcagcaacttacccaacaaaagacgatgaagaaattgttccttccttggactctagtgccaatcaacttctctgccagagatgtcactgttcgttgaagagcaccagcatcgatgacaacccaccttcatatacttctagtcataatcctaagatttgcacagatagtttgagctctgtttcaaataaagaagctcatcaaggatctgacgagaactcctctggctcgtgtaatgtcagtcaaagctctgaagctgacattgtcataatgaaacaagatgtttcctctagcaataatagtggaatcggtgcaatggtagaaaaagaaaccgagaatccgacttccagtgagaaattcgagttctctctgagttcaaaagatagtcttggggattatagcaggagcacaagcattagtgaggagagtaatctgagccgatttagctgtgggaataagcctcacatgtcgatggatgtgagatgggaagcgattaagcatatcaaggttcaatacggctctttgggtttacgacacttcaaccttctgaagaaacttggttgtggagatataggaacagtctatctcgccgagctgattggtacaaactgtttgtttgccataaaggttatggacaacgagttcttggcgagaaggaaaaagtctccccgggcacaagcagaaagagaaatacttaaaatgttggaccatccttttcttcctacattatacgcgcaatttacttcggataatttatcttgtctagtcatggaatattgtcctggaggagatcttcatgtcctcagacagaagcagctaggccggtgtttccctgaacctgcagcaaggtaaagatttaccttttccatttcgtgtctagcttatttaatgtactgaaaattgattgtaaaaatttgtttctgtagattctatgtggccgaaattctccttgcactggagtacttacacatgcttggtatcatataccgagatctgaaaccggaaaacattcttgtccgtgaagatggacacattatgcttacggattttgacctctcactccgttgtgcagtgaacccgactcttgtcaggtcaaactctccacctggtaaagatcccgcaaggatttcaggtccatacaacacatccaactgcatacaaccattctgtatcaccgaaccatcttgccaggtttcgtgtttcagccctaggctctcctcaaaccaacaacaaggtagaaaaccaaaaaggggtgatcatctttcgaaaacccaacaacacttgagtagatcattgcctcagctcgtggctgaaccaaccgaagcaagatccaattcctttgtgggaacacacgagtacctagccccagagatcatcaaaggagaaggacatggcgctgcagttgactggtggactttcggggttctcctttacgagcttttatacgggaaaacaccattcaaaggttacaacaacgacgagactttggccaatgttgtgttacagaacctcaagtttcctgatagcccgcttgtaagcttccaggcaaaagacttgatcaggggacttcttgttaaggaaccagagaacaggctcgggtcagagaaaggttctgtagagatcaaaagacatcctttttttgaaggattgaattgggctctgatccggtgtgcaatcccgcctgagctaccggatttctatgagtatggtggtggaccagaggcagcggcggattcgcctggaggcagtaataataggtatcttgaatgtaaagccataggcgatcatcttgagttcgagttgttttaagcaagacatagatattctctggtataagcattcagagtaatcgttgttgtaagttattatatctaagttaaatctaaatgtcttatatgtaaatttagcgttctctgagacataatctgatatagtattctcaaaaatatatatgctccttcgtatctcaatttttaaatatatgatcaaacattacaatcttagtagacactaatctacaaaaccaaaagattacaaacacttttcttcaatgaaagacttgagttgagattcccatctgatgaagaacacttgacgtcgaagaagctgacctcaaagcctcagctaatggtccacccatattgtggtggttccctacattgctccaccaattcaattgctccctctcattgttgttgtttctcaggttctcttcttctttttcttcttcattgcttgttgaaagttttagagaaacatctgaggaagcgttactattaccgggcacggagattgagatatgacaagtggatgagctcattggactggaggtagagcccaatgatgattcgcctagcccgcctaaacccgcctaatgaccgtgtaatccacttaatgtctgcatagtccgccaaatcttcctcaccgcctaatagaatcgattttaagaaagtcgaagcggtacatgaacgcctagcacctaggggatgcctagacggctgcgtaacccgctttcttgaataccgcctagttgtaattgcacatttttgggtgtatatcaatttttttccagcaaaattaggcagttgcacctatcacctatgtctcaccctactgggccgggcctgaataatttatgttacaaagattgcaatttgcaaacattaaaagaagaaaagcccaaaaaggacatctttgatcatcagattggctccactttaattacgaaattgatttctttatttttccttttttacttttccttttggcgggactgcttgctttgattttggaatgatgtaaaagcaaagcaattatgtttgggaaggtttaagcaaaagcaaaagacaagtgaaagtaaataaatagatattgagagagacatagagactgttgtaacaagaaaaaaaaatg

SEQ ID NO: 28679 - DNA, 3003 bp, Unknown; identical to SEQ ID NO: 28678
  misc_feature (1)..( 3003): 2750-1469P.txt file - cDNA_ID_2998164; gDNA_ID_2926242; Annot_ID_204119

SEQ ID NO: 28680 - DNA, 3003 bp, Unknown
  misc_feature (1)..( 3003): 2750-1469P.txt file - cDNA_ID_2998172; gDNA_ID_2926242; Annot_ID_142907
aaataaaggaatttccatagttagaatagattgagatagtatattttagcggcctataatgatttcataagctttttgttctcttaaatgtcttttatttttgtttgcatctttgaagctgtctcgggagtaagtagaaagataataaatgctgctcatatatatgattgggcagctatggttggcattttgccttttgaaattcagtaaagtgaaaacaaactcgttaaccatctcacgtatatgcttttctaaatttgttatatatattcgatcagattttaaattgcatgcatatgatcgcattattgtattgatagtctatcatcatatgctttttgtaatctatatatacatttttgcaattattttctgaaataaatcttcaagttggaacttatttacaaggaatatcattaacattaattatcatcaattaattaatatttttaattattagcatttccttatctaatatatctccatcaattctaattacttttaaaaaaaaaattagaactttattaatattatattttattaaagataaatattatagttatttaaagtttagaaaatatttagaatattttaacgaaaaaacgtttagaatatatattatatatgaaatctataaaattaaataactattagggacaatgtcccacatcggaagttgagtaggatcttaagtggtatatataagatatgggcctctcctcctattgccaattggttttaggttggaagcccacagtctaatatggtagcagagcccggtccgcacatactcaacccgatccacatcgggccggcccaatacttggcccgccgatccatgcccaaacatatcgagatcaatggctagaagagccatcatctcgagggggcgtattagggacaatgtcccacatcggaagttgagtaggatcttaagtggtatatataagatatgggcctctccacctattgccaattggttttaggttggaagcccacagtctaataataactatttcaaaagaaaacttttaaattgatttgaattataaatcttttaataaaaatattattagaacaaaaaataataatgtttaattttaccgaactggattaaatggtgggacatgtttaaaatattataatgtatggattttgtaacaattaaataaccatttgaaataaaattttaaattaatttaaattatatatcttttaaattaaagtattatttaaacaaaaataacaaaaacaaaatgtttaatttcactagacggggttagatgataggacgggtttgggtcgacagtaatacgagacggtatagcacgggtgaaatccattagatatgtttagtttcacggaacgggattagatggtaggacgggtttgagtcgatagtaatatgaaacggtataccacgtgtgaagtcgtagatataacaatcaaaatataattatattatcttaaatactaaacaaaacaattataaaataaaaatataattaaattttaaattatttagttataatctagattttaacttaatgaactgtacgttattgttcttatattttaaacagtaaaagttaaacatagtaattgtatactaaataatatacagatataagagttgtacattcagaaaatacaaaatattaaatcatatatatttttaatcgactaaacaaattatatttttattcttaaaagaacaaaatagttctgcggtgtacggtgtaccgcgagttaaaacctagtgtgttatatgatgataattgaagaagcctgaacggtgaatccgatccttaaaactagaccagagttagattggcacattgtgacaacactaacataaatcattatacattatctcgttaactaattgtttatttatgattacattctgtcatcgcattattattgttatgatgaagctgtaaattagtcttgatagtatcattagtatactaaaaactataaagtatctacacatttggcttttactttacagccgtcatctttttttgaaagatggatattggattcatttaaaattcgagaaaaacgccaagtggcaagccaaaaacttccaaatgaaaatactttagaaaacaccaaaatttgcatctacaattgaatgattcacgttcaaaagaaccattaaatgagtcctgaaattgaccgttaccgtattaatgtcaaaagaccagacgacaaaaatcaatacttagaaattaattagaatctttcatattattaaaaagaaatcgacgagaaaaagttaaacctaaatattaaagaacctttttttcaatctcctttgtttaagtattaaaatatacaaagttaaacctaaatatttgtaactactactaagcaactaataaaacatcaaattaaatcataaaataccctttttcaaatatgttaaaaaatcaaaacctccttgaatattcgcatccaaaccaaggattcacattcaaaaattcctcgtatcaattatcattcgcatatatatccaaacaaacccccaaatatataggattagatcaaggctaataatttgaaccaaacatttttttttgtattttgttgtatataaaaagagaaaaacaatctctagacgacacgtaattaaaagtgtattgttttgagaaatattatacgaacttaacggatacgtaaaacaaaccattaaataataaacccaaaaacagaaaagagagtgagaaagcaaacaaaatataaaagagtgagaagaagaggacagagagaagaaaccattaccacacatacagagagaaacaaacccactccattaaaaaccaaagctttaagcttagattcaatcccaagtcagtaaaaatagggttaatcgaagaaccccaccggaattccactgaggaattgcatcagtcgcgttcttgttgcggcttgaggaagaaaaagaacacctacactaaccaaaacaagaacaaggacgaattgaaaccgaagatg

SEQ ID NO: 28681 - DNA, 3000 bp, Unknown
  misc_feature (1)..( 3000): 2750-1469P.txt file - cDNA_ID_2998176; gDNA_ID_2926242; Annot_ID_142909
agagatgggtaagaactgagcttccctatatctgaatgatgcatcattgccgacatttcactttgagtgtcagaatcatcaggtggctctaacgcaagagctgaatcccaaaatttctgcatcatcgtgtttgccatatcatttacagctccagaactgttctccaccattgaaatagctgcgtgagtaatctgaagaacgtctacacaagctgcagctgatccatctttatctataattggaagatgtagaaactttccatcatgcattgtatgcaacgcatccagaatcgttgtctctagcgatgcacattcaggattcggtgtcattaccttctcgacaagagtcaattcaggagataaattttgtgccaccactcgcatcagaatgtcctttgaagtcaagattccactgattttgttccccgtggaaatgattacagagttaacccgcaaatccctcatccttttcgcagcaactgaaacaggatctgatggtgctacaagtgcaaccttcgaattgtctgtaataatcgttgacaaggcgggtttaaacattctctccctcaaggtttcaatgaaagcatacggtgcagaatatccgcttccccattgcttctccacaccttccactgcagcagctaaagcactaccttgctctgcagctttctccatcctagaaatagcatcatacaaacactttgtaatatccaacaaagcaatgacttcaccattctccacaacaggcaagtgtctaaacttcccttgaaccatcttctgaagagcctcaagcgccaacgaatcagaagtaacaaaaataggattcctagtcataaccttagagaccaaagtttgatccggtctcaacccttcagcaatcactcttgtagctacatctttatcagtaacaatcccggaaagaagcgcacttgaatcagtcaacaaacaagcatcaacacgcctagcagccattcttcgacaagcatcgaaaacagtagttccttcaggaatagtaagagctttcgataacctaagcttcttcactgttctctctccattagaaggagcttgagattgaggttgaggaggaggtgaattgggttttgaggtgttcccattaacacttccattctctgattgtactggtttcttagaaggtggtggtcctcgccgtacagtagaattgcttctcctccctgatgttgaagaaggacccgtcgcttgagtactcatattcggtcaatctagggtttacttagatcctaaatccgtcaaaaatgattcctttagatatcaaactcgtctctgcaaatgaaaaattcaacctttaattcaaaaactattgaaatttcatctaaagcacgaatctgaataaaacccaattcacaataaagacgatttgctctgagaatacgatgcaacatacacgaaaaggattcgaatttaacggacgagggaaatgaaacaacttgaaaccctaaggatttgagcagaagttatgtgggaagattgggaatttagggtttaccttcttctttcttcttcaaggtctctctctcgagcacttttgttgccaaaaaacaaacggctcttaacaattgagttaagccatttatcgagttttcattggttgttcctgtttccgcgtgtgtggtggttcgccacctcctttcttataatcgacgactaaaaatgttaaatataatactaatatttctttctataaaattcgtaaaagcaaaaatgttttttttttttctgataaatgtctataaatcaccctttctttttaaacaatgaaatttgatgacatttctctcttgtatctagaagagttaatggctaacataaatacaaaatttttttaattcaaataaatatgatttgtgtgggttacatggaaaaattgtcaaataataaagcaaaaaaaaattgtatagatgcagtgcaagttgtttctggtcaacttgccgtcgagcctcacaactgtttgttacaagtggactcgcatgtaattccctcttttaataacttaccagttacaccatccaacatgtgatttgacagaaaaatattttagtgaaatgtgatcggtgcagatttttctatgtacgtttaagcctttaaggtagacgtttaatgcaaaaatatccgtggaaataacaacaccgattaatggaaccaagtagatacctcctccgtttggatggctcaaatgcaaccatgatgcaagcttttgcgatcgaccaaagtgagagaactagatcgagatggattattcggaaccattacggcacccttatgtaatggcagcatcttaatagtaaacaaaagctttagcctaaggttttagcttccttcactctttgcatacattgtgaatctgcggttttagatggaccatagtggaaaaaggctttcatcaataactcgtggacttgatcaatggtagaaaagagaacacatagatggaaaactagatatttgatatatccatctttggttcaaactcttatccagtgttgaggtgatatacacatgaagacataacaatcgcattgccgagaaactagtattcattaacctttttctctaaagacattgtcctatcaatctaaaatttagatgttaaaaaagaaacccaaaagatgtagctatcttaaaatgacagtcgtttgcgagactggccaggccatcccatgggccataggctcaagttgtgcttggcagaatttagtgattggttttttttgtataaacaatcattagtttaaggctttacttgcaacaaatgaagagtttaagggttctttttggtaattttcccgaatcacacaagtgagctagctcatcagagtccacgagcttcccactaaaaaattgaaaattgttgcttctgtcatctgaaattaaacaaagcgagaaaaggcgatacaaacgatttcgaatgcttcatcttctcctttgaaaatccttcttctgcttaatgctgctagatatg

SEQ ID NO: 28682 - DNA, 3003 bp, Unknown
  misc_feature (1)..( 3003): 2750-1469P.txt file - cDNA_ID_2998183; gDNA_ID_2926242; Annot_ID_142918
tagatgatcagtctacgtttttctatgaccttaacacttattgaggccggttggttctctatgcccacttaacaacaaacaagtttcatcaccgtagtaaagtgtctgttgggacacaagagttcacatgatatttcaagttctgatggaactggaatagggattgtcgtctttgtttgccacccacacgtagcctctcgtgatgattgttttcataatctccacaaaagattacttgtggatcgcgaaccgagacgacagtcccttgctttccaaaatcaaacgaaaaggaaaagaaagaaaaaggaaggtgtaagaatggtggtaatgtggtagagttatcattttcttcttcttacctccttccattatatagtgtttcacatgcccatttcgtaatataacctaagccaaagaaaatcgcttcggttttaaattatataattttattttataaagttaaaactcataaatcagtaaataaaaaataaacttaggaaacgtttttgtttcaacagattatatggatttcatacttatacacaaactataaacattcccaaagttttagtaaaaattagcacccattatccaaaattttaaaaacttagcttagttttattatacaatacaatagaatcgaacaaaagggacaacagttttctatcatatctcgaatgtatcgaaatgtacttaagcgagtatggctttttgggggacaaggatcatgcatgaacgaaatatttctccaaccacatatgttatgttttggccccgtgaaaattttccacaagtaaatttattgctaaagttattgaccaacaacataaatcttgttgaaatgaattaactgaacagtgtgaaaaaatcaaccaatattcatggtgttccttacaatgcaatttcagttctgatgcaatccgtaacaattgaagttgtcacatgttcacaacaatccttaaatcgattttagcaaaagagcataagatacataaccaaggttgctgttagctcagtagttgcaattagaatcggctattgaacacaaccgggtgatatgagattgcgtagcaagatagtaaacaatgttttaaaaagagttattataggaacacaaactcttctgattttaatgataggaggacaagagagagcagtgaaataaagttcataagcagcaaaattctcaagtctgatattataagagtagcaaaagtgagagacaaaaacgaaataacaaggtttatgttttgcaaatattcagaaatgaacatcaactactaaaagtagctactagcagaaaagacgcagagtgagaaaagatggctttaagctcttcagcgtttgccaccaccacctcccaccttaggacccttggatgcagcagcagctttggggaaattagccttgaccttctgttgcttagaagcaaattccaccttcttagccttcttttcatctttggtctttttgattctttccttgatctcactgtttgttgaatcatcatcacaatacatttattaagtcaaatataactattttaatcctagttggatgatttgacagagggagaaaactaaccgcagagcagcttccctggctgcatcacgaacttcaggcttctcagctctcttcttctgaattacttccaaggtagcaccaacaatggaccttgagtatggcttcttggtggcacgtctccttctcttcacagcctcttgtgctgcatcctataaaagaaacagagttttagaatgttaacaaatcaggatcaatgaaaaaaaacaaagtacaaacaacaaaacagatccaaattactgagttttttttttaccttcttgtgttgctttctgtacatggcagtccatgcaagcttggatggcttcaacttgttatggaagtacctcttacattttgagttaagaaacaagaaaacctgaaaacaatacaaaccattaaaagactaaaaccaaaacatttgcaaagtataaacaaatcaatttgattagctgaagattcataaaagaaccaacctgagaatcagatcggataaacctaattcctcttcctgggtaaatcttctgtccactgaaacgacaaagctccgtcctgtatttcatagataataaacaaatgagacattgcaactagaaatgacaaccaaatgatctttgacactgaaaaatctcagtctacatgatagaaatgaatcatccatataccaaatacagactaatcacagatattaacgaagtatcatacttttattacttagaaccagatccagctacacagagaccatgaaattacccagcttagctaacggtaaagcaaaacatatcataaattccgattgaaacaagagtcaatttcagtgaatcgatccttccgatagtgtgaaatcatgaatcattatcactaggcgatgttaatagattcaacacaggaacagatacagagagagagagagaggtgagatttgattacttgagaaccatggtagtagctgctcctcttcttcttcgtcttcttcctcctgctcaggctgctcccggaaacactagactagaaaaccctaattctctcgatacttatatataagagacttcacatttcacccaatgccattttcgtctatatatattattctggcccacactttaagcccactaaataggcccatcacaaataggcccataattttattagcccatatatttttgtagtgatgacgtcagctctcctccaataattttttgattttttcccatagccgacgacggtagaggaaacttgtcaatggacctaaaaaacggtgacgtttcgtaaaaggtagatgaaagtttgaacaagtagctaagctctctctctgcacaagcttccagaaaaaatcaaatcaaaagagagagagatccacaaaattggattgaatcgtcgccggatattccaagagtagagagcttagtttgtctcgcgttgcgtctagatttactgaatatg

SEQ ID NO: 28683 - DNA, 3000 bp, Unknown
  misc_feature (1)..( 3000): 2750-1469P.txt file - cDNA_ID_2998191; gDNA_ID_2926243; Annot_ID_142923
agtcaatctccttaaccactcggacatatcgacttatttgtatatttacgaaaaagattaatatatgtgttcatattcaaaatttcaggactggtaagagggcaatttatcacactcaactctattgagatattcacaaagcacgactggttcaagctcaaacatacggtctactttcaatgcaatggagagaacaaaactgttcttccagacgttaccaaaacaggtgtcttgtacactttccgcggtcaagaatcatggcaggctagtcccaaatctcttttacatccgttcattactacaatctattaataacatggataaatacatatatgttcttcactctattgcctgttacagcctatgactggaattggtggcgaaaagtgtaaacgatgcggaatctatgagcaaggcagcctcgtttcagacaaagagttcgatgtatgggaagtttgtcccactgatttctctgctagccaagtttatatgcattttaaagaaaaggagattaatgctacttttgtctgccacggttgcgccaagttccactccggtgagtaataactaatttccttatttctgtttcctgtcaaaagaaacgaaaagatatgatgatgagtaacatatatgaattgtatgcaacaaaatgtgtgtagtatcttctaaagcagtagctgcttcaagtccgcaagaggaaggatataacgggttaacattcatgatagcgatcatagcaggcgttttgtgtacaacgcttgttgtggttggaggcgtttttatgtttaagcacacgcaaaggatgaagaagcagcgagatcaagctcggtttatgcagctatttgaggaaagtgatgaacctgaagatgaacttggacttgaccctgtgatatgacatgttttaagaaggttcgtccacgatttgttttgcataaagacttttggtgtttcatgaattttgcagcttatattagggaagaggattgacagtaggatctcactttttgtcttttggtatttgcttctcttccacatactttagtaatctcagtcaaaaataatcccaaaattttccaatactataaggctatttattgtacacattctaatccacaaatgcattgaggggaactctaaggtatgtattacgaagaaaagaactgaatcagtaccttcctttgagtttatctgactaatcaactcgagctcggattacttctgatggcacggttgaagctatccaattctttggaatcagggccgtatatcgtcttaattgtgtcaatgcagcagctgcaacgtaaaaagatatttttcacatttatctcttccacatttgttatatcccctaattaagattcagatacacatttgatttaaacactctcagtgtgtaagagcttgtgaaatagagttatacaaccaaggagagttacctgacagcttccttgttgaatttcttttcttcaatcccgtagagtgacttgaaaacctctggctcaacccgacaaaaatatggacgatctgaactcaggaaaggaagaaaacgttcaaagtttcagtccataaacagagagaacaatctgatagctaataatgattgattgttaccagcataaatagagcatttgcgtgtagctttgtcgtagtttagacaccatccatcatctccgatcatgcttcgatacagctggattaagcataagattatatatatattaacgttttaacacctaacagagtaattaagtcgaacaagtggtgggtgagaaacaaacaaacctcaacatcatcagggttgtcgaagatttcgtcaggtgttgcaaaggaaaagtcctttgcaatcttacagcaagctccacaaccttctacgcacttccaagtcaactcctttgtcgttccgccggagaaaccgcttgtcgacatcgttggccgcttattcgccggcttgactttcttagctttaggttgtgaaacttgggaccgcctcgtggcagagataatcgtcctactcattggtgccgtcgataacgcaagcgacatatccatttttcttttggcgcaaattagagaagcaagaaatgttgtcaagataagattagaacccaaatggcgaaagccggttcaaccgcaaattgtgaatttgcatccggttcagtcgcaaaccattttttttatccggttcagtcgcaaaccattctttatacaacaacaagatccactttttattgttggtacatagcattggctctcatatattgattcttcaagaaacaaaagtttcaaaaacttacacgcgtttcctttctttgtttgtttgtgtacaaccaaacctcatcttactatgattttctattctcgtgaaacaaattgagcaacaatacacaaagagacaagaagacaataactatgggttgtcacagcttgggacagtttcttacaaactcactactcgcatcttttgggtcttatcagtgtgtcaataataacccaataataatggcggattgtttttgtttttctgtctccgattcgaattgtgctacaaggtcagtgtttagaaggggtttatactgttctctattgaatattcatgttatgttacttcgattagttggttgtgctctgttttgttttcagattggtgtcaatcttcaaaagcgcagtatttggacagtagactaatacgtacattatttaagggattacgttacagataattcgatacttgtaaaagtaacacaagtgattgaggatacattaattttgggcattttggggtactggtaatgttaaagttaaggttaaagtaaacttgtcttactaggcccggccataatcttataaatacattttgggccgttaaagggtaatgcttaaaagggtcattagtcgattcatagcttttgccgtcttttccatgggaggccgattgtatataaatattaaacgtaattcttctgtagacaaaagaaaacctaaagacatctgcgttagatg

SEQ ID NO: 28684 - DNA, 3003 bp, Unknown
  misc_feature (1)..( 3003): 2750-1469P.txt file - cDNA_ID_2998195; gDNA_ID_2926243; Annot_ID_142924
tcacatgttgatctccaacattgatccggatataaaccttttaaatgatgcattttctgtagaacataaaaaattatcctatagagaataagctcatctccaatatatttttcaattagagtaactcaaaaatatagtagagttttttttttttcttcaatgtaccactctatttttttatttttattttaaagtgcaaaaaatagagttactctaaatgtaaagcaaacatatattttactctattttagaatggagttgtaaagaattttgctatgtaataaagtttagggaaaaagtagagtagacttggagatatacccttggtaaaaatatcaatcctatatcccaacgaaagtgaaagacatgtggttcatggaatgttcctagtgcgttattagtatgcatggtcttatatataaatcgacaaggaaataaaagaggtaaaaataccattatgtcgtggcttagctgcaatgtgtgtaatgttagagcatctccattggtgcatcttagcccatatcttagcttagtatcttaggtgtaaacatttaaaattaaatcaaaaatgattagaatgctaagaagtgaatcttagttaagatgttttatgtgtgttaagaagtgtagacatgttgcaatatgagtggttgaaagtaaagacaaaaccaaacaaaagtaaaaattcacctctgtgtatttagctaagataccaaaaagacaaaacttatattcttaaccattggatgtaatacatgctaagatactttcttattttcttaactcacaaaaaaacaaaaatttattctaaaatattggtaagattcaagattaagaatcaattgtatcttaaccattgtagatggtcttagcttctttaatccaggtgaattctgtagtaaccttgatataccagggattacagatcgaacgaactccgttttaacagtcaaagtttggaccttgagcgttgggaaaggaacaccgcggagctcggcgagagatagaatctgacaaaacgagatgaaattaaaaggtcatgtttgctagaaacccacttagcaagttggcgttctaaaccatcaaagaaacattattaaccaaataatagttctacaggttttagactttagagtatacctgaagaagggtttccccaacagtaagcctcttaacgttgtgaaattttgatagcatctccagcgccatggtttgataaccatctgcagtcaagggagagagtaggctactgataatggtaaggttagcttcgctcaaagaggagacatccactatagtagatggtgtgctagagtatgtcagtctcaaataatagatgtgtggcgcaacaatcgcaactggtcctgtgcggcgatattgctgatttatatccaatctcctcagattcggtgatttactcagatcaagacgctcaagtaatctgcatgtatccagtgtcaagctttcgagaattggacagccagagagaatattatgaatggattcgtctggaatttgacaaaaacgcagtgttaagttccttagggatttccaagacactgtgcatgtgggaatcatatcaaaaaagtccaacgtcacgtcgagtagctttaaggaggaactgagatagaagatatctggaaatctgtaagtcttggagtatgtgaaatccctaacgaacacagacagattttgcacattgcgggagagagcaaactcgatccagctatcaacctggggtacagtgttgctgttaaggtccataacaagtttgaaactagtgattatgggagccgtgtaggaagttagggtttggttcatcgctccgtgcttgagtgtaatgtcgagacaaggtgtctcgcaccatacatgcctccatcgtcgggataagacggaagttctcatggccaaatcggtgggaataaaggagagaatatggtgaaggatatcatctggcatatagttgatgaaatctgcaccatcgattattcgttggattctgcggtggctacgatgttgtcgtcggccccgtctctctcgccttttcgccatctaacgcagatgtctttaggttttcttttgtctacagaagaattacgtttaatatttatatacaatcggcctcccatggaaaagacggcaaaagctatgaatcgactaatgacccttttaagcattaccctttaacggcccaaaatgtatttataagattatggccgggcctagtaagacaagtttactttaaccttaactttaacattaccagtaccccaaaatgcccaaaattaatgtatcctcaatcacttgtgttacttttacaagtatcgaattatctgtaacgtaatcccttaaataatgtacgtattagtctactgtccaaatactgcgcttttgaagattgacaccaatctgaaaacaaaacagagcacaaccaactaatcgaagtaacataacatgaatattcaatagagaacagtataaaccccttctaaacactgaccttgtagcacaattcgaatcggagacagaaaaacaaaaacaatccgccattattattgggttattattgacacactgataagacccaaaagatgcgagtagtgagtttgtaagaaactgtcccaagctgtgacaacccatagttattgtcttcttgtctctttgtgtattgttgctcaatttgtttcacgagaatagaaaatcatagtaagatgaggtttggttgtacacaaacaaacaaagaaaggaaacgcgtgtaagtttttgaaacttttgtttcttgaagaatcaatatatgagagccaatgctatgtaccaacaataaaaagtggatcttgttgttgtataaagaatggtttgcgactgaaccggataaaaaaaatggtttgcgactgaaccggatgcaaattcacaatttgcggttgaaccggctttcgccatttgggttctaatcttatcttgacaacatttcttgcttctctaatttgcgccaaaagaaaaatg

SEQ ID NO: 28685 - DNA, 3003 bp, Unknown; identical to SEQ ID NO: 28684
  misc_feature (1)..( 3003): 2750-1469P.txt file - cDNA_ID_2998195; gDNA_ID_2926243; Annot_ID_204159

SEQ ID NO: 28686 - DNA, 3003 bp, Unknown; identical to SEQ ID NO: 28684
  misc_feature (1)..( 3003): 2750-1469P.txt file - cDNA_ID_2998195; gDNA_ID_2926262; Annot_ID_204795

SEQ ID NO: 28687 - DNA, 3000 bp, Unknown
  misc_feature (1)..( 3000): 2750-1469P.txt file - cDNA_ID_2998199; gDNA_ID_2926243; Annot_ID_142925
ttcctttctttgcgatattccgcagtgctttatcatatgcggaaagggatgggaactgcacaaagctgatatataccaacattgtcgagaatgaaaaaggatagaaattcattagtttggattcgaattcctctcttccaaagtaacaatccagagaattaataaagcttaagacttacactgccgcaggagttaagtttccgccacgcggatagttgaatttgagatcatctgatgtcagactgcagccctcgagtacgttcattatgtctgtcttcagagcatgttttgaaaagcctgaaaacttcccataaaacctccctgcaaaaagaaataagaaaaacacatcaaggaacatccttcatagtgagctaaacaaagtctcaaaaccataacagtcaaagtaaacaaagtccgcatttttggatagcaaaattcgataatagcctctgcggttaaatttgaaaccaacattttcaatttcaatagcttcagatatacacactccaaacaaatcaaaactctgcaatctatgatctaggatctttgccctcacaaattggagaaatgctctcaaagaaacactagataaatggaatgaaataaaagagaaaaccttctcccggagaacctcccggaggcggtggtaacggagaggcaggaggaggctgctccgtggcggtagataggcatttcctccactcttgaagaaacggaagcgagctacgactgatttccggatccaatttccggagacacaaactcgatctgatcgcgctacgagtgatactcatttctcaccggaaaatgtctagggtttttctctacagagagtctcagtggtgacgatgacgaacacggtgaagaagattcgaaattacacccacattcgctacataaacgacagcgtttcacattctaaaataattcaaaagcccacataataattaaaaaaggccaaagcccataacgtcgaacatcaatacggtccatattacattagtcattagaaggagtaacggaaaaaacttgaccattaaaggaagaaaaaaatgtttcaagaattgaagtaacaatatttgattaaatcttgtctaatttcaatgttattttaggtatatcaaaaggactttcgccttcgtaattccccgaaggtgaatactcgcaaatcactaggaatccacggttgttatcgcatttagaacgagcgcatccaacggctgtggttgtacgccaaacgatctgcgtataatgaccgcacatggcaccagacttgcacgtattagccacccgatcgtagttcaaactttcatccatccatttatcaacaactctcctcggcgaccaattctcactcctttggtacctgaaaatattctctccgtaaggcccacctgaatgggtcattttacaatccgatttacgttgtttggcccatttagatgcgaaacgggccaacccttgatcccatcttagattcgacgcgcctgaagctacacgcgctgcgttgtgcgcgagtaagaactccgcggattgcttattcctccttcctctgttagtcgcacgtgcggctgcggctttggtgtccggtgatgaagttcctgcggtggagggaaattctccggagaagattaataggaggaggaggagaacggaggagatggagagacaaaacggatgatataacgaagacgacgacatatctcttagtcgtcgtcttcgtgtctctcattttcaatcttctctgtttctcaggttttgttgtttcacttttgaaaacattcattattcggttagtgttttgccattttctgacaagctttgacagattgtgtgtctcatctttttgttatctgtttttcgttgttttttttttttggtaaaaagatttcgtagtttgttgacataatgaatgtcaaaaaaaaaaaaaaagtccataccataacaaaagtaagcttactttgttcgttttaattttaaatatttaagaattagcttaacaaattcggtaaaatttgggatttttcaatgtaaaatatgatcattatttttgtttgtgaatattttatacgaacgttacaaatataatgtattatagaatgtggtattgaagagggagagtgtttagagggaaagcgtgagacgcacgtggatctctgtccctcttttttctcgaaagcttgctttcctgttctttccttttgtttcaatattcgttgaaaacataacagagagaactaaacggaaaaaaaccctgaaaattagataaaaatgccgattcgaaaaccgatgatctggagaaatcttcttttctgttacatcatccacatgtggattccaggtaataaattccacacgactaattttcccgggaaacaaaacatgatgtttgtttcgttaaccaacaaactttttatccattcactcgatcgaaaatgatcgatcttttcatgatgctttttattgtttccatagatcgatttgtggttattttgcatgatgaaaaaagaaaacgtcccaagaaaaaagagattcaaagaatttaagattaatggggaattttctgtaaaattaaaattaaaaatcgtcgacagcaggattcgaacctgcgcgggcaaagcccaattgatttcgagtcaatctccttaaccactcggacatatcgacttatttgtatatttacgaaaaagattaatatatgtgttcatattcaaaatttcaggactggtaagagggcaatttatcacactcaactctattgagatattcacaaagcacgactggttcaagctcaaacatacggtctactttcaatgcaatggagagaacaaaactgttcttccagacgttaccaaaacaggtgtcttgtacactttccgcggtcaagaatcatggcaggctagtcccaaatctcttttacatccgttcattactacaatctattaataacatggataaatacatatatgttcttcactctattgcctgttacagcctatg

SEQ ID NO: 28688 - DNA, 3003 bp, Unknown
  misc_feature (1)..( 3003): 2750-1469P.txt file - cDNA_ID_2998202; gDNA_ID_2926243; Annot_ID_142927
ttcttttcttcgtaatacataccttagagttcccctcaatgcatttgtggattagaatgtgtacaataaatagccttatagtattggaaaattttgggattatttttgactgagattactaaagtatgtggaagagaagcaaataccaaaagacaaaaagtgagatcctactgtcaatcctcttccctaatataagctgcaaaattcatgaaacaccaaaagtctttatgcaaaacaaatcgtggacgaaccttcttaaaacatgtcatatcacagggtcaagtccaagttcatcttcaggttcatcactttcctcaaatagctgcataaaccgagcttgatctcgctgcttcttcatcctttgcgtgtgcttaaacataaaaacgcctccaaccacaacaagcgttgtacacaaaacgcctgctatgatcgctatcatgaatgttaacccgttatatccttcctcttgcggacttgaagcagctactgctttagaagatactacacacattttgttgcatacaattcatatatgttactcatcatcatatcttttcgtttcttttgacaggaaacagaaataaggaaattagttattactcaccggagtggaacttggcgcaaccgtggcagacaaaagtagcattaatctccttttctttaaaatgcatataaacttggctagcagagaaatcagtgggacaaacttcccatacatcgaactctttgtctgaaacgaggctgccttgctcatagattccgcatcgtttacacttttcgccaccaattccagtcataggctgtaacaggcaatagagtgaagaacatatatgtatttatccatgttattaatagattgtagtaatgaacggatgtaaaagagatttgggactagcctgccatgattcttgaccgcggaaagtgtacaagacacctgttttggtaacgtctggaagaacagttttgttctctccattgcattgaaagtagaccgtatgtttgagcttgaaccagtcgtgctttgtgaatatctcaatagagttgagtgtgataaattgccctcttaccagtcctgaaattttgaatatgaacacatatattaatctttttcgtaaatatacaaataagtcgatatgtccgagtggttaaggagattgactcgaaatcaattgggctttgcccgcgcaggttcgaatcctgctgtcgacgatttttaattttaattttacagaaaattccccattaatcttaaattctttgaatctcttttttcttgggacgttttcttttttcatcatgcaaaataaccacaaatcgatctatggaaacaataaaaagcatcatgaaaagatcgatcattttcgatcgagtgaatggataaaaagtttgttggttaacgaaacaaacatcatgttttgtttcccgggaaaattagtcgtgtggaatttattacctggaatccacatgtggatgatgtaacagaaaagaagatttctccagatcatcggttttcgaatcggcatttttatctaattttcagggtttttttccgtttagttctctctgttatgttttcaacgaatattgaaacaaaaggaaagaacaggaaagcaagctttcgagaaaaaagagggacagagatccacgtgcgtctcacgctttccctctaaacactctccctcttcaataccacattctataatacattatatttgtaacgttcgtataaaatattcacaaacaaaaataatgatcatattttacattgaaaaatcccaaattttaccgaatttgttaagctaattcttaaatatttaaaattaaaacgaacaaagtaagcttacttttgttatggtatggactttttttttttttttgacattcattatgtcaacaaactacgaaatctttttaccaaaaaaaaaaaacaacgaaaaacagataacaaaaagatgagacacacaatctgtcaaagcttgtcagaaaatggcaaaacactaaccgaataatgaatgttttcaaaagtgaaacaacaaaacctgagaaacagagaagattgaaaatgagagacacgaagacgacgactaagagatatgtcgtcgtcttcgttatatcatccgttttgtctctccatctcctccgttctcctcctcctcctattaatcttctccggagaatttccctccaccgcaggaacttcatcaccggacaccaaagccgcagccgcacgtgcgactaacagaggaaggaggaataagcaatccgcggagttcttactcgcgcacaacgcagcgcgtgtagcttcaggcgcgtcgaatctaagatgggatcaagggttggcccgtttcgcatctaaatgggccaaacaacgtaaatcggattgtaaaatgacccattcaggtgggccttacggagagaatattttcaggtaccaaaggagtgagaattggtcgccgaggagagttgttgataaatggatggatgaaagtttgaactacgatcgggtggctaatacgtgcaagtctggtgccatgtgcggtcattatacgcagatcgtttggcgtacaaccacagccgttggatgcgctcgttctaaatgcgataacaaccgtggattcctagtgatttgcgagtattcaccttcggggaattacgaaggcgaaagtccttttgatatacctaaaataacattgaaattagacaagatttaatcaaatattgttacttcaattcttgaaacatttttttcttcctttaatggtcaagttttttccgttactccttctaatgactaatgtaatatggaccgtattgatgttcgacgttatgggctttggccttttttaattattatgtgggcttttgaattattttagaatgtgaaacgctgtcgtttatgtagcgaatgtgggtgtaatttcgaatcttcttcaccgtgttcgtcatcgtcaccactgagactctctgtagagaaaaaccctagacattttccggtgagaaatg

SEQ ID NO: 28689 - DNA, 3003 bp, Unknown
  misc_feature (1)..( 3003): 2750-1469P.txt file - cDNA_ID_2998206; gDNA_ID_2926243; Annot_ID_142929
ttactagatagatagtgttgtgataatatgtcaaggtttggatcgaccagacaatatgggaccttcacgatgtctgtctcatgtttcctgcatgccatgcattctatttactctcgtctactctacgtgcccacgtctccacttttattcattttcttatttgtgatcaatcaaacctaaagaaaatgttaggctaaattggatctgttttcttatatatcggtacgcttaaacacatataattagcgtttaaagattccttttcttaaaggtaggttcagtttacttgtaacctaggtttctcgaaagatgagatgtacttaaatgctcgtttatattttactccaaattaaatactgtagttgataacatcagttttcaaattagagacagtgtcgatgcgagtgcattcaattttcttattaattgataaaaccatattattcgatttgttttatttctttctgaggaggtttgtcttatacttgcatcgatgcatgcgatgtaaactttgtagaagcaattccaaccatggatatcgcagatactgaagtaactccataatcaatcatttacatatctatcatatacattaatattgaaagtgttttgatattggtatttctctatatgaaaaaacaagacaacccgagacattttaacttcagattatagtgtgatatcgaataccaaattgacctttctatcgaagataaaccttaatatagataaagacatatagttactaaagaagtaagttaatgaatgttgaataaaaacaccaatggtaagctaaatattaaacaatacaaaagagaaaacaaagctaataagtaagaagtaagaagctaaagagatagactgacatccatgctccctcaaccaaaagacaaaacacagtgcatcaatggcccagctgtcaccacaactctttttttttttgatataggaacttgttttgttttctattctataatatttatttattcttctttcttgttatctttttaaatcaaaacgatcgagactgaagttgttcaatttttttcgtaataaggataggaaattaattaaggatagagagcacatgaaaatacactgtatgtactgtaatggtgcattcaaggacccttcaatacgttccaaggccacatgtgattctcacaaaatggttcaatatttatgaaagttatttgtgaatatatgttaagataaaatgtacctggaccattctttctatttgtattagactatcttacacgtgattttcttactcttttgatttgacttcaattagatctatatattgcatcaaactttttaccaaattatgcgtcaagtcacaccaattgatgaggttggccttatcgaactagtggaaccgtcatatgcgaaaccaaatataagaaatgaatgaaagacctttcaacaaaattaataagcaagtagaagtaaatccaatatcaatataacaattggttaaacctaaattatatgcatccaatacgaaaattctttttttggtatcttttaatccgtttattatatttgtggagcctaagttgcggatccacttgtattccttatttgaatcattgttatcatttctcattgtttgtgactcgtgagctagaagaaacaaaaacaaaaggataacgtaattttgatatttaaagtaaaccactataaatcattgtgtgtgtgttttttcttgttttaaaagatcgaattagggagcctaacatgtttttgtctcaagagattattatcattaaaaaaaacaagtggaagtggaagttgtgtaacccacttgttgaattcttaacttcgaagcacaacaaaaagatagacgaaaaacgaaaactcgatctaacttcgacatatgcattagataacatatagaaatttaaacaatctcgttgatgaaattggtctatcaacacacgacagtggttctctctacagtagcatcaaatcggtggatccttatgaacagaaaaaacgaggagggacagaggaaggccaatgaggggtcatgcaaaatggaacttagcaaaagtaccaaaaagatccatcctctttgaaaattcatttcagccccataattatccatgacatgaatttcgatctgaatctcacaacaagtaagagatcagcttttgataacattaaagaaaaaggtaaaaaaaagaaagacgagagactgagaaaagggcaaagacctgtaggggttaagacagctaagagtgttcctcagtcgccccacaaatgtcttctctcctctctcttcagtctttctcagctctcaaatctttaaatggttccaagttcaatgctcccaaaacccacgcccacacatgcatcctatgacctttccttttctatccattttcttcccacaaattaccactttgcaaacaaaagccaaaaactcatttacaagatgagttaataaagacactaacacacaaccaatgtgaaaacagacgtttacatgagatattgttacctctaagaagtcattaatcatataatgagaacattcttgcttcctaagtttttacaagattattaacctctaagaaaggagagacacttttaacgcaataataactacatgatgttataaatataggagagagtagaaaagaatatgacagccctactaagacagagaatcatcatcgaacagtaaagaggagaatctctgaatatccactttaaactactgccctcttgtcttaactctcagaaccatttaatttttcagttattttgacccataccctttttggcctctttccctgctttccaacaccttcacacttactctagggcttccacggctatatatatatggtcccttccttaaacttgtatctcataattcacaaccagcactgctactactagtttatcattattccatcaatttattctatatagagttcttctctgtttatattacgatattgctcgaagattacatacctgagaaagatg

SEQ ID NO: 28690 - DNA, 3000 bp, Unknown
  misc_feature (1)..( 3000): 2750-1469P.txt file - cDNA_ID_2998210; gDNA_ID_2926243; Annot_ID_142930
acgtgtacctcaatccaagcagctagatttggccgtccgattataatttcatatttaaaaacttcgtcgaggaagacttgaaagcgttcgataaatgggatatatgcaatatcaacctagcaaacaaaatcgagtaattttgtaaccatagtgacacattcaaaaaaggttcattcgcacttaacattttgataagactaatataccaaactaagctcgccaaggaagaaaggaccatcatcaaactttttcagagcattttccacgtgatcgaaggctgatgctgcgtcaaaaacacacatgtttcagccttcagatgcccaaaacaattgacaagacacaaaagaaaatcaaccttacctgtttctttaaccgggtcacctttgaaagagccaaacacagtttttacaaatgtttcatcgacatatttcaacagttcttcaccaaactctctctttgcagaatcctagaccaaaaatttcaaaaaaacaacatctcatcgaaatattgttacttacatgacaagaacaagtctataacatgccaacaaggtcatacctcagggtaaagtgaaggtccatcaaaattgctatcgacatatttgattagatcaagactctccccagtgatttttccattgtgttcaagggcaggaacctacatacatcattatcacaatcttttagagtcttctattgtcacttttgaaagaacgttaattagtttataaggattaatcataaaaataaacggcaccttgtttgcaggattaactttctcctttaaccaagctggcctattaggaagatctataggaaccaatttgatctcatcttgcagaccctaaaactccccaatgtcaaacaaatcaacaaatcttgcttataaatttttcatctcgatctcaatttacatacatatataccataaatatataaaaaacaagtaccttgaggtttcttgtaatccaaacacgttgtgcaaatgggcaagtgtagcttatgtacaaccttgtggttccgtcgaacagagcaggtggatcagaggtagcatcgagcggaacctgacgatcttctacgaaaatttttcttgataaaggaaaaaaaatcaaggagatgaatatagatttaacaagaaaaaacgactttatactaatcaagaaacctcataaagtaaacaaaaaggatcttacggaggagatagagccatggagaggatttgataagagttgtttcttcaggggattattattgcagatatgatgttttaaaggaactatggatcaaacacataagactacgtatatatattatatatatactcaatggaaattggaattaggaattaggaagaggcttggttcatgcttacccaatggtgactaccaatagaaaaaggtaaacgtacgtcagcgtttgattaatctctgtcgttgaactttctaatttttgttgtgaaggtcaaagatattgatcaaaagcttctactagttttgtttgcgagaatactaataatcacatacgtgaagtctaatcagttgaatacgtgaatactaataatcatattaattttttttggttgctttgtgatgatttttctttatatcaaataaaaagagtttaaaagaagaaaaaatggtagatgactaaatatttcaattgaaagaactatttttgttaattactgtgatatctttttgtaatgcttgtaatgttataataatacgattggaatgacacacacacaacgaaaaaaactatttttgttttcgtcgaaatttcattatgacaagtggacaaaaacaaaatgctggtcaaaaagctcagtctgtgaaccacgccattggatgctacctcaccgaatcatctatgctcaattcgtatcgtataaataattattctttttgtatatgaaaatattataattctttcatgcctttcttttctttctttttctggtagaccttaagcttctggttagtggttactaatatttgtatcagaagatacaatcaaaattttatgttttctttgaacgtatctaaatttaaaaaattttacatgtcattgtctatacagatttcattttgaaatatgaggtgaaattaatgaaccaaagaaaccttttttcttttttttttcttcttttttttttaaaaaaccttttttcttctaaatgcttttatagtttgtattcatattttccgatcgtaagaagacttttgtagattttcacatagtcacagaatataccaaacggtcaaacaaagatgcaaaacacataacacatactgacataaaaatatattaagaaagtttgggagatctttaagttcttttgcagcatttaacgaccaaacaaaaactaaagaggtctgcaaaacattatctcatccacacttaaaacacatctactaaatgctttgagtaatacccactgattgctttggttgattattacactaaacttcgttctcagtaatccggcgctaagagaaagtgcaacgatgcttaaaaggaggaacaagtgttgaaacgagacatgcatacatcatacatattcaagaacggatgaaacaagacgggaatgttaacaaagttccaatcctacattcctacttcgccggccgataattcgtggacgtggtcacgtggtggagaagattaaatcataaaaaaatgaaattatgaaacgatgtcgttttattttttatttgggccgggctatttagatcagacccggattgtaagcaagtttaaatagacaatattgccccttatttcggatgcttaatgtatcggactataatttagatccgatccggcccataagaatcaagttttaatctgactatattacccttcgtgtcgaagggctttaaaagtccccgagactcgacggttcgactctaaccctacaatagtcttctgctaaaatcgcgaaagagatatcttacgaatctccacaagtgcgaatttcgaacggagctacgattccatg

SEQ ID NO: 28691 - DNA, 3003 bp, Unknown
  misc_feature (1)..( 3003): 2750-1469P.txt file - cDNA_ID_2998212; gDNA_ID_2926243; Annot_ID_142931
aacgctagcacactacctgcccatataacagattatggagtcaaatacgagaaaaaatcgtatcaacaagagtttgcaatgcaataagaattatctggaaaaactcacctaactacaaagacggaaaaactttattgaggaaccttaggcagcgcttcctgatacagctgcctcctgatgaaacaaagagttcaacaagagatatcattagcttttctatcaattctctcattctatcagatggacgacacaacagaagttaaaagactgtttaccttgccaataatttgcttctcaggtaaatctgaagatgcatctgctgaagcctcttttgaaaacctaatgatgggaaattcacaaaccacaaaaatcaataattagaaagcatggcacagtacttcagttctcagggactagaagaatttgaggttgcatagaaaaagtacctcaatgctctagctttgcgcttattttcttcagcagaatcaactttagtctcttttccaaaacgagcgagcctagctttcttctttgcctcttcctcagtcttatcagtagtagaggtcgcagaaggaaccccaaatctgttcaaaatacaaagcgagtatgaaactcctttttctctaaacccaaccaataaacaactatcaagtacaaagaaagtattgtgacatacctatcagctcttgcttttcgcttcaattcctctgctttcttcgttccctctgagccattcaccactgctgcagctacagtaccaaacctgcaccgaaggtgaaattccttacaacataggtttgacaataagtataaaaaattccgtaaccctaattttcgaaacccctaaattcgacggaatctaacgaataaatattaaagtctttacctctcagcacgagaattgcgcttctcctcttcggtcaatttcaccgaaacaccaaacctctcagcacgtcgaatcttcttctggatatcatcgaccggagagatatccccagaatcaacaccagccgtcgatccaataccattagagtcggtttcttccttcttttcaccagaatctgaaaatcccttgacttctccgtcgagaatgtcgtcagtacgatctaactccgtagtgttgaggtctacaattttcttagggttttcaccagtagatagccctccgccattcaccaccgtagccgtgaccttctctccgttggtcgccatggaatcgtagctccgttcgaaattcgcacttgtggagattcgtaagatatctctttcgcgattttagcagaagactattgtagggttagagtcgaaccgtcgagtctcggggacttttaaagcccttcgacacgaagggtaatatagtcagattaaaacttgattcttatgggccggatcggatctaaattatagtccgatacattaagcatccgaaataaggggcaatattgtctatttaaacttgcttacaatccgggtctgatctaaatagcccggcccaaataaaaaataaaacgacatcgtttcataatttcatttttttatgatttaatcttctccaccacgtgaccacgtccacgaattatcggccggcgaagtaggaatgtaggattggaactttgttaacattcccgtcttgtttcatccgttcttgaatatgtatgatgtatgcatgtctcgtttcaacacttgttcctccttttaagcatcgttgcactttctcttagcgccggattactgagaacgaagtttagtgtaataatcaaccaaagcaatcagtgggtattactcaaagcatttagtagatgtgttttaagtgtggatgagataatgttttgcagacctctttagtttttgtttggtcgttaaatgctgcaaaagaacttaaagatctcccaaactttcttaatatatttttatgtcagtatgtgttatgtgttttgcatctttgtttgaccgtttggtatattctgtgactatgtgaaaatctacaaaagtcttcttacgatcggaaaatatgaatacaaactataaaagcatttagaagaaaaaaggttttttaaaaaaaaaagaagaaaaaaaaaagaaaaaaggtttctttggttcattaatttcacctcatatttcaaaatgaaatctgtatagacaatgacatgtaaaattttttaaatttagatacgttcaaagaaaacataaaattttgattgtatcttctgatacaaatattagtaaccactaaccagaagcttaaggtctaccagaaaaagaaagaaaagaaaggcatgaaagaattataatattttcatatacaaaaagaataattatttatacgatacgaattgagcatagatgattcggtgaggtagcatccaatggcgtggttcacagactgagctttttgaccagcattttgtttttgtccacttgtcataatgaaatttcgacgaaaacaaaaatagtttttttcgttgtgtgtgtgtcattccaatcgtattattataacattacaagcattacaaaaagatatcacagtaattaacaaaaatagttctttcaattgaaatatttagtcatctaccattttttcttcttttaaactctttttatttgatataaagaaaaatcatcacaaagcaaccaaaaaaaattaatatgattattagtattcacgtattcaactgattagacttcacgtatgtgattattagtattctcgcaaacaaaactagtagaagcttttgatcaatatctttgaccttcacaacaaaaattagaaagttcaacgacagagattaatcaaacgctgacgtacgtttacctttttctattggtagtcaccattgggtaagcatgaaccaagcctcttcctaattcctaattccaatttccattgagtatatatataatatatatacgtagtcttatgtgtttgatccatagttcctttaaaacatcatatctgcaataataatcccctgaagaaacaactcttatcaaatcctctccatg

SEQ ID NO: 28692 - DNA, 3003 bp, Unknown
  misc_feature (1)..( 3003): 2750-1469P.txt file - cDNA_ID_2998214; gDNA_ID_2926243; Annot_ID_142932
atgtgttatgtgttttgcatctttgtttgaccgtttggtatattctgtgactatgtgaaaatctacaaaagtcttcttacgatcggaaaatatgaatacaaactataaaagcatttagaagaaaaaaggttttttaaaaaaaaaagaagaaaaaaaaaagaaaaaaggtttctttggttcattaatttcacctcatatttcaaaatgaaatctgtatagacaatgacatgtaaaattttttaaatttagatacgttcaaagaaaacataaaattttgattgtatcttctgatacaaatattagtaaccactaaccagaagcttaaggtctaccagaaaaagaaagaaaagaaaggcatgaaagaattataatattttcatatacaaaaagaataattatttatacgatacgaattgagcatagatgattcggtgaggtagcatccaatggcgtggttcacagactgagctttttgaccagcattttgtttttgtccacttgtcataatgaaatttcgacgaaaacaaaaatagtttttttcgttgtgtgtgtgtcattccaatcgtattattataacattacaagcattacaaaaagatatcacagtaattaacaaaaatagttctttcaattgaaatatttagtcatctaccattttttcttcttttaaactctttttatttgatataaagaaaaatcatcacaaagcaaccaaaaaaaattaatatgattattagtattcacgtattcaactgattagacttcacgtatgtgattattagtattctcgcaaacaaaactagtagaagcttttgatcaatatctttgaccttcacaacaaaaattagaaagttcaacgacagagattaatcaaacgctgacgtacgtttacctttttctattggtagtcaccattgggtaagcatgaaccaagcctcttcctaattcctaattccaatttccattgagtatatatataatatatatacgtagtcttatgtgtttgatccatagttcctttaaaacatcatatctgcaataataatcccctgaagaaacaactcttatcaaatcctctccatggctctatctcctccgtaagatcctttttgtttactttatgaggtttcttgattagtataaagtcgttttttcttgttaaatctatattcatctccttgattttttttcctttatcaagaaaaattttcgtagaagatcgtcaggttccgctcgatgctacctctgatccacctgctctgttcgacggaaccacaaggttgtacataagctacacttgcccatttgcacaacgtgtttggattacaagaaacctcaaggtacttgttttttatatatttatggtatatatgtatgtaaattgagatcgagatgaaaaatttataagcaagatttgttgatttgtttgacattggggagttttagggtctgcaagatgagatcaaattggttcctatagatcttcctaataggccagcttggttaaaggagaaagttaatcctgcaaacaaggtgccgtttatttttatgattaatccttataaactaattaacgttctttcaaaagtgacaatagaagactctaaaagattgtgataatgatgtatgtaggttcctgcccttgaacacaatggaaaaatcactggggagagtcttgatctaatcaaatatgtcgatagcaattttgatggaccttcactttaccctgaggtatgaccttgttggcatgttatagacttgttcttgtcatgtaagtaacaatatttcgatgagatgttgtttttttgaaatttttggtctaggattctgcaaagagagagtttggtgaagaactgttgaaatatgtcgatgaaacatttgtaaaaactgtgtttggctctttcaaaggtgacccggttaaagaaacaggtaaggttgattttcttttgtgtcttgtcaattgttttgggcatctgaaggctgaaacatgtgtgtttttgacgcagcatcagccttcgatcacgtggaaaatgctctgaaaaagtttgatgatggtcctttcttccttggcgagcttagtttggtatattagtcttatcaaaatgttaagtgcgaatgaaccttttttgaatgtgtcactatggttacaaaattactcgattttgtttgctaggttgatattgcatatatcccatttatcgaacgctttcaagtcttcctcgacgaagtttttaaatatgaaattataatcggacggccaaatctagctgcttggattgaggtacacgtgtgatatatgcatgtcaacatggtaaaacttttgtatgatttagctgcatacttgattgctttacctcaatgtgtgtggtgcagcaaatgaacaagatggttgcatatacgcagaccaaaaccgactccgaatatgttgtcaattacttcaagagattcatggtaatttcgctttttataaacgtttaaacttttgtttatttggactcaaatgccctttttactttaatgttaggctttgcaattttgtcttaactcaatttccggttaacgttctaaaacaaaactaaccgattccggtttttctttatttgcagtaaaagtaacaaatctgttggactttggtaacgatgccatgatggcttatgaagaagaaatattactacttgagagtgttataaatttctggatttggtattgtacattttgtgataaataagagatatttggtattgtttactttcattcatcaaagagagagacatggtttattccggataatacaaatgtcaataataaaatgggcttaataccttattgaataccttattgaattgtatcaattacggcccattatgagttatggagttcccgacaaagatcacaaaactgccacgtgtacgatgatgactgtaatttcgagaaacgtaaacgcttccacacaaaaaaaatccgtagtttcttctacagaatcagatctttgtatcgtcaatg

SEQ ID NO: 28693 - DNA, 3000 bp, Unknown
  misc_feature (1)..( 3000): 2750-1469P.txt file - cDNA_ID_2998216; gDNA_ID_2926243; Annot_ID_142934
gctgcctccgactgttacattactaatcagtcatcattgtattttatgctaattcaaaccatatgcagaaaagaatggggaaagattgcatatcatctcaatgcccatcatattgtatacaatcttctaaataaacaaaagagttgtcttctaaataatcatctgacagctatctttccagttctgtgtagattcaaccataaatttaaaaccaaatttcgatctttgcaataataattcacatgctaagaaacaggcaattgcattatcaaaaattcgaaatttgtagagtacacttgttggtctatctaattgatcaggaagaaacctgattatcagagccaatcctgctgctgcagtttcaggggcaagtaaacttccgataaatactggaaaccaaaagagctcaacgcctgaatctcagccttttgcttcgttttcaccatcaggttaagttcctcgacccacccgggatttttcttcacgaaatcctcctctagcatatccttcccggtcttaatatcctgctcagtcatcggcaacctacactgttcaggtatcttatacttgtccaaatcactcggcctaattccaagccacttaatatcaggcgtagtcaagtttgcactatcatatgacatgttcttcgacccacatccatacaccgacaagatcttcaatccgtaaggatcactatccaccaaggcaagtaccggaagcttaagctccattttcattttcctcaagaagagccttgtagctacatcaggctggccttttgcagtcacgatgatacaagggaaccggttatagaatctgtcttcagctaacctcatataagctgcatctttttcaactaagagtatgaacatagcatcactctgcatatctccaacccggtcaatgtttggtggaatggctttcccacccattcccatctttgtgcaatctatcatgtctccattgtcactgaatataagccttcccaccaccacacctttctctgctgcaatgacattgagacttgaccttgtgcaaccgagcatacatgagacatcatccaacacagcatcactctgtgtctggtcctgaaaattcagtaaggttgcgaattggttcaaaaaccttccaaaatcgaaactacaaagaatcaatgctagaactttcgattcaggtttacaagagctggatctaaaacagtgactatcattctctatttaatgggaagaaagtatcatctcaagtaaaattgaaagcaagaagaacctacctggaaaagcttaacgtcggtgtagaagagatcacgcttagtaacgtgaatgttcctgaggcagagttggtggataagggcgaggatacgagtggtgatggtggttttcctgacagaagaaacggaggcaaatggacggagggtagatttgtcttttagcactatacggtcgagctcaggaacatacagctgattcgaggcggcgcgtgaaggaacactgaaggagaagccatcaccggcgagaatagaacgggcgatctggacgatgactgtctctatctctgtctgcacggaggagagtgagagatctgcgacttcacgacaggaagatgatagagagaggtcagctagggttagaggtttcgatgaagaggaggaggcaccgccggctccggcggcggctttgatagaagaggaaatatacgatttgagaagctccgtgataacgtcgtctgattccagaatgcttttgaaaggaagttcctccgcctcgtcatcttttgatcgctttcgcttcttcttatccgccatctgtagatagccacgacgacggagacgcggcggcccagagagttctggtactaacaatggcgggaaaatttaccctttaggtcaacgtatctcgtgaatgttatttctagggtaaactaaaggggtagacttagaaacgcatttattaagttaattaattgtgcttttaacgagatgtcgatatgtccgagtggttaaggagatagacttgaaatctattgggcttcgcccgcgcaggttcgaaccctgctgtcgacgatagttttttgaatattttttattgggttaaaatctttttgaatggcccatatggtaagcccaatattaactacatctataaaatctttaaacgctagtctcttccgccaaaatctattcaacggtccagatgagtttaccacttgacgttttccttacccaccattacacgtgtcagttcaaaaagatcttaataatctgccactagcctcctgaacgactgtttttgatataccatccacgtcactaatcctcgccaatatatgatgtggaaatatccgctctgacgtggaacttctcgaacgttcgggacctctagttttgtccatgtcagatattacgattttttaatttcctttttttttttgttggcccgagacaaatctttctaatatctatctatctccggaaaaataaaaatcggtggcttatggtcgtctccgatttccactctctgggagacagaaaaacctcataatctcaaaaattgttcactgtgtttatcttccttctaaagttctaagaagcttcgattcttaattctgtttatcgatttgaattccttgtttctatttcccaaccgttagctgattgtgctagatccatttttctggtgattgatgcaacttctggagctcgattcttcgttctagtatttgattattgtaagatcagtactctcttggaatttagatgcttttgtatggttggatttttatttgatgtaatttgtctagattcgattttttgatgattcttcaaaaagttacttgattagttggttttttgagaattcgtcgttcttcaactcttttttctgttaatctgagatattgtacgattctaactcctctagctattgcaataatcgaaattagggtttatggctgtgttttgatattttgatcatttgaattcagcgaagcagagttggtgtgatg

SEQ ID NO: 28694 - DNA, 3003 bp, Unknown
  misc_feature (1)..( 3003): 2750-1469P.txt file - cDNA_ID_2998224; gDNA_ID_2926243; Annot_ID_142937
aaaatgccaacttcaaacatttattttccgcacaaatctgcaagataataaggtctggatcttcacacctttgagttgcacaataattaacaacaaagcagaaatgttggcaccactaagagagagattaataccttgattgctgttgtgtatgcaacaacatcaggtctggttccagccgaatgcatagttctcaaaatctgtgctggaaaagaatttctatcagggaacttatcatattactgcaaatcccatcattgatattatgaatgtatctggaagcttataaacaaaagctggagaagtatgatcaccttaatgctatatctctgttttaggaaagagatttgaatgattaattttaaaaaaaaaatcaagagaaaagttaactcacccgtacagcaccttctacatcgcctgaacctccacacatatcaatcaaagtcgaccatgttatttgattaggtgaaagacctaggctcttcatctcatccatcaattcttttcctcgatagtaatcagtaccacaggctttcaagagtatattatatgtagcagttgttggcttgaagcaaaatctctttgaagcttggatataaggtgaattagaattgcgattcaccaaagacccaggaccattatttttcaatatatttgggctggaagtgcgacctttactaactatgtcatctgcatataaggattcattaacggagcttcctttccaagattgaaaaagacgaaaagctctgtcatactggcaagcttcaacgcaagcatgcagtaggatgttgaaacattgagaattaggctcgcagccagatgcaagcatttcttcaaataggtgatttgcctgctctactaaacctgcattggcacatgcactgattaatgatgaccatgtatgagtatttggggttacaccaacagatttcatatcatctttgactttgagtgcccatttccacatctttgcatctgcaaaaacctgatcttaagacattattcagagacttagggatataaaagcaaaaactaatgataaacttagttttccaaaaatactgatattgtacctttataatagtacaatatgtaaaggcgtccaacttcaacaatccggaagattccattcgttttgcttctttgtatatatcctgggcaagatcaacccgtccagccaggcaacatgttttcagtagtatgttgtaggatgtcatgtcagctgtaacatcaagtatctgcccatgacatgtagagtttcaaggtcagtccacacccactcctaaatctaaaatactctctagacaattcaaatacttgtattcaagagacagaagaaagaacatacctgcatattcttgtatacttttagtgtgtacccaagatcatgggaattaacattcattagactgttaataacataaatatttggcttaatgttttctttgagaagatcctgccacaaaattatgaattaactacaaatctcaaatgcaggatggcagacaaaatcgagcgtaaaggatacttacgcaaaaatacagtataattagggaattacctcatatatgtacctcgatttaacgtaatcaccacacaggccacaaacatctatcatcgttcggcatatatacatgttaggagtatccaaaatctgtttgcaggcttcatatgctgtcataacagagaccatatctcctttctttccgaaaccatgaataattctacaaagcaataactctgtatgcggcaaaagacatgcgtatctgcattcaataatcatcaaatcgttagcagaacacactacatccagcattcttgtaataactttctgaatttgaaaaccattaacctgaatcgttatgtgggaaacaaggcttacctaatagctaattgaggattggaaatttcaacacaactctttacaacatcaaaaggatccaccaactctttgattttgaatccgagacctgaaataagaagcaggtaatcaattcaagagttcatagtcacagtgtaacagcaagaattgatatagtatttaccggcaagtatctccattagatcaatagctttctccacttgcacagagttagccattgctcgaaactgtttcctcattaatttcacagacgaatcatcgacaaggtccaatggagcaattcctaccttctcaattctcttcaaagtgtaaacgacgctctcaatcttaccttgtcgaagattcgacgaaatccctttcgataagagatcataatcaaccatggaagcgaaacgagccacattagctccggactctgcagccaaagtctcggcgatgagagcgacgtcctcaattcgaccatcctcagctagcttcgaggcaaaatcagcgtaatactcaagcgagccatctggaatccatcttacgacattggagaagtggctagagagagaatgagtcgcggagactgaagcaggagaaggtgaatgttgctgcggtagtgacggaagtagcttggtgaaagaagaattggatttagttttccggttggactctggtgctgtggcgtaacagcgacggtggtgatggtgaggattggttatggcggaggaggagccaaagacaataacaaagtctctcattcctcgccaacggttaggatcatcatcgtatcatcattgtggctcagtttttctggttttctaatttcatgtaaatcaaatggattggatttgaaaggctatttttacaacttccacaccggaccggatttgtagtgttaaaatacaccggtatatataaaccgatttggtactttgattttaaattttaagaaataaaataagaaaaaggagaaaaatggatggcctgaaattgcaagcgaagcgtctccacatattatacaccaacttcttgcccgccatgtggatatcgtcgtcatttctctctctaaccccttctctcttcagtctctctctctctagacgatctctatcttgaataaaataccgataatg

SEQ ID NO: 28695 - DNA, 3003 bp, Unknown
  misc_feature (1)..( 3003): 2750-1469P.txt file - cDNA_ID_2998236; gDNA_ID_2926243; Annot_ID_142941
cgatttttaagaactatgatggtgtttttcaaactcttttcaatctgtttcccttagtgctctttactcgctattcaaattcctccatttgaatatttgatgatgatcatcttatcaaacaagcgccatgagttgataagaataactggaacttcaactttattagttattgcacacaactctacactcaatcgaataatgtagatagtccatcttgactccaaccaatcgaaaatacgtgcctcaggccctttagtcccgaactatgtgttgtcttacttccactggaaaattaaaaaaaaaaaagacttgagcctcaagttttcttatacagtgggataaaattataagcagcctttgcttgtatgttgggaaaggttgctctttgacttcgatcgatgacttgaacagatttgtccaacttacaggaatccctgtaactagtgcattgtttggacttggctcttacctttacgacgacgatttttccttgcaaatgtttagaattcagcagcaggggacgatggtgtatgcagatcacgcttgacgctttggaaaactgcgatcttttgctcgcttttggggttgaaggtaaggccttccgcccttcccattccctagcaaagcgaaagcgaaagctaaaattgttcatatcgacattgactcatcagcaatgtctatggatgttaagcttgctttgcaagagatgaacaaatacctgagctgaagaatcttgaatctggactctggaggaagcagttgaacgagtgtaagcagcaatactcccctttgagcatcgagaagcgtgcaggggagcatataactaccactggtccatccattagtttacttggccttgtatggttctttattaacttggcacttatgtggttgctctttaatttgcttttaataaattaattgggtttcgtagatttttttacaaattcataagtttcgtcacttttccttgtaaattacaaggaggttcttagatttttttaaaggtaagtaaatatggggattatcagtaaacggcataaaactgagtctttaaagtctaaacaatccggataagtcggtcaaaagaaagttgtgtcgacctgatgaagctttgtggctctccgcttggggctgaaccagtcctattagattatgcacaagcccacaaaagactttcttgtacgtcaagtttttcttataatcgtagaaaatataaaagaaaacaaaatactaaagtaagatctttttttgtcaataaagtaaagatttcccctaaattagttgaaattatgaatatcttaactccaaaaaagttagtcacacctttccgtataatatggtcagataacaactttcgtctctttctttgtaacattgcaaggaaattagtaattagaacttagggtccgaatggtgattgcgttttgcggtgcgggagaagtgcggtgcagttcaaataataacaaaaatacgtaaatacatatgtatatgtaaagattttaatactgttacagcactattgcggtgcagttttgggtgcggtgtatatcaccattcatgatcttagaatttatgtaaatatgagaatattattgtcaataatattttaatcaattgaatatcaaatactcattcataatctggtcgatagacgttttctcttgaacaacttccgaaccaattattataattttgtgaccagataattttatgtgatcgcccttttaagttatcacgaaagaatcgggttcaacttcattatgtattttttagaagatattgccttgattttctcttaagcttaacaagatatactcttgatttcccattttcccttattagttggcgaaagagtattattttaattgacctgacgtatagttattagaacttcctatacgaaaccctaaagtaaacgattaataaagccttaactttgttgctttaatatgataaaaatttaatttccaaagactaatcaaaaagccaaaaaaggtttctatttaagctccattaataatcaatggatttaccataaaaatgaactaattgtaagcaaaggaaataaataaaagctagcttttggattaattgtatggtttaaaactgttaataacgacacgtgtcacaattaaccccacatgaggcggtgctaaatactctgatcctaaaatccaaaacttcacgtccgttggatcttctctcaccaagttttgaaaccgtccgatctaatcaacctttcggatattcgatgtacacagtacttaccgtgtgcacatcccgcagatgataaacattttagaagtctggtctaattaacaaaccagcgtcttagcaaataagctaaagaaaaaaaaaagtatatacatacacacacatagtatatatatatatattatgtgtggatttcttctttctggagattaaaattttccagagataaaaccctagagagattctcatcttcttttcttcaatctctctgagaatttctaggttttcgttaccgattgggtcaatctggtgaaactcaaggtgtgtgtgattatgagttattttttttgtttcccttgatttttaatgcgatcatgatcgtttttttttcttctgttttgtgttgttctaagttgatcgtaatttctatttcgaatctgttatcgattgttatataatttgtttcctctgttttattgttcgttctcgatagtgaagtctctgtgtgtgtgtttgttttgattttatttttgaaattgatcgtctttgtctgtgtctgtgtagattctggtgagtaataatggtgtttctaagaattgccaaaaaaaaaacctaatttttgtttttgtttatttccactgattttgtggttagtgattgactcttagttgtactttcttatattttttttttttttgtatgttgatgtataaagacttgaactttgatcatttgcttggttacaggttgagatcagataatttaattggaagattttaggttatg

SEQ ID NO: 28696 - DNA, 3000 bp, Unknown
  misc_feature (1)..( 3000): 2750-1469P.txt file - cDNA_ID_2998240; gDNA_ID_2926243; Annot_ID_142942
aacccttgatggttgagcatcactagagaagctttcttcagattcttccataactctgaatcgtctgttgtgagtatcccatctccaaaaacatcaaacacttgtttgaaatcgggacctttggtgtaattggagaagtttgagctcattatatgatgaatattagttggatcaacagtgaacaacatatccataccagtgaaccatgggcctttaaatggaaatgtcaagtcagagttctcgagaacctccacgctgaagtcatagatccgatggaactccaagagcagacccggaagcatcccgagaaccggccagttcccaaggaagaagtgaaggatgataaagcaaaagatggctatggaagcttcgaataagcttattgaagccattagaagagtttgatttatacacacacacacttgtgatggtttctttgagtgcgcaaacaacttgatttatttatatacatgtagctattttttttaacttatcattattatgtgtagatttttctttcaatatccttaactgaccatttcttatctcgaagactttatatgtgaacacatgcacattatcacatacagagagacaagggggcaatggttggaccgtaaacgattatgtatactttgactattagttaagagtaattcacgaaaaccaaaggaaacacatgaccaattcatatacaaaagcatctcaagaaatgacaaattgaccaattccttacaaaaactgaatctagctagacaactttcccaagaggttatctcagtgattcaatgtaaacacattccacgtgatccaagatttattaaaccccctatgaagcatacaatgaacttaatctaatatcacaatggagacattattgctgcgaggaagtgttgaatccacctgatgcagttctttaaaccttgtttcattaaggtcacttcccacgcgtacaattattgtctccagatgcagttctgagcacaaattccacaaacaaagacatgagctcaggcattagcttcgttaatccaagtgttgaagagattggaagatcattgatctaagagtcaatgatttgaccttgaatgtcggaaaatgaacaccattgagctcggcaaggcataaaatctaacaaaagatatacagagaaagatagtgaatactgaagcagcacctaaatgatgaaaacttatccatcaaccataatctcgagtgactctgcaacatagtagtgagttctctataggctttagagaatgcaagaatggctaaacatatctgaagaaagacttccccaatagtaaggttctgtacgttctgcaacttttctagcatctttagcaccatgtcttgaagacaatctggcttcaaggttcagctccaccaaactatatgtcgagtttagcttcggttaaagaagagaaatcaactaaactacatggtatttgagagtttctcaaactcaaacaatgaagatgtggcgccacaatctgcaatggtcccttaaaccaaacacagcgatctatcaccaaagatcttcagattcagtgatgtcttctttttcgatctgttattttttttctttttttttttgttatcagaaacaatttcgtgaatttttgaatagtgtaccaactaattatattgttgttactcaaataaatacatagaccgacgaattgctaaaagttctgagatagacatttacaaatctatgtgaaaatatatattcgatttagatagatagatatcccttcatgcacaaaatcatgcatgggtttcaattcatgagatataaatttaggcggcacagtcccacgataatgtaaatagtatataggtggaagttgaacatctcttttctgataaaaatgaatgtatattaaccattttgattgatacgatagagactatgatttgttcttaaaaacatctaatcaacctactaattatagacattacctaaaatataattaaggttcaaattatatagttgttagctagatataattaatgtttgtttactaatacataaattactaagatgtttacctgtctttatcgtatcagatttatatatatgctttttgtatgcatcaatcatttatttcacggtttttgatttatgaaaaaattaaattgatacattgtttgcggtcaaaaacgaagaaaccaattcaaccacttttacaattgtccaagtaaagagtgtgactaccactagctagtatgtgcaccatgaatgcgtcaggtctgcaacaagtttgaagctatcaatggccttacaggtttgagctttagttcttgatggatttgagccaagtcattcgccataattcaaggactactagacaagaaaggtaagttatttcttcattacccggaggcctcatcaaacatttatatttctgattctactacaaaatggtttaatttatcttgttttgtgcaatattgataggatatgtttggtccttttcaaaactatgaagcacatgccatctgagggatggccagtaattaattcgaccccttttttgtatcggctaaactagtaaactgtagatgcaaacaaaacaagagtgaatacccacaactacgtacactgctactaagtagtaacataggtcaaatcattaattgcaggttatgttttgataaaattcataaatcaaatcattaattaccccaaccgcaaatcttgactcttgcttgtctcaatagtcaatgatcattaagactccatattaaccttttacgcaaattgagaacaagcattgataaaataaagtatcaattaattcaaggtttattcacatctgtattcgctgttgggtttcatttataacattaaagcacatttcttatactactagctagatatttgcaccacttttttttattacaaagttatgttttgcaagttgtgtaataacttgagttcctataaatagcagaggacggtctaaagccaatttcacaattcgaaccaaaatg

SEQ ID NO: 28697 - DNA, 3000 bp, Unknown; identical to SEQ ID NO: 28696
  misc_feature (1)..( 3000): 2750-1469P.txt file - cDNA_ID_2998240; gDNA_ID_2926243; Annot_ID_204176

SEQ ID NO: 28698 - DNA, 3003 bp, Unknown
  misc_feature (1)..( 3003): 2750-1469P.txt file - cDNA_ID_2998244; gDNA_ID_2926243; Annot_ID_142944
ttcttccttgggaactggccggttctcgggatgcttccgggtctgctcttggagttccatcggatctatgacttcagcgtggaggttctcgagaactctgacttgacatttccatttaaaggcccatggttcactggtatggatatgttgttcactgttgatccaactaatattcatcatataatgagctcaaacttctccaattacaccaaaggtcccgatttcaaacaagtgtttgatgtttttggagatgggatactcacaacagacgattcagagttatggaagaatctgaagaaagcttctctagtgatgctcaaccatcaagggtttcaaagtttgtcaatgagtaccacgagaagtgctcaaggatgggcttgttcctcttttcaatcattttgcagagaatggaacggtggtggacttgcaagatgtgttcaaaaggtttatgtttgatacgactctagtgacagtaaccggttctgctgatcctagatctctctccattgaaatgccagaggttgagttcgctaaagctctcgatcatgtaggagaagggattatgcatagacatgttagaccgagactcttgtggaagttgcaaaaatgtgttggatttggacaagagaagaagttttcaaaagctgacgccactttaaatcaagcgtgtgcaaagtacatattagaaaagagagaagagacaagatcacaaggttttgattatcattccaacggatcagaaagtgaggatatattgacataccacataaagatagatacaaccaagtacgagctgttgaatccgagtgatgataagttcctcagagacaccatcttagctttcgttctagcaggaagagataccactgcttctgccctcacttggtttttctggcttttgttggaaaaccctcaagttgtcactaaaattcgccaagagatcaacacaagtaatggtggccaagagaagccatcttgtgaacctatggagtacttgaataacttggtatatttacatggcgcgttgtatgaagcaatgagactctatccaccggttccattcgagcgaatgtctcctataaaaccagatgtgcttccaagtgggcacaaagttgactcaagtatgaagattttgatctttatttacgcgttggggaggatgagagccgtatggggagaagatgcatcagagtttaagccagagagatggctttcagagacaactagcttgagacatgagccttctttcaagttcttagcatttaatgcaggtccaagaagttgcataggtaagcaactagctatgactctaatgaagatagtggtcgtggagatattacaaaactatgatattaaggttgtcaaagggcagaagaagattgaaccagctcctggtcctattcttcgcatgaaacatggtcttagagttacacttactaagaagtgttgatcgttaaattaagaataaaaatcatttgaaatcatatgtagcctaattaagaatgattctctctaccttggttacaagattatactgcttatatttgattgatgatgtgatttcctcatcacagctcttttaatgtacggaagattccatacttatcaactgagacttttatttttatgattggtgtgtgtataatttatctggttattagaaaaaaaaaatccataaaggatgacatcaaaaaggagaagatatgtttgttggactaagtttgtgcactttttctctgtagacataccaaaaacagagccactcactcagtcacatctcacatgtcgctttctgcatgtaatatgtctcgtcagattttcagggtcaaacggtgtttttgtctcgtttttagtttcacagagaccaaaagatcaaagagatatatgtgcttgtacagttgggatgtttataccataatgcaacagcttcacattaatttgacactttcccacacaacaataatgttagtttcttgaacccatgtgagttttgcagtaggtaggctatactaggaatagcagactgaacaataaaggaactaagcaagatatagaatctaactaaagaatgcaaaaaaacagagtgaatatttactgaaacacataagccaaagcaacaaaaacaagatcaaggtaccaaagttcctcaggcatatacatataaaaaaagataaatatgtaatgaagaaaaaaaacagtaattcctttgtcttttgtggatctgtgaatttgtttttcgttgtatggtcgagccaaatggttatgttgggccttagccttttttttttttttgggggcaaacaagaccttggactttataatagttattacttctttgtttactatagttctttttttcgtaaatggaaatttattagtaatatatttcacctattaaaaaattgtttacttgattaataggaattttttttacaaaaatatataacacaaacatcgagaagcctaaacatatacatatcttgataatttaatctgcaataatttctaaaatctaatgatatactatatataatattattagtatgttttacatcagaattttttgtcttacttagtagaacaaaatttagataaaagaacacttacgtaaaaaaaacataatactagtccttttgcatcaatatcatcaaatatattatataaatgatcgaaatattatataaacaatcaataaaaacaaacctagtcatatgaaaatattacattataaaaaaaaagttattttttatgtcaaaaaaatcattcacttcgtaatagtcaaacaaaaatgacatctgttaaaaagataaaaaaaatgacacctgtaacatgttttaaaagttactttcattcgttagaaattattttatcttttacttcatttttttttggtctttattcccagaaaaaaaaaatatttatacagaaagacagcgtctccgcgacggttgaaatccctagccaccactctctgtctgattctcccctccccgccaaaacatg

SEQ ID NO: 28699 - DNA, 3003 bp, Unknown; identical to SEQ ID NO: 28698
  misc_feature (1)..( 3003): 2750-1469P.txt file - cDNA_ID_2998244; gDNA_ID_2926243; Annot_ID_204179

SEQ ID NO: 28700 - DNA, 3000 bp, Unknown
  misc_feature (1)..( 3000): 2750-1469P.txt file - cDNA_ID_2998252; gDNA_ID_2926243; Annot_ID_142947
gaatagtctttccattgttgaaaagccaatacctgagctcggttaatcacaaattgcagcttctcagtcgcatcatagcaaggaaagcaagctaaatgcttcatataatccacaagtttagcaggttcaaaagagattccatccgataacttgtctccaccgtatctaacacttgagtcctcacgaattccagcattgattatgttctgagtcttgagtttgttataggcttcctctgaaacacaagagcaagataaaccaaactctactctccttgaaacctcatccaaagcacaatcaatagcatcacgaaactcagcggagttactctgctcctgcatttgagagaaattctgatgaaaaggctttatctgagatgcattattccaagcaaatgtacaatccccaaaatacgcaaccaagacatttcctttcttgaagtgcctcatcgcagctttagaggcaacagatttatcaaagaccagtccaggccaccatggataacttcttagtttagcccaaaccaaatctgagtcaaaaagcttcagattctctttagaaaatcctttcttatccttgttcttaagcagatctgaatcagcatcaaaatcaaccccgttacagagactatccttatcatcacgagcagagacaaatacttttcgctcaactccagtgaggttcactaccaagtcctgagcttgaaagctcatgggatcagctagggtttcagatgtgtgagccataccgtagtcaaaactcgacgcatttatggcaaaatcagcgttggagtcagattcgactccttctggttccgtagacataacgagcaccaacaaaaatccctagacaacgaagaaacaaaaaaaagcagaaattgcttcagtatatgcttccattaaagcaaaaacagtacatcatacgagagacgaagaaaataatcggagagcaaaaaaggtggacagaacctccggtggcggttacggtttcgccggcgacgaaagcttagattttgggtaatgaagaaataacagagtttctttcgttttgagggggtttatgagagagctacgtgtacgtcacgaattattccacgtggcagtacttgattttgtctcgactcatcacaaccatacattattacattgagtgaggttcaaaattttcaaacttttgcttttccctctttatttgaacttgaatttgacttgtttttactgatattaaatagaatagaattttactacaagtagattagaattttactacaactagtttatttctaaagaattaaatttgttaattttatgtttaatgagaaccaaatgttttcctacaacattaagacacttttttataagttttctaaacttgtttaatagtatgttttactaaaaagtgatattttgaaaaacctcttttggggatatttttaaatactcctcatagactaacaaaataatatatcaattcatatataaacacaataacaccgtttattgtgtaaagtgcttagctctctcaatggtcaaaaaatgcaaaatccattttcttgttatgtctttgtcatttttattgttatgtcatgtggcgtctcaacattgagaggatattttgggagccagtaacgttcgagattcaaaattgtggatgagattttaacgattgaaacaaaagtactaaaaaatagtcgtttattagcacatgtactcttttttttgtttggacagctattagcacatgtactcttatatgtatgtatgtatataaaaacgtgaatagtgagtggaataagagaaagtagttaaaattcaaagcgataagagtaccattttgtttttattatattctattctatggacgcgattcctctgcgttgtttacctattcaaatgaagttctaagccaaaaaaaaaattagtcgatttgtttttatgttcataacaccccacgggctaactaatatggtccaaaacaatataacaacaacaaaataatcacgcaaaaatctaaaaaaccagccttgtgtccatactccacccacatatataaggagagaaacaaaaagagcgtaagataaatcaaggagaagattaagaaagatggtggctgttcagttgtttacctggaagccattgattctaccttctcaagctttgacaagagatcgattagcttcttttcacaggttttgtttttgtaatttctttcttatacttgatatttctgaaaacaattgcatggtggtgactttatccataagtgataagatgatgattgtgaagtttgtgatcctcagaagattttgagtgtttttgttagaaacaagctctttatttccaaacaactgatacagatacttaaagaacacggtatttatcatttaagcgatcaatactaagtaactcctctcaacaaattctatattctaaaagaaatgccaatgcctctgtttatttctgtgtcttctcttcttttctttataatccgaaccctctagttccgtcagcgtcttcttcgtccttatcttcaaaacttgcttgggcatatatcacagtttatttttgttgtttcttcttccggtgaattttacttcatgttttgcttacagtaaatgtagccaagttcaatggtttcgattagaaaatgtgacggttttagttaggagctctgaatttgggtttagagtttagtttcaaatggaatttgggtttgtaagataaaggtatatcgtaaattgattcaaaatctggaaattgtcattcaatcaaagctcattgggttgtgatgtttacaagttgtgtatctctgattctttttttgcaggagcttgagtttacactctctgcctttaggtgggattaagtcttctagtttcagaggtcaggttctgtatatttttccaactttgatgcaattctttacggtctcattgttgctgttcttccacaattagactcattcttgattagctaattgtattttttttctctctatatg

SEQ ID NO: 28701 - DNA, 3000 bp, Unknown
  misc_feature (1)..( 3000): 2750-1469P.txt file - cDNA_ID_2998256; gDNA_ID_2926243; Annot_ID_142949
tctgtttccactacagtgtcctctgtttcttttactctttcaagctggcctttgggttctccaaacaaagcatagaagatctgtctatggcactcatcgcagaaatagaagaacgagaagtgaccttcgtttcgaatcttatgtacagttgcttcaggaatcattctgctaatgtagtcactcattgatggtggagccactcgatcctccattccctttaaagaaacagaaatcaaggtttgattaactttactaaacaaactaactgatgcattgtatggtgcagaactcacctgccatatgtgaatgggttttcgaaatccgattagttcacattcggcttcactgtacattgacatgagccaagaaaggacaccgttggttgcacatttcttctgtgtgcggaattccgaaagagtaaagccccaattcgatacttgaagcacggcttcttctacaaatggttttgtgattccttgacggactgattcctccacgttcctttgataaacttcttgaaacgttggatctttgattaaaagtttatcctgaaagatgaaaacagagttagcagatatgatgactccttctcctagagaactcctctctttgtgtttgtgatctacaatggaggagatttagtaccttttctcctaatgacaatgccatccactgatcgagctgatcgaggttaccagagagaaaagatctacggtagaagaaaggcagaagaattggaaaccgccgagctaaaaagtacatgaatttcctctttgttagccattgctcccatgtttttaccacctcttctttaaccatgcttggctcatatggattgatcacgggagccaccattgcagctcctgcagtttcacaaaaccaaacccactgagcaacagtcttgcatgactggtatgctaatgataggaacagtgttaataatacctgcaattttctcaggaaaatatttcattccagcccatgtatgaatactaccagtagagtagccaagtaaccaaaatttctcatcaattccaatagcagctgctaggttaatcatatctgaggctgatgagctaagatttcgacctcgatgaggatcactctctccaaaccctggaagatcatatgacactaaacggacaccatactccaccaacaatgacttcttcactccaggtatgccttgattaagtacacattccaaacattagaggcaaactaaacgtaatgtgtagtaactaaaaccgatggaacactgatttgaatacctgcaagtcgagaggaaagaaaagaatgaggcataactaaagagtatcttgctctttctgctgaaacacctagctcttggtaagctatatatctaccatctggaagctgtacacgtgtagcaccggtaggatgtaaacgcagtttcgttataaccgtcactggtctatcgttctctggactaaagcttaatgctgcacttcaaagttcaatatgtcaatgcaaggaatcaaacctacaatactaagctatttaaactacatataaacaatactgaatcaacctcagatactaagctaataataacacattgtgttgatttgattacctgcgagtgctaagaggaagacgaagaaaatcacaggccaagcgtgaatgggatcacgatcctcaggcaagaactcgtttagaaagctaagcttcttcgacactttagccgccggtttccggagcttccgtactaggaatgagtcatcagtgaccaccgtctgctgcacaatgtccttgcatcctttcgcgagctcaagaagcatctctccccacgatttcatgaatcccgtcacttgatctttcaatgtctccttcggttcggatccggatccatccgccgacacaaaacccgatctctttgtagccgccgttaaatcgatcggtgctccgtcgtatcgtaatccggcgtcaactaggctcgctaactcttcctgccacgtaggcactcctctaatctcctccatcttcccaatccgaacctaaacccgaaccaactcttcacagcaaaacctgtacattcatttatatagaagaatcagagagagaaatgagctacgagtgacacttttacatagcgtgaaattcaagctccctatttttctttttaaaatctcggaaacaaaaattggaataacgaatcatctcttttttttttcccttaagaaagcgaaaggagacaaaagtttatcttaccaaatgacgtagaaacagcttcgacacaagactaatggtttgattcgaatcttcaatttattcttcagctaaacttttttttgtcacgttcgtctttttcaatattctccatcgcctcctggatttgactggctttatgaaaaatcccagtccgccattgacgaggttctggagcttttctttgactctctctcttcctctttcggatttagctggcgcattaataaacatggaccactggatcaaaattgcctttttgaagtaaacggttgtgatttgtccacgttggtctgtcgtggtatcgacggttaagtggtggggacgggctgaaccagtgactgtcgtgcgggcagtgcactctttgtgtgtcccttttacctgttacagccggttccgtaaggattacgggttatgctgatgtggcggaagtatttattcccagtattaattagcatcagagtatacgtgtatgtcatctaatgcgtccattagatccaacggtttagagttcagcttttaaaagcccaaaagaatgatgagaagttgagacaattatagtcaattttttaaaagcccatgacttaatgggcctactaattgatgggccaagtattagaaatccgcggaggtagaaccagcttcgcatatattaagagtcactgccttcactaggtttagggttttctcagccgcttaagagcttatcatctttgtgcttcctgcaaatagctctttgctgttgatctttctcctccatcaacaaacatg

SEQ ID NO: 28702 - DNA, 3000 bp, Unknown; identical to SEQ ID NO: 28701
  misc_feature (1)..( 3000): 2750-1469P.txt file - cDNA_ID_2998256; gDNA_ID_2926243; Annot_ID_204184

SEQ ID NO: 28703 - DNA, 3003 bp, Unknown
  misc_feature (1)..( 3003): 2750-1469P.txt file - cDNA_ID_2998259; gDNA_ID_2926243; Annot_ID_142950
ttgaaaagttcattaatgaactgttttgcagtaaactcaatggtgactcaaagaaggcaagtatcactgagacatcagaaccttgtgataagaaagactctgcagaagaagagatattacctgcaaataaagaaatcactggctcaggctcgaaagagcaaattggtctcaaggactgttctgcagattcattaccaccctatgctttagtcctcaactttgcggattcaggttcggttccatctgaagaaaagctgaacgagatatttaaacgttacggtcctctccatgagtctaagactaaggtcacgatgaagggtaagagagccaaagttgtgttcaaaagaggggaagacgcaaagactgcctttagcagcgcagggaaatacagcatctttggaccttctcttctaagttacagactcgagtatgtttgccccaaacggaaaaaaacaacatgactgattgagtcacggcatctcttaactttcagagattagggtctgatcagatatcatcagctaggtcttatgatgagagtagattttcgataaataaacgtaacctaggatttatgatgagagtaggttttcgataaataaaagtaacattcgtgtgatgagactaattcttaactttatgacatacaaaaccaaaactggaaataccaatgataacagtaaagttagtcgcaactgaagatgaggcttataagttaaaagagtaaattgattaaacaccaataacattaaacgatcatgtcttaattcaaaaactcataaaatgtaacacaaaatcaagttcttgaaacataaagtagaacagaacaagacttaaactgaactatcaaaaaccatatcaaaagcttgaagctttttgtacgggttgcttaagatcttggcttctccttcttttccttgaagagggccaagagtgaaacaccagaaaccttcacgaccttgaacctaactccgggaatatctcccacagcgtgacccttacgaccaaatccagcaatcaagacctcatcctgcaacaccataaacaagaaatgtatcagcatatgaatgaaactaatccatagtgtgatgattgaatagtcatttcatgtgacttacgttttcctcgatgtagttcaaacaaccatcattggggacaaaggcagcaatcttctttccattcttgataagctgaactctagcacacttacggatagcagagttaggctgcttagcctcaataccactgcatcatcaaacacaagagtctcatcaacgaccaatgtctctactcaacaaatcaattataagaaaaagtaaacttgaatgttatatcagacttacattttctcaagaacaattcctttagcgtgagaagaaccagcaaaaggcttcttccactcatttcccaagtgagacttcttgtactgcttgtcagcccacctctggttaattcggagtctcttcagcttacgcccagctcccataccacgtgtcttactgttaacaaatcatcacaaaataacatttgagaacaacttcactcgataaaccatagttaaaactcagaaaatcaataagaaattcatctaaataataacaagacgatagaagatttatctctaatacatcagcaaaagtgagcttcaaaacccaagagaccatagatactcatacagcgaattttaaatctccagttatcaaccatactagaactccagagtagctcaaaatttacacaatctattgtggatctatacataaaaaacatttagcaaacatatccagaaatgaagacgcatttgctatagaatcagttccaatcaaaaaccacaatcaaaagtcgaaaacatgtaacaatttcaaacaaaaaaaaaacacagcagactctatagaatccttcataattcatggaaacagcaagtgaatcagataaataaaacgctaaacagagaaatgagataggaacacgaaggatagatctaatagaggagaaacgtaccccatgtttgttgatggaggagaaagatcaacagcaaagagctatttgcaggaagcacaaagatgataagctcttaagcggctgagaaaaccctaaacctagtgaaggcagtgactcttaatatatgcgaagctggttctacctccgcggatttctaatacttggcccatcaattagtaggcccattaagtcatgggcttttaaaaaattgactataattgtctcaacttctcatcattcttttgggcttttaaaagctgaactctaaaccgttggatctaatggacgcattagatgacatacacgtatactctgatgctaattaatactgggaataaatacttccgccacatcagcataacccgtaatccttacggaaccggctgtaacaggtaaaagggacacacaaagagtgcactgcccgcacgacagtcactggttcagcccgtccccaccacttaaccgtcgataccacgacagaccaacgtggacaaatcacaaccgtttacttcaaaaaggcaattttgatccagtggtccatgtttattaatgcgccagctaaatccgaaagaggaagagagagagtcaaagaaaagctccagaacctcgtcaatggcggactgggatttttcataaagccagtcaaatccaggaggcgatggagaatattgaaaaagacgaacgtgacaaaaaaaagtttagctgaagaataaattgaagattcgaatcaaaccattagtcttgtgtcgaagctgtttctacgtcatttggtaagataaacttttgtctcctttcgctttcttaagggaaaaaaaaaagagatgattcgttattccaatttttgtttccgagattttaaaaagaaaaatagggagcttgaatttcacgctatgtaaaagtgtcactcgtagctcatttctctctctgattcttctatataaatgaatgtacaggttttgctgtgaagagttggttcgggtttaggttcggattgggaagatg

SEQ ID NO: 28704 - DNA, 3000 bp, Unknown
  misc_feature (1)..( 3000): 2750-1469P.txt file - cDNA_ID_2998267; gDNA_ID_2926246; Annot_ID_142956
tggaacggaagatgaggagatatggaccccgctgttgaccgacatcgacgtggcagtttcaaagttgggaatgccatcataaagtaatgaccaccgttgatacgctctctttctatctattcccaaggcagctctctccctcttctctcttctctctctgcctctgctttccgttacggttgcacttatcggccagttcaagattctaattaagttattgcgttttgcattgtttatttcattcgtttcccatatgaaaacgtgaatgtgaagaagatacgttaccacattctactagtgttttagggacatgggactttcgtttttatgagtttcataaaaacggaccacttcacttactcgagatttacaactttaacggctaacttacttatcctagtcattctctttatttaatcacccaaccaatgtattgtattctattgccacgaaaaaaaaaagcaaggcgggaacagagaaaaagggtttggcattatgtgagcatgtgagtgaggctataatgcatgtttcaatgttcaggtttcatcacgaggtgaattgtttgaatccccaatatttctgtactctctctgaccagatatgctgcagatgttgtaacgtgcttcttccggctgctcaatcatttttcttttggaccaactcacatctctgtgttaatttctcttctgtttatataacaaattcatactacaaactttgatcaatttttttttatttatgggagaagaaggagctctaatgaggtcatcaactttgatcttgaccaatgaggcaatgaaaacagatgacatactactgtatatccaaaggttgtcagaaaacccaccttaccagtatttgtttactcatcacaaatttgaggaatattttggaatgcataaactatctttttagctgtcgaataaacttaccgtaaatcacttctactaataccctctacatttctcaattttttttttaaacctcataacttgttttaatttttgagacatagaaagaaaaaaacaaaagggggttctactttaacagactgtaataatacagaagtggaggagaagagtaataagtaataataaaaagacaacagatgaggcatgtgctctgtgttccattatcgttctatctatataataaacataggtatgtatgtattctgatcctcgaaactagcgtgtgtgtatcatggagggtggatgtggccaaaagttatctaaaaagaaaaaagagagacacacttaacggtcttcaagattgtacccacttcctcattagctattactctattagcccccaaatatcactatgcacatttcagcttctttcaacaagatctagaataagaagatgagaagctgtaagcctgaaactccattactcgtatgtcagatccggatcccatacattacatatacatataatactgtttacgtaggtgcaactaagccgttctatgcaattccaatgctcattaatctgtacgctttttctctgctacagccccattttggatcccatgtaaaatgatatcctagcaagaaactagtatatgtaacacattactctgtctagcgaatcaaagtattaagcatctgcagccttctcctccatttggtccttcaaaccaccggtcccatcctaagttcaaaggtccattggttctgccagcaccacaacatccatcagttattcagtccaaaccaacactagagtttcaaggtttaaaaagcactcacagtggcaacagaggatcgggtcctttctcgatgacagatagcagcctgcgaaccaagggaatatcaatttgatcaccaatcaacgtacaagtttcagtcaaatccagataatatacctacaggagctagcacacagttgcttgcaagcgttaaaaaaaaacataggttgagtatcccatacttactcctcacacacggttgatacaatatctgtgttctcgacctccttcaactctttctggatatagtacatgaaacagaaagagagagtaaagctatttttagtaagtgttagagctcactagtaggaacaataggcaaacacattatctgtgcaacagagaaacttgggagaaggttaacttttaacatgcctcgatagatgataaccaagagagaatgatactaattggactatgatcaaaagtattcttgcacatccctaagaataagatcaacagagaaccattccaatagtggatccaaagagaacccagcagatttagattttgggaatacaattcatagagtcataaacaagactgactgaaatggtgccacttattgtcaagagaactaccatgctcttctgattggaacagatctgccatactggtttttgctttcacaggaaacaatcttagcgacctttacctaattgttgtaacaattgatctaaaaaggataattgagctatccacgagagacctacgtcggaatttgaaagagatacgagttagtttagctacctccaagaaagcgacttcctgttcaacgcgggcaagctctgcaaggatcctgtgcttgcccccgccgtgagaaacagactcctcctgctcgtaaaccacagtttcctctcgcatcctctcgctagcaggtcgcagatctgacaacgtcagagagagtctggtcttagtccgtacaagtttgaattgtcgtcgaagtctctctctctctgactcaaatcgacttttcccttccatttgcagaaaaatgccaaaacgcccaatactattatttgggccaattcttgcaaatgagcccatgggctcaacaaagggatatgtgttgtcgcaacaaacaacgtgaccgtacataaacatgtggttggagtcagtactgactctgttagagttagagggtttagtcacactctcattctcgtttgtgtttttgattggcggagaattggtgatagataagcttcttcttccctcttctcaacttggtggatctgtcatcgatg

SEQ ID NO: 28705 - DNA, 3000 bp, Unknown; identical to SEQ ID NO: 28704
  misc_feature (1)..( 3000): 2750-1469P.txt file - cDNA_ID_2998267; gDNA_ID_2926246; Annot_ID_204228

SEQ ID NO: 28706 - DNA, 3003 bp, Unknown
  misc_feature (1)..( 3003): 2750-1469P.txt file - cDNA_ID_2998271; gDNA_ID_2926246; Annot_ID_142957
ggccacaaagccataaagtcagtgaaagttgataacgctgatcaacacgccaacttggatgactcagtgaaatcaaggtttatctccctggctttatgtatttcagctttgcttctgcaatttggtggtctgattttgtggtcactgacaaactttgccattttctattgctatacaggagcaggagcccaattcgtaggagaaaccaaaacagcaggagcaaaagtcctagtaggagccctgtgagagttcttggaaatggaaacagaagtcctagtaggagccctgtgagagatcttggaaatggaagcagaagtcctcgtgagaagccaacagaggaaactgtggggaaatctttcagaagcccatctccaagtggtgtgcccaagcgcatccgaaaggggcgtgggttcaccgaacgctattcctttgctcggaagtaccatactccttctcctgagcgttctcctcctagacattggcctgacagaagaaactttcaggataggaacagggataggtaacttaatctatacatacatacaacaaaggacgatagctctgcggatagtactaaagcctcattttgtttaattatgtaggtatccgagcaacagaagttactctgagcgctcaccgaggggacgctttagaagcccacccagaagaaggagccctccaaggttcgctttcttatctctgtacagattctggctttggcttgggacgatatagcttgtaaaccagcacctagagccacttgcattagatttatatcctagaacgaccctttttgtgatattattttggttaagcaaaacattctaattgaatgctgaaagttgaaaagagcaactttatagcaatgttggatgtcctctgaaattgagtgttgtcttgcataggtacaaccggaggagaaggagcacttctcggagtccagatgggtaccgtagacgattgagagacggaagcaggagccagagtccgaggcatcgtagccgtagccagagccctagaaagaggcagccaattagccaagacctgaaatcccgtctcgggccacagagatcccccatcagaggaggacgcacctctcctgcagaatcactcagcccttctcactcaccttctccaccaggaaagagaggtctggttagctatgcggattgatggtcactctcatccattggtttctctgctgacttgcgagtttttgttttaatttccgtgttttagtgcaagcaataataggtaatgatattttttatgttggtcggatatataatactctaccttagttgcattattacagatcgtggaacattgatcaaattgagactgatatatgttggcagaattgagtttgggaatcgaagtttgtagaaaatttatcgaacaagtagcatagatatctcaacatgaaaatctagtaatacatgtaaagaaagaaggttaatgatattccgcatgttcatagataggactcgaatctttctttaccacaagaggggtttacaatgatacaatgatcatgtcctagaagagaaggatcagatgggttggtctttgggaacgatctgatccttgatccacatgtagatagggattaacacaaaccaggcagctgctagagttcccaggaggaagcgtcccaagaaggagaaggggttgttgacaggcttctctacgtcctcttcctttggaccaagctgcagcatttgagtgataagtttagtgtatcaaagagagaagaaagtaaaaaaggtgaagtgggaggtaaaagacctggagaggagagtcaccggaggcaggtttaacaccagtgacagaacatcccatgataaggccgtgcctgcgaacaccacggtaccacttggggccaatcctcttgagctgaacgtccttgaaaccggcattcttgaaccactcaatgtactcttcctccttggggaagagcatccagacatcagaaaagaagcgagagagccagaaggttgggtagacagggccgatgagacacgctttgccaccgatcttgagaaccctgtacgcttcccttattcccctctgcgggtccggccagtactcaatgctgtgtgatgatgagacacacaatcaaacccaccggaaagaagacgattataagaagaagaagaagaagaagaagaagaagaagaaaaggataccttccagcagaaacgtatctgtcagcataatcggttggaaaaggaagatcctcagcatctccctcgacgatcttgcattctttcaacggctccttttgctttgctttggccagctgatgtggcgactggtccagaatggtcacattcttggccttcactgtcttgactatgcccagagtagtgaaaccagttccgccgccgacatcgaccactcgcatgtccggatggctgagatccgctggctcaagagcgtcgtctctcatatcctcggtccaatgcccaggattgatgacatggtcgtatacgatggataagaacctgtagaaccagtaagcctccttcttgtgctgaatgaacctaggttgcgccgatggccgggaagacgacacgctgctgctgctgcatctagtagccaccgagagtctaggtgtggaggttcgggtaactgagagtaaggtcggccgaggaatcgatctggcatgcaaattggaaccaggggaacctaaacctttggggaaggtaatggccccgttgagcatcaaagaggccatcgatgacagatccaccaagttgagaagagggaagaagaagcttatctatcaccaattctccgccaatcaaaaacacaaacgagaatgagagtgtgactaaaccctctaactctaacagagtcagtactgactccaaccacatgtttatgtacggtcacgttgtttgttgcgacaacacatatccctttgttgagcccatgggctcatttgcaagaattggcccaaataatagtattgggcgttttggcatttttctgcaaatg

SEQ ID NO: 28707 - DNA, 3003 bp, Unknown; identical to SEQ ID NO: 28706
  misc_feature (1)..( 3003): 2750-1469P.txt file - cDNA_ID_2998271; gDNA_ID_2926246; Annot_ID_204229

SEQ ID NO: 28708 - DNA, 3000 bp, Unknown
  misc_feature (1)..( 3000): 2750-1469P.txt file - cDNA_ID_2998274; gDNA_ID_2926246; Annot_ID_142960
gcctccagtgtgtttgatgttacccgcagttttagtttaatgaagctaacttctaaattttcatcagggaccatctaacaatgcataccctgttcccccgggtcctggtcaatatgcaccttctggcccttcacaacttgggcaatatcctaaccctaagatgccccaagttgttgctccagcagctggacccataggatttacgcccatggcaactccaggagttgctccaagatctgtgcaaccagcaagtcctccaacacagcaggcagctgcacaggcagcccctgcgcctgcaactccgccaccaactgttcagactgcagatacttccaacgttccaggtatcgtacgacgtttcattagcaccttatctctgttttgtttctgagtaaagtcatataatgatcacctcttgtaaactgatccagcccaccagaaacctgtgatagcaacgttgacaaggcttttcaatgagacatcggaagcactgggaggcgcacgtgcgaatactactaagaagcgtgagatagaagacaactcgagaaaattaggtgctctgtttgtgaaactcaacagcggagacatctccaagaatgctgcggacaaactcgcacagctatgccaagctctggacaacaatgacttcagcacagcccttcaaatacaggtaagctagtaaattgatctcttctgggttccttgtagatgatttcgtgtttaataatcagttttattgacctcaaaaacaaacaaacaggtacttctgactaccagcgaatgggacgaatgcaacttctggctggcaacactaaagcggatgatggtcaaggccaggcaaaatgtgcggtgattatttattttctgggttcatggatttttttttttataaatcttaaggagggacgtgtgtatcaaactccttttgctttcttaattttggtctttttaaaacgccgttgctgctctaatcttcttttttttttttttttgtcatttatgaacctcatctgctacttccagttactcttttgtttagatagtatagagatcatcagattgctgaaacattctcatgtttttggatgttactttaccggacaagtttgttcgtctttctttctacgaattttgttagatttttacgctctttgtttttcttgtcatatttgaaacatggattaagcaaaaagtagcatttataaaatattgttgagcaacaactaaatattccgccagaatctcttactaataaaagggagacacgggtagcgggagtatcctagaacgcgttgagcaaacttttaaaagaaacgtgccagtcaccatcatggcctttttgaggtcgatctcggccatggtgcagattccatgtaggaggaagaaagacatcatcccccacgactacgagggcctcatccttcgaatgtacattaggacaataaggaaaggagtattgaagaaactggatgtaaaagatgatggtacgaaagcgacatgacaaatcaatgtggttgcagcaggccttgtcgatgaaaatataaaacctttgggttgtataaaacaggcccatatagcgagagaatgtaggcccatataatagagaatgtatgtttatggacccaaaaacgttaccaccaaattacttgacgtagagagatccgttgcttaaaaaagtatgacttatgtgcgagagtctgagagagacagagacataaaggcattgattggaacgtcgttgactgagaacacacattgtgttgtgatgactgatgacttgaaattcgaaaaagttagttaagtggggagagagagaaagagagctcaacctcaattgtgggttttgaaacccaatgtaactaacctactaataagagttgctgcagtgcaatccaatgcatgtgtgagatcactggcgcgtgagaatcacactgacccaatcgctacgtgtggattttgtgtgtaaatggagatgtcagagagggttgaaaggaagagaacgtgcaaatgcaataatacgatttcttctgactactacttttgatttacaaaagaaaaaggagtatttacatatattgagggtgcgggccgtataactaactcttatcgacgtcattatttttaacattcatcatttgcagctttatgtttttatcaatttaaccaagtgttttgaaaataataaaaattgatccttgagtgtatatatatgataataaaagaaaactttactgcgataagacttgactattggacccatatacatgtatctttataacttttgagtaattcttttattttttaaaaaggagaagcatttttaacaccaaagctttattacctctgggagtatattatgaaacgacaggtcaaatcaaataatcaaactctacttgcaaataaaagtttgaaaatcagaaacacacattctgtaatctggttgaatacttgaatgctgaaaaaaaaagaaaaagaataacacattatacttgataagagatgatgataaaatatatactagaatcatatgggtacaaaaatacatgagagagagagagtgtgtgtgtgtgttttgttgtgaatttgattgcaaaaatccaaagtttgacgctttgacccactcacttgggagttggagcccagaagacacaacagtcactccactcttctttaactcttttttttatttaatttccccacaccacacgactcacgagggaagtggcaactttgatttttgcaagcagaggaggaagaagaagaagtagaaagaagcttaggtatggagtggagtggtacactggtactagagtgatgatggtggtaaggtagttgagaaagaaagcctttttagctttgctaaagtccaagacaagaaaccaaacatctttttgtacacaagacaagacaacaatagcagtgtttctttttcctgccaaagaaagattaagcgagagagagagagacaaggtctcatcgagcaaagagtgtgtttccatg

SEQ ID NO: 28709 - DNA, 3000 bp, Unknown
  misc_feature (1)..( 3000): 2750-1469P.txt file - cDNA_ID_2998278; gDNA_ID_2926246; Annot_ID_142961
gagatcgcagttgctcttgagtctagccaaagaatcttcggagatcaaagcatgactctcgaaaaagtcgtacatacccatcaagtcggtctcgtcgttgatcaccgcatttcctatcagaatgcccttgagattgaagaagctccggtgatggagaaggatagtatgggcaagttgcggaacatagtggccggcatagctctcaccggcgatgtacaagtccctgcctttgtactccgggaacctctccagccagttaaccaggaagatgtagttatcagctgcggtattcctgtccccgtgcttctccaggtccgacgtcgtgttggtgtacgagaaccccactcccgccggcgattctaagaacaagacattcgcagctgcaccaccaccacccgtttgataattttttaatcacaagaatcgtttaccattaatttatttttgttatttaataaaaaagaaaaacgataggtaccattgttccatgcatatcggtttctaaaaagcgttttgccgtcgctgtgtactctgaacggcccaagctcttgtaatgctccatacgccagtgacgagcatcccggtcctgttaattatttccaacacactttatgcatatgtatgtattattagtcacccatatttctgtaatcaaattctcgattttgtgacagctaattcactgatgagcttactattaacgtctctggtgaatttgaatatatgttgtacattgcattttatttttatgtacatacataatatagaaatcagtatataatatatagatagatacgtagtggctggctaaataattgaccagtagagctgtgcaacaaacaaagcacgccgagaaatcctcagcatgtgccatttttgaaaaaaggcaaatcatttttctttttcttttctcagttgagttttcgattggggttgtggatcttttccctattattcactactattgttgcgcaaataataattagttccgataatttgatttaaaaattataaaagaaaaagaaaattagcagacctataaggcataaatatggtatggtcctcacaattattaaattctgaaaatcatatagcatatgatagattaataagcactgagaaaaagacagcctcgatcgatcaaactaacattcttgttcatctttgtactcagatataagatgtacagatataaacccataatgcagtgcccctaactaaagatgcaaaccaaaataaaagaaatatatatacgtatgcgtgtggacagtggaaacgtaccgccgttgagccagagaagcagaggagaagaatctttagacttagaggcttccacgaaatagtagaaaaaggaacgcccggcggattcgttgacggtaacatagccgccgtactgatcgaaactaacgggaggctgtccgggcaatctccgtatcagatctctctttcttagcccctcctgattagcagcactccgcagcgaagacggtttcaaatccttaaccgccttgaaatggcttgtgtccatggtggacgaaccaccaacccctcgcttagacaggtaaagacggctcagggcgtgcacttggctgctgcattcgattcgagacaccaccacacacagtaacaccaacaccgatgcgattacagagtaggagtagccctgtcctttcctcattctcttatgtctatgaattatagcgtgggagggaaacaatagaaggttttggttttggttttggttttgaagaagagacagttaaatgaagaaacgagtgtgtgggtttgcatctttaaacaacttcttcttttttgtgggtcaaaacctccaaccatacgaatgattgttccttttttttttttttttttttttgacaactattgtttttgtttttcatttttaaagtagtacaattattttgataacagattcagattaaagattaatttatttattttatttttcgggcctcaatcaatatatatatatatatatatatgtttcatgtaagaaaaggttgtgtgtctatgggtgtgaagtgaacttactaaattaaattagtaatcttcgaatgtatatggccttcgattattattagtcgtttgggagagaaaaacgaaacaccttgatagcaacttataacttataagtagaatgatgcaatgattattggtttttaataattatttctcttttttttcccaaaacaaaagttaaagaagcataaaatgcattaccctgataaaaatgtacaagtggaattctaagaatctgaagaaaaaaaagagcgaggagagaagatgtcaacgtctctgagtgatcatgttatgccatgtggtgtgtgagtcgatgctgcaatcctgattttcacacttgatatcattccatcttttgtttcttcgtaatacatttaactgcaaacaaatattagcttattttctaccattgtttaatacgaattctataaatctggaacagaaaaaatgtaagacaatgatatgagccgaacatgggactttcgtgtactagtagccccactggccagatccgatgtttcagcacattccttcccagtttattattcataacaatctcattgaccacttaaataaataatttcaaatttgatgataaaaatttcacgtgtttttgaaaacacattattgggcccaattgttgcgattcaaagttgggtaatgagatttatccagcatattgttccaaggcccaaataagatgggtcataggcctcagagattagttgacgtgtcatgtttagaatggctctcagaaccttaggggagtgtccgagattacccttactcttttgagttgaaagtacagtttcgcccctgtcgaaataagaaaataaaaaacattctaatcaaatctataatggtgaagtaactcctctcctcctttgttctccagatcccaatttacaagaattcaacttcacacaccctaaaaattaaatcccaatctccgattccaatatg

SEQ ID NO: 28710 - DNA, 3000 bp, Unknown
  misc_feature (1)..( 3000): 2750-1469P.txt file - cDNA_ID_2998285; gDNA_ID_2926246; Annot_ID_142963
acacggcgtggctgagatcggtgtgctcagataacccgcataatcagctgaaaaggtcagcgagcgtagctgatgcattccacagagagaggcaagttgaaatatgtgcagtggagatggagttggaaaggggttcaccaaaggaacctcgtttcgaagagctagagagcattgtgagaatgaagcaagcagaggcagaaatgttccaagggcgggccgatgatgcacgaagagaagcagagggactgaaacgaatagcaatagcgaagaaggagaagatagaagaagagtacaatcggagaatggggaagttgagtatggaggatgcacaggagagaaggaggaggaggtacgaggagttagaggcaatgcagagagggcagagagagttttatgaaatgaagatgagaatggaggaagagatgagagggcttctcaccaaaatggaaatgacgaagcagagtctggccttgtaatatttgtagtagtaaatcacatgtaatgtacacagaaacctcctcctcgtatgtaacctaaagatcaatgtaaggtcttttcttttagagagtactaaagagttctgcgtcctgacatgtacagccccttgccaaattttaataggcaatagtaaataaataacgacaagaagcaaatggccatcaaagtgatacaaagcagtgaggcgtgaaaagattactaacagactagacttggtgtttctcttctctgtctacactggcattgcccgtctcccaaaaggaccccatttacaaatggcgttgtcgattagttcgcagtgggaggcttgaagtctatcatctctcttatgttcaacttgatggaaggccccattgacgagcatatgtgagcgcttttccagtacactcctttagctccctttggcttgtttgtctccaccgatttctgcatttcatcatttacttttccctcttcatttttttttgtattttaaaccacagaaatacgtaataagaatggagaattagcctaccactgctgcaaggaagtttatgagaaggtcttcctctgtaaaattaactttcccaaatggaatgtgaacaatcccagttttgtctgctctgaattcaactttccccttcttgaactcttcaatagcctgagagatttatgcatctttaagccatgactaccagaatcaggaaaagatgttgcagagtaggcttacctggggaatgttcgctgtgactgtaccagccttgggatttggcatgagcccccgtggtccaagaatctttcccaggccagcaacctaagcgccaagttcaagaatgttagaaaatagatcacgagttacaagtatctcatgccaccttatttgccaagcatgacggtttcatatgctgtaacaagtagaacattatatcatcaacacataccttgaccatcatatccggggatgcaatcagcttgtcaaactccatgaagcctcctttaatctgttcgattaaatcatcactgcccacaatatctgcccctgcacttttggcttcatcaaccttctcacctggaagttcagcatggaaatggtgcaagccaaagatttagaaagaataagccacatgatacacaagaactccatccaatcaatatataaataaaaagtcaatcgcaccaaacaatgttgcatctagagaagtactgactgactgactgataccgtaaacattatctctgtcctaagtcctaacagtgaatttggtgactgaaatggtaaagcataatctctgtcctaagtcctagcagtgaatttggtggggcaatataccttgtgcaagaacagcgactataacagtctggccagttcccttaggcaggctcacctatacaaaaagacaatgcattgagattaaaaaatgttgtggaatgaagcagcacaagatagagtgtatatccagcaaaaggcaaagcagaccgttgcacgcagctgctggtcattgtacttaggatcgatgttgagacggaaatgggcttcaacagactcaacaaaccttgtgttggcagtttgtttaagcaaagagatagcagtgttgacatcatactcctttttggtttcccttagcttttggatttccaaaaacctcttagaccttgtctgtcaatgggtaagcaaacaaagtgatgattcacgagtaaaggaagcgaaattgaagtaggtaaagcacatactctatctctcttgagaaccaaagcggcttttcctttcttaggcttgggcggatcaaggacggcggtggcggtctgctccaggtcctcctccgtgtcgaggtcagcctcagcggccacggcggagacaataaacttgtggttggaagctctgtcaatagcagcacatctccggtccctggaacccccaaggagaagaagcgggaagctcaagtggttgggtctggagctggcaaaagagaaaagagatggagtaggggtaaggtcctgggaacgagtggatgcggcggcgtatgctagcatgagagaggagtgagtagcgcaagcagccattgttggagctctctttctttctgggtacaaagaagaagaagaagagtgcgagtctccctaatccactccacgcccaaggggataacaacaccccctattctttctaagctattattctctgcgtggcgggcaccttagctaccgtgttcctagtgacacgtgtcttcttatggaccattagatcttttaacaacccacacgcgtatcctcgtgacctcttctccttctccttcttcttcttccttctcttttctcaaaaatcagatttcgagtttcttctttcccgcccgtaagagaaaccctactctgactctccactccatttgagaggtaagttccgattccttttctctcagcttcaaatttcctgtgctactatttccccaatttcattcatcttctgctgactcattttgggtgtttcactgtagactgagctcgttccgataaggagaggagatg

SEQ ID NO: 28711 - DNA, 3000 bp, Unknown
  misc_feature (1)..( 3000): 2750-1469P.txt file - cDNA_ID_2998289; gDNA_ID_2926246; Annot_ID_142965
taggatggactgagatgatgctgctgccatcactgagtttctccgccatgattgtttgttttgctgcaaggaggaggtgatttgagaccagataatatggcccgcgtcttggcggaaacgctgccacgtcgcaacggaatcttttttcttgagatgatggacccagttatatttccggcccaaacaaaaaaaataacaaaaaagcccatacacgagcccaagactaacaaccacttgaagtaagccccgttcaatttacaattttaatcgacagagacaatcacaaacacagattacaaacgacaactaagcgcataagatgatttcttctccagcttcgtatggtgggggcaatacattgtgcacatctgcgaacacatcttcgtctccgctctctggactcccagatatgggtgaatctaagacacagtccgggatcgccctcaagctttcttccagcaacgatccaacactctgcaatacataattcaaccactcaacaccagttacaaactttctaacgtgttaccaccaatatatcacacaccctgcactccttgaaagctgcgtctgctctccgcttccacaagctatttccattttctgaatggaaaaggtttagcagaggctgcaatcaattgaaaccatcttcagttcacacacaagacttgtattacttttctcaacacctacagctttcttgtttaaaccacacctaccttcaccaaatccctcacattaggcctcccgtttccatgtgttcctaacacagaatctccatatacttgatattgctcaagaacctgcccaacaacacgcagattttagttagcttattgataagtttgacagacaaagcatctcaaaagctgaatatttccacggaacctgtcggcgtgtaaggccactgcttggtacaccataaactgcagtgtcaacttgtcctagcgtctgccatgggctgtcaaggatagacagcgagtcaagaaaaggggtctgataagagctcagatcaatcgagctaaatttcacatacttgttgtatgcagcacgtcctaccatgactccatgagctccttccttcagtgcagcgtttaccttacaatcacagaaatttttcagtcttaccctggtagtgcagaaagaaagctagtctctgatatccaagattggtgacctttgaaacagaagtaatgcctccattaatagtgaatctcaagtccgggaagtcacgcacgagggcatagtaatactcatacctgaactacgcccataaacaggtgaccttaaagaaacaaatagatcatacacaattgcaggtaagcaagaggcaagttacggtaaacaaactttagaggtgggattctccggttatcagcagggcttatcccaccgagcagtgccttgcgtgaatgtacaatgaaatgtctggtaggtgatagagtagaaaccttgtagataaagtcacctaagagtaaaggaaaagcagtattagagcgtagtggcaaatccatacgagactttagaaaaacagaaagcaaaaacaactcacagagctcatcatacgaatcatgattgtctacaccaattcgacatttcacagtaacagggacgttggtattggcagcaatggcagacattgcctctccaacaagcttaaaagaaagtgtgaaattaagaaagagaagatatctcttgaaatcatgaggaggagtaaagtaacggaccttaggtttgagcatgaggctaacaccaaagcatccatgaccggctaccttaggactggggcacccgcagctaagccaacaaaacaaacccagttaaagtatagaagtccacccaaggcggtgttggcgaaagaaactgaacaaacttgagattaatttcgtcgtatccgtaagcatcagaaagcttagcagcctttgcaaggttttccacattgctaccaccaagttggagaacaataggatgttgttggggagaaaacgctaagaacctgtcctgaggcaaagtgcagaagaacggacatgtctagcgagattcttcaatgcgacacaaatttaagaaaacaaaattagtctaccaaattggtctgctggtgaacaagggtttcagctgcaatcatttcagtgtaaagccaagcgtgctttgttatgagacgagcaagcgtccggtaatgattatctgtccaatccatcatcggggcgacgctggagagcaaaaatctagtaagaaccgaattagtgggagttaaagccctgagtctgagagagagcaaaaaacctgaaggaaggaggaagatagggagacgaagtggaggagaatctagcagtgggtttgagcattggggacttgaagaacatctcagagacatttggtcgaacagatggtagacaccacatttggaattggagaagataatgaaaccgtttgtttggaactagcataacagtaagggaacattaataatgtttaaagtatataagtagttgtgatgggccttactttacgcattttatatctatgatggagtaggaaagggccactgatagagcccagcaacaagtgtctttagtttaatactaattatttaatgctagtggtggaggatacgacgacacgcgataagagtcaaagattggactagcaacgaaaatgacgtaaacacccacgttctctggtctttgggagatggcagatgatgtaaataagcgagtaaagggagggcaaagggaaatggtgcttttcccactcagtttgacttgtaatattccttttcgtcttcctcctccttgcttgctccttcctcgttgcgtgattccttggtatataaaaaaggcagctgaatctgcaagttagggttcttccgacatgaatcttgccccaatcttcaggtactctcttctattttgtttcccttctcctcttgtgcgttttgctgcaatttccgatcctcataaaccctagctttctgacgcatattcagcaactaaaacgatg

SEQ ID NO: 28712 - DNA, 3003 bp, Unknown
  misc_feature (1)..( 3003): 2750-1469P.txt file - cDNA_ID_2998293; gDNA_ID_2926246; Annot_ID_142966
aaaatctcagctaaatgggaagacgagatgctgttgtccaaaagaaggaaatcagaacgcccagatttcagtgcgaccaagatctccaactgagcgcgatgagattttgtaagcaattccagtgttatatcagtcctgttctgcaaagcatcttgaaaagcaccaagttgtacattcttatccatgttcagcatcatctgccgaatgttttccttcaggctagtgatgtttcgagtgggcatttcatgaaatctcttggtcattacaggcatcgaatcggagagaatgtatctgatgacggtctcaacaaaatcatgcccaccggcttccagcccagttatccacgaattactaccactgtaaaagtccttggccgttttcttctcaacagtaaactttgaaccattttcaagagagcccgttcttggacatgctgatctaacatcaacacttttctggaaactcaattgtttctcaagtatatttgctgccttagagctcccatcgggcaatctaagatgctcttcatcagcttgacccgaaattaaattgcctttcattgctcgaggttgaactgaaccatttccattttccatcagtctttgatagactgtattctcattgtactttgaatcattatgagacagtgcctgccaatctataccctgaaatataggtcggctatgaactgactgctcattgtctccaatattgtgactcagcgaacagcttggattatgattgaacgaacgggaacctgaaaaggacatagacattgtaaagccatcagaattggtacaaaacgtgtctgtcaaagaccgaacacttccagaacggactggtgaccccagctgattagtatcctggccaccaatcggcaacaatacatctggtaggctaagtgacagatccagtggctccaacaacaacttctcatccttgtgcttattgacacctgactgctcagttttttttgctctcctaaccggagaactagagaacagttcaaaccctctgatactcggtcctccgaagttgtcatctttttcatctttatccttgtcatgaagatcctcagtcttgctttcagaaaagagagcatttccaactaaatgtgtaagagggacatcagaatttttgcctttatccttgcatttgtggacggagctatccgatacactgctaatgtattctgcaggcgttctattagctagagcattttcctcaacacattccgggccttcaacttccgctttgttggcatcaccatcattacccttcacttccttaagctcttccaaccgttcaggaacatctggataaagagtttcttccaacttcactccatgaaggttctccttataatcctcatctttgtcacctttctcgtcaaccgtatctgtaatcttattggcactagcagtgattgtgccatctctatgatcgtgttcaatagccaaagctgtagaagtatcattcacgttgttttgagaaacatgcatggactcagtcgcatgctcaggcacattttccgcgtcttcaacacttttcttatcggtcatgctatctgtcgtttccatttccctattaccacccacatgactgagttccctgttactctcagtgttggcatcaagttgagcgctttttccaatttcctggaagcttctatcaatccttgcgttcttatgatcatcagcagagcaggaaggcagtttacagtcatgtttggtttgatgagcaaggcctgaggcagtctctggttggggctctggctccagctctccttcctccatctcgctactggttgtactgctcttaccctgcacttcctcctcgcttttcttgacaacatttccaacacttttggattgctcactcccggaatctttggaccatgtcggagaagctagagatttggatctggagcgagaatttctggaatcgagtggtttgaatttggaaagctcgttaggcgagtctctggaccaagaaggggatttgagactcctatccctctcagcgtcccttaatctcctatctcggtcatcaacgccaaagtcattaccaggaccaccaaacctcctccaggaagagacactagcatccctattgggcctctccctctcagaacgaaatccctttggaaaagccctccttgagaaacaggcgctctcagatcgatggtaccgggcatctggccgatgattatccaagtcacgattggatcgcctacgggaaaaagccctggagaagccggcagcatcttccccgcggtcacggttgttgcccgagaagaagccccggtgggaggaagaggccggacggtccgagttgggaggttctccgtcaacattcttatcattacagaaatcaaggtcgtcgctggatcttagtctcttcatcgttttagttgctgaatatgcgtcagaaagctagggtttatgaggatcggaaattgcagcaaaacgcacaagaggagaagggaaacaaaatagaagagagtacctgaagattggggcaagattcatgtcggaagaaccctaacttgcagattcagctgccttttttatataccaaggaatcacgcaacgaggaaggagcaagcaaggaggaggaagacgaaaaggaatattacaagtcaaactgagtgggaaaagcaccatttccctttgccctccctttactcgcttatttacatcatctgccatctcccaaagaccagagaacgtgggtgtttacgtcattttcgttgctagtccaatctttgactcttatcgcgtgtcgtcgtatcctccaccactagcattaaataattagtattaaactaaagacacttgttgctgggctctatcagtggccctttcctactccatcatagatataaaatgcgtaaagtaaggcccatcacaactacttatatactttaaacattattaatgttcccttactgttatgctagttccaaacaaacggtttcattatcttctccaattccaaatg

SEQ ID NO: 28713 - DNA, 3003 bp, Unknown
  misc_feature (1)..( 3003): 2750-1469P.txt file - cDNA_ID_2998297; gDNA_ID_2926246; Annot_ID_142967
cattcttatcattacagaaatcaaggtcgtcgctggatcttagtctcttcatcgttttagttgctgaatatgcgtcagaaagctagggtttatgaggatcggaaattgcagcaaaacgcacaagaggagaagggaaacaaaatagaagagagtacctgaagattggggcaagattcatgtcggaagaaccctaacttgcagattcagctgccttttttatataccaaggaatcacgcaacgaggaaggagcaagcaaggaggaggaagacgaaaaggaatattacaagtcaaactgagtgggaaaagcaccatttccctttgccctccctttactcgcttatttacatcatctgccatctcccaaagaccagagaacgtgggtgtttacgtcattttcgttgctagtccaatctttgactcttatcgcgtgtcgtcgtatcctccaccactagcattaaataattagtattaaactaaagacacttgttgctgggctctatcagtggccctttcctactccatcatagatataaaatgcgtaaagtaaggcccatcacaactacttatatactttaaacattattaatgttcccttactgttatgctagttccaaacaaacggtttcattatcttctccaattccaaatgtggtgtctaccatctgttcgaccaaatgtctctgagatgttcttcaagtccccaatgctcaaacccactgctagattctcctccacttcgtctccctatcttcctccttccttcaggttttttgctctctctcagactcagggctttaactcccactaattcggttcttactagatttttgctctccagcgtcgccccgatgatggattggacagataatcattaccggacgcttgctcgtctcataacaaagcacgcttggctttacactgaaatgattgcagctgaaacccttgttcaccagcagaccaatttggtagactaattttgttttcttaaatttgtgtcgcattgaagaatctcgctagacatgtccgttcttctgcactttgcctcaggacaggttcttagcgttttctccccaacaacatcctattgttctccaacttggtggtagcaatgtggaaaaccttgcaaaggctgctaagctttctgatgcttacggatacgacgaaattaatctcaagtttgttcagtttctttcgccaacaccgccttgggtggacttctatactttaactgggtttgttttgttggcttagctgcgggtgccccagtcctaaggtagccggtcatggatgctttggtgttagcctcatgctcaaacctaaggtccgttactttactcctcctcatgatttcaagagatatcttctctttcttaatttcacactttcttttaagcttgttggagaggcaatgtctgccattgctgccaataccaacgtccctgttactgtgaaatgtcgaattggtgtagacaatcatgattcgtatgatgagctctgtgagttgtttttgctttctgtttttctaaagtctcgtatggatttgccactacgctctaatactgcttttcctttactcttaggtgactttatctacaaggtttctactctatcacctaccagacatttcattgtacattcacgcaaggcactgctcggtgggataagccctgctgataaccggagaatcccacctctaaagtttgtttaccgtaacttgcctcttgcttacctgcaattgtgtatgatctatttgtttctttaaggtcacctgtttatgggcgtagttcaggtatgagtattactatgccctcgtgcgtgacttcccggacttgagattcactattaatggaggcattacttctgtttcaaaggtcaccaatcttggatatcagagactagctttctttctgcactaccagggtaagactgaaaaatttctgtgattgtaaggtaaacgctgcactgaaggaaggagctcatggagtcatggtaggacgtgctgcatacaacaagtatgtgaaatttagctcgattgatctgagctcttatcagaccccttttcttgactcgctgtctatccttgacagcccatggcagacgctaggacaagttgacactgcagtttatggtgtaccaagcagtggccttacacgccgacaggttccgtggaaatattcagcttttgagatgctttgtctgtcaaacttatcaataagctaactaaaatctgcgtgttgttgggcaggttcttgagcaatatcaagtatatggagattctgtgttaggaacacatggaaacgggaggcctaatgtgagggatttggtgaaggtaggtgtggtttaaacaagaaagctgtaggtgttgagaaaagtaatacaagtcttgtgtgtgaactgaagatggtttcaattgattgcagcctctgctaaaccttttccattcagaaaatggaaatagcttgtggaagcggagagcagacgcagctttcaaggagtgcagggtgtgtgatatattggtggtaacacgttagaaagtttgtaactggtgttgagtggttgaattatgtattgcagagtgttggatcgttgctggaagaaagcttgagggcgatcccggactgtgtcttagattcacccatatctgggagtccagagagcggagacgaagatgtgttcgcagatgtgcacaatgtattgcccccaccatacgaagctggagaagaaatcatcttatgcgcttagttgtcgtttgtaatctgtgtttgtgattgtctctgtcgattaaaattgtaaattgaacggggcttacttcaagtggttgttagtcttgggctcgtgtatgggcttttttgttattttttttgtttgggccggaaatataactgggtccatcatctcaagaaaaaagattccgttgcgacgtggcagcgtttccgccaagacgcgggccatattatctggtctcaaatcacctcctccttgcagcaaaacaaacaatcatg

SEQ ID NO: 28714 - DNA, 3003 bp, Unknown; identical to SEQ ID NO: 28713
  misc_feature (1)..( 3003): 2750-1469P.txt file - cDNA_ID_2998297; gDNA_ID_2926246; Annot_ID_204239

SEQ ID NO: 28715 - DNA, 798 bp, Unknown
  misc_feature (1)..( 798): 2750-1469P.txt file - cDNA_ID_2998301; gDNA_ID_2926247; Annot_ID_142968
gtcgacagtaatacgagacggtataccaaaggtgaaatccattagatatgtttagttttacttaacgggattagatggtagaacgagtttgggtcgatagtaatatgagatggtataccacggatgaaatcctaataataacaatcaaaatacaatcatattatcttaaatattaaaaaaacaaataatattaataaaataaatataatttaaatttaaattatttagttataatttagatttatcttaatgaactatatattattgtttctatatttttaaacagtaaacatcaaaatagtaattgtatactaaataatatataaatataagagttgtacattaagaaaatacaaaacattaaatcatatatatttttaatcgaataaacaaaataaatttttattcttaaaaaaacaaaataatctcacggtttaccgcagattaaaatctcacggtgtatcgcagattaaaatctagtacgatcgaaaaacaaaagtaggaaaaaagaagaaagaagaaaaaaaagattacaccatacgaaaatagaaaaaatgcatggaataatggagtaataatatattttgtttaattgtcagtctatatttgggtgaatatttttccaaattaactgtagcaaataagaaggcaaatataatttgataacaactattagagaatctcataatcttatcttcttacttagtaaccattggtcataatgttatatatattgcgagtcaagtctctcggtaatatcgaagtaagactaaagctcaagttaaaacagaaaaaatg

SEQ ID NO: 28716 - DNA, 798 bp, Unknown; identical to SEQ ID NO: 28715
  misc_feature (1)..( 798): 2750-1469P.txt file - cDNA_ID_2998301; gDNA_ID_2926247; Annot_ID_204254

SEQ ID NO: 28717 - DNA, 3003 bp, Unknown
  misc_feature (1)..( 3003): 2750-1469P.txt file - cDNA_ID_2998305; gDNA_ID_2926248; Annot_ID_142972
ataaataaagagcgatcgatcggtaccattcaagaggaggagagatgtctttcttaacaccttgacctgccatcgtatactttctcggcaacttcccatcgttgtctatcgtcggcgaaaccagcctcaactcctcactcgacattcccttttacttttatgctatttcttacttagttttatcacaaagagtctcttcttttctactttcgtacatatgaatgctcttttcgtgtttgttactgatttgtatggatcgcctatgtgtagaaacaacgccacgtgacggtcttgaatgacacttggcgtcatgattgacacacggcgtcataggaaatctggcgaagacctgtgtttgagcacaactctatattgggctttattgggcctaaattgtattttttcctctctactatattagcctgtctcgttcttttttaaatcacgttatcttattattaaaggaccacttaacagtatactaattattgttttaacaattcccaccaaaaaaataattattgccttaacaataaaacaaagataattttaatataaattaaatttgtttaattttaaaattacaataaaagatatttcttattttataaacaaaaactcttctcatctttttttcttctattttttaatttattaaataagaatatctaaattaactaccttctaactaaaattaaagtgatttccatgtaatatttatcaattttgaagtcatagtaggatgctctaacgtgagccgttttaaccaatcgttaacaaagaattcgtctattaagacataaccatgatcaagtccgatgaatctaatagacatgttatccggtttgcgttccatgacagaatatagccaattgtctatatcattgtttctatttaagtatacgttcatgacatctggtgtgttgcataggtcaaacacgcgcgatagttcaaggaaagtgcgttagtgatgaccacgacacaatactgcactttgttttcatatcgggatgctccaagctgagtcactatagccatttactgtcaaagaattcgtccataaaacaatatttgtgatcaagacggatcaacataacatgcatcaacttactattaaaatttaagagtaagttaaagaaaatgttaaaaatttcttaggttggcccattaaattatattcaaattaattctttatttttcacattatatattaaatctaatagaaatttattctagattcgccattgccgtgtaatacatgaacaaatcttttaaagatggacatcgcatatgatctaccgagatcatatcatgatagtctagctgcacaataatcccttatacgaaatcattttcagctggatgctttataacacaacattatattaggttagtgagcctatagctaacttgttttcttttttcattaatcattgtttagatactcatagtaatgattttgagataagtatctatttttcaaatgatatatcaattttaaaaactcattacatcatgtcacaacgttaaaagtataattatacatatatacaaaaaattgtatgtatgttacaaagaaaacattgctaattttactatgtctgagtcactatatgcggctggaaagtaccaaaataaatgaagacagtaacatgagtccatcaccatcaccaatatccaaaacttggctttcacatttattttacttatgtaactactatacctttatttatttattcatttttaatccttagctttgttgatctagtttggcaaggtaagtctataacgtccatcggcccgaatccttctttttcatttatttcaaaattaacattttcttcttcggaaactatgacaaagctttttatgtaacccaaaaataacttaattacactgtatatccttctacaaatttacctatatcaaattatgttattatatattgtaatggcttttaagagacaatggagacattttctagaacatagcatttagttagatttgtacaagccatttcaaaacttttcaaaaacaaaatcagcaaataaccagttttgtctttaaagaatcgttctttcgtaggaactagcaactgggaaggtgtaaataggcgatttaaggaaaatatataattgaagaaaaataaatcaaatggtcgggactttttatctcacgtgaaagtaacgtcgcatttactcaacagtcgagacgacagttacatatttcacagttttaaacttgtaagttaaatttaacaaaaaaagaaatacaacttcaaacataatcgttgttaagaaatttcatatatatcattcgtttctatattaatacaaaaagaatggtatgggaaataaaatagaaagaatagaatgactaaatcatggaacatgacatgaatacggtcactgtttcaagctcatgcgtcttttccagcatagtagtagtagtagttgttgttgttgttgttatccggtcttttcaaagcaacgtacttcctatttttcttacttgtataaatccacaattgttttactcaaaaggaaaaaaaaactatcaattttgcaatttggctagttaattcaatttatatctatttgttttaaaactatatttgatctgtatgtgcaatttatttactgatttgaggcttttgagcatatatatttagtgaatcgattatagaatttgtattgaacaatgagagaagaacgaagacatggattgggacaagtactatacataaacgtgggtaatgtgctatgaaggtagttgtttgagaagacagtacgtagagtttgagctgtaagaaatgattagggtttgtttttcgtctgcacttcagtccaatgttttcaccgaaccccactactacgtgaaacccggagcctcacgtgctcttgagatctttttaccactaaattaaccagttcgtatgtaactatgtctatatatatgtataaccatatcatgtaacagttataaaccacgacaatcacaatg

SEQ ID NO: 28718 - DNA, 3000 bp, Unknown
  misc_feature (1)..( 3000): 2750-1469P.txt file - cDNA_ID_2998309; gDNA_ID_2926248; Annot_ID_142976
gtcattgcaactttgtaagttgctctatatatggtctagtcttctaggtatatacgaatataataactagaatttaatcaagtaaatttattcaacagttaaatacttaaatttgatatgttatacatttagttgaataaataagatcttttcagttgaagagattcatgtgtgtaaacaactcattagttgaataaataaatatactaagtaagtagattgtatatatggtgtgatcaacaacaccagttatttttggtccaatattcaacatgaaattctaaattattgattgaaataatacaactacaaggaagccttctaaaaacaatgacctaatgaataacaatgtgcatttcacgtttagaggttctaatcaatagacaaaacccaatcataagtcataacctccctaaccacatctttattaaattgggcaaaaagatggaagcaacacatccaaacatgcctttagcttcactcctactcaattcctaatttcccaaataaaaaccataacactcacttgacatctttccctataattcctaatttcgacacgttctttacataaattaccagatttgccactatgagcttcttgattcctaatagaggagtaggaggaaccaagattcctctctccatcatcgttctcgttctttgtggtttcatgttcttcattctcttatacactgaaagaatcagcttgttgtcttcttcttcctcttcgtcttcatctttcttcaagctaaagtcttgtccgaggaaagatgttagctcgaaacctagtaagcacatacgcgatactcgaatctgaaaactctgttttgtccaatttcagtgttcctttcttgttgtgcaagtagtctcatgaaattcccctgcttttccttgttgccagaggagaaaattcgaaaggaaagatcagagatattggaagtgcttgacgacaggttcgaattcgatcccgaagagtgtaacgttgcagcagggaaatgggtttacaatagctcaattgaaccactctacaccgatagatcatgtccatacatcgatcgtcaattctcttgtatgaaaaacggacagccagaaactgattatcttcggtgggaatggcagcctgatgactgtacaattccacggtaaaatacaacttagtaacacaaactaacactagtttggttcaaggtttgagacagaacctttatgagcttcatttcaattccaaacagatttagtccgaagttagcaatgaacaaactcagaggaaaaagactactttttgtgggagattcgttgcaacgaagccaatgggaatcgttcgtgtgtttggtggaatcaataatacccgaaggagaaaaatcaatgaagcgtagccaaaaatactttgtatttaaagcaaaggtacgttaagtgatggtagcttgcgttacaacgcaaaccttgttaggtcagatatcacagtaccttgtattacaagcaaagcttagatttttattttatgtttctctgtttttcttgattcataggaatacaatgcgactatagagttctattgggcaccgtatatcgtcgaatcaaacacagatatacctgtgatttcggatccaaagaaacggatagtgaaagtggactcagtgaaagatcgagctaagttttgggaaggagctgatattttggttttcaacacttatgtttggtggatgagtggtctccgcatgaaagctctgtggggttctttcggaaatggagagagtggtgcagaggcactagacacacaagtggcttacaggctaggactcaagacatgggctaattgggtagactccaccgttgaccctaataagaccagagtcttcttcaccaccatgtctcctactcatactaggtaaacatttagttttattatatgttttgatgtgtttggtttgtgattaacgtaaagtgttatgtaaaacgttcagaagtgcggattggggaaagccaaacggcacgaagtgtttcaacgagacgaaaccgataaaagataagaagttttggggaacaggctctaacaagcagatgatgaaagtagtgtcaagcgtgataaagcacatgactacgcatgtgacagtcatcaacatcacgcagctctctgagtatcgcatcgacgctcacacatcagtttacaccgagacaggtggcaagatcctaaccgctgagcagagggctgatccaatgcatcacgctgattgtatacattggtgtttacctggactacccgatacatggaatcggatcctattggctcatttgtaaatcaagctaggaggaagctgagggttaaacgggaaaaacccaaatcctctgtttttctcctcttgtgttgtcggagatttgtttgtttcagtgtattgtgattgtcgtcaattttcataagatcaaacagactcggcccgtttattatatgaccttgaagtgactaaaacaaaagtaataatattacaaggcctagatgggcctggcccgtctctggcctatttgtaaatagagggagaaacaagggtaaaataggaattccagaactaagagtttttaggttaatgttgactagtgggtaatatgaaccgttcgattttgttacagaacatcgtgaccgtccgatgagagacctaagacaaattacgcaaaaactcattcgccgtcacgaggaagatgcgaggtctatataatggacaaatctggtataatgtaaaatagggacttgacgcagatcttgttgggtctcgaaccttcctcttcgtttgcatcaggtaaggccgattctcttgcttatacgatctcttgattcatctgaggttttatcaattgttgtttgattttgtttgtaaagctgtgatttttcgagtttctgtctcttattttcctgttggatttagttttctctagaaattgttgcgatttggtggataattattgacattagggtttcgtttttgataggaaagagcgagaatg

SEQ ID NO: 28719 - DNA, 3000 bp, Unknown
  misc_feature (1)..( 3000): 2750-1469P.txt file - cDNA_ID_2998312; gDNA_ID_2926248; Annot_ID_142977
aattaatcatattaagtcacttcagatattttaagatcttaccaaaattactatgttatgttattttatttgtttgcagtgaataaaatatgttttcagttaatgatgtaaccattatatttcacttatttcttatcggtatgtatcttatgacataatatataatagattaattattggtaacatagaaaggaaaaagtacccaggatcaatttaaaagctatatccaaagtgatatgctctgatgattctgttttttgaaactcaacggacgaaaagaaactttgatacttttgaaagaaactttgatactattgatatgctcatcaattatttcaaaataaaggtcatgtaacaactttttttccttcacgtaagttttatatttaaaatggtcaaactttgttctgattgctttaaagctttgaacaaaatgttactatatgtgatttacttttcaaacatactgaatataacttcaggttgaaacttgaattttgaagtagatgtatatagttagcaaaccaatatgtcacatgcaattctaaaataaaatgagaatttagctaaagtcagattagtaatgttaaacaaacttgaaatgtgaaaattttccgttactataattttttgaaagaactataattttagccagaatgacagttcaacaaaagaaacttctagcttatttctcaatgtgcactgcacggtaaaacaattcattttaagatatagaggactaaatctttatcagatactaaataagttggcgggatcaatcttttgaatagtgattagaatctttacaagatgaatattataaagttgcaaaaggcctcttcgaaacctatctacttcgctttactattataaacatatatagagagtctttagagcaactaacttaaaggtattcattgattttcttgtcgtcgagtttaagagattaataatgtatgattaatctgatcattacatttactcacgattagtctgtttcataatatagaacttcttgttttttctgtttgattatatttggccatttagttagcgttagtttttataatttcattcgttgatacaatacatgcgcaacgggtaacacaatgtagctagtacttcttttagttcattaagatatgatgctattgttatgttaaataatatctttctataaaaagttgatggcttcactagctaaatatttgcaaggcatgatcgtcaagatcaaagattccaaattcaaaattcgaagtgtacaaagaaaaagaagagaatggtagtataaaatatttacagattcttttttacttttcctttttcaactttttcaactttttttcaaaataagaaacacgagaaaatctgatatgcgtggcgtcattttcaaaggtgaaggagaaagtacttgggtcgcttagttcacaccggaaaaagaggcaacgaaagcagagagacaaatctaaataatgtctgacgcgcgtgaataatattgccacaaagagacttgccttattccctatcaactctcgaccaattattatgcatttctgtttctttcttctatctaagcatatctctccaaattatttcacttctattttttgtatataaaaataagaaatataaaccctttaaaatttgtttttaaaaccaaaactcattataatttacgtaataatatagatcgaattgttttgtccaaaacctcaagaatataggcaagtttctatgttgttggcattaacttattggtttgtacggagatgctaatacatcaatctcgaaacgtattcgaaagcccattactagcccagacacaaacaggaataacttttgattgtaagccgatattttaagtatttgaacggttgaacaacgatggggatgtagctcagatggtagagcgctcgcttagcatgcgagaggtacggggatcgataccccgcatctccatttttttcctcagttaacccctttttcttcatactaaaacataatatctgatttaatgacggaaagtatgttgcaacactccccactatatatgcattattaattagttgcattattaatcacttaatgatttgtgtttgcctttaataattgctttaccaatttatctactaaaaataactaacatgaactattgttgattttacaagcaacaccaactattgtatttagttggtgcctgtttatttcgttttcatgtgcccattgataaattcgatatttttgttttctgttgtttaatctgatgtcgatggcgaagataacaacgattccttaaccatatgttcctcacactaaacgacttttgaggaatgatgattgattagcgatttgaatcagttgattaaccctcctcatcaaattaacagtttcttttgaacttccatgtcattgcaactttgtaagttgctctatatatggtctagtcttctaggtatatacgaatataataactagaatttaatcaagtaaatttattcaacagttaaatacttaaatttgatatgttatacatttagttgaataaataagatcttttcagttgaagagattcatgtgtgtaaacaactcattagttgaataaataaatatactaagtaagtagattgtatatatggtgtgatcaacaacaccagttatttttggtccaatattcaacatgaaattctaaattattgattgaaataatacaactacaaggaagccttctaaaaacaatgacctaatgaataacaatgtgcatttcacgtttagaggttctaatcaatagacaaaacccaatcataagtcataacctccctaaccacatctttattaaattgggcaaaaagatggaagcaacacatccaaacatgcctttagcttcactcctactcaattcctaatttcccaaataaaaaccataacactcacttgacatctttccctataattcctaatttcgacacgttctttacataaattaccagatttgccactatg

SEQ ID NO: 28720 - DNA, 3000 bp, Unknown
  misc_feature (1)..( 3000): 2750-1469P.txt file - cDNA_ID_2998320; gDNA_ID_2926248; Annot_ID_142980
ccaagtgggagtgacaaccttcttatacaggtttttatcatccttcacagtttcttctatactgtaaatagtggtatgtgcttttactatttctttattgttcctctttgatgacaggttcttcaaaccctcaccgaggggcccactccttcttcagaattgatacttactatacggaagttgtttgatacaagaataaaggtgaagacgatggaatgtttattgaaaactcgttaagagcaaaactataagctaattcttctctaatgttttcttgggttttgaacattttatgggactacaggatgtagagattcttttcccaattttgccattcctgccaagagatgatgtaaatctctttccctaccttttccccttttattgactcattgggttatagttttcttattttcctaaacttgtctctcgatcaggttctccgcatttttccccatatggtgaatcttcctatggagaaattccaagttgcactttctcgtgtgctgcaggtatcgtattcatttcttatgtctggcttttgagttaagtttgatctgctcactgtggaattttgttcttagggatcatctcaatctggcccagtgctttctccatctgaagctttaattgctatccatagcattgacccagcaagagatggaataccacttaaacaggtatatatcgacaatttccttgttaacatacagcaaacaaagaatacagctttgatgaattattaggagatctccgccacctgttttacaatcaacactgaggttgcttccctaaatcttatgttttaatgcttttatcaggtcacagatgcatgcaatacctgttttgcgcagaggcagacattcactcaacaggttttagccggtgttctgaatcaactggtatataacaatctccatcgtactgagtatttcttctattcatgttttgatttcttttcttcttctggacattttttctcattggcgagtttttggctgcaggtccagcaaattccactgccaatgttattcatgcgtacagttttacaagctattggtgcttttccagctctggtaacaaacttatcacatctcttttttcaatcccaatttaatattctctgaataatctctttaacttgatattctaatagtcggacttcatcctggagattctttctcgtctcgttagcaaacaggtcagtattggtcttgaaacgttatattctctctattgtccattcttataattgactgtgtgttggaaataaaacggtggctctctctatgtgtatgcctcagatatggaaatatccgaaactgtgggttgggtttttgaaatgcacacagacaacacagcctcaatcatataaggtcttactacaggtgcgattatttaatctcttccacaattgttaaattacctgttctcatctatcggaaagcggttttatcactgacattcctttcatttagcttcctccacttcaactgggaaacgcattgactaaaatcccggccttaagagctccgctaaccgcacatgccagccagccagagattcaatcttcacttccaaggtaacctttcctctttcaaatttccatgaattccagttctaaacaaacaacttcagctatttgaaatccatttgctgatcacggagatatgaaacatgtttgttggtaggtctacattggctgttcttggacttgtccctgattctcaaggaacacaaacaagccaagtgcaagcgaatgagacacaaacgagtcaggaacagcagcaacagcaagcaagcgagccacagcaaacgagccagtctcagcaagtttctgtaccattgagccactcccaagtagatcaccaggaacccagtcaggtagttgccagtcagtctcaaagcagtcccatagggaccgtccagtcagcaatgagtcagtctcagaacagtcccatagatacgggccggtctgaaatgagtcagtctcagaacagtcccatagatacgggccggtctgaaatgagtcagtctcagaacagtcccatagatacgggccggtctgaaatgagtcagtctcagaacagtcccatagatacgggaagatctgaaatgagtgaatctcagagcagtcctattggtcagtcacaaagcagtcctattggtactggccagtctgatatgagtcaaacccctcaagtgtcggactcgagtgctccagaaccaacaagccatactcggacatcagatcctcaagcgtcaagccagacactacgagatgatgatgagaagatagacgacacagcaacctcagaaaacgaggtgacagaaatcgagaaatcaaaagaatcttccgaagaagaagaagaagaagaagaagaagaagagtgagtgtaacattatgtaacttgagagagaagaagagatactttgaaattaaattcaggttgccttctacctcttatgtcggagaagaagagtgaatgaagcgtcgattagagcaggaaatcttcattccatgtattgtagcaatttttttcaaaatgaattttgtagaatttagttagagatttcttttaatgagtcattagcggttgtattgtcattgttttctttgagttaagactttaataaaagttttttttataaaaaatatatgtcatgaatgtttgcatacccttgcgaaaaaaaaaaaaaaaaaagaatgtttgcatacccaaagccttaaccaatcagcccattaaggtttctttttgggtagaaagcagcccattaagttaaaaactgatcataataaaacgggaatactattaaagaaaagaaaaaaaggagtttaccggttaaaatcacgaacggttggatcggttaagttggattaaaatgagaatcccggaagaaaatgaaataaacaagtcgaagagagtagtcatcgacccctaataaaatccagtgaagaagaagattgagtgagtgagagagagagagagagagaagatg

SEQ ID NO: 28721 - DNA, 3000 bp, Unknown; identical to SEQ ID NO: 28720
  misc_feature (1)..( 3000): 2750-1469P.txt file - cDNA_ID_2998320; gDNA_ID_2926248; Annot_ID_204276

SEQ ID NO: 28722 - DNA, 3000 bp, Unknown
  misc_feature (1)..( 3000): 2750-1469P.txt file - cDNA_ID_2998323; gDNA_ID_2926248; Annot_ID_142981
ttctccttgtcttttatgcaacaattaatgcggactagagcgacagtcgtggattctatgaggtccagttacatttctttgtgtcagaagatttttttccaaaattttttccctaaaatctatttaaaataagaaaaaataaattgtgaaaacgttttaaaacatcattaacaatgcatttaacacttttataatccaattccggacgactcattttttcttgtcaaaacctctagtttagttggctaaaatcttaaaatgcagtccactaaacatgtgttaatcgaaaaatcgaaattgtgttttaatcttgaccgtccgatcacaacaaaatcccacactttcccaaataaaaattaaaaattcaataattaaggagtttctatttaattaataaaaatagagaaaaacatctattttattattttagcttttattcacaccgccacaaactctcactataaagccgatccatagataaacgaggaccggccagaaatcgcttcaccattcccaaatctctcttccattttctccacacaaatttctcttcaatctccgataatggaaggaaccggcgttgtggcggtgtacggtaacggtgcgataacggaggcgaagaaatctcccttctccgtgaaggtcggtttggctcagatgctccgtggtggtgttatcatggatgtcgtcaacgccgagcaagctcgtatcgccgaggaggctggtgcttgcgccgtcatggctttggagcgtgttcctgctgatatccgcgctcaaggaggcgtcgctcgtatgagcgatccacaaatgattaaagaaatcaaacaagccgttacgattccggtgatggctaaggctaggattggtcatttcgttgaagctcagatccttgaagcaattggaatcgattacatcgatgagagcgaggttttgactcttgctgatgaagatcatcacatcaacaagcataatttccggatcccgttcgtttgcggttgccggaatctcggcgaggctctgaggaggatccgtgaaggtgcggcgatgattaggaccaaaggtgaagctggaaccggtaacattattgaagctgtgaggcatgtgaggtctgttaatggtgacattagggttttgcgaaacatggatgatgatgaggttttcactttcgctaagaaattagccgctccgtacgatctcgtgatgcagactaagcagcttggtcgtcttcctgtagtccaattcgccgccggtggagtggctactccggctgatgcagctctcatgatgcagcttggatgtgatggtgtctttgttggttctggtatcttcaagagcggtgacccagctcgtcgtgcacgtgccattgttcaggctgtgactcattacagtgaccctgagatgcttgtggaggtgagctgtgggcttggagaagccatggttgggatcaatctcaacgatgagaaggttgagaggttcgctaatcgctccgagtgatcaaagaaataaaaggtaaaatatctcagacgaaatggtttcagaattttctcagaccattttgcagtaatctctttgaaaagaagaagatgatgatattgttggtagtttgtatcctttgtgttttccttataatctttgatagtcttttgttattgtaactcgtaatccctttgcaagaacaagtttgtcagttataataatgtactactctcttgatcgatcagttggttttgaatctgatatattcttcgatccattggtattgaccattgagcttgttgttcaattacatttcagacaggcctattagtacttagtagtatcaggttgataaacaaaggatgaacttgtttaatttgggaattcgtacactggtactgagctctgtagatgtttgagactttgagtattggatttggttttgaagaactgtcctggattagattcacatagcctctagttcttattttaaatttgtgatttcaggcatagctgtcaacctaacaaaggaagataatatgagttgagttttctttgttgttaacgagtactaatcatcgatttcatgatgtgtggattatggtttatggggggttctttgcagctatgtttgcattgtaaattggtttttatgaaatgctatgttaatgtgtgattagtaaaggagaagagttcatgggactcttctagcttttaaaatccataagagtcctctagctttgaaaatccatgggactcactcttctagctttgaaaatccatggggctcttctagctatgggatttcagatctcatgcgcggtagtagcatacgatcatcggaatccatagagctcttttgttcaaaatcgagttcttgaaggtcttacacgacaccatgacttagggatacgagtatatatcccttgacttcagcctctaagctcttggctctgccggatccaatttctccaaagagcattacttcaaagttcaaaaggttctcactactaacaggttaattttgttaaccgagatcaaccaaaatcaaacaaaacttaaccaaattgtaaatgtgatttgattgcacatcactcgcattttgtccaaaaagactccggtaagaccagaaacacggatacaatttaaatatcaatcgaaataggcccacatcggcccattattactgcacattggcctatttaatcaattcactaactatatgagacttatataatatactatcaaatatgagggaccataacacaatttctttctttatccaaacgacgtagtgtaactattgatcagtctcctttaggaaagacctcaaaaatggaaatcagttcattagtgttcatatcagaaataaaacgaatctccatcgtcgtccttgtctctaaaccctatatgccatagtcgaagaagaagaagaagatagatgcatatccatcaaagctctgggcactagtgtatatattattatcgattgtttgaaacctatttgttatggttggaatcatg

SEQ ID NO: 28723 - DNA, 3000 bp, Unknown
  misc_feature (1)..( 3000): 2750-1469P.txt file - cDNA_ID_2998346; gDNA_ID_2926249; Annot_ID_142992
tggcaaaatttgaaaatttgttgtcatactcaataaataaataaataaataaaatgtcatactatttccgtccttgcctcgctccaccgatgaaaaacatcatcgcatctttcaattgtcaattccatcatgagatcattaaggagaaaatcggtttcacgatatggatgattggtgaatatttcattatcgatttcagagatcgaaaatggattatctgttatcaaacgaagcattggagaactgcctttccctaatgcttctaatgatgatcaccatattcacacatgccattggtatgaagagtgtcgtcgaaggctactcatcgatggagatgcgaaactccgaactcaaatagctatcgccctaaccaaactaatcgataaacaaaaaatctttcttcatgatatttcttcaggaaaactcagacaagaacgagcagaaactgttaggttaatagcgtcgttgtagttgctgcctaaacatgaaactttgggacgtgcgactattactttttatagcggagaaatcaggagatgcatgaaatctatatgccatcaagatatagagcttaaccagttatgtgtaaaagcaagtggtgaaaattaggttagcttgctttctaagaaattgcaagaacaaagagatatgtgtgaccaagcgttgtatcagttggtaaagcaccctcaactcaatcatctaacttttttgttactgaaatatatataaaaagcggtttagattcttaaattttcgtgactatatatatttatacatagaaagcaatctttttcgggaccgcgaagaacgatggtccagcataggaggcaggcaatatatgaatgtgtttttgtaagtccatactagggacgacgccaatgtgttattttaaaattgtttatcttatattgaattttgaacctttgcgatattattcgatttcattttctttatggtcacataagcgattaatactttatttacgcatcatggggtaaatcgataaagtttacatattattcatttgggttattaatgtaatttcacatgctgttgattagtaagagaaagaaatattgaaaaatttgtaataacaattgaataaagctaaaaggaaacctaagcccttattgcaaatctggaggtggcaaaaaggggaagaaaccctaaaacgattgccgtcctacccgaggatttagtaaaagagagatcatccaacaccttccagtgagatctctaattcaattcaagtcggtatcgaaacaatggagatcgatgatcaaatccacctatttcgttagaaaacatctggtttgtcctttcccatcaaacccaaaaattgttgttggatcaaggactcatgatgacgagaactcgctaactattcttctagagactttttcaagagaccatccaggtgaaatcgacacacaaatcagttgttctccttgctcttacatttttcatgatccaagaacagtgtgcccaactttaaccttatgtcgagttatagggccttgtggtttggtctgcatccaagagttaaggtactaattatcatgtacataatttggttgactagctatcatgagtctttgcatatgcaaggattacaaaaattggttacgttttcgatatcgtcagtgaattttagttttgtcttcctttttttttttgtacctgtgatataatcatttcaacaaatctaatttcctcaatttttgtttgaaagtattgtaatgacaatgttttcgttaatcatcactaatattataacctaaactttagctgtcgggaaaaaattgaatcaagtgtaaatcaagagaggaccggaaagtttatccaacgcagttgcatgcaacatggtccaggttatatgtcgtacgtttaattcgtctcaaacttgcaaattttatgaaagcaaatttatatatacttaaaaaaaaaataaaaaaattgataatataatttgaatattaacatatgtttgttgtttctctgtagattttatgcctctattgctatttgcattggatttgggaaagacatatatagttacaggaacatacaaaacgataaatataaaatttcccgaacgtcttcatgactatgctgtgcatctcaagacctcggttttgacttttgaccctcaacaatggcagcgaacaaagatacattggtgttttcccgattttcaacagaaacatttctagtgagcaaacatcagtctttgcaaatctagatttaatctagtgagcaaacatcatttctaatggcagatttaatacgatataatgttgttgttttttttcttaactactctagattaatgataaatggcttttacttacaattttaaagttttgttttcactcctcttcttcaatgtataataataagaactcgtttgagatttcagagcatgcataaaagatttctaataatatgttttttttttgtagatcaactcattctgattaccataagtaaaacgacgccggttattaataaagaacgtgacaacttacaaaacgacgacggtttttagttgagggtatatgtgttatttacagaatacgaaggttcaaaagaagaaattaaaaattgaattttgggagctgtaaaatttcagttcacacacacaggtaccgaaccctaatagctaatttgtctcgttcagcaatcttcttcttctcgtttcccagaatttgggtcgccattgattcgcacctcgcaaggtaggataaaccctaattttaaatttcgtttatctctatgaaagatggcaacttttttgatttaatcgtattgactaatgaagaattttctcataattatgttatttgtcttttgtggaaaaatctggtgtctttcttctaaattcacaatttttctaattcttagtgatagagtcttctacggatgaatgaactctggattgaatcattgtctttgtggaaaattgaaattgaaagtttgtgtttttttttttatcagatg

SEQ ID NO: 28724 - DNA, 3000 bp, Unknown
  misc_feature (1)..( 3000): 2750-1469P.txt file - cDNA_ID_2998350; gDNA_ID_2926249; Annot_ID_142993
aaacgaagatctaaactcgaatctgctagtggagatcaaatcagccattgataaatctaagatagagaatgtctttccactaccactctccaacttcttccaagtaaaaggcttacccaaaggtaagcaccttgtgcagcttaaatccagtcgtcctttgatctcccacaaagtagaatcagagattattgaagttgatttcgagaccaatgcccaaatccatattggtccacttcgatacagcattgtggcagatcatcagagtcaggtaaatagataacttacataatcttcgacattttttccattattcttgtttgctcattgtggtttgatttgtatcgacttcaggaagtgacacctgcagctatattgccactggttattggagtttcggcaattgctctattcctcagcatccccaggtaataatttattaccaaactgtaacatttgtaatttggaacatttccacaactagtaatccacatgcttataaaaaaaaggttgaaagacatctaccaagccacggttggaatttcgtctcccgggttcactacatctgccaagagagaacctcgaaaagctgttgctagaaagaagacgttctgaagaatttattcatcttcggtcttcttttttttgttttttgttatatagtatcgttagagggaatttattcaaaacattgcagaactcagaaactcctctaatccattttaaagtttagagaaacactcttaacggtcaatttagtcttcttttttaaatgtgaattgtgttagaatctttttctccatgactatttccaaaaacgctgttatcagtttttaccattactttttagatttaatttttaatgatacagttggtacaaaattcaaatacatctgagagaattcctatttatttttttctattaactaaattatcaacaaatctccacttacactactatatatatatatatatgttgtatcttatttagttacaacaaatatcataacagaaacaattgttagatatcaaaaggtttctcttagatttttttatagatgaaaatttaaaacattaatttcaattaaaaactgttaacaaataaatcaaagtattagtacttaaaaaaaaattatgtgagagcaaaatatttaatccttatctttaacattttcttttttattttgtatttggtatttattaaagataaagattatatatagctgatttatttatatatttcataattttacataaattaattttatacttttttcaaagtcattaattttcaatctccagtagttgaaaactgatgattagatcattagatacatattttttttttcttaagtatataatattgatgatatagaactctcaactgggaactatctcgttgcaaaagaatggagaaagacaaaaataatcgtgagactatcattacatcaaatgatattttagaagagatctttcaatatcttccaagctaagttcaaggccgtgtcgaaacaatggagattgatgatcgaatcaacctatttatcccacaaacgtctcgttcgatggggattacaaaccccgaacacgaaacttcttgttgttcatcaactgtcatcaaattctgactcaacaactttgcttttgaaaacttttaaaagagatcatgacaataacggacaaatatgtctttcttcttctagttcttatacttttcctgataatccaatcaaccaatctcgacacgaaactatccaagtcttggggtcttgcgacggattggtcttggttgggacctacgattttaagtacctttacttaatcaatccaacgacgggagagtggatatttgacaatttttctaatatatgtatttttgttcatttgaaggagaatttgtgaccataaggccattttgcgttggatttggaaaagacattattacaaaatcatacaaggtgattttgatgtactcagaaaaaaatcatcctcatggatattttgatggtttcaatatcaaagctatatctcttgataatggaaagcaacgagacgccggttggtacgttttagatgagcacgaaatttgcaatgaacaaacaccggtttacgcaaacggatcactcttttggtggacaacatttacttcttggaaatatcgaatattttcagaattaccttcacagatattagcttgtgatctacacacacaaaattttcgatgggtatcaataccggaatgttacacccgttacactcgtggagtgcaaatgtggagcctaaatgagcgtttgtgcttatcagatgtgctacacagacaatgttcagaattagacgtttggagtttacaagattctactcaaaaatgggagcatttgttttcttttaatattcttaatatcgatcgattagatgcaaaatgttggatgcttggtctaagggctgctcactttcgaaggattggagaggaccaaaatcaagtttcgtttgatagtataagaacggtgatttggtattcgccgactatgatttctccatcaaatttgttggtttgatgttgtttcaaccttctatgattaaataaatctcaaaagcttttgagtttttaacttcacaagtacaagtagaaagaaaagctcttgacttaaagaggaagagaaaaaaaaatgttttgtatttaaagaaggtacagtatagtggaatgacttgaagtattgggctgcacatgatccaacgctgaggattttacaattataattcaaaagcatatatcttggtcataccggttaactactgaagcggtcaaaaataaaacacacgaaaacgtatcttgtccaaacgacacgcagattaattactgtttaaacacattaagccacgtacaatagccggtcaccaattcaaggcatttatttagcaggcatccatgtttcattcctcactctctctctttttctctaaccataaaatctctttgatctctttctctgtgttttgataatg

SEQ ID NO: 28725 - DNA, 3000 bp, Unknown
  misc_feature (1)..( 3000): 2750-1469P.txt file - cDNA_ID_2998354; gDNA_ID_2926249; Annot_ID_142995
tttccttatcatgctgcactgaacgtttttttatgaccaactttcaattttctatgcgatctagaattaatctctgtaagtcgatcgatacggttgcaacagccacataaagcaacaacaaatcaacccattttacctataagccaaaaaagaagaacctctctcaacgtggaaccaaatcagcaatgagaccaaagggactaataaccatatttctcctacagattgttttccatgggtgtgaatggaacgttcctgggactaaatagcctatatgcaataaaacccgaaaacacaagagatatcatggacaacaaaatggctgtaatgctggccccatcgctagagcccttgacagttgaagccgtgagacccgaagaagaccccgaggagatatctagcggtgtccaatcgcagttgatcgtgtagtgtcctgatccatgccatggtttgctgtccactgggtaccagaatgcgacggacattttggccggcgagccaagcgtgaactgaacatcctgtagatatcaccaatctaggactcttagtttcttaaacagatgttctttatacataactcatattgaccaggtttcagttctaccggatagatttgttgtttctacaactacaagtgtctgacacatgtggatttggtttaagagtaactactatttcatagagggaaaaaatgcctggagattatactaaattttagggaagggccaatggtaactaaacgtcatcgatcgagtagaagatttactgacctgttggagacggtccattgtcctcaagggccttgaaaactcaaaatagtaagttcctttcttgccatctggcgtgtaagggctgtcttcctctacataacctgttaaaaacttcaaaaccaagtaactagaggagatgcctatggctacgatatggttataaacactgcgactaaattacacctcttattttttccagttaaaagcacgattattatatatctctgtattgggaactcatggaactgattatgaaggtatgtaaggctgacctgatagagtggtgaagctgctgtgccaccacgctccatgccaatcgttctgtgcactggaatcatttcctgtaaaaagaatatccatgtgatcacatatttgtaatttgcacacgagaaagagatcactctagagtagctagcatccaattagaatacacacaatttataatttaaggacgacttatacttggggaaacacattagagggttaagaacctaacaaacttggtaaataattgaagaccatagtcaattactaagcttccatgaaccaaagcagataaaaaggtaatttctgttcttagttgaaattggttattctttaacatcgtcatagggaatttttcagtcattaaaagctttttgagttatgatatagccctctgatataagaaggtacctgagggtccaagaccatcaaggtaccgacaatgtggattccatgcataaatgtcaaccagatgaccaaatctgttcatatgaaaaacacacagagacattcaataaaacaaaataaacagaggttcagataaggagctaaactagattcactatattggtacaagacaagaacaaagtaggagagagacagaacaaacgacattttactacaaatcacctgtcacctccatttccttccccgttgtctattggattaccaccgtaaagccgtcctggaatagcatttccaatggagaaatgcataatatcaacctcgaagcctctgcaagccttgctggtacatgagtctgtcccttctttacaaccacccatcttgtggaccagaaggttgacatcagttgtttagttgaacaaaatactcaagccaaatgagaaacttacattgtgataagtagcttgatcaccaatttggaacatgagagccactgaaggacacttgttgttttcactggatttaaagaagcaagcggttcactacaaataatgatagacttgcaatttgaagttatgtacgcagttactatctacttcaggtaatgaatggtcaccggttcttggatcatgcagaggtctagaaagggtataatcaaataataaaagacacacttaccctttatcataagcgtaatttccatcaatctccagaagaaagtagatatctcgaccatcatgtagtgcctacaaagatctaccaatcaaatgttaagaaggaaatcgaactcaaagtccataaaatccagatttatcaatcgaatccaaatgtcggaatgaggtcagcatcactagtcctatggtcaaactcaccaaatagatcttggcaaatctgaaatttcatcaatattatacatctacaagtaatgccaataagataatgcaaaatccgattcgaatcaacacattaccttgactgtcatcttcccggcgtcatactcgtgatcggagtccggatcaagtgcaggtcggagcgggaactcggagccgtcaatgtccttccagtcatcgttgtgaccatcgagggtgataatccccggtctgaaatcggctaagacctgaatctccgagtccgattcacaactccattcgccggattcctggtgaggtacaaccgtctccgccgtgaaaatcaagagccacgctacaaccacgagctgaagcattttgatttttctaccggaaatttggtttctacagttgactgacgattacttgactcttcttcaaacggtaagcaaatcacgacagctgtaattaaaaaacaattatttttaattaaatattatttttaattaaatattatttttagtgggctttataaagcccattaagccctaaagagtcaagagaaccttgataaaaccaacggagatctacagatcggagtcatcggtccgatatcttggatccgtgctccattgacgaacaataatcattcttctttttcttaagttcaaccattttagctccttcactggagcttcacgtcgggtacaatg

SEQ ID NO: 28726 - DNA, 3000 bp, Unknown
  misc_feature (1)..( 3000): 2750-1469P.txt file - cDNA_ID_2998382; gDNA_ID_2926249; Annot_ID_143008
cacagagattctccgcgagaattgctgtcgtccaggcgaccgtttaatttttctgataaattataagccaattttcataataaccaaaatacccctgttgaatagtcaaatcttgtagcaaaataatatgatcagcccatgcatatttatagacgattaaccctcttttggaccaaaattcgtacaacaatcttcctaaaacaacactaaacaattcagtccaggcgacgatctctcctagagcagaagaccgaggaggccacgccggcgacaaccaagagaccaaaaaaacaaacacaccgccttaacaatcaagtgacatcaccgttgtctcctcttttctattatttgataaataataaataaattcattttgttttacttgactttgactttgaacattatgagtactgataccgctttacgtatcttggtccaatatttcgattgcccatacttaagctgtgaatggtaaccaaaaccgcatccaaaaccgcactacaacagtgttgtaacagtatcaaaatctctacatatacatatgtatctatgtattttcgttattatttgaatcgcatcgcactttttccacaccacaaaacgcaatcaccattcggaaccttaatttaatttttcaatagagcgaacttgttaattgtaattcgccacaactatatatttcactttaactagacacaccctttcgttgatttttttttttttttttgcacacaccctttagttgattagtattaccaaatttctagacagatagaaccatataagtaacggatagtaataaaaaaaaagagactatcttttagatgcatggggataaggaactgtcagtttttagtttttatttcgtgtttttaaaacataaatgaaacacatgcttttttagggggtattatagaattgggtacttattgggccaaaaactagagaaaaagaacattttaatgggcttataaaaataagtacttgttgaaataaaaaatgacgattttacccctttctctaattgattgtgttctcatctttcatcgtcttcttcatcatcaccacaattttttccgaccacaacagtccttgcttctcagttctccccaccgcaattacttcattaacgccgtattcttctactctatcattgttatatccgtcaacaccaatcttttctaaaatcccatggatccaatcaaacgaattgtcattgaaggaatctaaactctaagggatactgtccagggaacccaaaaactctaatcttaaacacaaatcagatcaattattttccaattcatcaaaattctaaaccaaaagagaaatcaatttttatcgaagctttgaaaaacttggatgttggaaggagaaagagaaaaacaatcgacaatgaattattagggcaaaaacgtctttacaaccatatataagtacctagatttgtgaggtatatgagatatgccttattcaacaaaggaatagacttaattgtggtttattcataatcgatcctgcttttttaccaggtacagaagggagagagataaaggttacattatgattaatttgaaaaatagattgaacattatgcaggagaaaagctgaggaaaagaaagcagaagaagacaggttgtcataagaaaagagagtaatgacattagaagattccaaaagataaaaaaattactgaagtggacattggagatggtgttggcagagagatttgtcctctcttttctctctatataaaataaaatatctcatatttcttccgttatatattctcctcgtatatagtatatattcaatgactgatgggaatataatctaaaatatattaactcgagtactaaaattctcagttctacgtcttgtcttgtttaatacaaggaaaaactgatacgactataatctagtattgtactatttcatttttccttataataaaatttgaatttttggtttgtctagtgtgacatgacatctctgcgcgtgtacgttcccggctaaaactttgggaagtgtgtttctctgttgcagtaaagattacagtgtatatcattctatattattatagtatataaattatagttctcttctcaaaccagaaatttacttttaagtataaataattgttgattctgtaattaaacaatgaatttgtactaaggtatttagacaaattcactcctctctcagttaataaataatcaaaggggaagaacagagttgcatgaatagaaagctagggtttgctctataattgtagtctttttgtattaggttaaagatggatccctggagagtttgaccctcccctatttatacaatgggtcgaacataccaaaatatgataaacttctaattatcttaagtctaaatctccattacttccattcttcatgagattaccctcttttaaatggaagttttcccttcacacgacctcagaagccgcttatggcgatctcgattgtcgacctaaatcttctggcgagctcatgacttaaggcccattcacaggctatccgggattccccggttcaatcgaattctcgattttattcacgttattccttggtttaaattggtattgtcggaggtgctaattcctgcaccaacaattagtccccccagttcggagagtccgagttgcttaattcgaaatttccgaacttagaaattgaatattcgatttaaatcttggaaagcgtgaattaatcattagatttccgaatcgattcgtatttcgaacgtatctgacatgtgtccaatcgctgcgtcagtacgcgcgcgtgaagctcaggaaccgaagcgtctcgtaggtttaatgatgacctcgtaggtttgccgcccattcgcctctatttatattagattaaaccctcgggaaatcattttccgccgcttgcaagaagaatcaaaggtagctctcgctctctcctctgcgaattattttgtactctcgattctttatcgatttttccggcaatg

SEQ ID NO: 28727 - DNA, 3003 bp, Unknown
  misc_feature (1)..( 3003): 2750-1469P.txt file - cDNA_ID_2998390; gDNA_ID_2926249; Annot_ID_143010
tacgcgataatagctgagataggacatgattttgaaacggattttgacgacattcgataatctgaatctgaagcggtgcaaaattgatttagaaattgagtatggtagccaaaagggtgagattatggtgtataagaagagacaacgagcaagcgttgatcaaccatgtagcagagaacccggagttctaacaagtagctcaagctccttgaccagtagagaagaatctcaacaagtgtgctctgaccagtccaagtcttcgcgtggcagagttcgagcggttccttcaaggttcagggactccattgttggtacatggaaatccttgaagagtcgcaaggaagagtcgacggagacatgtatctggggaagctcgaaattgcatcgaagcaaagacccgaagctgtttccacgtaaggataacgaagacagcagcgaagtagattgcgattactgggatgctaactttggtatgccgaaaaagtccgacgcctcgcgtaagggcgtgtacaaaccagaggaatttacagtcggcgatcttgtctgggccggctgtggtacaagcgcctgatggggtcttgaaacattgcgtccctggcgcaatacgtgtcatgttttttgggtactctaaatggaaaaaaattgtcaattgtcaaaaagtcgtgttaaatatagatgtattgtacagatctttgactttgaagtacttcatttgctgatcacagcctcatctttatctgttttttttacactgtaattatagattggatgccgattggtgcctttgtgcttgattctcgaacttcactcctgactgagagtttgagtggtcgcctgaaagtcccaaaggaaggaaccatagaacggatgttacaaaaatgtcttattcatgatcttcagaaactttgtcaactgcaggaaaaactgtaacatatggcttatctcattttccagatttacagcttgtgcgacctgtttgtgacctcagtacctgtgaggtaaaagacactaatcaactctaatctgttgctgaaacttttgtattgatctcttgcaataactaaattgcaactaagagtgtttctgttttactatgtaggaacaatgcaaactcttgatgctaggcacattgaactcttccttagtgaaggctacaaagatggaagctgggactacaatctgattggatctcataagttgcagaaaaacgcaagtgcagcttgtggagccatatttgacctcaaacaccataaagaatcttcatcctcaggtaacttcaaatcttcattactgttatgttcctttacttctcctctttgaatcattctcctttgtctcatacaaatttcacatgaaacctctataataggtattctcaacctcaagtcttggaccggacagccagatatttcccaacctaaagcagttatcgcaccccatgcagttgctgttcacacaagattgcgagaaaacgaaggtatataactttgcatcatcaaccatctttatctagaaaacacaattacaaataattctcttgccaaaaggaattgaatccaaatttgttgtttcagttgcggaaatccaatcagtattgtggcatttgcaagagagtatggcagcccttcaaatgatggagattgggtgagaatatatgtgaccatgtttggtgaaatacagacctgtaagaaatgattacatctatttagctgacttgatttgatgtattaggtttattgtgatgagtgtgatgtatggccgtatgggtgcgacaataatttatataagcgctttaaggtacaccttcatgcatcttaacttttgattctaagtaatgaacacgcttgttgaactatcacactaatttggttatcatcttaaggaactggagcacaacagttactattgccctaactgtaaagtccagcatgagcttatcaatattagaagaacagaactcagtgttcaagtatattgttaacttctcatgttctcctgattttattgtttgcatttctccattgctataatatgcgagatttcctcacaacctctttgggattggtctacagaaaaggcgacacagactgagctgcctgatgagattaatgtagtctgtaatggcatggaaggaacatatatcagagcatttcatgcgtacgtattagatgtctcagccttatttcaatttcttcatttagaaaggatcttatttgtttatgaattatgactatgcagcacaatatcgtaaattgattttttctctgaaaacgataaaaaatccgtgtttaatcctaggtttctgttatcattgtcttgttgttttagagatttgaccaacacattaatctttgaactattgtttcagaattgagtgcaagtgtggttcatgtgggtcaaggaagcagtcaccaagtgaatgggaacggcatacaggctgtagatactagatagcgtaagagtgaaagacacaatgctacctctagaaaaatggctttgcatgaagactttgatactatatgtatctgtatatgtagaagagtatcagttttatctaaatgactagtctccaaatttgtggtttattgatttcgtcagaatggtaggctctttaactgatttaaggtgaaaactacattggtctttgttcagtgttagatttgtcttttgtgggtttggaatggattaaagaggagtcttttactggattttgttgaatgctagatttgggtttagtaaacaatgaatcctttactggttttgaaggatgttatatttgaaactgattagagctaaaccctctattgcttagtggttcttaatttaagggttttgccgcagcttccctaatttaagcttgttttctaatacaaagtacaaaagcagtgtgttcgtcaactatcttcttactctgttttcgtttagagagtttttgcagagatgaggagaactataacaatggtgataaagatgtcaatacttatgatattgatttcatcaatg

SEQ ID NO: 28728 - DNA, 3000 bp, Unknown
  misc_feature (1)..( 3000): 2750-1469P.txt file - cDNA_ID_2998400; gDNA_ID_2926250; Annot_ID_143015
ctgagattgttgggggtgtaatctgctgtttattaaacgaagaggatcctgatattccgtgtaatgatgacattttcctgtccaacaactcccgtccgatgtcagtttcttctttagcccggcggaactttaaggataccaatagtccaataactacatgtgtaagagacgtctccgccagtaaggaaaaaagtgagggatattcactccaggctcaaaagaaaaaaccaggacgtttacaggggtctactcaaggaaagccagagatgggccaaccaagtaaaggtagcaaattcagggcatcgactagtactgagttaaagaatactgtagctcctggtggttcttcctctgcacaggcttgctctaatactctactttctactggtaccggtgcaaaagatggaaagaaagaaactgctactggaacactctttgtcggatctgatggccatggcaaccacccagagaaggatagtgaaaattgtaaagagaaaaatgttgtaccacctgttaatgaatcgccacatgctaaagatactgatgatggcttgatagagattacagtccctgagctggagatcacccgtgcagaagcagaagcagaagcagaagcgcatgtttgtgagagtgatgaggacttacccaattattctgacattgaggctatggtaactcttgacttccatctttattcttgtgctatggttccatgacacgtaaacacctaatccataacactcttttttatttcagatacttgacatggacttggaacctgatgatcaagataattttgatctcgaaggtagttgagcgtcccttctcgtccagtggaactcatgtttctttctatctatctacatttttgggaaaagaaagcttttagtatgtgaataggaatgtatttcggcatttggctcctaaaagttattacatgctgcagtgatgtgggaaaccttttctatgggtagcgtatgagatgttagaagaggtttaaggcttgtttgtaaatccctaaaatgttttcacttgcagtctccaagtatcagagccaagacatgaaaagaacaatcataagacttgagcaggctgctcattcatatatgcaaagagccattgcttcccgtggtgcattcgctgttttatatggcagatattcaaaacactatatcaagaagcctgaggtaatattatcttattcgtttaatattccttgtatgatttgataagcttcttaagaattatagtagcacttgttgatatcggggttcttttttcttaacataggttttggtgggtagatcaacagaagacctcgctgtggacattgatttgggaagagaaaagcggggtagcaaaatatctcgacgacaggtcggtcaatagtagatacttctatttgtattttaggtctttaagttgtatgagaagcagcagcccaggatctgtaatggttgttgtgtatgtttttttcctttttgggttactgaatgcaggcgatcatacggctgggtgatgacggttcgtttcatataaaaaacctggggaagtattcaatctcagtaaatgagaaggaagtagatcctggacagagtttaatcctcaaatccgattgtctagttgaggtttgatccgggatactcttttatgatcattacttacgcttctaggtccgtacttaaacccgatatatgtgcgcgcagatacggggaatgccttttatatttgaaacaaaccaaagttgcatgcaagagtacctgaagagaagagggaaagtgaactgagaccagatcaagagtgcgtgttgtttgtgtagatgaatgatgcatctcttgtgtaatgtaccttagccataggaacacgtcttgtagatcttttaatacatctttagttccgcatcatgcatagttgaccctgttttaaggcgttgaaatgaaaatacaagtctcttgtatctgaatttgtgttttaagcgaagaatgattgttcttgtgaagttgatacacaagttctttggatatcctatcagtataaaggataggtttccattttcgtgactcactcactgatttccattgcttgaaaattgatgatgaactaagatcaatccatgttagtttcaaaacaacagtaactgtggccaacttagttttgaaacaacactaactggtcgaagcaaaaagaaaaaagagtttcatcatatatctgatttgatggactgtttggagttaggaccaaacattatctacaaacaaagacttttctcctaacttgtgattccttcttaaaccctaggggtaatattctattttccaaggatctttagttaaaggcaaatccgggaaattattgtaatcatttggggaaacatataaaagatttgagttagatggaagtgacgattaatccaaacatatatatctctttcttcttatttcccaaattaacagacaaaagtagaatattggcttttaacaccaatataaaaacttgttcacacctaaacacttttgtttactttagggtaagtgtaaaaagccaaccaaatccacctgcactgatttgacgtttacaaacgccgttaagtttgtcaccgtctaaacaaaaacaaagtagaagctaacggagctccgttaataaattgacgaaaagcaaaccaagtttttagctttggtccccctcttttaccaagtgacaattgatttaagcagtgtcttgtaattatacaaccatcgatgtccgttgatttaaacagtgtcttgtaattaaaaaaatcagtttacataaatggaaaatttatcacttagttttcatcaacttctgaacttacctttcatggattaggcaatactttccatttttagtaactcaagtggaccctttacttcttcaactccatctctctctttctatttcacttctttcttctcattatatctcttgtcctctccaccaaatctcttcaacaaaaagattaaacaaagagagaagaatatg

SEQ ID NO: 28729 - DNA, 3000 bp, Unknown; identical to SEQ ID NO: 28728
  misc_feature (1)..( 3000): 2750-1469P.txt file - cDNA_ID_2998400; gDNA_ID_2926250; Annot_ID_204340

SEQ ID NO: 28730 - DNA, 3000 bp, Unknown
  misc_feature (1)..( 3000): 2750-1469P.txt file - cDNA_ID_2998404; gDNA_ID_2926250; Annot_ID_143016
agaaagcgtttatttatgtgattgttacatcttggtgttcatttgggtccaggcaaaatgaattcaaatgcattaaaagatatagagattaacttaaggtgctagtggatcaaaggatctgaaatacgatgtaaagtgaaaatagtatacttgttctcaatgtgttcaagcgggtttcttggttcactcttttcattttacttatttgttactttaccatgaatgttcagagaaattctctaaatagtttcctagattttattcaagtcaattgctattttgttgcctgggttgaactgaggtttaggtaactgacgtgttgtcgttgcagtatacatacttggatgaggtgtcatttaattctctgcgataaagttactctcttttggatacatataattagatttacgtgcattgtaattgggttattctgttggttggaaatcttctctttgttttcttattttatacttgatttcttgcctagagaaattggaactcaaatatagtaagcaaaggtctgtccggaagtagaaattgatttcttttgttatttctacattttttatgtagattctggatgtggctgtttccttagccaaagttgcggatatagacaggactctacaaaatgaagttgcagcgacagatgggttcaaggaaggcatgagactgctggaatctttgaaactggactctgaagattctgctctcgagcaacgggtaagattcttgcacgactccctttttatttgtatcttatccaaagctgctgaatgtcagtaaaactttatctgacaaatgtaattttaacatgcatgcagcggctctctgtactggagttccttaagaagcaagtagaaaccgatgctgaaactgcactctaaaccgatgcaggcttaagtacgtatatagaaattatacctaagttctcgtctgtggcattttgctgaataaagaaagcaaaaatgttgtatttgcgctcaagggacaaagaaacagagttgtctgtatgttgtgaattgtgatggttttcaactttcaatgcactaatcttgcaatgttaaattgttaagcatgattgtactctatgcacttgtgaaatttaaaaattaagatatcttaagcggctacagctgtgaactgctttctatttcttttcagtgcaaaatgagaaagaacccaacagagattgagagatgatgtgaaaggaaaatgcaagtatttgcaaactcaatcagctacaaagagtataaattgcgacaacaaaaatttgtctttgttgttttgttgaatgaagtttttcttgtaactactcttacaaaaataaaaacataaacatagtcaatccctaaagccgatgatactatgcaaacgacaaagatatactaactccaacgcacgaatcaacaaaattaggtcacttttacgaaaataaatctacataatcaacaaaattaggtcaacttcgttctatttgtaaagcttttttcagtatttttttctttaatatgttcacgtcttttaactgttcatataattacgtaactaaatctttaacttcgtatgtaaaactatgtttttacgtattagatatagagaaattgttaagaatgtttttccaaaaatatgtttttttagtactatcctcccatgtaatcatttttattgatattatcttttaattattaatgactattttgcttctatttgaaaatacttaaatcaacaaaatgaaaaaatgattttttccgccaaaaaatgtacttcacatcaactgctatgaaacaatgtactgattttatcaattcacaaaaattcttgcctctaatcaatcgtgattcaagcaatcatgcaaaatcttgagtaaccaagcctaaaaaacctaaaaacctaatcaattcttaaaagatacggaaattaaagtcaaagattactatcaactctcgcctcttatccatcttaattagttcttcaaagatttcacacgagtaacctaaaatccattgaaattaagtcaactatatacctctcttcgcggtttatagttgaaatctggaggcatcgccaagtagccgccagcttcgccgattttacgttgaagatcagcgttttcttccaatatgaaatttctggcgtaaagcgataagtgcacttttccggcatagattgagttgaactgaacaagaatagtacgacgacagatcagatttttgaggataaagaaaccattgtcgagaatttgagaaaaagatgaaagtcgagaaatgattattgattatctgaggatttataaaatatataaaaaatatttaaagttcaaattttattaatcctactaatattagtttagaagtacatttaaaaaatatgaactaatatctatcatctaaaagagtataaattacaacaacaaacgaaatgtgttgaaagaggctgtttttccgggaaataagcatttgaagtttagtttcagaaaaaggagttaaaagaagagcaaagtaaaaaaatcacatatatccaaaacggtgtcgttccattctcaaacgtgctttatcttcttctttacacactctcgcctccggacgacggagacagtcagatataaattagggtttcagattttttagattttatctcttcaattcgagccagtgaattgccgcctcctcctcctcctcttcttccctcaagttagttactttcgtcttgagttttctaaattctctatctataaattgtgatatcaacttgtgagaatttcgaaaaaattgtatgtgcgtcttctttggagcttgagaatttaacgagagtattgattttttacctacagtacataaccaaagcaatgaaattctacttgtatcctgtaatggctgactaaatcaactgcgaatcgtggttcgtcactttcttaattaactatttttttttcgatctttgtctaatttcaataatttatccaaatcctgatacttgttgttccagttttgtgacatg

SEQ ID NO: 28731 - DNA, 3000 bp, Unknown; identical to SEQ ID NO: 14457
  misc_feature (1)..( 3000): 2750-1469P.txt file - cDNA_ID_2998410; gDNA_ID_2684120; Annot_ID_190924

SEQ ID NO: 28732 - DNA, 3000 bp, Unknown; identical to SEQ ID NO: 14457
  misc_feature (1)..( 3000): 2750-1469P.txt file - cDNA_ID_2998410; gDNA_ID_2926250; Annot_ID_143021

SEQ ID NO: 28733 - DNA, 3000 bp, Unknown; identical to SEQ ID NO: 14457
  misc_feature (1)..( 3000): 2750-1469P.txt file - cDNA_ID_2998410; gDNA_ID_2926250; Annot_ID_204346

SEQ ID NO: 28734 - DNA, 3000 bp, Unknown
  misc_feature (1)..( 3000): 2750-1469P.txt file - cDNA_ID_2998446; gDNA_ID_2926251; Annot_ID_143034
ttgtatctcctttcattattatgattgttaaactcttgatatatgttttcttgtctctgcagtaccgttaaagaggcctttgactgatgcttataatacacaaacatgttggtgttgatgaattggccttgaatcttttaagttgttgttgcattcttctttaaagtttatctcttatttggaacaatgatcttttggttttgattaatattttgcttgttaatatagaccattttggcatagaatctctaggttttcttgaagacgtttagacatcagaatccttgaaaatccaaatgtttttattatatggttttgatttcgcaatgtgagctctgccttatgcttcagctgaactacacaatctgataaagaaacctagtactaacatcattatctcacttcgttaattctctaatctaactgtacgttccaaaattttagtttctgtattaccgtaattaaaaattagtttcaaaattttacagtctaaacttgtcaaccatcccttgaagccatcttaagtggtaagttcctcttcgcttctttctaatggcttttcatcttaagtgaaacgaacctttcctagttccattctttgcgctgatccttgtggagcggatatcagagacgtctcgaacttgaaaaagaagctgcctccggagttgatgaaagaaatgggaacgatcaggtcatctcatgactgggtagctacttcaaaggacgatggagttctgcgtctccaagatgacttaaactcggttgcgtcggacagagatccaagacgcagcttgcgacctcatgcctcattgccaaaccaaaattgttaccaacgtattaatgccattatccttaggatggattctgttgtggcgattcaaaacgcagcttggtgttttttctgtttacaaaaagatccattttttttttaataaaaagactgaaaaaagcccacaattttaaaaataatttgttttgattataataaaatgccaaaaatattacaaataataaaatagataaattataatactaaaaagcccaaaaacgttttttgcccaaaggtcatcatttctttgggtggagctggttgtggttgtcaagttcttgggatctcaatttagcattatagatccgctcaaagcaaaaatttcaagtggatcatcatcgcaaacccctgctccttcccctcccgtgtcattagtccaagaaagatgacatgttttgcattcctggatcaagaggtcacttcactagatcatgggatctccacaatctcagcaagaaatcatgttgcagagtttacagttttaaaactttcatgtgccgacaaagactagacgagagcttttgaagtcgtgttgcacaagccaacactcgatggagtcattatcaacttgtgagactttgttggttaagtcagtgatacaaaaagaccaccgtcaagatcatcaaggtataactacaataaaaataaaagttttaatggtgaacaaggaaacacaacttatactaaagatgtcagagatctctgcatttcactctcaaaaattgaactttactctatcccagctagctcatgtcctagaaggatatggtggtttgctcatattttaatagatgtctagttgttgaaatttctaatttacttaggcatatcaaaatcaaaccgtaatcgtatttaggactataactgtaccatttttaaattgtaattagactataatcaaattaaacagttaaaaattgtaattattaatcgtaaaaaaaaaattggttaacagttttttatatgtaaagttaccatatttaccataacagttaaaattgtaactttgtaaattgtcaaaaaaacattacatttttataccaaatttagatattttgaatgttttttattttcaaattagacatttcgaatctatatggggatacattgttttgtaacaattgaaaaactaaataaaaataaaaatcattatatgaccaaaaattgttccatctctttacttggcatttacacataaatttatagaaaataataaaaaatatatttagcatttataggaaagcattttatgttatctaattagatgaattatttaaacaaataaaccatgtaataaaaagaattctatgttacctagtatgatttaatacattatcaaacacaatttttatgcatttctattttattacatggtcaaataaaataacatagaaatgcataaaatgttatataactatctagtttctccttcttgcatcgacaaacacaattttcatgcatcatctctatttgttttgttcgaacgaatggtattttggtccaaattcattactcttgccaaaacatgaggttagttcccactttaccaatccatgtgacttacaagttaaaagtgattttattttatgaaaaaatacttttttaaatagtgctttgcaatggagctataaaaatatacctatataatttatgttgggactgtttatgataaaaagtttgtaattatgagaagatgaacgttaaaacgtatattgaaataatggcatattcatttatttgtctgacacaacacatgtacatgtcccacccatctctctttcttatggcgaaaactacaaattttacgcattttttccttgtttcgtccaaattcgaaacaaaggacattttcgttcaaattcattcttttgccaaaccataaaagttagtttcaagccaaaactattttaaataatgcgtgtcacaaataaaaaaactaaaaaacgtaaataatgattgtcattattcattattaggccaacttgtcataatagttagtgcccatacgaaaaatacatctatccaactaaccctctcctcctccatttctactttgttttttgttttcccacttctctcaagcctcgacgaccaaaatttttctttctacaaatactttgacttaagagttgcagaaatatcaagttaaaaaaaaaacagaaggagaaatg

SEQ ID NO: 28735 - DNA, 3000 bp, Unknown; identical to SEQ ID NO: 28734
  misc_feature (1)..( 3000): 2750-1469P.txt file - cDNA_ID_2998446; gDNA_ID_2926251; Annot_ID_204375

SEQ ID NO: 28736 - DNA, 3000 bp, Unknown
  misc_feature (1)..( 3000): 2750-1469P.txt file - cDNA_ID_2998450; gDNA_ID_2926251; Annot_ID_143036
cccacatattatggtgtgatttggatagaatgtttcaaatctttcatttttccacccattttaattcttttaaattcagttcttcaataccccctaagtcgtttgagggactagcacaattgatatatttgatttagccacttggaaaaatccgttatctgaatccgaactataatttatgaattatgagagtcggccgaaatcaattttcattaaaaagaaattgtagaataaataacttttttaataaaaggacacatttctcttttgtgtatatacatattactttttgattttgaaagatattttttcacaaaattttgaaggatattaaacatcaattacatatgaaacaaaaatacattaaacatctaaaaagatttactttttcattgagtaacaggaggactatgcccatgaaattgaccatctttcttgatgttgcgagcatcccaaaaacgaagtaggcgaccaacaacctgttgagtaaagcgaccaagacgtaaagcatcaaaagctacatagtttgtttcagaaggaattgcaacaacatcaactgcagccactttcatatatataagaaacatacaaatatgagccgacaagtaaaccacaattacaaacgtgtatgcatttggtgatggtgatgatgcaactatacatgacacatcaaaagatgcatgttgatgatggaactatacatgacacatcaaaagataaccttcatcatatagtcatatattcgatcaagttggcattataactcaactatgaaaatgttaaatctgagctgataaatcaactataaccttctcaagtgatactacagaattaatagactcaagctgcaaacaagaacgaactgaaattgtttttgaggcaatgaaataatcttacaagaccaaaaagtatcaagccaggaaccctttaaagccattgttcacgacggagaccaagcttgttctgcttcatcttagccgacttattgttctgcaacacactatgcaatagcaatacacaaaaacattagccactcgtattgttataagcttatcagttgctaatcctaattcgtcactctaaacctgagtataagcactcaaaactctacttagtgcttacatcaataaaattaatctgagaagaatggagcgttgacttcatctgacaattaagcacacaactaattagaaccatcaccacggagagatgaatcaaaaaaccaatctctaatcgatgtttggtcttaccacattggtaataacttggaaagattggcttcaaaaggcagcttttgattgagagtgaacaagcacggattttacaaaaacgacgtgtccaacaacaagatcaaaatcaagataaaaaaacttctcctccatctacttcatttggacaatattttaatggttaaattgcaaactagtaacttttcagaacataattataaaatagggcaagttactatttataattgtagatttagtcactctcctcttaccccactaatcagaaaatcgattataccccatagaaacaactatatttaccaacatgccattgtgagagagagaaacgtgtgggaccttagtgcgttaggattttctttaaaaaatctttttctttctttattacatatcccaacaaagtttaataattaaaatgctctttaataaaattatatttttttaaaaattgatcatataaataaaatctatgtttttttctctatcatttgaaatgcattttgtttaatgacttttaaattttatattatatgacacagtataaataatatatatctatacagatatagactactgtacagatatggcgttgtgtatatttatatacatatgtacactaaaagtgtttgtacagatgtaagtgtacgaatcaaatagttaaaagtatacaagtgtataaaaaaattgagatatgttgttaaataataaattaagttgtataaatttgttataaatatgaatattaaatatgctgtataaataaaagtgtgtacatataattaattaattaacagtaaattatgatttcgtttaacagatgcatcaatttgtacagtagtttatatctgtacagtgatctatatcagtacagtaatcatatctgtacattggtctatatatatatacagtaatctatgactagtttgccaacacactcatattttagcttggcggatctacaagcaatttatcggactattaaattactagttttaagttttaggtttcttatgttgtttattttaaatttagtatttgtttgttgttaagtttataaaattattttatatttagtacttgtttgcttgttaagtttataaaactatgtgttgtaactgttgtttgtaaaatgattatatgtattaaataaaaaaaagaaattgagggactaaagtatagaaaaaaaaattgaactaaaaatagaattgagaatagagttgctctatgtatagagtcaatatgtagaaatctctatttttgagtcaattatagagtagagttgaagaagaattttgttattaagagagaccgctgtcgtttttgatatattttttcacgattttgttgagagaacccattgagagaacttgacttaacaatatcacatgtctttttttttttcatctaaaaaatacttcattaatatgaatcagtgtatacaaaattatcaatgagattacagagataatcaatggtttatgtaacgaagaaaggataaagtaaattacgctccactttcttaatcaagtacttaatcacatgtcttatctgcttattttggaataaaaaataggaggccaatgttgggctattaatgggcctacaacctagcccgttagtattattttgttttctttaataaatccgctgttgataaaattaatcttctcctccaacgagactaatatttctagggttttgaagagtctctcgtcgccgtttgtaattcctctgtgagcaaatcgacaaaatg

SEQ ID NO: 28737 - DNA, 3000 bp, Unknown; identical to SEQ ID NO: 28736
  misc_feature (1)..( 3000): 2750-1469P.txt file - cDNA_ID_2998450; gDNA_ID_2926251; Annot_ID_204377

SEQ ID NO: 28738 - DNA, 3000 bp, Unknown
  misc_feature (1)..( 3000): 2750-1469P.txt file - cDNA_ID_2998458; gDNA_ID_2926251; Annot_ID_143039
atatatatatatatatatatatataatattaaatttacccgtattgttgtttttgtaggaggagttaaaattttagtgggatgagttgaatctgttcgtctagaagggtttgtgctccgtcgacgattggaagccattctacattcaataaaatccaacaatttctaaattagaaaataaattattatatatctacgtcttgtactttagtcttgcatctatatatttttttttataactttatacatattacaacaacacttttatataaaatacgatataaatcattgattttatttgacaaattaagctagttacacatgtatattaaacatgtatgcaacatacacgtgtatatgagctaattactaaactagttgagaaactaagctagttacaaactaagctaattactatgcaacatacacgtatattacaaaaaaataaaagcaggatgttcaatggattaatcaggctttcacataaaccggaatatgaattctatatccatttctttaaaatataatcttgttctaagttgatagtgtcgtgtggttaaaaaactctataaacaaaattatacacaaataattacttttaatggggattggcaactttctttaatatcaaagtagaaaaaaaaaaagagtgtaatgagagagaatgaatttttgtgttttgttcgtaaattctctctacactaatttaccaatatataaggaagaaacaattaatagaaaaagaaattataaaagaagataatattgtaccagcgaattttactggaccactgcttaactggagtgtggcagttttgaagtgcggtcctgtgttattatcctttgaaatccgcatctgtttttttttttttttttggaaaacgcaatttatcttttagttttattgattggtgaaaagtcacgtttttccacactctcactttaaaatccgcgaatactgtgtctccattcactgcctaaaaaccacaaaacattttgaaaacaaattaaaaatatatgcgatgtatgtttacaatttaagtatttgtattaattattaaattttacgaaataaaatatttgtaattgttaatttaataataaatttttttctttttaagaaacccattgaagaattttaccattagacgaacaaaaaattaatgaccaacagaaacttttaaacttaaaaatttcaaaatttatgattaaaaatttggaagaaaccctcatggtcccttgccattggggttgctctaagaacactaatttttgggtttgtagtgttcactaattttagttttgtagtgtgaaaactaaaacatcactaagctcatgaattacatcttttgtaccttgaatcaacttgccttataattttgtctaggaaactatttctttagtaattaacaatcacttactcgtatttgaaccgatgtaacaaaaactgtggatgacaattaaacaagaaaatgcatcacagttttgttatatgactataaacaagttagaaagtatatcatcatagtccaaaggaccaatgtaaatattgaaaatagtaaggacttcttataaacggcgagaatatccggaacctccacatttcttgcaaaaaatcaaacctacattaacaaaacaaaacttattcatatgttatcaagagactactgtatttagcacccaaaaaaacagaccaagaaaatggtttaagtattaagtacctgaacctttgcagactttgcaatcaaccatgccagattccaccttcatcttcccttctaggcaaaatacacatttcgttccgcctttgtgcgcaacccataaaacacaaaagattacaaagacaattagactcggaaaagagaatgcgctagaataccttcaagttttcgtaggaattttgtaggaaatttctttcgaaattctgacatcaattttcgaaataacctttgaatttcctactaaatatatttttcgtcacaatttcgtagaattttgatagataattttttctaccataaatttggtaggaaaccgggtaggaaaactctatgttttcttgtagtatatcaatgttaagttgatctagaatacctgtgaaactacagtatacattgtttactttcattgaacaatgcataagtatccaatcaaaagacaagcatgctacatagtaaaactagtttagaattttttttaagataatttacatagaacctaatggattttgatttcatgatataggtgactaaaaatttaataagacatatactaatcataatgcaaacaaagagagacagagtaaaagattcaccgtttccaccacatctctcacaaggaactggatctccctgaaacaaatcaataagacattaaaaagatcaaaaactcaccaaaatgacttattgaacgattaagtagagaagaataattgatacaaaaccttgaagccgaggaatagtgagagagcaatggctacaacgagactaatggtgacaataaaagtctgtgtatcgatgaatcctccaccgccatcgaaggcgctacttaggaaaagaacagaagggtgaatgatgagattagctgagtgttgatgaacacttgtccgtgacaacttgttacggtttctatggtggtggctaattagttcaggtttatgaaagaagagaagttttgttgttggttttaacgaggaagatgaagaagaagaagaaagaagttgcagagagatgagaggtcgactggccatggattcactcaaaaaaaaaaaaaaaaaaaaaagctaaggatcattcaaagcaaagaacatgtggatggagaagaaagaaaaaaaaaaaagaatccaccaattaatgggcctttagaaatatggcccatttagataaaaattgtactagttataaaaactcagcttcttcatcatcgtgactaaatttctagggttttgaagagtctctctcgtcgccgtttgttattcctctgtgagcaaatcgacgaaatg

SEQ ID NO: 28739 - DNA, 3000 bp, Unknown
  misc_feature (1)..( 3000): 2750-1469P.txt file - cDNA_ID_2998475; gDNA_ID_2926252; Annot_ID_143048
tgtttcatctttggttggggcaattagaaaactggaagatgagaggctccacttggcatttgagaatgtaaatctcttacggtcccaaatagttgagagggcttctgctagggaagaaatcagatggttgaagtcagattgggacttgcatatacagagactagaaaaggagaagagcgagctgcaggctggattggagaaagagcttgatagaagatcaggtgagtggacgtcaaaactcgaaaaattccagcttgaagagaagaagctccgagagcgtgtaagagagcttgctgagcataatgtctcactccagagagaactatctgctttccacgaaaatgagacagagaacaaagacatgataacacatttggagagaagagttgctgagctgaccacaacagcagataaattgcatgaagagaacaattatgttaaacaaactctctccaagttacaagagagttacgcaggtgctacagaagatcttgatttcttgagaagaaactttgaagagaaggatcaagaatgcagggagttgcacaaatctgttacaaagtttttcagaacttgcaaagaacaagggaagacaattgagggacttcgagatggtgtttctgaggaggttaagaagcaaccgtcagagaaattagaccagttggtcaagaaattgcaggtcgagcaggtaaggttgacagggatcgagctttcacttagaagggaagtagaatcaatgaagcttgaaactgactctcttcgccatgaaaatatctgtctactgaatcgattgaaagggaatggtcaagaaatagacattacaacccttaagctagagaatgagttgaagatgcgtgtctgctacttgcaagaacagggactgtcaatgttaaatgagagcagccagctgtgttacaagttactgaagttcatcaaagggaaattaactcagcttcctgaaacctatcaggataagaattcagtgaaggacggattaagtgagcagtttatgattgagtctgaaatgaaagtccatgggataaggcgcggaactgaaaacctgaagaggagtttgcaaacggtgaccagtgtggtagcttcgaattcagaatcgtcttcctcaaatactggtaggcctagggaacaaagaaaccaatcagttgaagtaagtccacggatatgtccatttcttaatatctctattgtattttcttgtatgtcctgttttgctttacactaatatgtggctaatgtatacctggcccaatctcatgtaggaaaacttgcgagcagaactgagtgctgagaccctaatcacaagtttagtgcgggagaaactgtattccaaggaaaaggaaatcgaacagctccaagcagaactagcagcagcagtacgaggtaatgagattctgagatgtgaggtccaaagcagtttagacaacctatcagttacaacccacgaactgaaagacctcaagcatcaggtattgcaaaacaagaataacacatatcccatgtctgtttttgtatataaagaaactattcccatttataaaatgttaactttacgctaatcttttttgacatcagatgttgaagaaggaggaaagcataagacggctcgaaagcaatctccaggaagcggcgaaagaaatggcgaggctgaacgcactattgtcaaaagtgtctaatgaaagaggccagatatggagtgagtataaacaatacggtgagaaaaacatgcttttgaactcagagaacgagacattgaaaggaatggtagagaaattggaggagaaggtattagagaaagaaggagagatcacaatactacaagacacaatcggaagcaagcatctgaatctcctctcaagtcctgatttcttggtataagggtttttctttatcattgtttcttagacgatgggtcattctttggggcttatagatatgattgtttcttcttttatttttacttttcttcttttggattgcttatctcaaagctggattctctctagtttcagatttgtacttaaaaatgggcttataaacttagtggtgaagtttatggtaaagaaagtttgtcatttgactcaattctattcaataaatcttcataagccattagttcaaaaagagactagcaataattttatatatatactatcttacataaatatatatatatatatatatatagacttggtatttttacttttttcactaaatatatgatcacttttcactatagttagtcattctttttctcaataagtttgacaaagctagtcttatattattttttttcctacacttgtagtaacaaattggtaccatattttagagaatatttcataaaaatagtagaggtattaaatgttgcaaaaaaaaagtcaaaccgttaaagtcaaaaagaaatggagagacgacaggtagagaaaataaaatactataaatttaccagaaaaaaaaaaacaccataaacacgatgaccgcgactatcggtactttctctctctaaaaaaaacaaatccaacgtctccgtctcttcttcaaacgcgtcttcttctctattttaaccctctttcatcgtctctttcgctttttataggttttgatttgtattagtaatcatcttgctaatctttccccctcattgatctgaaatcgaatgatggattattattctactccaagcttttgaaataaggaaccctatttctttcatctaatcctcgatttcatcaggtatttcaaatcaattacccaatcaggttgatgggtcaaagttgaaacctttagattcatatgtggatggagttatgtaaagttttcttcttaatcaaaatttgtttctcccagatgcttgttatcagattgatgggttaaaagttaaaaaatttagtttcctatgttgaaaatttggagactttatccttttttcgattctagattactaaatgttttgtttttgtttgtgtggaatgcagattaatg

SEQ ID NO: 28740 - DNA, 3000 bp, Unknown
  misc_feature (1)..( 3000): 2750-1469P.txt file - cDNA_ID_2998479; gDNA_ID_2926252; Annot_ID_143051
ttgaatacgagaaatccaaaacgcattttccatccaaacgctaagaatattattgttaacaacacaaacctaacagatttctcatgatgatgcaactcattcaacacatagaaccttcgtgttcacacgcttccacacgttacttcatatatataaggcctatacacagatactagcaaaacagagaacaaagactaacattttgatcatgcaaagagtgttttgattttcaagtgtaagcacatcatttctcactttaccatcttttgttctaaatgtctcgcatactagtagaagatgataatgcaacaccgtttcattccatggagattattagctcatctttgactttaggccaacttctcaagaacgttagcgacgttcgtaaggttgaagttggtgacgaaactcctgttcatgaattctttgacagggatggttcttcacttgacggagataatgatcatcttatgcgtcctgttcctttcgttctatctttcaacaaccttacttacaacgtctctgttcgccggaaacttgactttcacgacctggttccatggaggaggacatctttctccaagaccaagactcttctagacaatatctccggtgagactcgtgacggagagattcttgccgttcttggagctagcgggtcaggtaaatccactttgatcgacgctttagcgaatcggatcgctaaaggaagcttgaagggcacggtaacgcttaacggagaagctcttcaatctcggatgctgaaagttatctcagcttatgtaatgcaagacgatcttctcttcccgatgcttactgtggaagaaaccttaatgtttgcagctgagtttcgattaccaagaagcttacctaaatccaagaagaagcttcgagttcaagccctaatcgaccagttagggataagaaacgctgctaaaacaatcattggagacgaaggacaccgtggaatctccggtggagaaagaaggcgagtttcgatcggaatcgatatcatccacgacccgattgttctcttcctcgacgaacctacttctggtttagattccacaagtgctttcatggtggttaaagtattgaagagaatcgcagagagtggcagtatcattataatgtcaatacatcagccaagtcacagagttctcagtttacttgatcgtcttatcttcttgtcacgtggacacaccgtctttagtggttctccggcgagtctaccgagctttttcgccgggttcggtaatccgataccggaaaacgagaatcaaacggagtttgcactcgatctaatcagagaactcgaaggatcagctggaggaacaagaggattagttgaattcaacaagaaatggcaagagatgaagaaacagagcaatcctcaaaccctaactccgccggcttctccaaacccaaatttaaccttgaaagaagcgatttccgccagcataagcagaggaaaactagtctccggtggcggcggtggttcctccgtcataaaccacggtggcggaaccttagccgtccctgcattcgcgaatccgttctggatcgaaatcaaaactctcaccagacgctcaatcctcaactcccgacgacaaccggagctactcggaatgcgattagccaccgtaatcgtcaccggattcatcttagccaccgtattctggcgattggataattcaccaaaaggagttcaagagcggttagggttcttcgcattcgcaatgtcaacaatgttctacacttgcgccgatgctcttcccgtgttcctccaggaacgttacatcttcatgagagaaacagcttacaacgcttaccggagatcctcctacgttctctctcacgccattgttaccttcccttcgctcatcttcctctctttagctttcgcagtgacgacgttttgggctgttgggcttgaaggaggcctaatgggctttttattctactgcttaatcatcttagcctctttctggtccggaagctccttcgtgactttcttatccggcgtcgttccacatgtgatgttaggctacacgatcgttgttgctattttagcttacttcttgcttttcagtggcttcttcatcaacagagatcgaatccctcagtattggatttggtttcattatctttctctggttaagtatccatacgaggcggttcttcagaacgagttctcggatcctacagaatgttttgtgagaggtgttcagcttttcgacaactcgcctttgggagaattgacgtatgggatgaagctgaggcttttggattctgtgagccggtcgataggtatgaggatatcgagctctacgtgtttaacgacgggtgctgatgttctgaagcagcaaggagtgacacagcttagtaaatggaactgcttgcttatcacggtaggtttcggattcctatttaggattttgttttacttgtgtttgttgcttgggagcaaaaacaagaggaggtgaaactgaaactactgatgatacctaaaaccaaaaacatatattgtaattctttttcattacttgtaattcgtagattgattgtgtatttgaattgtattctttttaacatttgtattacttttgccatcaataaaaaaaatatcattctttaggaaattggaaatacaaaaagcacctatgaatcgcttttactcagaaaattaatgcaacatttcaaatagaggcattgagattgtggaagaaaaatgaggagacacagacactgttgctagaggcaagtaactctcaaagccatttcactttgtaaggtatcaaaaagtcaaaattggaaggctatctacaaaatcaattaaaaacaaaccgatttatctgaaatttaaaaccgaaacaaaccggaccgaatcagcatcagaatatcgtctggtcctggccgctctgctctagccgcagtcgaaacacgagtccataatacgagcggtggttgctcacgcgccatccagtttggctggagatg

SEQ ID NO: 28741 - DNA, 317 bp, Unknown
  misc_feature (1)..( 317): 2750-1469P.txt file - cDNA_ID_2998483; gDNA_ID_2926252; Annot_ID_143055
tatctcaaataaccaaaatatataaaatcaataatatgaaagataacgatagaaaatatttgaaattatcctaactatgtgctctgcatatttaagggctcaaagcttcaaccaccaattgtcaatgcatctcccaatcaaaatataaaaaaagagacgaaaacgaaagtacacgtgcttacacatccaacactcgtaatcgtaactattgctacctacccttctctcttctacttaaccccaaaggccccaaaaacacaatcaagaaaagctctgtaacattattatcaatcgaaattccaaccgactcaacaatg

SEQ ID NO: 28742 - DNA, 3000 bp, Unknown
  misc_feature (1)..( 3000): 2750-1469P.txt file - cDNA_ID_2998486; gDNA_ID_2926253; Annot_ID_143056
ttgtctctaattccggtttggctgacattgtatagtcttttatctctcatgtcagatttcctcgaacatatcttttggattaccttggtgtttcatttgtgacttcaatattttttcaaagctttccatgtatgtttgaaacttgaagcttcgatcatttatttttttctgtgtttcattcatttgcctatttgactcttagaaaatcacagaccagtgagtgtaacaaagtcgcagtgtacaggctctctttcctaatccaaaacgacatgtagtttttatgactagaactgaacgacaagatgtttttcttttgttatcccaattcttaaaactaaaacggctgcgtttagtaacccgcgaaacccactaaactctttagttctctctctcgttcccttgcccctctccctctctcgtcctcggatttttctcgtgcttcactgataatccagcttgacgatgtcgttgacggagctagacgacggactggttcgcaggatggccatgggcgcagtcttctctgattttgtacgaacgaatttttctctttttgtaatctcatttgatttcggattaaactttggtggaatccagcttccgagattaatccgttcaatttctcggtgttggttttacacagggagggaagatacattcggtgggtttccataggactgatgatctattggtcacatccagcgaagatgattcacttcgcctcttcgatatcgccaacgctaagtcagttcttccttcctgtttttaggttttatacttatctggtcaagttctagagaaactaggttacttaaggaatcaagaagaagctttttgattaaccgattagttgaaattcttgtggagcaaaaagaagactgaaatattcaatttgtatggatgtttgttagacagctgaagattacataccataagaaacatggcaccgatcgtgtatgctttacccatcatcctagctctctaatttgctcttctcgatacaatttggagtccactggtggtgagtcctccttttctcttgcttgagattggataatcaaagcggtggtggattattacttacttgtatacttgtttttgtgtaccagaatccttgagatatctctcaatgtatgataatcggatcctacgctactttaaagggcataaagacaggtctgcttataacctctggaattgtgaatttggattttactagtatgtacattgatgatggaaaatgttcttctgtttcagggttgtatcactttgtatgtctcctataaatgatagcttcatgtctggttctctcgaccgaagtgttagactctgggatcttcgtgtaaatgcctgccaggttggtttctatagttttacactctgagaaggctagatggaataagtcttaatatgctagagttttaatgagaaaagtgcctttttctttttgttagcaaaaacctcgtgatatatcaccttgaaagttaaacttgatgaagatgctggaaccacgaaacattgagaatatttaggctctttaccttaatactctctctgtgaatttatatggtttcatgatctatgcttacccttttagtcaatagggaattctacatctacgtggtagacctgcagttgcgtatgaccaacaaggccttgtgtttgcaattgcaatggaaggaggtgctgttaaattatttgattccaggtgttatgacaaggttagcttcttacaatgattcacacagccttacgcatgactgctcttgttagttctaacttctaaacccaattgatctcttatgtagggtccctttgacacatttctggtgggtggggatactgctgaggttaacgatataaaattcagcaacgatgggaaatccatgctcctaacgactacaaataacaatatctacgttcttgatgcatatcgtggagagaaggtaatcacgttctctatctttcacctgaagaagacagaacgttaggtttcaagttggtaaaagacggtatgttattttgcagaaatgtggttttagtttggagccttcacagggtacacccatagaggccaccttcacaccagatggcaagtatgttctgtcaggtaatacgcgttcctagatgatcttttatcatgactcatctacacaatattcaaatttaatcagcttagttttctttttcggatacaggttcaggtgatggaaccttacatgcgtggaacatcgagaacccatctgaggtaaagtgcagaataatcaacaccactaggacactgattcacttaaaagtgatgaataatttataaagttgtagatactatttttgcgttatgctttcacagtatttaaattttagtggggattttgtgtaaaaagcaggtggcgaggtgggagaacaacataggagtagtgtcgtgtctgaaatgggcaccacgtagagccatgttcgttgctgcttctacggttctcacattctggatcccaaacgacggtgaatcaccagcccccgccgatcctcctaccgatcaacaacagtgacgacatatatgtttccattatgcacttgtgtatcgttttttaatgttgacaattagaaaaatttggaagcagtagtatgttaatcaaatttagagtttatgaatttgagtctagatggttacaatatgttttctttaatgactatttactcttattttacgtaaaaaagatatggatgaatacatacatcaatgttcacgtaaactggaaaagatttcacgaaccatgatcctaataaaaaacccagaagaacaaacaacaatgagcatattgggccttaaaagcccatggtataataaacctgagaagaagtcaaataggtcataagaagcccattatatcgtcctcttgtaccccgacttttaacaaatcgttttggctaaaaccctaattctctgtctctctttttcctctccgcgtctctcgttccttctctggtggcgttttcaccatg

SEQ ID NO: 28743 - DNA, 3000 bp, Unknown
  misc_feature (1)..( 3000): 2750-1469P.txt file - cDNA_ID_2998490; gDNA_ID_2926253; Annot_ID_143057
taaaatcctgctggttcttcttttgtccctccatcgagttgtgtttgagatttcatcgttgcagaaagtaaatagttatgggccaatttaagttagtaggcccaactggcttcagcaattagttgaaatgctgacttagaaaaagcaacaagaccgatgaaaaatgatgacattatttcatcaggaagttagaaaatcatataaaatcgaaatcaagggagactaaaaaaattatataatgcaatctttcgatctaataaaatcggccctgttctcggataagcagataatggatctcatgaacgacaacagcaacaattcacaagacggcgatcatcagaactaccgtgtcggcgataatggattggaatcgaagaaggaagctatcttccctagctatgatttccaacctatgcgccctaatgcctccgccggattgtctcaccacgctttagatctcgccggatctgttaattccacggctgctagggtttgggatgcgtctgatcctaaaccggtttcagcttcttccgcaagagtaatatttctaagttctcctatatctcccggtctttgtgatttgcgatcaatctagcttcgtttgttggcttcactagttaatcacgattttacgttatttggcttattagaatcggttcttaaggtttctttaggtttagaagatatgtactagttctggttcttgttcccaagctcggctctgtgttattcttcactgtgcttacatttatcatcgtgtgaagttgaaagcagagactttgtgtaacaacgatcatttgcttatctgttttctacattataatgtttgcttaaaccttgcttgatgcttgcatggttaggattatgacaattatcacacttagccttacttgttgcatttgttcgttctttcagagttatggctctatggactctctcgaaccttcaaagttgtttgctgagaaggatcgaaattcccccgagtcagcgattatatctgcgatcgatcggacaatgaaggcccatgctgataaattgttacatgttatggaaggtgtcagtgcacgtctaacgcagctggagaccagaacccgagatctcgagaatttggttgatgatgtgaaagtttctgttgggaacagtcatggaaaaactgatggtaaattgagacagcttgaaaacatcatgttagaggtactctactcttttgggatacctaatggagattaatttgaaattagaaataatcacatgaatctgagatactagacaaacgttcttctctgccttttggttttggatgccatttcttgactggcctgggaattcttgatctgttaacgtcaaacaagtttctggtttcatatttttcatgtttcaatgcatctgagctttcatacttttcgctatatcatctatcaagatcctagattcctcagttccttctttgtatgattgcattcaggtgcaaaacggtgtacagttgttgaaggacaaacaagaaatagttgaggcgcagcttcaactttcaaagctccagttatcaaaggtaaaccagcagccggagacacactctacacatgttgaacccactgctcagccgcctgcatctctgcctcagccaccagcttctgctgcagctcccccgtctcttactcagcagggcctcccaccacaacaatttatccaaccgcctgcctcacagcacggtctctcaccaccttcattacaactgcctcagcttcctaaccagttctctccccaacaagagccttatttccctccgtctggtcagtcccagccacctccaacaatccagcctccttatcaacctcctccaccaacccagtcattgcatcaacccccttaccagccacctcctcaacagccacaatacccgcaacagccgcctcctcagctccaacacccgtcaggctacaacccggaggaaccaccttaccctcagcaatcttacccgccaaaccctcctcgtcaaccaccttctcatccacctccaggttctgccccatctcaacagtactacaacgctcctccaacgccaccatcaatgtatgatggaccaggcggcagatccaattcaggttttccttccggatattctcctgaatcatacccgtataccgggccaccttcacagtatggaaacaccccatctgtgaaacccacacatcagagtggaagtggatctggtgcctacccacagctcccaatggcacgcccactaccacaaggtttaccaatggcatcagccatcagcagcggtggaagtggtggtggctcagattccccaagatcaggaaacagagccccagtcgatgatgtcattgacaaagtggttagcatggggttcccaagggaccaagtgagaggaacagtgagaacattgacagagaacggtcaagctgttgacctcaatgttgttttagataagctgatgaatggagatagaggagctatgatgcagcagcagcagcagcaaccgccaagaggttggtttggtggtcgttagctgtgttgtctctaattccggtttggctgacattgtatagtcttttatctctcatgtcagatttcctcgaacatatcttttggattaccttggtgtttcatttgtgacttcaatattttttcaaagctttccatgtatgtttgaaacttgaagcttcgatcatttatttttttctgtgtttcattcatttgcctatttgactcttagaaaatcacagaccagtgagtgtaacaaagtcgcagtgtacaggctctctttcctaatccaaaacgacatgtagtttttatgactagaactgaacgacaagatgtttttcttttgttatcccaattcttaaaactaaaacggctgcgtttagtaacccgcgaaacccactaaactctttagttctctctctcgttcccttgcccctctccctctctcgtcctcggatttttctcgtgcttcactgataatccagcttgacgatg

SEQ ID NO: 28744 - DNA, 3000 bp, Unknown; identical to SEQ ID NO: 28743
  misc_feature (1)..( 3000): 2750-1469P.txt file - cDNA_ID_2998490; gDNA_ID_2926253; Annot_ID_204434

SEQ ID NO: 28745 - DNA, 3000 bp, Unknown
  misc_feature (1)..( 3000): 2750-1469P.txt file - cDNA_ID_2998494; gDNA_ID_2926253; Annot_ID_143059
ctccaccttctccatccctcctctggtccccgtcatctcctccgacctcaacctctctgcctccaccgtatccgccgccggaatcgcttccttcgctggctccatcttctctcgcctcgctatgggaccactctgtgatctcatcggaccacgtacttcctcagcgattctctcttttctcaccgctcctgtaatcctctccgcctcactcgtctcctctccgacgtccttcatcctcgtccgtttcttcgtcggcttctcgctcgctaatttcgtagccaatcaatactggatgtcctccatgttctccggtaacgtcattggtctcgctaacggtgtctcagccggttgggctaacgtcggcgccggtatctctcagctccttatgcctctcatatactccaccatagccgaattccttccacgcgccgtcgcctggcgcgtgtccttcgtatttcccgccatttttcaggttacaacggccgtcctcgttctcctctacggccaagatactccccacggtaacagaaaaaactcgaaccagaacaaactcacaattcctgaagaagaagaagtactagtagttgaagaagacgaacgttccagtttcgtcgagatcctaatcggcggacttggaaattacagagcgtggatcttagcgctgctctacggatactcgtacggcgtcgagctaacgacggacaacgtgatcgccggatatttctacgagagatttggagtgaatctggaggcggcggggacgatcgcggcgagtttcgggatatcgaacattgcgtcgcgaccggcgggagggatgatatcggatgcgctggggaagagattcggtatgagagggaggctgtgggggctatggatcgtgcaatcggtggctgggttgttgtgcgtgttactcggacgagtcaactcgctctggggatcaatcctcgtcatgtgggtcttctctgttttcgttcaagctgcttctggccttgtatttggcgtggtccctttcgtctccacgcggttagtttaaagtctaccaatccggtttttgctaataatttcggtttggttttaatttggttttgtttataatgacagatcgttaggagtggtggcgggaattacgggaagcggcggtacggttggtgcggtggtgacgcagtttctgttgttttccggtgatgatgttcgaaaacagagaagcatttcacttatgggtttgatgacttttgtgtttgctctttctgttacatcaatttactttccacaatggggtggaatgtgttgtgggccttcgtcatcttccgaagaagaagatatttctcggggactccttgtagaagacgaagatgaagaaggtaaagtggttagtggtagtctacgtcccgtttgttgatgtcgcatttgaactgctggcccatttggccaaagcaaaagcaatagcaaaacattagtatactactaataaggacgaatttgctgttatcaagttaaagagtctatcaatttttttaaatatatatatgttcttgtttgtgttgaaattctccttccataaacaacactagagctgacaacattgcaaaacaagacataattagtttgtatcctttttgtatctcttgtaacaatataggcaaagtgactctgacaaatcacaatcgtgttgatgagctcattgtgagtttctttcttcctctgtttcttttcttgttaaaaaagaacaaatagcaagaaaattaaagtagatccttcatcattcaaagcgtacgtaagattaccaagagtttctacgtttgtactacttgtgatttcatttgtaatactaaagataacgagtttacatagaaacttacaccatttggtaaatgaatagaagccacgggccacggcgttgataaaacatggacggtagagaaagagctcagcaggggtgacctgagaacacatgaaacgagagctgtaacaatgacgtagcgtcgttatagccgttgattgctcgtgtgttctcatatcaaccctgtcgagatccactaccttaacaatatttatctatcttctaaaccagtaataaaaggactgttacagtttgagtttcgatatccttcaaatctgctgagagctactatatatacacaacacaacaaatgatgaaaggattgtgtagtacacaatattaccacacaaattgtagtacacaacacaacacaacaaacgggccaacgatttgttgcattcatatacgttttctttagtacaataaaaaaaacctacagaattgtgtactgcgaaactgatttacaaaaaaatcaacattgtacttctctgacagtagtacaaaggcgagttttgtactagttggaacgtcaaagaggtactaggaagtgttccaaagatgccctcacgtgtttgtttattatttcacactactgtgatatttatttcacgaaccagttttctgtaaattttgaattctgttaaaaaaatagttaacgaaaagaataaaataataatttgctgggtaagaattggaccgggcttaaaatatcccagtgggaagtgttcgctttaagaaaaaatcagagagagaggcccacttcaccagctctactcattgattttacacactcaccagcacctctatttctttctcactctccaagtctcctctgtgaaagctgaaagctcatcttcttccacgtgatttgtcttcccgatcaccaaacctttccggtaattactctcccttgcgttcgacgccatcttccttggagttctcttcaatcaaccggtaaatcttccactgattttgaagaagattcttccatgttcgatctggttcgtctccagagatcgagagttgaattgcctcgaaacagctctagtttcaccagagacgcgcgaccgatagaaataaagagactcgaagctgcgtgtaccggagacgaatggcgggaaaattgacttgagcgcgattttctgtgtggatccaaaatg

SEQ ID NO: 28746 - DNA, 3000 bp, Unknown
  misc_feature (1)..( 3000): 2750-1469P.txt file - cDNA_ID_2998498; gDNA_ID_2926253; Annot_ID_143061
gttgcgggtgtatctgttggtcttatcaccgatgtagatccatcaagtggtgaaataaaggactaccgtattgtaaccgatattctcgtgagttctcttattctaatttgttgtctttatttttatatggttagttatgtgaataatcatgaaactgaaatgtgtggcagtgcagtagttaatttaactgttgttgtctaaaccatgagtagagttaagttgctaaaatggattttatagaactgcatacaatgacttctcagggtttggaagatcatcttggagatatggatttcaagattgctggcacacgagatggtgtgacagcaattcagctggatataaagccagctggaataccgttggatatagtttgtgaatccttagaaaatgcacgtgaagcccgtcttcagattcttgaccacatggagagaaacataaattccccacgaggccaggatggggcttactctcctcggctaggtttttttcccacttgtcttttcgttaaccttagctaatagaatttcccctgctcaaactccaaaattatgtccgtcttgcagcaacgctcaagtactccaatgactcacttcgtaccttgatcggacctatgggtgtactcaaaagaaagattgaagtggaaacaggtgatttcttgacttcaactttaattgttaacagcttagttcttgtgacctttaaagactaaggaattgaataactcgtttgaattgaaaaatttaagtgcttttaagaaagtagtttcaagatgaaattcataaacttatgaataatatccacttgctttcttatagtttgctttgaagatctgataaataagtttttttgtttaggtgcaagattgtctattgataatggaacattaactattgttgccaagaatcaggatgtgatggaaaaggcccaagaacaagtatctttcagtcaattcagcttttaattgatcaatgattttccatgaattctgattttatgcatgtcctcaggttgacttcatcattggtcgtgaactagttgttggtggtgtgtacaaaggcacagtgtcatctataaaagagtatggtgcatttgttgagttccctggtggtcagcaaggtctactacatatgtctgagctatcccatgaaccagtaagctttcttagttacaaactgtgtccgtatgtttccccctgagtattgttttctcatgtaaacctaaatgttttcatctgccaaatcttagaacgacaatccgagagctttattttctttgccattactctagttgagatttggtttatacttaccttgtctttatgcaggtctccaaggtttcagatgtattagatattggccagtgcatcactacgatgtgcattgaaaccgatgtccgtggtaacattaaattatcccgcaaagcactgttgcccaaacccaaacgcaaacccgcatctgatgctggaaaagatccggtgatgaaagagtcgtcaacagtctacatagaaaattctagtgttggagagattgttgcaagcatgcccagtatcgtaacgccacttcagaaatctagattatcagttcctgcagttgtcatccgtactgctgtggagtgtaatgaggcagagaaatcttcccctgtgaacgacaacgacaaacccagacgcgctgctacatcaaagccagaccggaaacccaaatccacagcctctaaactgattgcgacacagaaggaagaggaggcactcgaatccattgctccagaagaaacttcagctgaatgtggtgagatactgaagcaggacgggaagctaaaatccgtttctcccaaaaacaatagcactgcttctaacctagtatcattttcaaaagctaagaaatcaactatgaaggagaatctatcagagaacaaggctgaagagagtgcatcggttagtacccgaaaactgaaaataggaacggagatgacagccacggtcgaccatgttcgagcccttggattggttcttgatttaggtggtgaaatccgcggtatgtacatattccaggtatgtttcagtaaattctcctttgacttgttctcccattttcttgagttaacttttgaggcgatatacttaattcttgctttgtattgatattgtgtactatgaatgagtacagggagataaagataagttcaaaaaaggagacacattgcgagtgaaatgtacaagttttaacaccaaaggagtccctgtgatggctttggttgacgaagagggagaagaatagtggtaaactctctttcctttctacaaggttttttcaacccaagggatcatgtggagtcgatcatatggatcatacgagagttttgcttgaaatgtttttatcatacggatcgaatcaagagatgctcgttagctgcttttggtgagcaaatcttggtagatggatagattcattggcgtcacaacttgaggaaagctaatgaactcggttaggtaactagtcttttactttggccttgtgatgtgccattttgtttctcttttattgggggggttttgtggaaccgaaagtggattgtattgtttagtgtcttagtaactgacgtctgaaaggtgcgtaacgcaagtttcatcatttttgtccaatttttacaaaaatacaaaagcaccaaaaacccaagtcggcagctaaagatagaaactacgcatcccaatggcattcttgatagatattatttgtccgaatatattttcttctaaattacaaattcatttcaacaattgacgtcaaaaattaatttaagccaagagacgaggaactaaaattgaatttcacattttgattgagcatttgggtttgaattaagattactcgaaagttgccaaaagtttgcctctgagtcattttattgttcatgaaagatttaaattcaaagataatgttcattgattgggtggtcgtgtaagtaagagtcgtcagcgagttttcttctccgagagtaatg

SEQ ID NO: 28747 - DNA, 3000 bp, Unknown
  misc_feature (1)..( 3000): 2750-1469P.txt file - cDNA_ID_2998502; gDNA_ID_2926253; Annot_ID_143063
tccttgtttttccttggcttcggcttgtaataactcgtctgagaatagttccggcgtagaattcaccgtcctccacgcgatatatcctgcgagtaccgccgagaagaacactaatacaaatctcaagggacacataatttcttgatggataaagggaaaattataagaagaggaaaaaagaatttggattttgatctcaggctttcgaagaatggatctctagggtttgtgaatagacaattgtaagagaaagaaaattaaacagacgttttcgatatttatagagtgcattacatgtctccttctcccatcgagaaaaggaaacgcgtttctatttatatattacttgtagaacaatttatctctagaaactactatttatcatatttcaaaattttggattttggttttgtcattaccaaatttcgaattttgtattctagaaacaaattcacagcaattatttttttaacaaaaagaaagcgtaataagacaaatcatgaaaatatctaatacatgaatatcataatgtagttggagaatttggactaagctagacattggagtcttgcaaacgttaagtaaccggtgtgacctcttgcttcactacaaggccgagccatgacgactgaagaagcattagaagagttgtcctgtgaaacagtgtcgttttcgtttgaacggtgctttctcttgcaaggcctcattccttcattgtcctcctcgtggctctcaccaaccatgctactggtatccattttcacttccttcacttcatatgttctgagaagcacctcaaacgttcttatctctgcaaaaaacaaactcatcatgagcaaaaaccggtataagaaagaatgaaactctcaaggaaataaggacttatatgcctatgacagttggttttgattcccctgactttccaaggccaaagaatgtcaaactatttctctaaagatacttatctacttaaagcaatcctttcgacttattaatccaaagatgtgtgaccatagaaagtcgatgatacatattggaaaaaattgtagactaaagaacagaacttcagtctatacaacatgattttagtactagccactaggatttgaaaatcgaggagaggttcagtcccaaattcactactttagtactttgatttttaggatccttccaaggcaagagcattcggataatgtgtagatctagagctcttttagtttgagttggagaagaaagtagaaagagatgttgtaaatcagaataaacttaccaatgaaatctgatctgaggacttcacaagtccgttgtacttgctcgatgcaaggtgagaaagagcatagaactccatcctgctttaacatctttgctgcagaaggaaccgcaagccaaggctgtggaaggtctagaaacacagaatcagccaaacctgacagtttctcaggaaaaccctctccttgaatgtctctaacctctacggttactaaactacttatgcccgtcttctcaaaatcttccctgttgcaaagtaaagtaaaggatgaataaatactatagcttcaaaagaaaagcacaacgagatagctaaagaaaacgaaagtttctaccttgcagagacagctcgctgctcatggaaatcaaatgaataaacgtgtccagttggagccacagctcgagcaagtgaggtcgaaagcgaaccactacctgtgcctgactcaagaacaacacagccaggcacgacttctagatacataaccacaaagctaatatccgcaatgtaaagaatttgagtcctgtggcttaaaaccaatgtccatagttcaggagtaggagccaacaggtacacaaatttacccttgttgctgaatactttcgtccctaatggtttcccaatccaatccgagtgcttatacacaccaaaacggttctgaagcacaccgtctttacttactttaactggtttcatcacatcatgtctttcgtaaacaataactaagtccccatcttcaatacaccttttgaatgaaaaggctttctttgactcagttggtaacatcttgagattatgaaatcacttgtagattgagttccagcttctgctctgcaattccaagtctcattgttaattactaaacaacacactttttaactcagaaaacaatgaattctcacaaatcacgatatatattcccaatctagctatcaatccaaagctacgcattctacgcaatattgcacagccaatcaaacacattgagattcaaaatcattgtaatgaattagcttagatgcacagaagaaaaacaatttaaagtttgattaagttaaaatttaagaaaaaagctagaaaaatcccattcacggatccaaaagtcctaacttcaacgaagagacacaattttttaatacaagcgggtaaaaaactggaaccaaacacaattaccagcttctataagataaaaagctgaaagaaacagtttaacaatagcgaaaaacgacagaaatactcacagaggaataatcacgaagaaagctaagaacttgagctgataatggagtttgggtaataatgttttgtgagaaggaagaacaataaatctgaccagacaaagaaataaaacctctaagtagggttttcgctttccttttttcaaatcaaatcggacattgagaccaaccggaccatattacagatttggtaccttcgaaccggcaaatccggtttgggtttatatagacagaaaaatttactgggccttatgttgggcctactgaaataatctatacggctctcttttccttcttgtttaccttgccttttcgccggaatcgtcgattattagagagctcagagcacactttagcaataaacttgccgaccgaaagctgcagattcactgattcagtgatcgaagttgagagtttgggttgaggtcggagtctcggatgctgaataagctcacgcacggcgttttcacgtaccgtgccagcctcaccgccatg

SEQ ID NO: 28748 - DNA, 3003 bp, Unknown
  misc_feature (1)..( 3003): 2750-1469P.txt file - cDNA_ID_2998506; gDNA_ID_2926253; Annot_ID_143064
tatattttttaatttataccttgggcaagaagatcgctttgaacatcaccgtcgtagtttttgcaagcccagacatagccaccttcacttttgactgcgtaagccaccatgtcatcaatcaaccggtgctcgtacctaaaccaacagtattattcacatattacctttaatgaatatgtaaagaaaaaggacgcagaacacaattttttaagaaaaaggaccagattgagtgctcttcaaacttttgcttccaattcgcctcataaacttcttgaaatatgtccttaaatctgtattgttccaccacatattaaagcagctcgcttgctgaaaagtgaaacccagacttcaaatcaccaagaagataaaaacaaacctgccatcatatttcttgagaattgtgttcttggtgctcaagtataatggccatttcttagttaatgccatcgccatagatgactcagcaaaagctctaattgactggcatgtcacaaaaccagcatggttgtcagaaaccaaaaccatgccaaaactaaagccagttactaaaagagacagacctcatctacgttgtacatagcaagtgcgacacctgggcccttgaaatcatatacatctagctccacaggtgcgtttccatcttctgggactaattagacaagagatgtatccacttagaatctgaactatatgattgaagaatcctcattgtctaatgaatatagtttggtatgatcttaccaaaaaccattttcaactttcctggccctttaattactgtatcagtggcacgatactggtcaccaaaggcatgtctaccaatgcatataggcttttcccaacctataaagacaaaagatttgagttctcatttggtatctcaaaacagatcctaacacagattcataacaaggcaaataaatttaccaggaacaagccgggggatattgctgcacataataggttcacggaatacggttcctagaaaatatagaacactgtgtaagaaatgtgtagatactagattgtaaaagaacctgctaacaggataaaataaaaagtcgcaagcaatttaaccaagatattcctattcagcaaacatgcattgttttttgacaatacagagacaaaccatctagaatgtttctgatcgtcccattaggactcctccacattgatttcagtccaaactccttcactctaccctcatctgccaaaaataacatacagaagatgtaaaaatgcttcctctgatcggaacaagcagcatatgtgttgcgatttgcgaaggacatcacataccaggagttatagtggcacatttgatagcaacattgtacctgcaaacataaaagttttaagcgcgaaatcagcttatttcacatagaaattaaaatgttttctgttactaaaagaatctaaaccatagaaaatgcaaagaatcaatagcacttacttaagagctgcttctgcactttcaactgtaaccttgtcatcagtagcatcgcgattcagaatccccaagtcgaagtacttaatgtccaaatccagataaggaagaataagctgcaaagacaagaaatcagacatgtgagctctgtcaaaaaaaaatgaaccaactgttgcagacttggtgataaattacatccttactttctcctttatcatactccatatcaccctcgtcatttcatcgcctgaatttccacaaaatataaacaaattagaaacattctcaaagataccaaattcagtaagaacataaacaaatgacttataccaatccaaccaattatctggaaactacgatcaaatgtaagtaaggaacactgattgcgcaaagaatctcaccatccatttcaacgataggattctgaacctgaattctatcagaaccgcctgaagaagcaaaacatcgaacagctgatgcgcgatgaaactgaacgggaaaagtcacgcgattcctcgaagcgccactagagaatataccggaactaagaaatctcgaagaaacgaacgaagacgataaaccagcagaggttgaagaagataacatggcggtgaggctggcacggtacgtgaaaacgccgtgcgtgagcttattcagcatccgagactccgacctcaacccaaactctcaacttcgatcactgaatcagtgaatctgcagctttcggtcggcaagtttattgctaaagtgtgctctgagctctctaataatcgacgattccggcgaaaaggcaaggtaaacaagaaggaaaagagagccgtatagattatttcagtaggcccaacataaggcccagtaaatttttctgtctatataaacccaaaccggatttgccggttcgaaggtaccaaatctgtaatatggtccggttggtctcaatgtccgatttgatttgaaaaaaggaaagcgaaaaccctacttagaggttttatttctttgtctggtcagatttattgttcttccttctcacaaaacattattacccaaactccattatcagctcaagttcttagctttcttcgtgattattcctctgtgagtatttctgtcgtttttcgctattgttaaactgtttctttcagctttttatcttatagaagctggtaattgtgtttggttccagttttttacccgcttgtattaaaaaattgtgtctcttcgttgaagttaggacttttggatccgtgaatgggatttttctagcttttttcttaaattttaacttaatcaaactttaaattgtttttcttctgtgcatctaagctaattcattacaatgattttgaatctcaatgtgtttgattggctgtgcaatattgcgtagaatgcgtagctttggattgatagctagattgggaatatatatcgtgatttgtgagaattcattgttttctgagttaaaaagtgtgttgtttagtaattaacaatgagacttggaattgcagagcagaagctggaactcaatctacaagtgatttcataatctcaagatg

SEQ ID NO: 28749 - DNA, 3000 bp, Unknown
  misc_feature (1)..( 3000): 2750-1469P.txt file - cDNA_ID_2998510; gDNA_ID_2926253; Annot_ID_143066
taagcaaacacatcatcagtttttccttaacattgatctccatatattcttacgattgaaaaatctgttgttggttcttaagatattccataagcgtacacctccagaagctgtagaccttgtctcaagacttctccagtattctccaaacctcagatcaaccgctgtaagtcaatgaagtgattaccataataacattatgtttgatatatctggttggttgattcaaacttacttgttattgtagatggaggcgatagttcacccgttcttcgatgagctacgtgatcccaatacacgtcttcctaatggtcgtgccttgcctcctctcttcaactttaaacctcaaggtctgtctcctccaaatatgcttttgtttgtttcccaatgctccgttttaacaaagactaaaagtgtgtgcttcttgttaaatatgtagagctaaaaggagcaagtttagagttgttgtccaagcttatacctgaccacgcccgaaaacaatgttccttcctcgctctctaaatctcttcctctctctctatatatatgtgtgtgtgtgtgtatgtacacatgcatataatatgcttatcgtttctaagtaatggagatagcttctcaggattatcattagctttcatctttcatgtatctttgttgtttattgtcttatcacaacctttgtactttattacatacaatgattagtgtaatgtatgtgacggtctttgactcgccggtcgctacagttatgttggatactaaattataaaataaacttctcgctcgtcacgtgtcattgcatgcatccaaagctcatgcttcaaagcttagccaaacttatttttaaaaaagcctatgttctgtgtaaaagtgtcatttacgagagtttcttgtttaagtttaaccaatttcacttcctcaaacgaaatacggtaattggtaatatcctctaaacatgaattatcattgactataaaaattagtttcgcaaattgcctctaagcaccacaagtgtcacgtaacgtgtcatttattcatgtttattgatttagttaattaaaaacattgtagtttaattattgaagtagtacaaagaatagggactaaattgcaatactctgaatttgtttttttcttttttagaatcatccgactttttgtttcacggtttcctcctccagtaaactgacgacgatacaagctctctcaccaacggcgacagtatctttgccggcggcgggagcgcttctgcttaatctgtagctcaaactaaaaattctctgggtattactcatggtgatttggaataacgatgatgatgattttttggagattgataactttcaatcttctccacggtcatctccaatacatgcaatgcagtgtagggtcgaaaatctagctggtgtagccgtggtaagtgatccaatccaacagtcataagtttatgcctaagcagaatcattgcttatgtgaatttttgttttgtttcagacaactagttctttgagctctcctactgagacaactgatttagttcagatgggcttctcagacgaggtttttgctacattgtttgacatgggatttcctgttgagatgatttctagagcgatcaaggaaactggtgaggcttttttctcttgtttgtattcctttctggatatatatgatccgtaacttgataccaataattatacaggaccaaatgtagaaacttcggttataattgatactatctccaaatactcagtgagtttctaatactttgatctcttgggttgcttgtcatttacatgtgcttctgtcatcacagtattcatatcctctcctttgtttatttgtgaagagcgactgtgaagctggttcttccaagtccaaggctattgatcatttccttgctatgggatttgatgaagaaaaagttgtcaaagccattcaagaacatggtacttacagatttctctcctccttaagtaagaagtaacactttatcactttgctgatatttgctttataaatcgcaggagaagacaatatggaagcaattgcaaatgcattgctctcttgtccagtaagcgatgttacgaaaatatactgtctcttgacattaaaaaaatagtacttaaagttcgttgatggtttgtaggaggctaagaaactgccagcagcagtagaggaagaagatggcattgactggtcatcaagtgatgatgataccaattacaccgatatgttaaactcagatgatgaggtataactctttcatgttggtgataacatatttaagcatcccaggtttgaattgtaaatgtatctcactgctattttgtatatgtatctaattttatgcgttcttaatctattttaaatcatgacagaaagatccaaactcaaatgaaaatggcagcaaaatacggtctttggtgaagatgggtttctcagagcttgaagcttctttagctgtcgagagatgtggtaactttattttaaacgattgccattgtcattaaattttagttccgttttgttcaggtttcttctagacaacgtcgtataaattgcttggtttagcctctgatttagtggtgtaggccttagatgtgtttgctgagcattttgattgtatttcactaatcgaaagttgtcattagttctgtcttagcttctggttctgtgatgtacgccttagatatgtttgtagagaatgtgatcgtatttcacaaaatgataaaagttgtcagtacttgataaaattgtatgttcactagttcctttttattcaggtttcttctagaggaagtggcataagccaaattgcttagttttagtgtaatgtgatagtcaaattgtggctttagcctctggttctgtgatttaggcttgaaatgtgtttgctgagcattgtgattgtatttcactaaatgatacagttgtcagatgttaatatatatctcttacttactctaagtatgttgctgccttatccagactcatatg

SEQ ID NO: 28750 - DNA, 3000 bp, Unknown
  misc_feature (1)..( 3000): 2750-1469P.txt file - cDNA_ID_2998518; gDNA_ID_2926253; Annot_ID_143070
aatcaaacgcactgctgaagaatctccacaagatccagctgatgactaaatttcaaaagcaacgcaaaaccatgcggtgatttcatgtctgctgaatcccgcaagcttttgagagacaataaatgggtgtgttgcagtacagaagaagaaaaacgttacaaaaaactcttttgattgatctagtaagtgcatctgtaattctagatgttattcgatgatactacacacacaaagcatcatatatattcgtgtttagtctccattctcgaaacataaaaacaaaaagttcctttatttgttgtgtaatcttagactcttcaatgtctttcatatatggctatccaatgtctggtctgctgtatctgattgcaaatgcttcttgggatgttctcgtttatcatcatggtcctagtattaactgagtactaaggaagtatcaaagaggtggagcaaatgaagcgtttcttggaggaattgtcatgtcttgagctcgttaacgttggcgcatccccaaaagaccacaaggaaaagctacgactcaccacggattttctaatgctacctaaagcttcttccaaattcgagatcaagttgagtttcttgaaaattaccatattggctctcatatttgtccaagtttgttggaacatgaatctacttactcttctgttggaccatttgagccctcatgcatagtgtatttgatttggttttattagggttctataaactgagagaatttgtaaaaaccttctatataaggaggaaaaggtatcatatctactctttagctaggaagaacatttccataagtttagaagaaacaaacaaaaaggtaaaagtaaaaactatcacaaatccatttttgacgttttaacacacaatgacacaagcatcaacggatggatgctataaaccgttgtaaaatcagacataatacttctttcttctccacaatcactaatggtctccaaggacaaaaagtgttcagcttcatcatgcctactcagtactcaatcaaaatgaaggtttgatcagtattcatgaataatgattttttcctctaaatgtctccaaaactgtatatatagatataatctaaaacccctaaggatgttatttaagtgcatcaatactttcaaaagagtgttcctttcaaatttctacttagttttaaaatgggatatttaagttatttaccttggtagcgatgttgttggagagccaatcaaggccttcatagagaccttctccagatgtggcacaagtgctttgaatgtacctgttaaaagaaaaaaacataagatacatgttatcacaatgtgatcaatctaaccacatttttttttatttttcaatctaaccacattaattaatgaaaaactttgtagaaagaaaataactttaccaatggcgttggcgaagagagtgaagaccaagcttatcagttatttctgcagcattcattgcgttgggaagatcttgtttgtttgcaaacacaagaaggacagcatccctcagttcatcctacaaacatggtataaatcaaattataggaagttgtttcagtctaactgtgtaacaagagaaaactagaaagaaggcaaacctcattcaacatgcgatgtaactcatccctcgcttccacaactcggtccctgtcgttgctatcaaccacgaatataagaccttgagtgttttggaaatagtgcctccacaagggacgaatctgtttatgtttttacggaagtgcattttaatgtcaaatatcagacaaaaaaagaagacgacaaacactcatagatactagacgtggagattaaaatttcaaattgagcttgcacgatatgaataaccaggttttatgaaagatcattactagtcacaccaaaaccagagcagagcataaagcatcacgaggacagtataccataaacatggcaagagttaaatatgtaccttgtcctgaccccccacatcccaaacagtgaagctgatgttcttgtattcaacagtctccacgttgaatcctggaaacgaaaccctccttaacattaaattttaagaaacaaaacttccatgcagaagaggattacataaaatccgtagcggaggattacacacaggtaagaaacacataaaatattaatctaagtgtacacatcgacagacactgtgatttaaggaatccttaaaccttaccgatggtcgggatggtagtgacgatttcgccaagcttcagcttatacaagatagtggtcttaccagcagcatcaagacctaccatcagaatcctcatttctttcttggcaaaaagccggctgaacaactttgtgaaattaagccccatttttttcctttagctagcacctacatccaaagcaaaccacaatactctaaagaaattctctgtataactgaagaccaacaaaagaaacacgaaacactaaatctttattgataaacacgatcacgttaacattccaaaaaaccttaacaacaaagttcgtatagattaaaaaaaatatagataatgagatccttgaacaaagccaagtgacgaataacacctttagaccatgaacaaaaagaagaagaacgtataaaccagataaatcaatcgatcaatcacttgatactcttaagaaagatggagatcaaagaccgagaaaatcaatataccagagattttgagaaacgatgatacagaacttgaatcgatgaatggtgtgagagtttgtttacctttcgaagaagctccaaagaaggacctgttgtagagcaagccgcgagtttcgaaagagaaaatgtctctcctcacaaaagctctaataatagaatattggttttaaaaatcgtccttataaaatataaatatttcggaattgcaccttaaacaaaagcagaattacaaaatggtctactcaatcttttacttactctccacacaaaattcagtttttccgcttcgtctgaaattactcttcctctctagccatg

SEQ ID NO: 28751 - DNA, 3000 bp, Unknown; identical to SEQ ID NO: 28750
  misc_feature (1)..( 3000): 2750-1469P.txt file - cDNA_ID_2998518; gDNA_ID_2926253; Annot_ID_204448

SEQ ID NO: 28752 - DNA, 3000 bp, Unknown
  misc_feature (1)..( 3000): 2750-1469P.txt file - cDNA_ID_2998526; gDNA_ID_2926253; Annot_ID_143074
gaaattattaagcctacctaagaagtccactaactgttgataaaaaggcccattgataaattccttttttcttcattattattttttgtcaacgaatttggagtttttactccaacagaaaaaaggattaaatatattagaaaccgaatattttgactttgctaagaaacaaaaatgaacatgtttcacatgtgactgaaaaaagacggacacagaccaattattgatgtatattatcaaaaatatggtattttcttgtaaaaccggacattttcgcagccgggccgaaaaccaatcaggtagtccggcaattaaaacccatccaccaatcagaagcttacacgtaagctcaattatttttacttccgaaacaagcccgttactttagtgacgcaccatcaactaaccatctcgatgtctgaaaatagggcaaagagtacggttgaggcccgtgcgtgtctactggtcattcaacacgtgcttctcctaattttcgcgttttccctctcagccgagccgtttttagccacatcaattatattatgttgctctcgtgaaaaaataacagcataccacaataccacatcattctacgatttcactattttcgtgaaataaaaataaaaatataatggataatgtcattttacaaatcttcagttaagtgaaatttttaatatgaaacgaatcgtagtattttttagctttaaagattctaaccgtttaccattccaaagtgttatactatcatcgtttaaaaccctaatctctttaatattctatccttatacgaattgtacattaaatctacatttctctagctataaacatatatttatttagttatgttgcgcagagaaaatatgtttggttaagtcatatttgtacatattgagttgaaattgatgtgacattgttcgtcaaacaagaacgaattaatggaataatgtttgaccatttctatctaaaatgtactgaattgtaacttcgtggtgagagcatatgctaagttggcccaaaagcagaattgcaaatttgaccactcttatctgcgtcttcattttttccactcgttaattatttgaccaaaaatgggcttaagaagctgaggcttacgatactcaattaatatttatccctgaatattaaatatttatactatgtgattagtgtatactagtaaaaataaagcatcttaagatgtttaattcaattccctgtacggatcatattaaggataatctttagaatttctcaaatggtcatatatattcattactattctcaatggtggtaggtttacttaagatgtcatcaaataacaattaatgtccttataataatcgtggaatagctttaatgatttcctgagtattagattttgcctttttccttttggccttacgagaccttctaagcaagagtaatagattagactttttcaattaagagaaatagtaacccataaagcaataagagttggtgacaatttgttgcaccattaattcactttcgtttaaaaacaagagttacactgttgaaaacatgagaatttggtacgatttgacatttttggaagtttataattagtgttttcgatttttttgtctaattcgtagtatgatagttaaatttatgtatagtagatttttttaacaatataagtacaattatgtatccattaaataatatattgtatatttgtatgcgtagacactttcggtaattgctaatatgcatctttgttatttgtagtcagacaatattcaaatgtgtggatggtcaaacacctataatataacaaaaaatatattacacattccatagttatatgtaagtagctcaacatagaaaatgaaaataaaatatgttgagaagtatttattttttttttatattaaaacgtaaaaataaagttattaaaagctgaggcggagaacaaaaatatgaaaatggaatgggaggaaaaacaatactggttacgtgtaaataattaatggcggagaacaataccatttattctctatattccgtctagtccacccacgtaacactctatcaaaataaaagtaaaaaatcaatactaaataaaaagtttagacgttaatataatacaagtaacagtttacccaaatggtaatattttgaacaatttttattgtatttagattacgaacatttagttaagtcgttgtcctcttaattaatcaagttacttagccgtcgtattattaggggtcaactagtttgaccttatttaaaattaaaccaaaaaaaaaaaaactagtttgaccgtaatgaccggtttggaccaaatccacgtatattcaaaataaccagtcatgtaacacggcagctctatttttatttacgcaactctcactaaattagtttattttaaattgtaatttgtaacctatctgacttcataatataagaagaagaaaaaaccctgtataactttgtaattacttgatttttttaaacaaattctattacatttacatactccaacaataataaaaattaagagactaataacataatttagttcttgataaactttgatatttacttagtcacttcatatacattaccataggtgatctgaaagatatcaggtttttggaacaaataaaaacgtatttaactatttatagtcttttttataggtaaaataataaatatacaccgtagatgggatcgtattcgtataaagaaaggaagccaagctgagccgataaagctgaattgtattacacttgtcttatttttttcttcaaaaaaatgagagactctttagcattctcgtgtgatgtgtaacggcctctgtttctttctctctataaatatcttcttcctcatttctcaatcctctgtgtatctctttctaccttctctgaacctatagagccaacgaaaccagaggacagtgaacaaagaattgtataattcgatctcaactcgttcctttgttgattctttactccgactattatg

SEQ ID NO: 28753 - DNA, 3000 bp, Unknown; identical to SEQ ID NO: 28752
  misc_feature (1)..( 3000): 2750-1469P.txt file - cDNA_ID_2998526; gDNA_ID_2926253; Annot_ID_204452

SEQ ID NO: 28754 - DNA, 3003 bp, Unknown; identical to SEQ ID NO: 24444
  misc_feature (1)..( 3003): 2750-1469P.txt file - cDNA_ID_2998534; gDNA_ID_2926254; Annot_ID_143076

SEQ ID NO: 28755 - DNA, 3003 bp, Unknown; identical to SEQ ID NO: 24444
  misc_feature (1)..( 3003): 2750-1469P.txt file - cDNA_ID_2998534; gDNA_ID_2926218; Annot_ID_142334

SEQ ID NO: 28756 - DNA, 3003 bp, Unknown
  misc_feature (1)..( 3003): 2750-1469P.txt file - cDNA_ID_2998542; gDNA_ID_2926254; Annot_ID_143079
ctcccgaagactaagaggatttgtggacttagaagccagcttgatgatccatggatctctgattattcagtgttgatgttatgttgcagcttaacatcgttgaagggaagatgcagtacttgtatgatgagagtggtaggcgatatctggatgcctttgctggaatagtcactgtgtcgtgcggtcactgccatccggatattcttaatgcgattacggaacagagcaagctacttcagcacgcgactactatttacctgcatcatgccattggtgattttgctgaagcattggctgccaagatgcccggaaatcttaaggtacttgagagttttaaacaaacaagtctgaatgatgtagttaggtttctcttgttggtttatcgaggaatcagcatgctctatgatttggatgcaggttgtgtactttgtgaattctggctcagaagctaatgagctagcaatgatgatggctaggctttacactggtagccttgagatgatttccttgagaaatgcttatcatggtggaagttccaatactattggactaactgctcttaacacatggaagtacccattacctcaggttttccccagagactttcatttaatgaattgattcctcttcaaagttgagatattttctttagcattgatttttgcctctcaagccgagtctttcatctttagcctcgttttagacccatcagaataaaattctctgcaaagtagttctctgccatagactgcttgtaaattttggttgccaattctgttattgtgcagggggaaatccatcacgtagtaaatccagatccataccgtggagtttttggctctgatggttctctttatgctaaagatgttcatgaccacatcgagtatggtacctctggaaaagtagctggatttatcgcagagaccatccaggtttttgtttgtttaaacaaaccatcaagtgaaatttagtgatttaccactctcttgaacataatcgtcaccatgccattatcatttttacttcagggggtcggaggagctgtagaattggctcctggttacttaaagtcggtttatgaaattgttcgcaacgctggtggtgtatgcattgctgatgaagtccaaactggatttgggcgaacaggaagccactattggggtttccagactcaagatgtggttcctgacatagtcacaatggcaaaggtttgtcaaaagaagttgttaccacttgctctgttcttacttcttaccatatgctatgttctccattctttgactacgtttactgttatatacttaaagaaacatgtgtagttcactaataattgacaccggttatattcacagggaattggaaatggattgccattaggagctgtggtgactacaccagaaatcgcaagtgttttagctagcaagattctgttcaacacttttggtgggaacccggtttgttcagctggtggacttgcggttctaaacgttattgataaggagaaacgccaagaacattgtgctgaagttggttcacaccttatacaacgtttgaaagatgtgcagaaaagacatgatagtaagtaccaaacaaacttatataatcagatcatttactctgtttttacttacaaccgtgtctgtttggtttcagtcattggagacgtgagaggaagagggttaatggttgggattgagcttgtgagtgaccggaaagacaagacaccagccaaggctgaaacatctgtcttgtttgagcaacttagaggtaaacaacattaaagccaaaagcatcgatttgataagcatcagttggttaaccaaaatgttttgctcctttctcttaatgaagaacttggcattctcgtcggaaaaggaggacttcatgggaacgttttcaggataaagccaccaatgtgtttcactaaagatgatgcaggtaaattcttagtttatatatcgcttaaaattatgaagtttcaccaaagaacaaaacgagattgtataatatctataatgaatttgtgtgtgttgtaatgtatccacagatttcttggtagatgcattggactattccatctccaggttgtgaacaaggatgaaacaaagccaacgagagtttttaaccatatgaaccgttttaatgtttccgcgtctttgtaacgaaaaccaagccaagtctcatctcctttgatttcagaataaataaataaaatttatttatttctcagtgttgctatgacataatacaaatacattagaaaagcccaattatttttgttttctttgttaaaattcccatatttcatctggtggacttaaaaaaataaaattatacatgagctatatattattctgctaaagcatactttaaataataaaaatttaaattctatagatatattttgtgtttcggattaaaaagaacactccaaatcatagaactaacaatacatgattttgattatataaaaaagaaaatcaataacacatgattttgtttcgatatcaaactccatgaaccaaaaaaccttataatgtggaaggattactaagatttaaatattttttttttctttttaaaacactttattaaatttttgatatcatttatattaatattttgttgattttagtttaataaataaattagtatcaaaaataatattgtagaagataaatgttactttagatcctatttctttcactaaaataggtacaagcatttatagccattaattattctttgtatagttaaaaatcccataataattaatggtggacccgtaaaggttgcgaaaagtcatacacgttccaaaacaaaaagtcgcaagtctacattttccttcttccagaaccataacacgtctcctcccatttcttcgtaaatacgtttctcctctctgacccatcacgatcacaatctaacaaaaagagttttcaacaaaaatcagcaatcgtggcgaagctatataagaaagaggaggagagacacaaagcgatg

SEQ ID NO: 28757 - DNA, 3003 bp, Unknown; identical to SEQ ID NO: 28756
  misc_feature (1)..( 3003): 2750-1469P.txt file - cDNA_ID_2998542; gDNA_ID_2926218; Annot_ID_142337

SEQ ID NO: 28758 - DNA, 3003 bp, Unknown
  misc_feature (1)..( 3003): 2750-1469P.txt file - cDNA_ID_2998546; gDNA_ID_2926254; Annot_ID_143081
agctgcaacttgctcctctgacaagggtaagtaatatatcctggggatcgcttttgtcttcttgaatagatcatcaagagtgacaatgggaggttcttgttcctcaggggctataggaggagggggaggcagaggaagacgttctacaacgtgaggtggtttggccagaggtggtggtggtggaagagcagttggaggtggccgcgaaagagtctgagcttgtggctgatgctgaggctgaggaggcagaggagcttccagtttttcttttacttcttctgctctaacaaattcagctatcagatggcggcctccattaggtggccactggaggttatacactgcttctcttgttgctgctgcttcttcaaccgagggatactgcagtcacgtcacaactcactcatgttacacaaaattctttggatatttagataattgaattcgaaagtacacaaacagaatcaacatttttgtaaatcaaaaggatttgaagaagcggtcttaccgatacatagcagtgggtcttaatgtggtccatccagaaactagtgacatttccggttttacccaggagctcctgaacagctttcagtgtgaacggcctaaggaaacggtcaatcctgagggaatttgtaggctcctttggagatggaggaactgccaataaatattgaacacatctatcaaacaaagctttaagacaatgaataagagatggaaacatacatagagggggtgctgtattacatacccacacgttccttgggtccatcttcactaaccgaagagtcagaccttgagaagtcgcgcttcagaccagtcgaccttggtgttgtagtgggtgtagcactattagtgatctgtgcttcaggaactttaatactattagagttccatcggcgcctctttgcaggttcattgtttccaacagcttcttgatctacattgagttacaaagaaagacatttcagcatacatagctagaatttcaaaacagatgcttcaaaagccaatatatataagaagtagccataaacgacaaagatgaaacaactattaaacactaccagtatatgcctcaaacaccaacattacagattaaacacagtaaaagatttgattaataaaacaaatgaatatgagaggaattaccattagcaggaagctttcttttgtcagaagccaccagtgggtgacttttattttcaggggatttccctttccccgcatccatatcagcacggctttcctccttagaaagcatttcaatttttgcactcttatcatcagatgtaattgactcggattgctttgtctccggctcatcctccatagactcatcaccagaacttctatctaaattcaacttttctgagtcgcctgcatcgataatattattttctttgatcatatctgcgtttgcagcattgctgtcatccccacctccaacagatgtcttctgctcaagtggctcctcgacatccattggatgcgattcgccaacgactgttgatggctcttggaacttattaacattttgttctaatttgacattatcagcaattttgttatcctttagttctattttttcattatttgacacagaatcagtagaaatacaatcagattttacctcaaaccctgtaacggggatgacctcagatacctggttgtacatagcagatttttcaagcactgcctctgatggttgagccttagaatccccaccatccaacccactaaatggttcattattctcagatttgtgctcactagacgccacttgcacaactgctgcatcacgtgcaaccactgaactatcaagaccagctatgtctctaacatcatcaactttctctttctcatcttcatcactagcgaatggcacagcgttaacctctggttctgaaaacaccggggctggtgtagtctcaacaccagctgaagcttcagttgttatcttggtctgagttggttctggggttttctcagctgtaacaggagttgtctcagtgctaaatgccgcttcaacaggagtaacaggagtggtttgattacgatcacctacagtaacaggaaacatctgaggctcttgattggctttttcagcagcagcaacagtagcactattgatcctttcagactcttcttgctcagcacgaagtgcttcatcaagacgcctaaccaattcctccttcaagcctcttgttgttagtctccgtcttttaagctcttctttcaattccgtaaccttccacttatcaattggtcggttgtccaagactggaaaaggcgatgacgacatcttagcttatgagagagctgattctgaaaaaatattgaatataaaattagagaaacccatcgcagaggacaaaacctaaatcagacaaattagcaaagcaacgcagcaaatctatataatttaaaaccaaagcttaaatctttaacaaacccaatccaaaagagctagaagtttaaagatgacttacaacaaaatggcttgaaacttcctctgatgggtaaaagaaggcaggaaaaatgtaaaaccctaaattcgtagcataagaagaatgaaacaattagagagacaagacaacaatcaaaacccagtacggaagattacaaatttatcaaatttccgactcaaaatagattcttcaacaccagattttactctcttaagacgaagaagaaaaagaagaacgcaaaccttaaaaacgaaatccagaagcaatggaacggagagagagtgacctttggttgaagaattctaatcgagaatgaaagataaagcggacattgggaatttttctatcccgtcattacaaaaattgggaattttggaaagaggaggcgaattctagggttcttgttcgtcgagtggttttgatattggggaaaaactcgaggacctgaagtgataatgggtcgcattgtattgtgaaatgtctaaattaccctttttctcaagtaattttgtacggcgtcgtttcaatg

SEQ ID NO: 28759 - DNA, 3003 bp, Unknown; identical to SEQ ID NO: 28758
  misc_feature (1)..( 3003): 2750-1469P.txt file - cDNA_ID_2998546; gDNA_ID_2926218; Annot_ID_142339

SEQ ID NO: 28760 - DNA, 3000 bp, Unknown; identical to SEQ ID NO: 24450
  misc_feature (1)..( 3000): 2750-1469P.txt file - cDNA_ID_2998550; gDNA_ID_2926254; Annot_ID_143083

SEQ ID NO: 28761 - DNA, 3000 bp, Unknown; identical to SEQ ID NO: 24450
  misc_feature (1)..( 3000): 2750-1469P.txt file - cDNA_ID_2998550; gDNA_ID_2926218; Annot_ID_142341

SEQ ID NO: 28762 - DNA, 3000 bp, Unknown
  misc_feature (1)..( 3000): 2750-1469P.txt file - cDNA_ID_2998560; gDNA_ID_2926254; Annot_ID_143089
agtttagtcatcaaagactttgactccagagaaatagttttttttttttttttggggcaaaacagtagatgttatgaaattaggagattttttttctttccattttgtattttggacaaaaatttagttatattctgttttttttttcttccataaagtgcacagtcctcgaatttacccatttggtggtttacaataagagcacgtcgcatccaaaattgtcctgtgaatgtgatatatggtcaaaagaatattaacatgcatgtctcatacgtacgaaaatatgcttgatttcattaaatacttatttagcatgaaaattatttctcacataccggtaattaattgattttcagtattagactttctagctttgctaagaattgcattgagtatatatatatatatatatatatatgtgtgtttttgtgattttgccacatttctttttacaaactttggccaagcgtaattagctcatcagccataaattaatcacgcgtaactaaggactcgataaacgggattaacgtgatgcggacaattatttgcatatgatacttttatgcctcgtagggttccacatgttaggtagagacactcttgattccttacacgtgaggtgtcggttcggaattttgatttgaaccttgccttaatgtcatgccatattgccatggacgcatatttatatataacttcatacacattaacacatgatatatatattttacttctatgggtgtataatgtaacatacgaacatataacaataaatatgtcctttggctaccgaatatgataatgaatctatgatttattacgttattgttcaagttaatatatatgtggaaacaaagatatatgtatatatatatgaggaatgcttacactaaagtcgtttgtttcttgatgcatatatatactgtagttttttacgaatatgaagagataactggttgcgaaatcagaaagcttacaaaaattaagaaagtatgtatatatatatatatgaaagtgtggtttgttcaatcaacaattgatttaggttccacaattaattaacaaaaaggtgataatttcgttatcccaaaaaaaataaaaataagcttcaatcaaatgtaaaccgaactatatctgaaagtagtggtcataaaaataattgtagactattttagtcccataaccacgtttccctttttaataaggtttccttctcctagaagttactaagaatcctattcaaattcttctaaatctcgtaattaaatcatgatgcatgcatatgcatcgatgttttctacatcagcagtggaagcttctatgagattttgagcatctgagattctagagtatgagaagaataaaattcaccggcgagtcatgaagatgacatgtgaggcaaatttcagataaaatggttcaggtaaatggacattcaaagaagaagtgaaaatgggattaattaagccatcgagtgaaaaagcatgtagttaaattccgttgagaatctgatatttgatcttactgcaggagggagtcttcgaacaatgaatatctgattctgccggataaattattgaatcgagttaaactcacgagtgaataaacgtgaatgactttggcacacaaccgtgactcgaactccgatgaatatttgtcagcgatgagatactaagccacgtggcattatataaatttcaacagtatagcatatatagctaaaagaaaataatacagttataacttataagaaggaaatgttccgatgcagttacgagaatcttttggcgtattataaaattacatgctaggagcatgattggctgatacaagtcttaatgcggtaatcgttaaaataataaactaaagtggtgattaaaaatgaaaaaatccttcaaattattttgaatttttacaattgtggaaccatgttacagagcatggtatttcaatttttatcgtactactactactacggtattgtttccatttttttaataataacacaaaaggggttaaatcatgataaataacaaaaatgaaggaccaacactttgaagagaagattattgcctaatgtgtattttcttgaattttcaaattttcattttgaaactttttgattgaaaataattggttctgttcgtatgagttcctgagattatttattaattaatatatatactaaaaaattaggagcaagatggcaaaagaaagaagcatatggtggggggtgttaatggggaggggaccacgtggcggttactgggaacgctgcaaactaaacgatcggtgtgagcgggaaagccgctttgtggggtccatcatccatctagtaggacccacactcaatgggttccagcgttcagacacacacaatatctgattttccctttaactttttttgttcaagttaaaactaaagtttttttaaaaaaagactttttttttattttcctataataaactgcaactctataaaatcagaccataccacaacctcagcctctgtctctctcaaagcctacacactcattctcactctgtttctacaaccctaaatctcttttcatttacagacagaaatgggtaaattgtttagagttccttagattaatgcatacaaacgtttataatctcttacataatccttatcttgttttctgttatttcagttagattcatagaagaaaacacaaaacttgtagaaaaagaaaccgggaacaaatcaaacaacgatgtaacaacaacgaagaagaaagctcttcaagatatcattatcaacaatggagtaggattgatcaattcatgggttgattcaatgagagcttgttcccctactcatcttaaatctttgttgaaacaaagctcttggctcgtacgtctatatatcatccattgatccaagctctagtttctacttacatcttttttttcttgaaataataaacggtgtgtataaattcgcagacggaacatccatcagctttggatatg

SEQ ID NO: 28763 - DNA, 3000 bp, Unknown; identical to SEQ ID NO: 28762
  misc_feature (1)..( 3000): 2750-1469P.txt file - cDNA_ID_2998560; gDNA_ID_2926218; Annot_ID_142347

SEQ ID NO: 28764 - DNA, 3003 bp, Unknown
  misc_feature (1)..( 3003): 2750-1469P.txt file - cDNA_ID_2998570; gDNA_ID_2926255; Annot_ID_143096
aaatgaaacctggttttgatcccactaaaggtggaagacctgagttcattttcgaagatggacagtatcctgaacaagtaattaccatgaacatctatacattttcctttgagtttcagcttaagtatttgttcattctagtgtaacatgaattggttttgtgtaggttgattggattggacagaagaatcaaattgatgcaggtatgtgtactttcttccatttgtcttttgtttaaggttaaattgcctaatttggttgagcttctatgaacagccaaggttgctggtgttaagcatattgtcgtggtcgggtcaatgggtggtaccaatccggatcatcctttgaacaaactgggaaatgggaatatactggttggtggaaatttctgtgtgtttgtctttcccaaatgagtttagtttcttacactgcgatcaatatttggctacctaatatgtgttcaggtttggaagagaaaggctgaacagtaccttgctgattctggaactccttacacaattatcaggttaaataaattctttagagtgcttctattacaataccctttttatattaccacatcaaaattcatcccaaattctgtagtttcaaaaacttctagatacattgtgtcttggtaattggttaagctttttattctgtggatcaaggagtgttattctctatatttgcgagcctgttcttacttgttttcaccatactttttctgttgatgaacttagagctggaggacttctagataaggaaggcggtgtacgagagctgctagttggtaaagacgatgagctacttcagacagacacgaaaaccgtccccagggctgatgttgcagaagtctgcattcaggtctactcatctgcttttattttgttaacaaaattttcatatcctctccttggtttattattttcagatcttgatatttcttctttgcaagtacaggcattgctgttcgaggaggccaagaacaaagctttcgatctcggctcaaagccagagggaaccagtaccccaaccaaagacttcaaggctctcttctctcaagtcacctctcgtttttaaatcattatctttgttgccaataagaacatttgggatcaaaccttctaaaataaattctgtagtgtctatttgaaaggatacgttctttcaattcaatgagaatattggggttgaatgttcaaaatttaaaattttgatcatacagtaacttctccagagctattcattgaggtgaaacacttattttcatttagtctaacacatcaatcttatagccaacccctttaacaaattaaagaatctactttgttaacgttttggaattaaaaatagaaatttcagttgaaaggagacgatgaaccctttaagagacgtcatgaagatcgaattaaatctgcagttgaaatcgctagacgggatactttggatgattcgttatcaatttggtgttataggagcgtgaagaacgaaagaaacgaatgagatttgacaggcactctcgaaactctcagctggtttttcgtgatcagtcttatcagaacagagacattagagtttatgatcaaagcaagctccctcagggtaagtaaattatatgctttggcacttgttcaaatgttaggttcattggtttgttaaagtatgttttcttcttataataggtcggctagattgtcctggttttggtctggagataggattgtatgcttccttgtttatcttgtatgtgatgttttttattggtgcgtatgattttggtcttgaatacgacattgaatctgaacactgctgtgtatcttactttgacatggctagtaagagtgttactccaagagcaatatcaatctttattgttcatagctaatttttacatgtctctctgctgcagactgattgggaaggtggattctttccattaacgatgcacttcagtgaggattatccgagcaaacctccgaaatgcaaattcccaccctaatgtctatccatctggaactgtctgtctctctatccttaacgaggattacgtaagtactcttctgtttctttcttttcatttctccatcagaaaagccaaatgtatcctcaagctctcttttcttatgttgtatattgaccagccattaccgtgaagcagattcttgttggtattcaggatttacttgacacacctaatcccgctgaccctgcacagaccgatggttatcatcatttctgtcaggtacacttccaacgaaaactctaaacactttgataggttatgaaacataataggaaggaactaagtcgagtacatgattttgcatgatccagttgagtacaagaaaagggtgaagctgcagtccaagcagtatcctgctcttgtctaaaacctcaaaaaagagaacgcaccaaaactgatgacaagctctgaatatattctcgtcatgtgtgtcattgtgtttaaatgtcattgggtgattgaaaactcctcattttggcaccttaagacactggaatctatttattttcggaaaaaaactcttctttctctatataactgttaatattcttggtactgattcagttggtactgattcagttggtgttgcttctatattattataaagaaggaatgcaaaacatgacttgaaatagtgtttgtctctagtatccatgtatacgtatatctctttcaaatgatctcttaggaacatttgggaggtaatgtatcaagccttttaaaataaaatctccggggtcaatttgaaaggagcccataacattaagtagggcgttcatttcattaattgggtttgaatgttaaacataaagcatggggaacatttagtgatttagtaaaaataaggggccaaagatagaatttctcgtttttatcacccgcttcatttgcctttctatcgccacaagaacacagagagagaacgattagcccagttccgatatcgttcggtggcttcttcatctgaagctacgatg

SEQ ID NO: 28765 - DNA, 3003 bp, Unknown; identical to SEQ ID NO: 28764
  misc_feature (1)..( 3003): 2750-1469P.txt file - cDNA_ID_2998570; gDNA_ID_2926255; Annot_ID_204502

SEQ ID NO: 28766 - DNA, 3003 bp, Unknown; identical to SEQ ID NO: 28567
  misc_feature (1)..( 3003): 2750-1469P.txt file - cDNA_ID_2998570; gDNA_ID_2926276; Annot_ID_205340

SEQ ID NO: 28767 - DNA, 3003 bp, Unknown
  misc_feature (1)..( 3003): 2750-1469P.txt file - cDNA_ID_2998574; gDNA_ID_2926255; Annot_ID_143097
aagaatattttcatgttactatgttatctaaccattaatacaagtcaccgactaggtgataatttggtatttacgtaagaatagttatgcatgtatcgacttatagacttttttttttttaaaaaaagggcaaccctatcagctcatactttatttcattgcattttcaacgacggctaaggctaatttgacagaataaaaacatatcaaaagtgaatctagaaccaatgatatttaagcaaatatatttgttttttggtttttatatcttataagtagaagttaagaacaaaatagcatcttttaaactgactatgatgtattgtcaaaaaaaaaaatgactatgatgattaatgaaatgtatatacccaactaggaaccaataaacaaagaaaaggtaatttgacggtttctgttttatacattgggaaatactaacagatgtcaagtggtacggacggcgtaagatctaaggatctgtttgcttctaaaactcaaccctaacatgcatctttactaatttctcataaagctattgcgtaaaacatattgatgactaataacatcggtaaaaaatattaattcacatgtagtaaaatgaataacttgtcgtctaatgccataaatgatttgttctaggtgaacaatattcttggaaacaatctcatgtgcttcttggaattttacttcaaataaatctctgacttttgttgacttcttgtttaattacattaacatacgatctatgtgtaaacaatgtgattataatacattttgtaaaatccgacaaaacccaaaaaaaagtgtggaaacatttatggtgtacgtaacgtagtaatataaatatgaaagccctagggtaatggcttacgtaccttgaaaccaattatttatagaattaaagtaattataaagtagtggcaataaatgaagccacatggatatagtggtcgaatatttctataaacaaatcatagtattatatataccattatgtgaaatatatatacaaaatatgtacgtaaatgtaaaatctgtttttgaattcgagtctacggtataaaatgatgattacgtttttgcaaatattgtttttaggttgttgattgtggattaggtatatttatataatgtgatcttctgtattttttctgtatgtttcgtattttactatttttgtaaaagaatgaatatacattatacgtaacatttattcaagtggggtttaaaccagtcatatttatatatgcataggtaatgtatgtggcaaaacgtgaggttggccccggaatcagttgaggcccaactgcatcgacgcacggctttttaattgtgatgccgtattttccgtgttcttatacggacggacggacactctcgtacacaaatagaatcgtttcacaaataaaatatcatacactttgttagcaattaattatagaatcgtttaaactataagaattagtgtgtacttgtgttgtcactaaaagatggaagaagaaagggaatgaaattcccgttatcaaatatttgtaatcatttatctttgttctatttctatataaacacaataatttcaagattatgtataaaatatgaattggattggatcggagggttttggttcatgtgggatttctgattagagacacaactcgcaaattgaccaaagaaaaatgcatgaggtgcccatgtgcggtccacgtgcatttgctatctttttggcttatatacaaaatttaattattaactcgactaacagtgagtgaataaacaatgctgcatttctctgtttgaagaaaaaaaacaatgtagcatttttctgacaaaaaagtaataatgtgagttttatattggtgcttcttatttttcgtaagtagatttttttttttctataagtagaattttcttaaaattgagtataaatgcttcttttttaaaaaaattcaacgcgagtgtaaatgcattttaagagaacgaatttgatgagctttttgaaagaaagttgatataatttaaataaatgacattcttacaatagtaaaactcttaacagttatttttgtttacgtcaaccaaattaagtaaaaagttgacaaaaaagttttaagtaagaagagttctcaaagaaattatctaattaatgacgttctataaattctccaacaatcatttaatatataattgcaaatcatcgtaatataatcacttttagttaataagttagttattagttaaggtcactgtgacgcagatctcagactcgacgcgctacaactctcgacaactacaattttcgccgcgaattatgatcgcgtgaatatgacatgcatgacttgcgcgtggtatagatgactttaagcaccaaagccacgtaagccgccggaaatgtttagttactgggccaagacgtattttattttgggccgattaatcaattccatatctattatctttgacctatagtttatcgcgtttactatttttacctattgtttagttactaggccgacttttgcatgtacgtaaatttttgatgtattctttattctttttagatattcactttttgctttagagaaagtttgaaacaagtgttcatttttttttggggaataagtaccaaagattggatatttatcatcttatactcataaaacataattttcgtattttttgtggggtcaaatttaatatttaaaaaacaatttaaatagtgattgaacactttggtaagtatgcattctcgtgaattcggtggaataaatttatattagatccacgagggaaaaaatacggaattacaatatagttttttttatttgataatttttattaataaaagaatacttaaattagaaaaataattaaaaaaaggcgtaaagtcatttgaagcctccataagtagccttcctagcttcccctctccctctcacattcctctcttctctctctcttttcccaaaaaccaaaaccttttttccgtaccaaggtcaacaaatg

SEQ ID NO: 28768 - DNA, 3003 bp, Unknown; identical to SEQ ID NO: 28767
  misc_feature (1)..( 3003): 2750-1469P.txt file - cDNA_ID_2998574; gDNA_ID_2926255; Annot_ID_204503

SEQ ID NO: 28769 - DNA, 3000 bp, Unknown
  misc_feature (1)..( 3000): 2750-1469P.txt file - cDNA_ID_2998578; gDNA_ID_2926255; Annot_ID_143098
gtggttttagttatagccagatttgaagtaccttaaaaggctaaaaccagattcatcaacctttctttctagaattagaatctaaatgcaatggcttgtgaaagttttgtgttttgaatgttctgtttctgaaagaagaattcttgtagggctaagttcgaaattcttgagtagagatgggagcaagggctcgtcgaccgcttccttctcttatatgcctcgaacagaaggcgagatcttgcaaaatgctaatctcaagaactttagtctcagtgaactgaaatctgcaactaggaatttccggcctgatagtgtggttggtgaaggtggatttggttgcgttttcaaaggctggatcgatgagtcctctctcgctccttctaaaccggggaccgggattgtcattgctgtgaaaagacttaaccaagaagggtttcaaggtcatcgagagtggctggttagtcacatttcttctcactttttctcctcaagctactttttttgttatttcaagattgtcgcagagcctggttttgtggtttcagggagtgatcatcttttttcgttttttttttcattttgaaaacaacaggctgagatcaattatttaggccagctggatcatcctaaccttgtgaaactgattggatactgcttggaagaggagcacaggcttcttgtttacgagtttatgactcgtggtagtcttgagaatcacttattcagaagtaagttcaaatcttcaaagataaagaagctcatggaagaacttgttatacacaatggttaatctttctttcttttttctcataataggaggaacattctatcagccactttcatggaacacgcgggttcgtatggctcttggtgcagctagaggacttgcttttcttcacaatgctcaaccgcaagttatataccgagacttcaaagcatctaacatcttgctagattcggtatgacatgattgatactttttgtagctttggttttggatgcagtcagagaagtttatcttaatgtttctctgcatctgcagaactacaacgcaaagctttcggatttcggtttggctagagatggtccaatgggtgacaacagccatgtttctaccagagtcatgggaactcagggatacgctgctccagaatatctagctacaggtatatatgaacatgcattctctgttattatgatcaatgaagagacctccaacacttatgtttctgtcaaatttgaaaggtcatttatcggtgaagagcgatgtatacagttttggggttgtgttactggagttgttatcaggaagacgagcaattgacaagaatcaaccagtaggagaacacaatctcgtggattgggcaagaccctacttaacaaacaagagaagacttctgcgagtgatggatcctcgtctccaaggtcaatactcactaacccgagctttgaaaattgcagttcttgcactcgattgcatatctatagatgccaagagtagaccgaccatgaacgaaatcgtcaagacaatggaagaacttcatatccagaaggaagcatcaaaagagcagcagaatcctcaaatcagcattgacaacatcatcaacaaatctccacaagctgtgaattatcctaggccttcaattatgtaacaatcctaggcgagctatttaccgggttttagagatgtatagactctttaccttctgtctgtttagatattatgttgtttggtagtaacaaaagagctggcaatgtaagggagagaaggaaacttactagttgtaaacttaggttctcttacaacgttcacatgttatctcacatacaaaatgttatcaggataagaaaaccacaaaaaaaagaggcaaagaagtgagatgatcctagcagagaatcaatctctagttcatcgtcctaacaaagcaacacgatctgactgtacagcttgagtaaggttgatgtcgaaaagctcgcaacggataggcatttcaatctcatagaaaggattcttcaagacgtaatcagtgtagagttcataaatgtatctaaggaggctctccatgtgaggagtcccaggttcacaaaccacaaagaactttgttcctgagatatgatcagttattgagccaagtcagtaatcaagagaatgtgacggtatcttcttgcaaatggcgatgtatgattacctgggagagactggaaacaatggagatcgaaagtgtcggcttcgagaagctcgatgccagaacagccattgacaggtgaaagctgctgagaaatggcgtgcattgaatgccataaactagctactctcaagctatcattcgtatccattcttccctttgttccacaatcctgaatttttcccaaatccaaacacacacagaacagatcaaaattcaaatccaatttctttagtagctattcacaacccctagattaataccgaaaacactccttctactaaacctagtgatctcaaaaatttcatcttttggtctatccctcgaaattaacatcaattagctcgtcattctctagacatggaaagtccacaagctgcgagatcgagaacaagaggaagatggagagatcgtaccttgtagaatatcaaaccaccagatttgttaattatgtaaagactgtaaatcgctgccatttttttcccccgataatcttcaaagatccaaatccgagaaatcagcgagacgatgaagaacaacagtacagatcttattaatgatttttctttttctcaaaacggcgtcgttattatatcgatggtctctactcgcgccacgtcgcctaattaatttaacgacgtcgtcttttaaagaactagcgtctcttaaagcgccacgtgagctaatgtttaaaaaacttcaccaaaaatggtgtcgtttcaataacttttcttcaccaactaccaaaaacgtctgaagaagaaaaaagtataagtaaagcagagagaagagcaagggagaggtactaaaaatg

SEQ ID NO: 28770 - DNA, 3000 bp, Unknown; identical to SEQ ID NO: 28769
  misc_feature (1)..( 3000): 2750-1469P.txt file - cDNA_ID_2998578; gDNA_ID_2926255; Annot_ID_204505

SEQ ID NO: 28771 - DNA, 3003 bp, Unknown
  misc_feature (1)..( 3003): 2750-1469P.txt file - cDNA_ID_2998582; gDNA_ID_2926255; Annot_ID_143101
gagcttctttatctttgaagatttgaacttacttctgaataagtgattctcaagactaccacgagtcataaactcgtaaacaagaagcctgtgctcctcttccaagcagtatccaatcagtttcacaaggttaggatgatccagctggcctaaataattgatctcagcctgttgttttcaaaatgaaaaaaaaaacgaaaaaagatgatcactccctgaaaccacaaaaccaggctctgcgacaatcttgaaataacaaaaaaagtagcttgaggagaaaaagtgagaagaaatgtgactaaccagccactctcgatgaccttgaaacccttcttggttaagtcttttcacagcaatgacaatcccggtccccggtttagaaggagcgagagaggactcatcgatccagcctttgaaaacgcaaccaaatccaccttcaccaaccacactatcaggccggaaattcctagttgcagatttcagttcactgagactaaagttcttgagattagcattttgcaagatctcgccttctgttcgaggcatataagagaaggaagcggtcgacgagcccttgctcccatctctactcaagaatttcgaacttagccctacaagaattcttctttcagaaacagaacattcaaaacacaaaactttcacaagccattgcatttagattctaattctagaaagaaaggttgatgaatctggttttagccttttaaggtacttcaaatctggctataactaaaaccacataatgactgaaacaactcaaaaaccatactttagattatgaaaagacaagcttttttgagagagaataaagtgacagtcaattctacttagccgacactctgatttgatttccatggattcagctcttcttaccaataatggaaacatattgtctgaacaagaactgaaatctaaaaactttctactacaggactaagcaagtgtgaaagaataacaataattgaaatctttctacaagatatcaatcaccttcatcaaattaataaataagagaaagacaagaaaattgaccaaaggagactcacatgtactggaagcaatatctgttttaatccgattgctgaaacaacctcccattaaaactccaagaaaccaccaatcagtcactcagctctataatcttctcgattgaaagaagaaaaaagataagagctttatgtgtgtaaacacaaacccagttctatgcgtacaaaatggagcgagaattgaaaaagacccttaagaaaatcccaaactcccagagaaagaaagaaagaaagaaagaaaattgagctggctagtaatcaataaagcctaaccttttgttctctcggagaagaaaagtcttttgtgataataatgaaactaattgaaaatgaaaagaaaagatgtttttttttgagctctttcctctctctttctctctcagttttgggtacgccctattggactttgtcttcttcctcatcttcctctgttcatcgttgacttgttgactttttctaataagactttgagtctttgtggagattttttttcagttccttttcaagtttttttttttttgtttgacatcatctttgtggagatttatctttagaaaaccgttatcaattagtttgtttagtgatataaagttggtttgtggaccttgtgaatgaagtttctttgtgggttgtaatgaaggctgaatgaaacgaaattagtaggaggaacatgatttgagcatatgtgaataaaacaaattggctagtatatctatgggcccatttaggaaataggtattaacaggcttcactttcatccatggacttgggcccttggccattaatatagttgatgaagtgtatactttttaaacttcaaaagttcaaatgtaatggcatattgataatttttgtctatcaataaatttgcagaattatatatatatatatatatatatatatgcttgaaaattttaatttatttttgggacacaattgtttttaagttagtgcattattcattttacaatagttgtattcagtatatcatcacttactatactacatcaaacagtttctatttagtttattatatcatttactatttctgaaattgactttttgttttcatctctgtctaatgactatatatatatatatatcttattttttaattttatttatcaacaagacattatatttatatagaaaaagacttttgatttcttgaccaagaaaaaaaagacttgatttacaaaggccatttacctttcatgtttctcattactcatatcttggtaattacaaaattgtaaatgaagtaactaattttcaaaatatgcatttattataacttatataaaaaagtagaaaacaaatttcaccaaaataaaaacagaaaaaattaaaattaaaatttaatgtcattaaaataatatgatccaaagattctacatttctactagtaatggagctagtgaattgatgacaaaaaggaatttattttagtaattgaaaatgtcaactactaaatcaacaaaaaaaaaaattatttagcaaagagaaaaaaaaaattacaagagtgacttattcttcgttcgtatcacaattggtaaagagacttgccgagctccgcaaaccgccatgcctttaaccaatcttcacctataaactctttcgtatttggtgcaatcggagaaattagggtttttttctgagacaattggaggtatttcttcttcgatttttggaacctaagccgattctattgctgtaatataatcattgtaatttgaacaatttaggttttactttaaagttcttctggctctggtgtgaagacgatcacttgttggttctatctaagtttcatcgtcttcgttgtactccgaaattgaggaacaaaccctggagagtcacagttccgtgttagtgtttctgcagcgttgtgtcagtggtggttttgtatatccgccgctcgttaattgtggagatg

SEQ ID NO: 28772 - DNA, 3003 bp, Unknown
  misc_feature (1)..( 3003): 2750-1469P.txt file - cDNA_ID_2998586; gDNA_ID_2926255; Annot_ID_143102
agattgtctcatgaagattctgtatgtactgcgattgtaagcagcagctcctttgatagctcaatggcctctgaagtccacaaaattgatcctttccatgccctgcttccttcttctgccatatatttgatacgcgaatgtttgaaagttttggagacatgcttaggaaatgatgaaggtatatcaaagtttctttgcaagttgtcctcttctagcggcagaaacatccctgaaagtaagatgtcgtggccaaggagagatttgttaaatgttgaaactggaggaagtgtatctagtaatcttgccagttctagtagagatccgagtactggcttatcacctctatgcggcgatattcaaacaaatcttagcttggataatgtttgtggaccgtatggggtggttcagacagatgttacagctgactctaaaagagtatcttgcaactctgctgatttgacaaagaatgcatcaggattacgtatacttggtctgtgtgattggccggacattcactatgatgtgagttctcaggccatatcagttcatcttcctttgcaccggttactttctctgctaatacaaaaagcattaaggatatgttatggagaatctgcatcatacaatggagtcagtattagtcatgagatcccacatgcagacttcttcagctccgtgataggagatttccatccttgtggattttctgcactcgttatggaacatgttctacagattagggtgttttgtgcccaggttatcgctggaatgtggaagaagaatggggattctgcattagtatcttgtgagtggtatcggtcagttcgttggtatgtgagaatactattgtttttataaactgctataattcatcatttactcgcatgtttaactagatgcagctttgaaaactggtagattggttgtgaagagattactcgtttctcattctagtaatttctatttacaggtcagaacagggacttgagcttgatctatttcttctccagtgttgtgctgcgttagctcccgcagattcttatgttgataagcttctcagtcgatttgggctctcaagctatctttcacttaatccggatataacaaatgagtatgtacctattgtcctcttactggtaattgatctcattatatggttttatagttctactacattcgatatgactgtctcttcatttcattgttcaatctgcattagaggagaacaggtattttatattattctgtgaattttctgaatcgtgaatttatttattactagatggtcagtcctattttactataatcagtctgtcttacctccttctgacatgattcttatcataaatttattttcaggtatgaaccagttttggtccaggaaatgcttggtcttctgatacagattctgcaagaaagacgattttgtggtctttctactgctgaaagtttgagaagagagatcatcttcaagttagccactggagatttcactcatagtcaattggtcaaatctttaccccgtgacctgtccaagtcggacgagctccaggaggtcttagatgacgtttcagtctattgcaatccatccggcatgaaccaggtcttgattcttacccatatgctgggatcacctttaagttgacacataatgtaaaaaatcacttgacattagttcgttggcagggaaagtattcactacagtcatcttgttggaaggaattggatctctaccaccctcgttggcagtcgagagacttgcaatctgcagaagaaagattttcgcgttattgtggagtgtctgcgttgaccactcagcttccgaggtggagaatgatctatccacctctaaaggggcttgctagaataggcacttgcaaagccacatttcaaataatttcatctgctttatactacgcactacagagtggtacatcagttaaatcacgtgctcctgatggtgttctcataactgcactgcagttactctcgttatcattggatatttgcactcagcagaggcaatctaatagtcaggattgttgcttagaaaattcaattccaattctcgaattagctggtctggaaataattggtatagctcaagggactgaaaaagaaagtttattgtctcttcttgtttcgttaatgaagactcgtatgggagatggccgccatcaatttccagagccaggcagttgcaatatttcgtcctggattggaaatctgctgaagaagttcagtgcaattgattctgtttgtatgaacctattgcaaagtcttgcccccgaggtggttggtcaatctggcttcgataaagtcatgtcaggttctacttctgatgagaagcgcaaggctaaagctaaagagaggcaggctgctattatggtaagatccttttatttcaaatctagtgcaaaagtttgacatggaaccggtagccattgatgtctgatcatgcacttgaacatatgatggctgctgttcgctccctgacttgtctgggtcctgcatgctccctgttaatgtatctccttgttgataagcatcaacaaggagcatgcagaacgtagacatagttacctctgtggtaatagaagatttttgtataagactgtctaaattgtttttatgctcattattcaagttgttatctgtagttagaattaataagttccaggatatggtagttatgcttatatataacttgcatgcaggcaaaaatgaaagctgaacagtcaaagttcttgtctaccttgagttccagcatggatgatgatgatccgagatctgaatttgaaacaagtgattctgtgatggaacatgattcagaaatagctgtccgtgaagtttgctccctctgccatgacccagattccaaagaccccgtttctttcttgatttttctccaggttggtagcatgactgatgctataatatgcgactgttaaggttaaataaacatatactccgaggaaattttgttctgcatcattcttaatg

SEQ ID NO: 28773 - DNA, 3000 bp, Unknown
  misc_feature (1)..( 3000): 2750-1469P.txt file - cDNA_ID_2998602; gDNA_ID_2926255; Annot_ID_143109
caagttgtgatcaaacgtttcaaggatctaagacagaagataaagcatgtgattaatgagaacaagaacgagaaacaccgtatcactatggatgctgtgttggacaaagtacctcggaagtacggtttttcgaaagatttgagagacgatattttcgaacacttgaaaggaaactctgcagctaagaacaacaacaaagcagaaggtacaaaactgaagcaaataacaagagcttcgtcgctgtgtggttcgctggatagatatcttcagctctatgagtgtagcttccaaagagaagcgaagaacagtagtaattcagagaaatcaaagatggagttagaggaatcagcgttgccttctaagagagctcctaaattcttggggaggattctttcgttacctcaaatgaaatttcatgctttgaagattgatgaccttactgtccaatcaatagaggaagaacaagatggcttggacaacatttcagagatctcagaagatcactctcagtcttcagaacatgaaacacttgaccaaacaatggatgcttctgaggattcacccgttgatgcagaaacagaacaagacagagagatctctacgcttgacgttgaacatgaaacaagatcgttaaaagaatcatcagaagaaagtcctaataacgtttctacagttgatattgacgaaaatgcttctgtatttgatatctctcgaggtatgtatatatctttaacattcaatcatttctccatatcaaagttttccatcaaattgagaaagttattttttttttgttgctcagatttagatacagagactgtctcaacaagcaaacaattagatgaagaagtcctcaacatagatgcacaagataaagtgaaattcaactatgtaagagacattctcgagatctccggtttcaatgcaccagaatctctctcaatgtggcaattagattaccagccactggatccattagtctacgaagaagtgacaacgacaacaacaggatgtatgttccaagatccagaatgttcaagaaatgaagaagaaggcggtaactgcaaccacttgcttcttttcgatctaatcaacgaggtactaatcgaaatctacgaaaggtcttaccattattatcctaaaccgttatcatccctatgtaagatccatccaatgccggtggggtatagtgttttgaaagaggtttgggttagaataagctgttacttgcgttacaagccatacgacgaacaacaatcgtttgataaggttatgagtagggatttgtcgagagacgatggatggatggatttgcagttcgagagtgaatgtgttgggattgaagttgaggatttgatcttcgaggagcttctggaagaattgcttatatcatgttaataggcattcaagaactcgaatcatttcttcatttttcttctactttgttgctttgcttggagtttaaggtacataaaagagaaaatatggtgtttgtatgagtttttgttgttgtttatgataaaactttgtttaaaagaaattgtagaggataaatttttggaatatacaaaaatattttcaggtgattgatacattcatagtttatataatatggtatactatggtataataacattgtgctacaagattttaacaaaagcccgtctagctcagttggtagagcgcaaggctcttaaccttgtggtcgtgggttcgagccccacggtgggcgatactttttatgcgattttgagatttgtgtcttaaaatgtaatcgtgataatattaactacgcaactgttcatttcaattcttgtgaacgtgtaaacctcgaaactacacaaatcaaatcacgagatcctttccttttttcatatagatactcttttacttttttatagaattagacttatcgacactccatgatgattcccatatggatggttctcatatttttaacattactttttacatagatcgaatttttggaaatgtatcgaaaaaagaggagagattcgattcaaatacccacatagaacggacaaggtcaataatgggcccactattcttttgagagcccatctcaacaagttgaatcatcttttttgtgtactctcacttcaccttttgacaaaaagtcatggaagccaaactttggaacactactttactttgccaacatcttgttttgttgaatacctttttcaaattggaaaccaaagacatatctaaagggaaaacctgtaggacaataaaacaaagaagtgatagctaaagtctaaactaatctcaatatatgtaaatcaaagagataactaatgaaaaatatgaaaattttcgcgaggattaatgaacaaaggaatttttttttttccttctaaaattttttattagacaattggtattacaatgacaactacgaagctaatacaaaacttcggaaaccaacttattacataagcaaaattatgtgtcatatactgaaaattacgaaactgaaaaagtgaatttaacgatttttcctttcgataagctttattcgctaacatgttaacatgttagaacatagaaaatattgaaaaaaaatttatgtttaaattgtcaaatggaaatatactttacacttttatttgtattaattgttactttgctctcctagttataaagaagtaaagtctatgattttgttacttctttttttcttgtaaatctttatacatgtaaaaagcttttgtttccaactctaatcctcaatattttatttttctgtttattggaaaagggctgtaaactaaaattatttacttgaggaacgattatttaggtgataagagtggacaaagatcgttgacacgtggacggtctacaaattctaattttgcctataaatatcaaagctcctgaatatgtaagtttcattcactgattatcgtttaaggcaaattaagatcatcttcataaatcttctcagatctcttccaattttctagaaaaaacatg

SEQ ID NO: 28774 - DNA, 3000 bp, Unknown; identical to SEQ ID NO: 28773
  misc_feature (1)..( 3000): 2750-1469P.txt file - cDNA_ID_2998602; gDNA_ID_2926255; Annot_ID_204515

SEQ ID NO: 28775 - DNA, 3000 bp, Unknown
  misc_feature (1)..( 3000): 2750-1469P.txt file - cDNA_ID_2998605; gDNA_ID_2926255; Annot_ID_143112
cgtgcctttgctttgcatggggtcctcgcgatatttttttgaaacttctctatgttttagtttcttatgtttcttcaatcttcagatatacaatgtcgtatatggtaaaaatttcccaatatcgtgaaagaataattttctcagatgcttcctttatcgtgcacgcaagtaatgaatcaccaactaataattgacttcgcactaattaatttgtgttctcatcgtttctttccttatcaaacacgaaaaattatctttttatttcttatatatttctcgaaaacattattgcctatataacggcctctctaaagaaagtgatgtttaatttaccataaaaaaaacttttagatgttacttatagatttaaaatgtaaactgaattaatgatagtaattttcacaagctaatgatactactttagaggatttctgtatatttagataataaaataatctttgtaagctaaacttgtacatgtatcaaattatttttaatttactattttaaattagatttcttgataactattttactgttttgtgataggagtagaaaacaaaacataagattaccattaaatgcagcaataatttggggtatgactatgactacttactaatcatacccctaagattgagatctccaaattgcagacgcaacctttcatgttcaaaaccaataacaatccacacaagactgttctaaaatgtctatttttttctttccattttgaatatttgttttatccatcattactgttgtagttttacttgttattattaacataaacatttgaaatatcgatgttctttagtataaattaatatatgagtgatactcgtggaaaattataactttggattcctcagccgtaaaatgtgaaccactttagatttggtaaacttgctatacgctaaacgacgactaccagaaccaccatccaaagtccaaattaacaaattgtgaaatatatagatgtaagtaaattaggggattaagtatggattaaaaggtgtagcaaaggataatgaaagattggcgactaggcatgtggtgcgatgactacgcacatgggtgctcatcatgtcctccatctttcacgttttgttatttactttttttagcttaataaattatacttatgattgggtcaaaaattaggagaaaaaatatctctcaagtacaaaatttatattttcataaatgtatatagtacaattaaaagtcgcgagagaaagttgcaaacatgatcaaataacatgtttatgcattagccaatttaatgaaaaagataacaagatcgtacaatcgaaattctcaacctcttacaaagcatatacaataacaagttaaaataagactttttgagctttatcagcttatattctaaaaataaatatatcttggtataatttccaaagttttgtagtatcattaagaaatttttgatcaggtttccaattaattgattccagtgattacaaaattatattaatacagatttttttttctgttttcaagttacaaaatatccaactagagtgttaacgtcgtcaataaaattatctatgtgtgtgtatatatattgatatatgtatatagaattcaaagagagtggtttctctctttttatatagcaaaggtggtgtgctttttacacatggagagaaaagaaaaatgagatactttatgacatcaaccgatgctgcttagacatatatgaatcaaatcccacatgcaaattttgggaccatttcttttgcttggtttttacccactctatctaatgatcatgatcagtaacaactattattcacctcaccctctaaataatcacatccggaaactatctaatgatcatcatcaggaaactaaactgagaaagtctgaaaaaaacaaattgtgctttgatgttcataaattgataatcaagtcgtcaaatcttttaattcttttacacgttatgaaccatcatattttcagaatcaacgattatatatgtttttcacgttaattttatgcagttttataatttatttgtccctttgtaaacaaaagagaaaacagcttattaatggagtttaccttaaaacaaagtactaatagtataaactaaagtcaaaacatatagtagtaaattagataaaggttgggatctgggtccagagattctaattgaatgctttcattatcttataaagctttatttgtgattcccacatcttttaatgaaaatcgctttgcagtgtatattcttaaggacacgagacagctttgttgtctatttgtgtaggacatgcttagtctttttcctctaataattatcaaggaggaccattaaaaaaagaacaatatatatagaaaacttttaatatacattttcattaaacttaaaaaatgatagaatatgtgagaaataataatatggggataattttagaaaaccttttccgtttgacaataattcaaattcattcgtagtcatatcaatatcagctaggcattattaccaaaacaagaaagacacacacatctgtgcagttgttatcaattatagagtgataattgatctggttagcatgactagtgaaattgacaagataataaagcgaagaaatcactttacataggaaaattttgatcactacaaaagttttgggtctaacagtagttaaatgaaaatattgaggactaatcgaaatatcgactttttaaggtatgagaattacaaatatatataaatacagggctttcttgttacaacttacttgggctttagtaaaagcccaacatcaatcttgatacgttgacttcgatttgactcctcgtaagttttctccgatgtaatctcaccgtcttcttcagctcactcaattttccgggaaaatccgatttccgttgtgaattattcgtcaggcaacgaaaacccatgattgatccgcgaatgtgattcggatccgattggttccttttgtgggaaattagagggaaaaaatg

SEQ ID NO: 28776 - DNA, 3000 bp, Unknown
  misc_feature (1)..( 3000): 2750-1469P.txt file - cDNA_ID_2998629; gDNA_ID_2926257; Annot_ID_143132
gtgtgtctttttgtatatggatggttccgtgtaaaaatgtaactgtgagtttgaacaagccttctttggtgttaatttagctgtcttccaagcaaaggaaattaatgaatggggtttggtggttggtttcttcttaattgattttttgtcgaatatgattggttttctacaacctcctcacactcgaaatagcagaatcatttggtccatttttaaaagataaaatctacacatctttctttcttctatattacctggtaggttttagagtcaagattttaatttacctttttcctgttagatgtaacaatacgtttgaatactgacataaactaagatttgacactaaagtatgttgagttaataagttaaggaaggtgtcggcggctaccattcgagcgtgttcatcacccgcctgtcgtgcgcgtagaaaactcatttcgctcccacaaattaatgtggaagacccttgctatctatgttacgaggcccatgggcccatgtaattaaaatagtgtaatttgaaattactgatgtgttctcgggaagatcaatatataattagaaagaaggctctgcgccgacggcgtagaagacgatgcgtctcttgtcgtcgccgataaatcgaggcttcttcgactatgttgaactctatccatcgctcgtttcatcttacttcccgccaccagatcgtccttcggctgtgctctccgtcggcgagtaggacgataatgagttcttctcctcactctccgatcccaaagacgcatgtgagtgatcgttttcgcattctctagactattatctttcaacctagtttcgctgattttgaaccatttttactatgccgctgatcgcatgaatttgattggaaaaaaatgctctcatgctttcatagtttatattcaatttccagtggcataccatatcaagtactgttgtttagagattatgaactctccattggctcccagtgattttcctatgatcaaagcataatcgtggcggtatctaaaggacacgttatgttaattctgttaagcagactgcatcgcttgactcacttaatgattatgaagagcaatttccaccacttactggtggctctaagacgaagaagttttatcttggttctaccaatccttctactccatgtcaaagttcacagcttcaaaactggacaagcggtaaggatgctttgtctttgcagaggaatttgggatgtaagaataggaggaggagacgggcttcacggtttttacatgaagaatccaatgggacaacttttgaggttggcgctggtattggctctccaacaagtatggttcattttgattctaccaacccttcttcttctagtaaaagttcacaatctcaaaatttgaaaatccgcaaggttaggaatcacaggaattctggattcaagagtagggatcaaagtcctcagaggataaaggatcctccgcctttcgacatatgttcttcagtcctcgaaagaaatgatacaagtataaaagattggattttggcggatgaaacaaacagagaaactgttgaagttagtaataaacacaaagttataaggcctggaatggtgcttcttaaagacttccttacgcctgatatacaggtaaaaaactgtgaaaatgatcacataatccacatatttctctagtaaagtaaagagttgtacatgcttataggttgacattgtgaaaacatgccgagaacttggtgttaagcccacaggattttaccaaccggggtatagtgttggttcaaagcttcatctgcaaatgatgtgccttgggcgaaactgggatcctcagactaaatacaggaaaaacactgacattgatagtaaagcaccagagatccctgtcacatttaatgtcttggtagaaaaggcgatccgagaggcacatgctctcatagatagagaatcaggaacagaagatgcggagaggatacttccagtgatgtcaccagacatttgcatagtcaatttctactcagaaactggaagacttggtctccatcaggtgttgtgcagtttgactttaaacctctttgaagggttctcttgacactaataatgcgttgttttgtattggcgtataactatggcaggaccgtgacgaaagcgaagagagtatagcaagagggttgccgatagtgtccttctccataggtgattctgcagagttcttgtacggagagaagagagacgtagaagaagctcaaggagtgatattagaatcaggagatgtgttaatattcgggggagaatcgcgaatgatcttccatggcgtcaagtcaatcataccaaactcagctcccatgtctctactcaacgagtccaagctccgaacaggacgtctcaatcttacttttaggcatttctaatcatctttcaattttatcaaatatataaagaattattgaaaaaataagtaaaccctaaatttgaagaatttctctttattaattttaaaaatacataaaaatccaaaatctcaaaataaaatgaaaagaaatcgttgaataattttgctgtaatttaggtgaaataaaaatatagatgtgcaacattattttccttaaatttatgtatattgaaaaagaaacaaattttgttgatttcccaggtggtatatattactatcattaattaaaaaaaaaaaaaaaaaagagaaaagagagaagaggagacaaaacgcaacacacattgacgactttccgtttcttcatcttcttcttcttcttcttttttttttttttttgctgctgacgacaaaatcccaaaatttggcatttctccacatttctctctttgtgcaccaccatctaactcttcatctcctccggtgttcctagggcttccgcttcgctcttctccgtccttaccggattatctcttcgtcatccgctcattctccctgcagtgcacaacagtggctttgctgattgaattcgctttctcattgttcaatttggatg

SEQ ID NO: 28777 - DNA, 3003 bp, Unknown
  misc_feature (1)..( 3003): 2750-1469P.txt file - cDNA_ID_2998633; gDNA_ID_2926257; Annot_ID_143135
ttagtgtcaaatcttagtttatgtcagtattcaaacgtattgttacatctaacaggaaaaaggtaaattaaaatcttgactctaaaacctaccaggtaatatagaagaaagaaagatgtgtagattttatcttttaaaaatggaccaaatgattctgctatttcgagtgtgaggaggttgtagaaaaccaatcatattcgacaaaaaatcaattaagaagaaaccaaccaccaaaccccattcattaatttcctttgcttggaagacagctaaattaacaccaaagaaggcttgttcaaactcacagttacatttttacacggaaccatccatatacaaaaagacacacttgccaaaagctatacttaaattatcaaagttttagtcatgcactttaaaccaaagtgaatgcgacagttactataataatcttctgatcaatttacgtaactcttgtaactgttcattgctcttatttaacaaaaaggtaaacgtattatatgattcggagttgcattaccgacacaaactgattaaatattataataataagacgatggaacacaaaataaactaatatatgaaaaacattttataaaatttcaacgttttattttccaaattttgcagcggaattagcagaggaaacatctgcggattccgaagcaggaagtggattgtgatctctgaattgggtagtcagcagaagagtcgaaggatgaaaatcttcgcatgacattcctttctgtttgaaacttgaacagatcgtactcattttcgtcgatcaacactctctccgacagagatggtggtgatgaagccgacagtttcttagccttaccattgtgatcgcccgatagccagaagagccttgtcgggattagtgcgaggattttcttggtggactttttggaacggcggcggatttggtcgccggagaaagagaaatgagacggcggaggagtgagaggtggcagagtaggtagctcagaggaggggtgtttgggtgtgcctggatgagattcccattcgaaagggacggcaccggcggctccgtcgtagtagtagattctaaaggaaggacaagcagctgataccgacgaaaaacgttgtttggtcgacggtagcttaccggagaaggtggcggtgtcttgctttttcagtgagagtgaagctgcccgctcagatcccgcgtttggcattattgtcttgggagagtgagagagagagagggaaggaaagagagggagagatgtgtgcatgagacatatggagtcaatctatcatgtatatatgggtgcctggtgtctttggtacggtttttacttttgggcttatttgtttggctttggtgtctatagaaactatatattaaaagcaaaatgtaataattaatgatagtgaaataatagtttcaatagtgcggttaattagctctcatagttagaacttataaagatacatctcgaagtgtgttggtccaatcctacaaaggcaataaccactcgatggatatataaagtcatcacaacttattagacccttgaacactaagtaatgctaccgggtacaaaagaaaacactcacatatgaataatgaggagatctaaatacgtcatactcaaggcaagatatttgtatcacatgtatatagcaattaacgattcatccatgagaatatttacattacaagccaacatatacataacttcaacacaaacatgtcattgatgagtagattttattaagaaaggtgtggttattgtagaagcatttatttggagagtagataggaccattgatgaaaacaatatgaattgaataattggtttttatctgattaaattggaaaacagtgtatgactaaacgagccacgacccatgcattcctacatgtgctccacatacctccgagcattgctttccttagtatatacacactgatagaccccatggtcggtccattcttttgcattaatatctttcatgtgatattcatatactcgctcccctcatcagaatttacatctcttcgttaaaggttaaacaagaagacataattacattttcttccgtccattaaagaaaaatgagagattttttttttaaaaaattgaaggtctttaaagtattgagaaccgtgacctatttataaggtttaaaaccaacaaccaaatttctcatttgttgggttgtgaaagataatttggcgaatatcatacaaatgcgattaattacggtttaaacatctccattaaggtattgacagtatcaaaataaggagaagaaaatggaacaaacaattttgtccagaggtgtataaacttggagtatcatattcttatagcagatgaaataaaatactagttagtttatttgtttggaaaacaaaataggtaatgtgaatatagattttaaaagtaattttgatactacagccctttaattagattgaaaataataataataataaagaaaggaccaatcatatgtttgacaaaaaaaagggccaatcatataattctgttaccatggatctaaatgagaggagactcttgctttttcacaaaaaaaaagaaaaagagagagagagcagcaaccccagcagcatcgaagatcgtcgatcgtcgatcggttgctctctttcattaatcagatctaattgatacccaagcttcttcatcggaggccgtgtaagctagcttcttcttcttcatcttttcgtacacttatttgattgttgtttatgtatcgattctatggaataagagcttttagcacatattaatttgtccccagtctcgtcgtatatgcagacctatttagcgcttatggtttgatttagatctgtttaatttagcgtttcaacctaaaattgttgacaactcaaaatcggaatcccccaaaaagtgtctgttgacttatgaatatggccatctccaaatcggtttttgatccatcatcattaaatttggtaatatatagatctcacgaggaaacatg

SEQ ID NO: 28778 - DNA, 3003 bp, Unknown; identical to SEQ ID NO: 28777
  misc_feature (1)..( 3003): 2750-1469P.txt file - cDNA_ID_2998633; gDNA_ID_2926257; Annot_ID_204592

SEQ ID NO: 28779 - DNA, 3003 bp, Unknown
  misc_feature (1)..( 3003): 2750-1469P.txt file - cDNA_ID_2998644; gDNA_ID_2926257; Annot_ID_143140
tatgaataactttttcttactatgaacaccctcacttttatataaagacaccaaatccttccatcgtagattcatttcggtccgctagcattctcgttcaattagtagtcaaccagtaacaaaagtaataaatccgtttttacgtgagacattgcagagcttagaaataagagaatatcattatctatgtttagaagtttcaattcgaaagtaaaatgaggtagtgtaatatgcaagagacatgaactactcattcactaataaccaaataatctcgaggataaccatgaaaattaacaccaaaatcattacaattgtaatttacgtatttagttttcatagcaaattttgaaacttgtgattttgaaaattttatgtttggaatgacattttggtacattatattggataactatttgtcttttgtaggtgtttttaagaacagatacatatacaaagattttgttgtttattttctggttcaaccaacacctttagaatatataaaatcattagtggaattttttgctgcctagttattcaatcattagttgaacaaccggcccatatctctccgcattaagcaagattttataaagcaaatgtgccatttaattctatactaaagcattcggattaccatcgaatgattattttatacagcagtggaattcacatttttcttttctttctgtaatttcgattaacagttatatacgtatatatagtgccatcaccacctcataattttatatcgttaaacaaaaaataatttacacgttttcacctgataattacttaacggtttaaaaatgtataaatagtaacatatactattatcaacaatagttagctaggaaaataatggcgtaaagaccaagtggatgatatatctttgttttaaccacaacagtctcatattccgcaacgaccaatcatttatggaaacaaacaaacatcaaatcactcttttcaaaaagattgtgaataccattcagatcaaatatattagatagattaattaataacttagccacagtgacgtacaaaagactttcaaaacggtggtagtaaactgcctttttaactgcgacaaagaagaggttatgcataccaatattattttaccatccttaaaatccaaaacttctccttttaaggtggtgtgtatatatatatatgattagtcgataaacattgcctagattatccaactcatgatgatctagtagttgaaatactagaattcaaatctttctctgcaatggttagctactacgattgccaaaaaaagccaaatttcccacatgtcttagagatcaaattagtaaagactttgatataaaattcttatggtaatatacttatatcaaacgtataggtagattaattttgttttttttttaaaaaataacaataataattttgttcataaaattgttgttaaaaaaaaaatatactctaattttttataaccaaaaatgtaaagtagaaacgaattttaaaaagttggcttgtttgagttgtttatcttgtatatttggatttcactttggtgacccatgacttaagaaagtgaaatccaaatttgatattgggcctgttgtccattaaccgtagtagaataaattacacgcgtcttctaagtgatattttagttgtcgtcttaaatcattttttttttttgtcttcttcactgctatttaaaaacttcatgtcatgtacatatatgatatatgattggaaatatttgaatatgtgaagaatccacttcacacatggctactgttagagaagaaaatatgtgattataaaaagcctacgaatcatagagaagcaaatagaaataaggtagaatctcattaaataagactgaaagaagaaaaatatggtaaaccatacgtgcgtgtagtaggtagaagtaggacccgaaaacaaagcctcatgtctcataaactcatttgccaaactccaaaatataattccaccaccattgggggagctctctctcacctgcctaaaccggactccgatccggacatgtggtcgtctacattagacgttcttttgaagtagtataattttctacaataatagcttgttttgtagaaaaaataaataaaaaggttttgataaaatcatataaataaaacgtgctaaaaagaaaaagagaaaaacgacaaggaacaagaactagtaattaagtgtggacaaaagaaaaaaaaagacgaagaaaatgcatcaatcagataaaattgattcgaaaggaggcaagcacgacgacctactaaatagccagccacaaagcccatacttagccgagagccgagccgtgcatccattactcgagtaggacctaataagaatgtccaagtcggctgatttgacacgtgtcgtttaataatttggtatcgaaagacattactccctccaatttcaattattaattaagaaaagaagacaagaaaaagagagagagagaaactacttttgttttttttgggtaaacgtcttcgtcttcttcgtctctctttttttttttccattacttttcagaagattaaacattcctctcgccggagaactaactgctcgatagatagagatagagagagagctctgataactgccattctgtctctatctgcttcctctagatacacgttagtttttttttctttgaaaggggctaaatttcgtacacacgacctatttcttcttcttattggattttgtagagaaaactttattatataggtttctggggaatcttctgagccgtttagaacaaggatttaggcaaaaatatggtcagttagtttcttgtgctagcaattttgaatgggagattgcgacgacgacgactagtctctcctcgaatcagggtttatagttgttgttgatagagatattgaattggaaccaaaagaactcaatgatagagtagtgaattttggatgtagtgtttttctcatcaacggagtaataataacaataataatg

SEQ ID NO: 28780 - DNA, 3000 bp, Unknown
  misc_feature (1)..( 3000): 2750-1469P.txt file - cDNA_ID_2998648; gDNA_ID_2926257; Annot_ID_143144
tcttcttaaagaaatagaaaactaaaaaataaattattattaacatatactaattcatatgtctatatctaaaaaatattatattttatttttcttaaccaaaaggaaaattaacaaaaatatatatatatatatatatatgttattggtcaaatttttaatatatatggtattaacaaatgttttattattatgaattatgttttgttaattgttaataatttttaatattaactaagatatagatttgatctcatatatatatactattttgacatgaaatcattatcaagtaagataaagtgtgtagaattaaaatcgagttttttatgaaatagatagttaaattgtattacaaaattgaatgtataagataaaaatttattttttcttctaaatactaaattataatataaaaaaaagtgtgtaggttactatttatacttcaaatatcatcaataagattgaatgggtataacaaaataaaatgtataagactactattttactattcaaaattatatatcaagaacaatgtatcgattattattttactattcaaaatttaaatattatcgataaaaattacatttacatcttacacccgcctatttaggcgggccttatctagtattatatatttttaattttaagaccgttttatgctttgactaatgtttataggatgaaaggcatgatataagaatgtcaatatattgaccccataataaatggtctaatatcgctttttagatgtttgaagcatatattttttgctcaaatttaaacagaaaccaaaatatttaaatttgatattttatttatttatttcaaaatatttaaaaccttgttaattttgatttgtgtttacggtatttaaaaactaaacaaaaaaaaaagtttgataagagcttgatcagtgacagtacatggaaattaaatgcatataataaataaggcttataagttgaggagtcaaatatgggcctgatattcagaataaaaaagcccattaattaggtgaacatgcccaagtcagaataaaatctgttgttacgtcaagcaaatggaagcgggagatatatatttgctccctattggacaacttcaactcttgggcaatcgaagctttgaatatgttttgtggctgggcccattaacccaaaattagaaattaacatgtcgtgtgtcatgagaacagagaatatagggtcagttgtgatggcatggacatggttaatgcagggtgcacagggatttaacattacatataaaaccatattggttacgtctatcattagtttgggctaaaccatacatatttgttattcttttctttctttgggtgtcaaatactcatttataataaacaccacgtacacacacacacacacacacaaaattggtaagtgtacagtttttataggaaaagaagacaatttctatacctacctaacaatggataaacaattccatcgaattgagaaacgatggtcacatcttgattcacaatacattcaacttgaaattaaagttgaagagtgatagttgtccttataatatctgtatattgaacaaaacattgttactaagaatttgtgttaatcataaccaaaaaagaagaagttagaagtagatttttttttttttgaaaaaaacattaaaacaattctactcgagggagtaggggatcatgaatgtaagtgtttttttttttttttttttacatgtgaaacataataatgggaagtggtgagttgttgcttgggaatgaaacaaaggtagagtcttgagatcgtttggtaggcatgttttttttttatcctcaaatgatcatatcagtcattatccctcttttttttgcctctctattaatttaatctcccctaatttagtgagtgataataaaggagttttttttttttttttagtgagtgataataaaggagttagtttccatcaaactagttgtatgattcacagataaaaaccaacaaaataaataaaaaaattcgtacgaacaaattgaaaagaggagtgaaggtaagtaagtcaacgggaaggttgtgagatggagtgagcaccgtttacgctacttctccactgtgtgcattcaatgaagtgattctactgaaaatcttatataaactatacatgcatgatgcattgagatgcatatgtttttataattgacataagattagtaaacacatgcgtgagtggtacgactaatctaagagtagtagtgcttgaggtgtggaagctctctctctctacaccttcttcttcatagatggatcgtctaaaatcacttaagtaattatctgtataataaaagaaaggaaatgatggcgtagcaatgcatgctaagggacaagaaaggcttcgggggagagatcacttctcttctactccatcctctttgtctctgctgcttcaaatctctcatctacatgatcagatcatttaagcgtgatagactctttttttatttttttattattacttatatttttttttgaaaaagtattaaagtagtaataaaaagcggggagaggagaagattgtctcctagagcgacttgaatccttgagctttcaaactcatctcccggagcttcccttttctctttactctctctctctctctctctctctctcacttttctctgttttttttcttggtgtctgtcttaattccaccattaatgctctctaccttcccttttactcttcccctgcttttgtgttttctctttctcttttctaaaccctttcaaactcttcttcctcttctttctttttctccaataacagtttcttgtgctcatgttaaaactgcagctcttttccggtaaaaagaaaagctttttggtcagtttagttatcctcaagcatcaaaaccttacttgagctctgcatcatcatccatggccatggccgactagccttctttcttcgctttttacctccttaatatctttaaaagcgagaggaaatg

SEQ ID NO: 28781 - DNA, 1859 bp, Unknown
  misc_feature (1)..( 1859): 2750-1469P.txt file - cDNA_ID_2998656; gDNA_ID_2926257; Annot_ID_143150
ctactgtttttgtagtacatcaacaaaaaacacttgaaaatcattgaggcctgccggacaagtgtatctgaggaatatagggacaagtgagtaagcaccaaatgatccaacaggatactacaacgaatcatattgggaatactgcatagctgatgaactgttagctgatgaaagtggactcgttaaagcaagggaaaccaaatataggagagaaagtacagaccattcaccactatgataaaaatggcatgccagaaaggtggtatggactttggaggcagcatgattaagggatacaagaggtcatccttccgaaaccaccaataaacaccaacaacatgggccgtaaatgctacagagattccaattaatgccgagatatgcctctcaccctgaaatcattaaaagagacttaagactgacccatttgaacattgaatgggaaaagaaacaagtaaaagcaaaagaaaaccttcaaagctgtttgcttcttgagaatatcatttgacttgaacatgacagcagcaatccaaatggcgacaaagaaccctgagagagagatagcaggaggaaaagtcaaatagcaggaggaaatcatcagaaaagacacgagagagagagatatgaaatagtaccctgcaaatgctggcggataaaaacaaccaacagaagcaaagaaaagggaagaatttgctcaatccagcgtgcagcctgctgaatatcatatctttggtaaggcgaatcccgggaagcggcgtctccagcagcaggatcacctggagcagcctgagaggcaccttctgaagcacctcccatgggatcaacctgagtagcagaagaacccaagagttcagagtgtccgggttccctcagagcattggtatcagtttcagcatcctgctcggtgttgccaatgatcctaatggcaacctccccattggagagtcctgaagaatcatcactaacaagcgtctcagcctcatgactaggacttggcctagctcgaaagagacccgaatactctaacaaggtagaaataggggcctggatgatgttagaagcagagaggatggagtttctacgaggagaacccctaaatgaatcatgactggcgccgggcgtttccatttaagaaaaccctaaaagcatatatgaagatgattagctaacagtggtggaaagaaaacgcgttttccaaaaaacaaaaaaaaagagtacctgcaacgacgagaagcaatagaagaaagcttagggtgaaatcaaaatcgtatttagctcatatcgtgtaagaaaccctaaaggcaatgaataagaggggaaatgaatgaagaagaagaagaatagagtcaaaaagggtagaggcgatcgccaagactaggatcgagccacggagtctttcctaaaaagggattgagctaaacggaacccaggggaagaagacaaaggagatccggcgagctgcggaaagagagagagagaggggacggaattgtcttgtctcgtctgtgtgtgaatcaaatcaacggttgagagttttttagttggacgaattgcattgtggatttaatccaaagggttggttgacttaaaggaagcgacgacagtcttctctaaatgggcagcctattaaatacattatgggccttataacctaaatgggctttaatgcaagcctactaaaataacatgcgtgactacagcccccagccattggggaggaataaaatatctctctctctctctgagactctgactgagaagaaagaaagaagttgactgacatgagaagaaagggacaagagcgcgtctcgaaacgccgtcaatgttgggttgctgatactaataaatgcaggctaatg

SEQ ID NO: 28782 - DNA, 3003 bp, Unknown
  misc_feature (1)..( 3003): 2750-1469P.txt file - cDNA_ID_2998672; gDNA_ID_2926258; Annot_ID_143161
cctattgcccctgtaatcaattgaagattaaagaatgtatcctgtgttacagacacgtttgaagcttgaaacagatttaaactgactaaagaaacacagtttttctgactacccttttaaaatgcaagtgttaaatcaaataaagacagaagaaagaggggaaagtacattgaatccagcatatagaggaaattctctgaataagaaaggttggccgaaggaagaacaggaggcctgcctgccgtcctcaaataagcagctgctgcaattgttggtgcctgcaaacacgttgtaaaccctttttctagtcccgcaacttatacacagatacgttaaggaaacaaatcatcaacagatagaacaatacctttccgagaatgcgaacaatctgtttatcacgaacttgttttgacttgtaaatgtcttggccctgcacccaatgaaagaaaatcgagttggcatagccattttcagaaaaaggcatcttgacagtacgaaaagaacaggatttcaaaacttacactaagagcaggatttgcatcagggtgaaagatagaaagtgcactcatggcactcacaagaactcccattgggtgtgcatcatgaggcatggactgtatgatatcctgcaaaaacattcagaaatcgtctcagatcaaaaatccatagaaaattcttttactaagcatatacacataactatattcacaacggcgagtaagacataaggtactaatactagaaagagatccagtatccttaatagacatggtttacaagcaagacaaacaacttgtacacttgacaagaaatcattttcaaaatccctctttggtttggatttgcattctgatacaaagtttggaatttgcactagtatgaaaatccaaataacgaaagagtagaaatttcaccaatactccttgtggcacagctgaatgctgagaaacagtgaactcccaatcagctagctgactttgagaaggcagatttccatacactggagacaaaaaaaggggaattttaacacgacactaagagagacacaattttcaagacattttcttttccacaagtagacgccacaaaagtaaaataagcaacaacaacaacaagaataagcaacgagattgataaagacttactgaggagataagcaacctcaataaaagtactgctctcagccaactcttcaattgggtatccccgataacgtaagattccttcatctccgtcgatgtaacaaatcgaagatcgaaccggagccgtgttcaagtaaccaggatcgtacaacttcagccccttatcatccttccccgtcgttatctgcacaccaaacatgcaaatccatcaaattccttatcatattcagggaaaattaggtgagacgaatcaaaattcagataaaactaactcgattccacaattctgttcaggattacaaatccgttacataccttcttgagatcaacggctttaacggtaccatgctctgagacagggacctgatatttcttccccgtacgctcatcgacgatcgtcaagtttcctttgagtgatccatgaggtgcagcggtaatgtgagccgatgtacaccatggcgcgatcgccggcaacacctgttccaatccgacggtatcagacaccgccaaatgcgcggtgagaacggctaatctagctttcactctctgcgaaatctccatttcttcctctcaaaaaattttaaaaaaaatatctgaattcaatttcaaaggaaggaagcgaagaagaagaagaagaaacaatcttgcggtaagtgacttggcttttgtatcctgcatttgctaattttggtagtagctgatatttttattctctgcgggtaagtgtattgaaaatcggatccattgtttatccaaagctcgacggtgataagattattcagcttagatcaacggatagaattgttcgtcaaaaactaatatggaaagtctaaagaggcttatctgtcaagtttatcaaaggattaagactttcgtttctgaaatccacccgggcaagggcagtgaagactacgcgctcaatgagaatgacaggtggaagaacacgagcgagtgtctttcagacgctatgtagatcgagtagaagtcgattggcgtcctcggattgctaaataactatctggttttcgataatgggccaactcattggtctcacattgagaaatttaatttccctaagtgtattgatcggcccattagctctttacgcctgggctgatgacaatagtaataagaacaagggaaatggtccaatatctttgcagttaaaatttatgaacatatggaaattttatatttgtagcacaaagattcaccagtaagaggctggtaatacactgcattgggtcacaacgggccggtccattaaacccaattaactcttatgtatgagaaggaacttaaaaccccattcagtttttgatggacttgtgaacgctgctactaaaccaaggtcacttctcagttctcacaacacatatgttatgtttgcaaattaaatgcagttttataatttttagtatttaactgactatcccaaattattttcaaaatatctttgaaatttaaaaagtgattcaattatgaaacctccactcacacttttgtaccatcctttgcttttgcactaatcaaatttatttgtttgttcagttaaattgttcaaaaaaggagaaagttatgtccaacaaaaaagagagaaaaaaatgcaattagccttttaataaaaaaaggagtagtaattacaaaaaaaaatgaagtactgtagattatgatgagtagggaggaggaaaacgagtatgatacttcacccgcattaagaggcaaacccttaaagcctgctgattggttgggacttttttttctacttttctttttcttttctgttgctgccgttacagttccatttacagctcatattgcttgcggcagaaaattctcaccaagtcctctgttgaacatg

SEQ ID NO: 28783 - DNA, 3000 bp, Unknown; identical to SEQ ID NO: 4552
  misc_feature (1)..( 3000): 2750-1469P.txt file - cDNA_ID_2998676; gDNA_ID_1620714; Annot_ID_49068

SEQ ID NO: 28784 - DNA, 3000 bp, Unknown; identical to SEQ ID NO: 4552
  misc_feature (1)..( 3000): 2750-1469P.txt file - cDNA_ID_2998676; gDNA_ID_2926217; Annot_ID_142284

SEQ ID NO: 28785 - DNA, 3003 bp, Unknown
  misc_feature (1)..( 3003): 2750-1469P.txt file - cDNA_ID_2998684; gDNA_ID_1620714; Annot_ID_49087
gtttaggatcaggttgtttcccaattttatgttatcgtttagactttagatcttttttgagcatggaagggagtttagcatcattttttaagtattctagcgaattacataagaattagtcattctaacgaacttaaaacccgaccaactaataattgtgaatccaaattttcttgcagtgtactcataaactcattcttggtcaccaactatgtatataagtaagtaactatataatattgatatttttgaaacaatatactaccaaacatattcgagagccccacattcaccagacaattcgtccaacgccaatctcgccagcctttagcttaaattaccaaagggacaaaaaaaagttaaagatgaagaaaaaatataatacaatttccgttaaatttacttataaacactaaattgctagtcaaaatttcattacctatgaataatatttagaaaaaaaatactgtataagttggatttcttatacaaagatacatgactcagccttccgttacaaatagtcggaaccaaactaagaatttgctccataatctcttacttgtggcattaattagtcatttgaacgtcatttctattaagtggagagtaaaagtctgatgctaaaaaaataatcgatttactttcgcctttgtgtctctttgtatccccaccacctccttatctagttaaccgcgtaacgagatggacgggcacaactatatacatacaagacgtgtgtgtgtgtgttcatgcctatataatagctaatgttcttgtaagttataactcgaacaagaaacagtaagagaacttataaatagagaaggctatatggggaattgtgcactaaagccaaaagttctgtcagaaaccggagctccggcgccggaggagctcaaggattcacttcttgaataccataagatggacgctgcaaaatctcttagcaacttgttccttcaagtaagtcactataaaattaaaaacaagcacaagaaattatgatgttatattaagttatgttattctttgtgtctcatttgtgttttcttttggttaataggacaaggcagataagataacgaaagaagacgagaagatcacaccggaaaagataccggttactgatgatctgaaaacagctttggaggaggaaaatactccgaccaaagaggcaaaatctccggcaacagagacaaagtattcggtaacagagaaaagagctccggctgacaagaagataacaccggaaatgatgccggttactgaagatctgaaaacagttttggaggaggaggcaaaacctcctgcaacagagacaaaagctatggttgatgatcagaaggtgaagaacgaagtggccgttcgtgaagagaaaatcattgacctcgtgactgtgaaagagaacgaaacagaggcgaaaacagagtaggtgggaaaagaataaacacagtgaaacagccttgaaacgctagtttctgcgttcttgatagcaaaatgcttgtttttgtttagattatatttttcctcgatagataaacgcaaacgctgtattctttatatgaattgaaaacttcaaatttcctattgaccgatccgtcaacccaaaagaatgtcaatgtaagaggctacgaagaacgtgtttttccgttttcgttttctgcgattgcgtttcaaagagaatgcatgcgtaaatcggtgcccgttacaacactttcgaaagttttggtttggactttaacgggccgatacgggccgtattataaaaaatttgtaaaataagcaacagtttaatggaccgaacttcgtcgatcgagatctaacgggcgagtaagaaccgggtcggaaatacggatccggattctgagcattaaattgtgaaacaactaactcgacaaaccttttaattgcagcaatttaagaggccaccgaactctcgcgcctcgacatctcaattatacatgtagtgaacagccaataatatttagccacgtgttcatagtttgttggtagttataaacttagactaataaactcgaccacttctaaccaccaccggttcatggacgaccgacctgacctacgaaagttaaagtgagttctttaataaatgtgagaccaaacgaagaatttttgttagcatcaaattaagtccaaaacatgacttttattgatttcatatgattcaattataaagcagatcagataagtgatgtgtaacgaggatgaagacattaattgttatggcgagttcggtataataattcgaattttatcaacaacgtccaaccagatttatccataatggctttaacttcaagtttgaaccatgatgatgtgaattataagaagaagaaaaaatcacaacctcgcatagtcatatattccaaaaatagagaaagtgaaaaggacatcttaattatacatcatgtattttttctttttatccatagctaattgacgtgctttaaaaccgtgagagtgttatatgccagtcataaattcccagcaaataaatcggccatgcaagaaaatttgaaatcaagaatcaagggcagtgaattcagtaacgtgtcaattctgacagtaattttttctctctttttttcaaaaaaaaaaaagaaaataatcgcatacaaaacaaattatatggctattttctgttaaattttataaatgatagtaattttagtcaaccataatttaaaatgtgattttgttttaagaatttttccctaagatggcatttcagtcaacattcatatatggtattatatataatgaaaataaataactttcttaatttcacgaaatggaaaagtttagtatagaaacaaatctttagtctcttaatttactggtggcagcaataaaagggatattaatatctctatctacttctctcaactgtaactgcccatatatgtaccactccctcgagagtatcacacaacataaacccaatctctcactcagactaagacagagtcagaaacaatg

SEQ ID NO: 28786 - DNA, 3003 bp, Unknown; identical to SEQ ID NO: 28785
  misc_feature (1)..( 3003): 2750-1469P.txt file - cDNA_ID_2998684; gDNA_ID_1620714; Annot_ID_165582

SEQ ID NO: 28787 - DNA, 3003 bp, Unknown; identical to SEQ ID NO: 28785
  misc_feature (1)..( 3003): 2750-1469P.txt file - cDNA_ID_2998684; gDNA_ID_2926218; Annot_ID_142303

SEQ ID NO: 28788 - DNA, 3003 bp, Unknown; identical to SEQ ID NO: 28785
  misc_feature (1)..( 3003): 2750-1469P.txt file - cDNA_ID_2998684; gDNA_ID_2926218; Annot_ID_203116

SEQ ID NO: 28789 - DNA, 3003 bp, Unknown; identical to SEQ ID NO: 24446
  misc_feature (1)..( 3003): 2750-1469P.txt file - cDNA_ID_2998688; gDNA_ID_2926254; Annot_ID_143078

SEQ ID NO: 28790 - DNA, 3003 bp, Unknown; identical to SEQ ID NO: 24446
  misc_feature (1)..( 3003): 2750-1469P.txt file - cDNA_ID_2998688; gDNA_ID_2926218; Annot_ID_142336

SEQ ID NO: 28791 - DNA, 3003 bp, Unknown
  misc_feature (1)..( 3003): 2750-1469P.txt file - cDNA_ID_2998696; gDNA_ID_1971923; Annot_ID_58556
agaaatgaataggagacaaatgtcttaagctgcagtgactattgtttgaagcagagtttccaagtccttcaatctacaaacaacaaggaaacaccataaagttagcagatgggtacgaggaacagagagaacctttacgcataatttttgtgagaaacttcaagtttgatatatgatcctacttacttcacattgctgagatcagggtatacggcaatcgcatcattgaaattctggataaaaaaaaacaaagtttccgcctgttcttaaaccaaagagcaaaagaatagagaagtgaagaagatgttgttgttgtagaccagacctgatcagaggttgaagaagtgtacgtgatcacacatgacatccctgcttttgtagcagcctatatatagattaaaagtcaaggcattttaagattttctttcaagaatagcgaggacaagcaaaagataagacttttgacctgcaggccaatcacactgtcctctacgaccaaacagtctttcactgaaacacctagcttctgcaatcaaccaacatatacagaatgtgaaacttgggctaattcttcttgttaagttatattaactttcattttacttgggagttatattacctcggcagctgtaatatatatcgaaggatcgggttttttctccttaacatcatcccctacaaagccaaatatacaaccaaatggattcaaactttagaaaagtgtttaacacataaaatgcaagtataagaagagagagaatgtgatgaaatcacctgcaaggaagcaatcaagtccttggaaccgctcctaaacgacataaagtataatcgataaagaaaaaacttgaaagaagcatggtagatcagagattggcgaaaggaaacaacttacgatatcgattagattctcgagacataagattactgaactctttgtagctgcagaacaaacagctagttttttcccctgaaagcatttcaagaacctattctcataaagagctaaaaatacagtttagacaattataaaaggctaaaaagaagatcttattacagcagcttttgcttcatccattagtcttattacaccaggtcttggttctacctgaaagtaaaaagcagagagagttagtttctctcagagtaagtaatcccaaaactacgatttggctacttacacttcctgattttatgatttctttatacctctcagttttccaatcctgcaaaagataagaatccaatcttttaacatcaacattgcagtaaattatagatttggttcttcttcaggcaagtgacctgaagagtatcgattaacttggctcgatcatcgtcattctgaggaggagagtcaaaaatggtggaagttggccatccattttctttgaaataccaacgcattttcggtttcccacctccgactagattctgaaacttatcgtagaactcgaggctccaatcgagagactcagaggaagaaggaggacatcgaacatcgaaatgcgagaaagcatcgttgtaagcttgacggtgtagattctcggattcgagaatcacgccgtcgcaatcgaaaatcagagcttctagagaacgtaaaggcaatgccgagacaggagaagaaactctagatttcgaataaacgcttcttgatttgaaacgcagcgtttggaaacgaggaaagccgatgagcgacgaggaagaagtaacggaggaggaaccagcggtggatgatggagagaagagaatcgcagagtggttgcaagaaaccgccatatcgatgaatctctgtctctctctgggtgtgtgtggttcttctcaagataaaatgaaaaaaaaaacaatctgtggtggctataatttgcgaaaacctaattttctttacaaataacggtcaataactaacttttaccgctccatttttgtatttttgttcaaataattagttgatgaatattataggattttgaataagattctgtaaaataatacttttttgcagatataaaaaactatcatcatccaataaagacagattttttataagaaaaaaatcaagcaatcaagcatttccaaaactatgatccattaaatgctctaaacttattgtaatgattttggtaggggttgatattcgattttctatcacattaattttatttaaaatccttgtgtttcatatatataaagggaagttagtataagatggtgacaaatattaaaagggcgtggtccatgaattcatcatatcttataaaaggattcagtgtgtgtgttaggtggtgataaacacaaattagtctttagatcatatgcaacttgatgagtggtggtagatttggttggtgaaggctttttttgtcattagcccaatttccggacttccctttaaattttttttttgtcatcatccaaattttgataagtggcatcaaatttcgaatgttttaaatgagctacctaaaaaagaaatattatacgtaacgtggcataaattaagttaacaaacataaatattggaatatatttttatactttccaaattctggtttttcaaccttttgttttgttttgagctttgtaaatcaacaaccaaaagtttttaaatgttatctagtatctaccaaattttggatcggttcaatcaaattgaatcattctttactttttagcatcatctattataaaatttattttttacatgaaaaacgtttcctttaacggtggccaaaagagacaaaagcttccacgtcgcctgaaaaatatctcaaagcacacaatttacataaatacccctacgacggccaacaaccctctttttggtacactagtgttctgtctgcaaaacaaaaaactctgaaaagtcgaaaccaaccctctcccttataaataccttcttctctttccacattgtcttctctctcctcacatcaaaaccgcctccatttctcattctctctctctctaaaaaaccaaatccagagtcagagaaaatctgtgatg

SEQ ID NO: 28792 - DNA, 3003 bp, Unknown; identical to SEQ ID NO: 28791
  misc_feature (1)..( 3003): 2750-1469P.txt file - cDNA_ID_2998696; gDNA_ID_1971923; Annot_ID_177209

SEQ ID NO: 28793 - DNA, 3003 bp, Unknown; identical to SEQ ID NO: 28791
  misc_feature (1)..( 3003): 2750-1469P.txt file - cDNA_ID_2998696; gDNA_ID_2926219; Annot_ID_142368

SEQ ID NO: 28794 - DNA, 3003 bp, Unknown; identical to SEQ ID NO: 28791
  misc_feature (1)..( 3003): 2750-1469P.txt file - cDNA_ID_2998696; gDNA_ID_2926219; Annot_ID_203219

SEQ ID NO: 28795 - DNA, 3003 bp, Unknown
  misc_feature (1)..( 3003): 2750-1469P.txt file - cDNA_ID_2998700; gDNA_ID_1971923; Annot_ID_58557
aagcaaccgtcaatcatccttcacatttcatcccgccgtcaacaccaagcctaaatccgttaacctcgtcacggctgtacacgcggctgagccagctagaaacgctgtttcagtcaaagaatccgttgcgtcttcttcgtctggtgcattgaaatggactccagagagctggaaactgaagaaggctctgcaacttcctgattatcctaacgccaatgagcttgagtctgtgcttaaaacgatagaggcttttcctccgattgtgttcgccggagaagctaggaatcttgaagagagattggctgatgctgctgttggtaaagcttttcttctccaaggaggtgattgtgctgagagtttcaaggagttcaatgctactaatatcagagacaccttcagggttctgcttcagatgagtattgttcttacattcggtggccaggttccggtcattaaggtcagatcgatgaattcaatctttcttgttttttcttttgagcggaatttgagagaatttgtgtgtttaggttgggaggatggctggtcaatttgcaaagcctagatctgatgcatttgaggagaaggatggagtgaaattaccaagctacaagggagataacatcaatggtgatacttttgatgagaaatccaggattcctgatcctaataggatgattcgagcttacactcaatctgcagctactttgaatcttcttagagcctttgccactggaggttacgctgctattcaaagagttactcaatggaaccttgattttgttgaacaaagtgagcaagctgacaggtacacccaactcatcaactcaattttgaaagcaaacttttctagatgaattagtgatggtgatagcagctatcctaggttatgtaaggtgctaaaggttttgctgtacaggtaccaggaattagctaatagggttgatgaggccttggggttcatgtctgcatgtggacttggcacggatcatccacttatgactacaactgatttctacacatcccatgagtgtttgcttctgccttatgaacagtcccttacaaggttggattcaacttctggtctctactatgattgttctgcacacatggtctggtgcggagagcgtaccagacaattggatggcgctcatgtcgagtttctcagggggattgctaatcctctgggcattaaggtacttttaactttttcaaagaaaaatacaaaattcaacgcgtaggtagagcgataatatgcagcttcttactgatatacttaaaccaatgattaggtagatattacttttggtttatgataaagcaaaacagagtaacatttgagaggtttatgcttggtctcgtagcattttttgtttttttcttctcttatcttgcaaatcagacggttgattttgattgtcttttcttcagtgagagactggtagctggtttgatttgccactgaataacgagagtttattaagttgagttttaagcggaatcgattgaataaccaaaactcttgttgcaggtgagcaacaaaatggatccctttgagctggttaagctagtagaaatcctgaatcctaataacaagcctggaagaatcactgtaattgtgagaatgggtgccgagaacatgagagttaagcttccccacctgatcagagcagtccgcagatcaggccagattgtgacatgggtctgcgatccaatgcatggaaacaccatcaaagcaccttgcggtcttaaaacacgtgcctttgactcaatactggtacacactttataagctaaacctctcataagcgtaacatagatttgccataacagagatttaaacttcctgtctttttctacaggctgaagtccgagcattccttgatgtgcacgagcaagaaggaagccacgcgggcggtatccatctcgagatgacaggtcagaacgtgacagaatgcattggagggtcccgcactgtgacctacgatgacctcagttctcgctaccacacacactgtgacccaaggctgaacgcgtcacagtctcttgaacttgccttcattgttgcagaacggctcaggaagagaagaacgggtagccagcgtgtgtcttgagtccggttcttcccttttatacactttttgattccaaacaaatcttttctctttgtcctgtgactgtgagttggtgtctttatgacctaagttaaaagccccaaaagcctctctaggaggagtaaacctgtttctgctgtggacagaccatgtcatgtcattgttctttatgttaactttaatgtcaaaccgtgtcacttacactagtgtatatttctttttacatatctacacgaacatgaaacttgtcttctagttagtactaaagattgatcttcgtctttcggctattcgtaaactagaaatgaacaaatctttagaaaacgatcttccaaaatggcccattagctcagttggttagagcgtcgtgctaataacgcgaaggtcgcaggttcgaaacctgcatgggccatttttcataatatctttttttttcttctgagtttcgtcgtaaataaacaatccgacgccgacggttttgggaccccccactaatcaatatcgtgtcccgctcacttaacccaaaatatgatcccctacgtacctctttactctcttctggtgctcccaacaaccatacttcgtctcgatttccatcacgtgttctacacttctctttattccacgtgtcatgatcttggctcatagtcactctcaattaccaaagactctcacacactagatcatacaataacacaacaatttaaatcaagcagtcaataatcagccaactagctttttaattttctctacaattcctctgtcgctctcaccagttaacagctacagcacaaaactgtaaccacgcttccgatctctaaaacctgagagagagagagagagagagagagagagacagagagaagtgtttcaatagtttggcgtgaagatg

SEQ ID NO: 28796 - DNA, 3003 bp, Unknown; identical to SEQ ID NO: 28795
  misc_feature (1)..( 3003): 2750-1469P.txt file - cDNA_ID_2998700; gDNA_ID_1971923; Annot_ID_177210

SEQ ID NO: 28797 - DNA, 3003 bp, Unknown; identical to SEQ ID NO: 28795
  misc_feature (1)..( 3003): 2750-1469P.txt file - cDNA_ID_2998700; gDNA_ID_2926219; Annot_ID_142369

SEQ ID NO: 28798 - DNA, 3003 bp, Unknown; identical to SEQ ID NO: 28795
  misc_feature (1)..( 3003): 2750-1469P.txt file - cDNA_ID_2998700; gDNA_ID_2926219; Annot_ID_203220

SEQ ID NO: 28799 - DNA, 3000 bp, Unknown
  misc_feature (1)..( 3000): 2750-1469P.txt file - cDNA_ID_2998712; gDNA_ID_2926220; Annot_ID_142383
gtttcatgtttgattatttgaaaagctaggaaaaataataatgaaacttcgaaaaagatgatttgcatcttcttcttcttttgtcatctggaatttacagtaaacatcagaaaggatacacaaaactcatacaaagtgacaaagacagctacctaaaacccaaaaagggaaaactaagccctaggaaggagaagctgataaacaccaacaaaaaaaatcaaagagaaggaactggtatactaaacctgaaccattgaaccgaaacactaccacgaaaatatgatttgcaattttgcatctatagtttaaaaattataaaataaataaaattttggaagaaatgatttgcatttatctctttggatgaacagttggttactttggattcagaaggagaaagcggatcaaacggtctaaaacgaagcaagcagaacaaatgtggatcaagattttttcttaagacttttgttttagtgtatataaatgcacctcggtataagagtttgtatagtatttttatttttttgcaacttgttgaaatttgaatatactacaaatccacaagaatatataattagagtcgttgtataagagtacaaagtccttttttttaattaattccagtttggatgactgaaatctcattcgttaaatatataaagaaactacaagcatttatgagagtctttatctaagagtaggaagtctttttaaaagaattttgttgattgaaaaaataagcaaacacatggccaagttacagctttaaattagttacagcgttgcattaaacatctcacaattacaatctctcccaatttcctgaaaaagcttcaaccaacaatggatttagttaatgttcattccaatgaccaaccaattctcatcaacaaagacatgttcaccaacaatcaactatccgaaccagtcaaagatcaaaacctccatggtttagccgaaatattgactcttcagagatgtggaggtacagaggaaattaccagaccgggtcaagaccaagactataagagtcaggagcagacttgctccgtgttctgtgagatcgaggtgataggagagaggtcggaagagaccacaggagacagttggttaatatcgttaagagacaagctcgatcaagcacatagagacgacgacacaacgatctggggagagctctgcatggagacgttgaccgaagttgaccaaccaaaactcatgaacgggcaagaaaaatcattggacatacttgacgataagggcaaattgcactgtctggatgtatttcgtcagagtctgctccagtctaatcctacaccgaatcaaagatctagactaatgaggttgactaagaatacgtatgtggtggacaagcgattgcaacaactggtaaattgcgtgacagagctaagaggagctggtgtaaagttcaggagaaggaatactgaccggttttgggatattcaattcaaaaatggttatctagaaatacccaaactactaatccatgatggtaagctaaaaagttttcatttctttcctactttttattcattactcacatatgtttgtataaaatctaatttgttcaagcagctatgtcaagaagtagtttttgatctccaaaatagtcatctatctcgactgtctactgatgtagactgtttttctaaccgtaggtggaatgtttttaagagaatcttgatatacaagtaccaggtgaaccttaataatccgtgggcatatttttcattttttgctgcagttgctctgctacttctcacattatgtgagagtttcttttctatttatgcttattataagccaaacccttaattttgttttttgttttgttatatagtttttactaatatggaatgttaagtttttctgttttttttcccatcattttctattttcttcttttcaaaattggtattgtaatttttgggttttggaatgttgttgaaaaacaatactaaaaacgttgatttggtgggtaagcataactaacatctcagaataatcaagtcttagactatgaatgagaccagtggaaccggtggtttatgttggtgcatgaattaacacattcgacaataccgacttaaaccagagagattgtgaataaatcgaaaaagagaagacttccatttaaaaaaggaggatctcacgaaaaatggaaggaatgaaaattcaatctttagataattaaaagtttagcatatccttaaactgtctaaatattgtataaatagagggatttgtcctctattcaaatcatctgcaacttaatatagaaaccctatttttcttacattgttctgaagcaaaagccctaccttcgttcttaagcaaccatgttcttcttttcatctaatctttggttactttagagcgaaagaaagaagtgaatttatctaatcctttaatataaatttattatttgattttcagaattaatagtttaaaagtggtttgataattatattaccattcaacaacattttgcaaagtgtagtacacaaaataacttgataacaaatttataaaatagtaatatgttctaacaatacttaactacaaatgtttcttattttttaggaaacgcggcacacggcacaatgagatgcttttatagaaaaactacaaaagtgaaagaaacacctcaacattttttcttataagactattttcttgtagtctttctttaagactttctttcttgtagtctttctataagagcacctcaacatttttttttttttaataagagtaattgtttctatcaagagtagttgaagaaaagtcaaagaaacatcgctcgcctaggcattcattatccaatacgtttaacgattatttaacacattttaagtataagtatgattagatgtcaatattggtagttgtcattacagaaaaacaagtccaataatataagcgtccagtcactctcaaagtctcaatctcctaaaatacttcaacaaaacaaaaatg

SEQ ID NO: 28800 - DNA, 3000 bp, Unknown
  misc_feature (1)..( 3000): 2750-1469P.txt file - cDNA_ID_2998720; gDNA_ID_2926220; Annot_ID_142385
acataaactattgcagctaatttctgttttcaaaatatcaagctatacttttggtttgtttcacaaagctatacactctttggggaaaaactagtgtataatgaattacaattaaatccataaatagcgaattagcgatggacgtcaaaccaagttgtttccagcttactaacttaatcataatcgagtaattaagaacctaaagaaaattgaattttaaagtttccaccattccattttgatacgttgcgtttatataaatataacaaataattcaagaaaaaatggattcccaaataaacacttctttaaaaaaataaaagaaattaacttccaagattttaacttctagaacgttagtaaaaaatagtacatcacaatgttttattcattgctctattaggttaacacaaaattttgcttatagctcacatttcgtaaaacagctcactacttacttccttttaaatcaaccctcatttttatccctttgagaaatcttataaccatccttcaatctccttcttcctctaaaactcttctaaagaagaaaacagaggaacgagaagaagaagaagagtgaacaatgaagaacggatcagggaacacgaacacaaaactaatccttcttcatccttacatccaaaaacaaacgagcacgactcgtttatggcttctcgctttcgtctctttcttcaccatagtttttctcctcactcttctctacactagagacacaatcccttccaaaaacacctccgtcgccgcagccgtagctgcagtcgtcaccggaggatccacaccttcagcatcatctcccatctccaactccaacttaccaactagtgcaatcaacgctttgcttcactacgcgtcaagatccaacgatagtttccacatgtcttacggagagatgaaatcaatctctgacgtcctccgccgctgcgctccaccgtgtaatcttctcgttttcggactcacacacgagactctcctttggaagtcgttaaaccacaacggtagaacagtgttcatcgaggagaatcgttactacgcggcttacttcgaagaaatccacccggagatcgacgttttcgacgttcaatacacgacaaaagctcacgaagctggagagctcgtcaccgcggctaaagaagccgcgggaaacgagtgtcgtcctgtgcaaaatcttctcttctcagattgtaaattaggtctcaatgatttgcctaatcatgtctacgatgttgattgggatgtaatctttgtggacgggccacgtggcgatgctcacgaaggaccggggaggatgtcgtcgattttcacggcggcggttcttgctcggagcaaaaagggcgggactccgaagacgcatgtgtttgtgcatgactattatagagacgttgagaggctttgtggtgatgagttcttgtgccgagagaatcttgttgagtctaatgatttgcttgcacactacgtgttggataagatggataaaaacagcacaaagttttgcaatggtcgtaagaaacgttcggtttcgtctttgtcttaaaagtgatgccagaagacttcatacgtacatttgcttattgtaagaaataaagttttttccttgaagttttgctttttgtgctggtgtaaattttcgatcttggatttattgaagactttaatttaatctcttttttttttttttttttttctcaaaggccaaagcaatcaatttgatgaaacatctagggatatatataaccaaatgtaaactgaacttttgaaccaaaatcaatattttattcattcaagctgaacactaaaacaaaatatctcaaaactaaaatgcttttatgtgtgtgaataattatttattatttagttttttatataaaatgatgatcggaagcattttcgtttttcatatatattttgttttccttggctatagttaagatacgattttttgttattcatgatacacctattctaaaataaatcttttttttagttaaaattaacgaaatagaatgtgtaagattgaattaaaaaataataatattaaattaactagaaaaagtgtgttgaatacgatttagaactaacatatcatagattaaaatagcatttatttcttgcaccttctgtttacacgggttttatctagttacactgttacaatagaaattaaagttcattacaaaattttgaaacattaatattaataagtttcctttttaagcaaaattaaactgaaaaacttaagagaaaaatcgagcgtttttttttagtccattttgataattgtttttcaaaacccaaaacttcaaatctcgatccctaaattatttttccattaaatacaaaaagagcaatcgaaagattcaatgatcttgactatataacaacttcaaatgttttaaccctcttaatcattcatacttgcgtacaaaacaacttcacacacattgcatacttagatttcttctactcactacacccattctcttattagactctaaacttagcaactattttaccttacctctagacattagccttagtgttacaagcaagcaagcaaacttacacaaccttaccttagccactaaccttacacaaccttaccttaacaaccccaacaacacttaactattccatcttaagtacttggctaagatttaaacccatattacacattttctctcttgggcctaactaagcttaacagcccattagtattcttagcccaaaacaacaaaataacaatcttcctcatcctctttcacttttcttatcgttgacttctcctcctttctgtagcaatcgaaagattcaaatctcttgaaagaaagaatcttgagtaagttttcttttttcggtcaaaaacaaaagaatctaaaaatagcaagttcatcgtttgatattttagagtttaacaagaagaatcttgaaagccgtcacctacagatctgaagaatattctcaaggatagagagagaaatg

SEQ ID NO: 28801 - DNA, 3000 bp, Unknown
  misc_feature (1)..( 3000): 2750-1469P.txt file - cDNA_ID_2998728; gDNA_ID_2926220; Annot_ID_142388
ttgttttgtaccacagactttactgtgttatgttacgccagatttttttttttcgcagattttttaaccgtgactgatttgtttcatatagtctccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacaaagttgttttgtgtaatcacagatttaattaacttgttaacaaatttggtgttttacaacagatttttgttaaaaaataaaattactacacagtcacatagtgataacagatttgtttttagtgatgacagttttgtttttcagtgtcaaagcataacagatttactcatgtcaatgttatggccgatttgtttatgactagaataacttttttagtaataacagactttttttgacagatttatttttaaaatttcgaaattttttgttatatgagatttattagctagccctcaattaaattatttccggtctgattgtatgttaaatccggtttgactagatttttttttttttttgaaaaagaaattttcataacgtcacgacagacttttattaatgtcggcagatttttacataatattgtcatatttgaattttaatgaattttattagtcatgataaattctccaagggttttcataaccgttttttttcttcttctattcctaccatcaaatcaattatttgtgaattgatacatgtcaaaatattattggtaagctaaaacaagtcaatttataatatgcaatatcaaaattaaattgtttttctttaatatttttaaaatcaaaaacgaaatatgtgaagaagattcttctttatctaaattttgttcaaaattattattttaaaaaaagtttgttctcaagttaactggattttcgtttttgttttaattatgtaatataggttttggttttcttttttatccacgatttcttttttgattttataatgggtgatttgcatgaataatactttttgagagaaaaattaagaatatagcactatatatgtaattattaagtaagtaacttaaggggtaggtaaaatgatctaaggtggtggtggtggtggttccagcgaagatggcggtggtggttccggcgacggcggcgatggtgattccgacgacggcggcggtagtgattccggcggtggtgattccggtagaggtggttgtccggcgatggtggttatggtggtagttccggcggcggcggttatccggcgacggcgacggtggttgtccagcgatggtgacagtggttgtccggcgacggtggttgtccggcgacggcggcggtggttgtccggcgatggtgacggtggttgtccggcggtggcggcggcggttttccggcaacggcggtggttgccggcgatggtcgttatggtggtgattccggcggcgtcggttttccggcgacggtggttgtggttgtccggcggcggaggtggttgtccggcggtggaggtggttggccggcggcggaggtggttggccggcggcggtggttatccggcagcggtggttgtagtggtggttagtggtgttagtggtggggataaaattgtaataatatatattacatatgttatattgttaggttgtttttattggttagtttgttaatttataaatgcttttaagttatatctgcaaattttccttttataattctgttgaaaaataatttggttttgctgatttgtcaaaattttattggtggagtgacttgtgctttaaaatataaaagatttgttttattttttattttttattttaatttgattacaattaatcattaaggttatttcgtctttttaccaaagatatgggttactacagtttttgaaactaaacgtgtgtcatttaagttatttatgttaagagttgagtcaatctaaacaaatcttactaaataaaacgtgaaaagatagccacgtttttcaaagctatcatgattaatcatggttttaagcagaaatgtgtagagttagttaactttatcgtacaatgaccattattagaaaaactaacattcaataatatgcagctcattttaccaattacaatagtttgatgatttcactattttcttatgttcatgacttctctctttccgtccagtgatcaaaagccaaaaggtccaaaaccactgaaaatacttagtatatcttctaaaaagatcgaaaaatggataaaggaaacggatacaaaccaagtgatgaattctgcaatgcagatagacatgtgaggtagggctcaataaaggcccaaatagagcgtactgcggtccctacactttgggatttttgtttttaatataatttctgtatctgtattttactgttgggattttcccgcgcagaagaaggaccagaaacgaatgtcttgactcttcgtaatttaataatttttgtcgttaacttaaagagacgatggaaactaccaaaactttggaattatcgacctttacacacccagttgtctcatttacacgcaccataattaatttaactcgtctataaaaccaacaacattactgtattttatatgaataataaaagtgtggtagacagatctgtataataataaatccgatcttgtttcaatacacacggaccagtggattaaataagaataagtcaatagaagaagaagaagaagctgacgtggctggcaaaaaaagtaaatttagagtctcgtggagggcacaaaaggaaatataaagatacctcgtatacccaaaccagagagatatcagtgaagagagtaaagcttcttcttcactttttcttctcccgaggaacaagacgaaattgagactctgattcaacttttcttctcatactcgtcgaagaaaaggagattcctcgatg

SEQ ID NO: 28802 - DNA, 3000 bp, Unknown
  misc_feature (1)..( 3000): 2750-1469P.txt file - cDNA_ID_2998754; gDNA_ID_2926220; Annot_ID_142401
tctctgcataaacataaacaccctcagtcatgtgaatatctctctcaatatgatcacaggaatggaagatcggaccaacggtgttgacattgtgtgaacatctattcgtcagttttgcaattcgcatattgaaacagcacgccactaaggccattacaagtctaaggccaaagaaagaagaagcagaggccgagacaagtgacagtggttccaatactgcaatggtaccagtagttagtgacaataagaagaagaaaatgaagttcatgtggaaagctggtattgggaacttcgttgcttcaggtatcgtagcttacatcgacggacgtttgtgccgacaaattcctaatccaattgctcgccggattgtgagtgggtttttgttaagttttctcgataaaagcagtgaacaataatcacttcctctgtatatatattcttctataatagaaccattacataaaataaaagcaataaagctcctttacgtttgttttcctcttctctgcatcaatcacgattcatcaacataggactatgagaccgatttcgaagtcttctgcatccgaggtgtgatatatcggccaatatagttttaatggggttattaaacttgtcccccaagcaaagacatgtaatttgttgatcagaagttcagaacagttttgtaaacaagattctactcaacttggcgtgaccaataagaggaataaaaatggaatgagagacgttgaacattgatcatcaaaattatgagaaccaatcaactaaaattactcaagtgattcattacaaataccttgaagaaaagtaacgttttggactgaatacgtacattcagtcagaagcagccttgtctgcaaggaccatgtatcaacagcctcaagtcttgtgaatccaactcctcttggaatctttttagaatctgtaggagaaatttgagaacattcgccaatgatccgttgtctggacactcgtccgtcttcttttctgcgtaagatttcgactttgtattgtcatcaccatctctgaaaaactactcatacttggtgatctgcaacaagttgctcttgtcatgaggccaaacatcactagtatcatccacaattacgacactttgcttatcagccacaacaagctcaagtgtcttcttactaggactttctttactggttatgactcgatctccaaagtaaactttgtccggatcaatcaacttcaacacggtctgtgcgtaagtgaataaccccattgtgtaaacatgcatagtgaaatgctcgttggctcctaatagaaattcatgaagaaaaggtcgaagtttaatgatatactcattggaatggcctttgttgaatctccataaatctagccttgaatcgacttgttcgagtagatacttctcctttttagaaatttacgaaacaagagtcgaatggataagcgtgtggtccaaatcaaggactaggtgaagcttcttctccgtcttcttccccttcttcttctcatcgagattcaagtgttgtaatctcttgacagatttatcaagtatttattataagaaaaaggaaatatatatgtggcgatctcaaataaaccgacgtacattatattgatcaaaaataataataatcaaaattgtaatttccttttttccgaaatacaatcccatctcaaaatttggaaacatctctctatatataatagacgagtagtctcatcacccacattattcatcaatatccctctgttttctctcgagtttcttctagccctagtttcttaagtacgttttctctgcgttgtttttctctcaaacacacaatggatttttctgatgatctcccaccaccatgtgtgaacgatcatgtgaagagaagaagcaagaaaggaagaacgataagaacgaagcatcttgaagaactaattagcaccgccataagagccgctcatgttgcaagagacaaagggttttacatagtctctccggaagccatacaatgcgttgagatccttagacatatgcgaaccttacctctcaacgctcgtcttattagcaaaaccgacggtttacgcgttcttctctttctctctaagaacggtaaccctaaaatcaggtctgagtctaacgccgtcattgatcactggaaaagtatcctccaaagaaaagttcactaacggaagagaagagatcattcacgaggactacgtacgaaggtttacatcatcaatggacgagtatagactagagattcacgaggatttcatcatcaaccggagagtatagggttagggttttattttgtatttttgttttaattgtaagaaactaatatctttttgtttctaatttcgaagttttacatgtttctaataatcgaaagtagcgtaattgaaagcagagtactatatgtatcaaattgagaattatggggtaataaagagatgattgattaatacggggtcaaaaacataaaaagagtaaaacttgtcctggtttatctctcgtgcctcagctttttttttttttttttttgaatttgtatattttttttttgttttggttttatctccgacaaagaggcagtgagtaggggtagggctttccttttttcccgacgattcgttccctcgcgcttcgtcgtctgacatcagcgcacgttagccaccgtcgtcgatatcatacgcccaccaccgccgtaggtaattttgcgccccttcctacacgccgtttcgagctgatttaaaagcgaaaacgaaaccctaactcgtcgatttttccatcacttaagctctgcgtttgttcgacgctggttttatcaaggatcgaatctgagaattgattgtttaattttggtgtttttgattcaggggagattcttggattgattttccagtttttgatcaattcgtcactctagtagatctgaggcaatacactgcgaacaaatttgactgggagaagaatcagatctaggtttaaggtttgatgcgttggggatg

SEQ ID NO: 28803 - DNA, 3000 bp, Unknown
  misc_feature (1)..( 3000): 2750-1469P.txt file - cDNA_ID_2998758; gDNA_ID_2926220; Annot_ID_142402
atcctcccttgagccgagaagctaggagccaccgttaactccgccggaccaccaccaccaccaccaccaaactgatccggcaacttaaactcttgattcaccatcggcggtgaactctccgacacacgccacatcttcaccgatctatctaaactcccactatacacaatccaccgtctctcaccggaaaccgattcttgatctctctccaccgccaaacacttcaccggaccagcatgtccggtcaaaaccgaaagacaaacatgctcacctccaccttctggtctcctccacacacgtatccctaaatcagcagaaccactaaacatcaaattccccgccgcgacaagacaaagcacggcgagtttatgacctttcaaaacgccgccgtttttcatattattctcacgttcccaaaaattaacggttccgtcagacgaaccacaataaactaacgtcgcgctttgatctacagcgatcgccgtaacggcacagtcttgtttcaataacgtctcagagaagaaatgtttcgtatccttcgcttgatcttctcttctccaaaccttaaccgttccatcagctgaaccggtaaaaaccaaaccgtcaaaaccggaaacgacagcgtttaccgcatcttcatgagcgttcacagattccacacaccgcaaatccgaaactctccaaaccttaaacgttttatcccaagaaccagagtacaacaaccgtttatcttcgcttaacgcaagacaagaaatcgcgtctaaatgacgaaaccctaacgcagcactgctacgattacgtcgcgtgaagttgaagtaagaagaaggaacaatggagtttcttatataatcgagaaggttaggcattgtacctacacgacgatgaacgtttgattctttagatgcagctttccacacacggatcttaccatcttgatgaccggtaaagattttatctccagcaagaacaatggctttaaccaatccactattcgatttaaaactcgagaactcaacatggtttttccaaaccctaatgttcttggaatcagatcctgtgtagagtaaatctcctgatgtagctaatgaatagatatgaccttcttcgcgaacaagtgaccccaagagaatattaggagagtggttggttgatttttctttggttgtatccgtcgtaactttcaccgaatgatacggagaatctacggcggatggatcgacttgaacggaccatggtgatttggataatggtgaagaggagccttcggagggagagatatctacgtaggttatgtcgtaaatgtctggatctggaatagtttctactttcgttagttttgtaaatgcttggctatttacgtctctgcttgtacctttcttatgcattgaagacataagaagaagatgatggactttttttttgttttggttggatttataattagacagagttttaggttacggagaagaagaaaaaggttggagacgatggtgtctatatggaatttatggaatttttactttccatttatagtttattcgaaattggaaccgtttatttcggtacaagtacaacttattattaggtttgattaaataatttaatggtcctaaactcgtaagtaaattaaaacgaaaaccatctttccgttgcttgatagttcatacttcatacattttcttcttttgtttcgttgccattttatattaaaagttaaaaaggaaggaaaaaaaacaacaatttttatatctactcttatacatatataacgttcaaaatctgatagtagaataaacatgtattgtgatttttaatttttaaccatcataacattagaggctggaagaagcataacaataaagcaagaacaactaaaaacagaatgaatagcgaaaattaatggctgagcttcttcttcgatgcctgggtatagccaagatggaccatgaaactataattggttcggaatatttaattgttgactttttttttatatatatataattattggatagaaaaaaacccaacccatacctcaatctttattatgtggagtaacatatgacttgttggagtataattttggtggaaaaaatttgcagataaaccgttgccatttgacaaaagacacttctccaatttaatttgttgatttatatgttaaaaatttgaatttataacatgtaaattgatttatatattaacaggttttctcaacttattcccaatagaacactgatttggctatcgttttggttaatctttttagatgtttgagagattttgtgcaaactggtaataagttcttttttttttcttttccactttgtctttcattgataacattaagttcttacaaaaagttgatcagtggactttccacttaaacacataagaatatctaacaatttttcatagatgtctttcacataaaataatagtaaaagtaaagacatctcaaaaatagatgtctcaaatgtctctagaaagacaatttaaagacatctttacttctctctcttatttttttattcttttatatttaaaaatgggtatctaaagacatccacaaaagtaaccaaagtggttactctaaggcaactagagctattacaatactgaaacagaaactaaaacattgctggaattgaagttaagaaacataaacataagtaggagtatgtcctaaccaaaaaacatactcatctaataagttcaaattaagttaccgacgttaattttttttttctttttcttttgacaatatcctctacaaaaactacaggtagtctcgttagctaggaagaaaacggcagataagtaacttcttcatcgcctacacaagtctacaactgagttaccgacgtaagagactgacacgtgtccataaggtttcgttctccgtgacttcgtctttgtcctcttgctttcccgctcttatcaactcgtttaatggccgaatcgttcgatttcaatcacaacaaacactaaattcgcatg

SEQ ID NO: 28804 - DNA, 3003 bp, Unknown
  misc_feature (1)..( 3003): 2750-1469P.txt file - cDNA_ID_2998762; gDNA_ID_2926221; Annot_ID_142411
gaaaaaaaaagaatcctgattgcttttagtgtaaacgaacagaggaaaacaaaactcaattgagagttaatgatatcatatcagtgtcaactaatatagtaagttaagaaaaaaattcatataaaatctagttatagcattatcaaaacataaaatatttagtaagcattttatgtcaaaaataatatatactcctgagtccttgcgtaatcgaactctgaaaaaacccttgatgcattcgaaagcatgtgtcattttgttacatctcttggattatacgaaccactaaatactcttatgcagtcacattaatcagtaatcacgtattactttattttatcaagtagtattaacatagaattcttatatagttatatggcatgattgttttgaacatagaattcttagtaaaccacgcgctaatatatttggttctcaactatgattgctaaaagaatgcatgttgtttggtagatttgctcaatgaactaccacaatagtaacatttattcatattctaactatataaactaatggattgacccttttgaaatggactattttagttataatattcgattaattgacatgtaacatataatatgcagagaggataattgaaaactaattaaaaaaaaaagagtgttgctacttgttaatgacttcagcataatcttcacaactactaacgttgataaaaaacaccccataattacgtatgcgtttgattaatttttgctacctaacaaaattattttttcctaattaaattacacaaaaactggcttttgggtttctcaaatcattcatgacccatgccataaaattaaaatatactgtattatcataggctgattcaacataaattgactacttttctcatcttttttatttgcgaacaatttaacttattttatttggactaacccatttatattattctattgtgtaactattactcattagatctcatacttaatgaatttgtcaatctaggtttatactctatactaatattttaactaaaataaattgaagcattcgcaaagcatccatatgattcattcaccgccagaacatagaacctagttcatttattataacctaaagaaactttaattgtttttatgtgttcccaagaatattaaaatacagtacacaagtttgtcgacgagtctttgcgtgagttttaactaatcaaacaaagggggctgcctgaaagaattgaattcgatagttttggaattcaataaattgagtatgagccacgtggaattcttacactgacacaacaaaaactaaaataaaaaatatttattggcgccggatatgattgggaaacttcaaactatgcaaccatgtgttattggacccatttgcctctttaagaaaattttcaacatttaagcctaacactagttagattttttaattttaactaattacatttgcatgttaatccttccttaaatgctcatttactataaatttatttttggggatttggtacagagcagaaaatattaacaatgaaaagaaatcatgattcatttttgattatatcaattaaaaataagttgaaataacaattttaaatgtaaaaataaaaattaaaatctcccaacctttttttcatctcaaatatttaaatctatcttttacagtattgtcctagtaaatctgaaaagtcagaaagtcagaatattcaatctaatcacataattataaagtttttcatgccattcgattttgtttcttctattgcacaaattagtaaaacagaataaaaaatatctattaaacttaaaattttggaaataaatacacatcaatctatatattccacttcaattctatttaacatgaaaccaaaaccccaaaaaaacttgatcgatatagattccacttcaaatctatttatgataagaaaaataaattagaatcaaaattagattctacgccccctaattattaaatcaatagaatcaaggattatttttttatcaagttgattactattttccttagtagacacctctttggaaaatgttcttacaacattaaagaatgaatcaagtaataaaaaataaaagcgaagaactcgtgaccgttcatattaatgatccaacggttacaaaatctcatgacaaaatcactaaagcccagattttcatataaatattgagtggcattttgcgcgttttctcatttttctttttaattttttttaatttttctgggtttctttctcgaatcgaaaaagggaagaacagctttatttttattcgaatcattctcgatcctttttttttcatcatcagccaaaaaaattcagtctttttcagaagaagaaagttgcgaaaaagagaaagaaataaagagaaaaccaatttgaattatgtttatttccaacctaaattctcaatctttcttcccaaaactctaaaaattgtctatttttagtaaaaattcaattccgtcttcaagttgcagagattttagtaagtgaaaggtgagtttcttcaacttttgatctaacttcttcttcttcatttcaaccatttattttctcagatctaggtccattttattctcgattcatagccccccaaaaaaaaaactcctgctttgagttcattactaaatctccaagttggtctctttgttttcaaaaagcttttagctttgattttgataatgacttttagttactgtatctatctaatttaggaaaaatgaatttggacaattttggagtaacaacattttgtgttaattctttagaaatcacacattttgtcctctttgttgaaaagtctctgttgtttaattttcccgtcaatgtccagagaggtctcccaagatttacgcaactaaattaattgatatttttggagtgttaattaagtcattatggagtatttgattttgatttgttatggataagatttttgatttcctggtaacgtttctcttggcagttttttttgttgtttgaagatg

SEQ ID NO: 28805 - DNA, 3000 bp, Unknown
  misc_feature (1)..( 3000): 2750-1469P.txt file - cDNA_ID_2998766; gDNA_ID_2926221; Annot_ID_142412
tcactttctccatctctactcgcatcaaacccgcccctggtcacggccttgcttttgttgtcgtcccttccattgaaagtgacggtcctggacccgctggatacctcgggatattcaacaaaaccaacaatggcaaccccaaaaaccacatctttgctgtcgaattcgacgtttttcaggacaaaggttttggagacattaatgataaccatgtcgggattaatatcaactctgttacttccgttgttgctgagaaagctggttattgggttcagacaggaattgggaaaatgaaacactggtcgtttaaagagttcaagctgagtaatggagagaggtacaaggcttggattgagtatagaaactccaaggttacagttactctcgcgccagaaaccgttaagaaacctaagaagcctttgatcgttgcccatttagatctctctaaggtttttcttcaaaatatgtaccccggtttttctggtgccatgggccgtggcgttgaacgtcatgacatttggagttggaccttccagaacagtgccaagagaatctaaaccggttctgttcggttatgctttttctaatgtatcagaaagttgtaaccggaatgaataaaatagcaaattttgttgttttaattgtttgtatttgactatttacacagtatcctatcctgctaggacctgtgcacttgttgttatgttgattcttcattctaaaagattctaagtagagacctgacacacagaaacatcacaagactcgtttcaagaatcaaaaattgatgcaaagcagagtagttacttagagtagaatttcaatggaaacatctcataacattacacagatcagtgtttgactaagcagtgtgataaaaattcaaaacttcatgtcgatctgcggtgggaacagtctgccacggtgattgaatatcatgaaatccgaattatctggtaaaaacaccgccctgcaaattttttgaaagaaaccagttaacaggagatattcactttatctagcaaaagccaaactcaaaaccaattcaagaacctaatgtacaaaaaggtaggggagaggctgcgacatagaaggaaccaaagtgggtctaaagagccaatgaaacaaatataaactgattgaattagccaggagcagaactggttaaagctcttgaaacccataatcgtaactggaccaaatataaactagaaaatgtccctttgaatgtcctgcattttagaaaaccttagctgcacaaagtattaaagaaacatcaatgtttgacctagaacatctctagacgacagtttcttatcaataaacatgagtctttggtggtcattcaatcatcgggaaatataataactaccaaatttccatgtttcagattgataaacactgatgcacaacagagagttaaagagacatcaaaactagaccctcgaaacatctctagagcacaagttctttgaatcaattgattaacaacacatccgtaaaccttctcagtcaaaagaaaacatattcactagaaacacccatgattaaactgaataattgaaccaaatctagccagaagatgcttctataagacccgtagtaactctacaccaagttcaacaaagtacgaacagagaaaaattcaatagtaaaaacactcactagataacatgaattcagattgattaacactgatgcaaaacagagagttcgagagaaacatgatcacaaacctgttttcatcagaatccggatggatcgagagaaatttaccagggaaagtcaaagcagcccacatacacagagctagtccaatgatcaactccagaataaccttaaataaatccaatcatgattcatataaaagcataatcattgctgatataattcaaacacaattgaggaaaagagaaaccgttatcattatatactcacattaatcggtggtcgagaaaactcttcctccataatcttcaacaatcctctatctgaaataaacaagagaaacccaaatcaagatcctatctcgaaaattaaagtagatctgactcaattggaactggaattggattgggaagagtagacatacattggattgttgaataagcggcatgagaaagaataagaacgccgaaaactccaactaagaaccccaaattcatctttagaagttctcttttttaattttcttcttctctaagttgattcccgatctggattttctcgtcgagtattctccgtcgagaatcgaactagaatagaagacgatcagtggagtttaaaacggcatgtagttataatatcgcaaatctcaaagtgaaaacggcgcaacgtctaatatcgaagagactaacaacggcgcgtagttctagattgatgatatcctagattcctattaatcttttgtaacccaaacttttttttaagtaactaatatttttaattagatgaaagttcagttagtttgataacttttttacaacaataagggtttatcttttgggaaaataattattttttcgtataataaataattatgaatatttatttagaatttcatattgatgatatattcatatgcaaacaaaaatttctgcaattattgaattgaatcgtatgttgataacttcgtataaaaaaaacggaaatctattttagaacaaagaaatcaaatggtaagatattaaatttctatttataaaaaagtaagaaaaacatgtagcttgctttggtaccgctacctaagaaccttctattcctttcttgtgtttgctaaaaccagaaagtaaaactgttatcctcacctctcttttacttttattttcaactttcccccataacgtttttaataaacatttacgtaccctcgccacactattaaaataagtttaaaattacatcaaattttttaattcttcatataggtagatttttgttttgattctcgataaatcatataataatataaattaattgatatgatgttaagggaacatg

SEQ ID NO: 28806 - DNA, 3000 bp, Unknown; identical to SEQ ID NO: 28805
  misc_feature (1)..( 3000): 2750-1469P.txt file - cDNA_ID_2998766; gDNA_ID_2926221; Annot_ID_203294

SEQ ID NO: 28807 - DNA, 3000 bp, Unknown
  misc_feature (1)..( 3000): 2750-1469P.txt file - cDNA_ID_2998778; gDNA_ID_2926221; Annot_ID_142416
tttaagataagaaggttcatgccgtttcatacatcagcagacatttttttattttattttgttcctttatatattaaccaaatacttaaaacttgtttcttttagatagcatacacttaatatatattttcgtacatcgtaaacaataaacaaatgttgttcctttgtcgctgtcatatgaaaacaaaagacaatttgattcagggcaaataaataaacagaagctatgcatataggacaactgcaacatttgttactgtttgattaatgaatagaaaggaaaaatgatgtcataaacatgtataagcaattgcctaatctttgattttttttctactacatacgttctctaaataataacacatcaacgatattagcataaaaccacaaactagtatattacttttttatgggcaaaaaatattatattacatgtataatgtattgatattttcgatttttttttttgtcgtgatattttcgatttctattaacaaaacaagtaatacaaaatatcgtgatgcacaatccagtcctctattatctaatacacgaaattgaatgtactaacataatacatgatccctccagattttgtagaaaaataaaaactcgaatatttctatccacaaaggcgtatatacaagagttttatgtgagctccaccaaaaaacaacatatgaacgtaattaaaattgtatatttaaatttcgtccaaatcatttgctgatgcgaaaacctaatccagcacttataatggataataataataattatatattaataaagaagatatatccgtcagcaacattataaaaatgtagaataaagttgcatcaggatgacgaggagagtaaaggtgagaccatgaacttaacaaatgccaagtgtttctgactcagctttgaatgtgacgtacacaaattaccgctttttagtttttacatgcaattaccactaattgtttactaatttctgttataaacatatccgaatcagcaaaaaaaagaagagaatcctaatatcattaatatggcaaagtttagtagatgccgttcgaaaacttctacactgatacgatacatgtggttatgagtctttgacttgtgagatttttaggacgatatcatgaaactgtatgtgcataacaagcatgaatcatgatcagaaatgatgggtgatgatgatgtatgattaatgtgtagggtattatgttgacatgttataattagtaggaccggtccacctcaggcccacatggcaatttttgtctctgtttggattgcacggcacgagtctcccccacaagtacagctggaaaatagaatggtcttcttcttcttgtgtagttgtgttccaaaatgaataataaaaactcgctacatgagacaaatatatatattcctttcccatattttcactgatttggtctaaattctctattatttttgtggggtttaatatgaattcagattataaaaaatcatatacgtgaagtatatgtcttttttttcgtgttgaacaatatttgattattgcctaaaaattatttgtgaaattgaacttcacagcttacctaatgtttattttattttaagattggttatatttttgttattttcctaatttttataacatcattatatttatctgtttactttcttaatttataaattactactctcaaaacatgttattttgatttgttaatatccttttctttacaaacacatttattttctctatgagttttctgcagttaaaataaaaaaacttttcataggttaagctcctttttcaaaccaatctgataataaagaatgtcaaactccttgaaaagaattaggtaacaacttgtaattaaacaatgataatatttgtaagtaaattctgacttttcaaaatttgctcagtcgccgcagccacacgtgcaaccatgtttccaccttgtttcgtttcgtttcgttttacactcctcagaggagaggggctgagaagagtcctctctatgtacaaggaagccactaatcatagtccaagtctccatgaaacgtttttttgaattttgactatttctcaaaataagttggaaacttatttgactattccattttgtttcagtaaattgtcaaacactttgaacttacacttattaaatgttaggttgacttgattttttatatgatcaataaggctgacttgattttataaaataattctattaaagcttttccgttccaattttctatacatacttctactgtttttacatgttgaaattaacaaaaattccttaaaatttttctaaaaccgagggtaagttaaagaaaaaagaataaaaagggaatgagcgtatatgggccgctattggtttgactaggcttcattcttgtgggccggaagaagatttgagaaatgtcttgaaaactccacacagttctacaaatttttgcaaatgaccactaactaaagttattattgccttaaacaaacaatccttaccagtacacttatacaccaataaaaaaaatctcttttgttttagaacacaactacaaaaagtcaaaaactataacatgttgtctcagattcacctttactatttttctctcatacgttgcatgttgctatctttctcgtggttatttgagtaattggtattttcttgttaccactttgttcatatctagcaatcacacatatgacacatctacttgaaattaatgacagttacagttctaaagaagcaaaaactattgaaaacatgttttgtttcttcttattattatcaattgacgttttgttgatcactttgggccttgggctgccaaggaaagttatggatattttgataacatctgaggtaccatgtttaaaaattaaaatgaccgaacctgatgcaatcgaaccggttaattaaacagaaccggaatcgttaaggaaataacccaaaatctctgaaacacacgccacgagaacaattacttccaacggagaatg

SEQ ID NO: 28808 - DNA, 3000 bp, Unknown; identical to SEQ ID NO: 28807
  misc_feature (1)..( 3000): 2750-1469P.txt file - cDNA_ID_2998778; gDNA_ID_2926221; Annot_ID_203300

SEQ ID NO: 28809 - DNA, 3003 bp, Unknown
  misc_feature (1)..( 3003): 2750-1469P.txt file - cDNA_ID_2998785; gDNA_ID_2926221; Annot_ID_142421
ctattctattcttcttcaacactgcaaaacttgagataaaaatagagtctttcctcttgtttttctctttgttttgctgattgtatctcactaagctgaagaagcaaacaacaatagaaaagagatgcgagcaattcacatcgtgacgacgcgattgagctccagctttattaggcctgttcttcttgacttcgtttcttgttcgcctctacgccagttctctacccctaggcgctttatctgtgccgcgagcaaggtcaatggaggaggcaggtcaggttcgattgttgctccattggtagtgaatgaagaatttcagaacatcgatgtcaatcctcctaaaggaactcgtgatttccctcctgaggatatgcgactccgcaactggctcttcaaccacttcaaagaggtcagagaattacatgaactctatgttttgtttctgcaattcttcttttggttcgatgaaattttgaatactgtccgtaaagtttgacacttttatctgtttattttgctttgaaggtctcacggttatttgggtatgaggaagtggattttccagtactggagacggaggcattgttcatcagaaaagctggggaggagattagagaccaagtttgtctttctacgtttcgatttcattcgttttacttagcttcattcttaggatctttacttgcagtttaggtagaatttggggaagaatttagttccttagcttaaactcttgcaaccttgttgtgtagctttactgctttgaagataggggtaatcgccgtgtagcattgaggcctgagcttacaccttctttagcgaggcttgtcatacagaaagggtaactaatgcagaattttctctcaagccttgagaattgtccttattcttcaatgagcggtttatttatttttgtttgtaaaaattctgtatcaggtaaggatgtgagaatgttgattcccatattctttttggtccagaaaatctgtttcccttccattgaagtggtttgctgttgggcagtgttggagatatgagagaatgacacgaggaaggcgacgtgagcattaccagtggaatatggatattattggtgtgcctgaagttacagtatgtatctctcatacctttaatcactttaggccttctagttttttgttatatgaacctgatctgtgtttaaagtctctataagccggctaatttggttcacaaaccttttcttttaggctgaagcagaactaatttcatctataatgacattcttcaagcgaattggaatcactgcatcagatgtgggttttaaggtttcaagccgcaaggtatttttgcttacgttctcttttgatgtgatatgatcattttgtttcttggtttacactctagatacagaaccaagtaactcacttgcaatgctaaacatgagttgagattattttgcacgatctgcagcatctgaatatccactgtagctaacatctcccataacttcttccttgtacaggttttacaagaatttttaaaaaagtatggtgtacccgaagacctgtttggaagagtttgcttcattatagacaaggttagcaatctaaacatcaattaacagctgctttgttgccagaattgggacaagaagtagagaacatcgtgtgtgctttggacaaagatctccaaggagctgcaaccaccattgcaaccgctcttaaagacaaagggcaaaccgttgatttagtattggagagtaaaccgctgaaatgggtgttcaagagagcggctcgggtaaacgcaagaaggccggttctggttgggaagttggttcggtcagtgtcaaggttttgtcttcaggtgagcaatttcaagtcaaacttgatgacttggagtagtagtatctaaggcttgaacaaattgttcaattgtcctttttttcaaaagcaattgagttgagattggatttttattttgtcctcaaaggtttcattaagaattttattgatggatcttcaatactcgtttattcgtctaatagtgatttacaaaatatactttttgacttcgaatcagccacatgtggcatgtgatttttatttcaaaccgagaaatgctaaaaagaaaagaaaatgtgcctttcgtgaaccttaagctacattatcacataatcttcggaactagaaaaactcttttgctccagttttagtaatgaaagaggatgaacatgatatgtttatatttcctaaaagctcaaatcttatcaacactagaatgagtaaatttcatataatgaaaattcatatcgaatgtgattgactagtggtatcaaccacacatgtttttaactttttgacttgatcatccatctacattatgatgtatcaatgtatgttttttatatttgttttcatgcttattaaagccatataaacatattttggtagataattccagtatttagccaacaaaagaagaagacgaagataattttagtgtttagccaaaataaaaataaaaagataattccagtattatattctgattaacaaaagacctaaatttcactaaagagaattaatcttttggtaaaataaaaaaaaagtaaagaaaattatcttctttaactttttgtttttttttcacctatgagtcagtttggtccctctctctctctctcattgtggacatcttttcaccatcgcacaaataacaagcctcccaaccccgatcgacttatcctcctccttctccggcgaaatccattaactctccgccgcgaaaaccacctttccagagtagtatcacactaagaattctaatgttgatccgccattattgaagcttctaattctcgttaataaccaaaaacccaagtcgattttcaaggtcagtactcaaaatctgggttttcgtcaaaatcagaaactttccttgacaaattttaacaaatctctttctcgttttctattgaattctccagtagcgcggtagttagttttaggtggaagaagaatg

SEQ ID NO: 28810 - DNA, 3003 bp, Unknown
  misc_feature (1)..( 3003): 2750-1469P.txt file - cDNA_ID_2998789; gDNA_ID_2926221; Annot_ID_142422
aattctaatgttgatccgccattattgaagcttctaattctcgttaataaccaaaaacccaagtcgattttcaaggtcagtactcaaaatctgggttttcgtcaaaatcagaaactttccttgacaaattttaacaaatctctttctcgttttctattgaattctccagtagcgcggtagttagttttaggtggaagaagaatgacaactactgggtctaattctaatcacaaccaccatgaaagcaataataacaacaataaccctagtactaggtcttggggcacggcggtttcaggtcaatctgtgtctactagcggcagtatgggctctccgtcgagccggagtgagcaaaccatcaccgttgttacatctactagcgacactacttttcaacgcctgaataatttggacattcaaggtgatgatgctggttctcaaggagcttctgggtatgtaaaccacctcaattctgtgatttttatattaaaaggctttgatgtgtttattgtgatgtttggtttagcgatttttagggttttcattctattgcaatggctgcttttatgagcttaatgaatatatgaaactgaaccagtagatgtaagtatgatgtgtggatcatacttttacaagcttgaatttggctctcctgatatgtattagtctaaaatctactaataatctgcatatttgaatactcatctttcctatccttattgggacaaaagatactgtttaggccattgtctttgtgcgttaatttttgtgtggaagttgttacatgtgttctgtgtagtttagttgatcatataatctatttacagtgttaagaagaagaagaggggacagcgtgcggctggtccagataagactggaagaggactacgtcaatttagtatgaaaggtcttatctctttctctgcccctattatgctttcatctaaatgcctttcaagtttctagctatgaattgtgtggataatgcctcttaagattggttatacatttaactgatattatgttcgtctggccttcctttcagtttgtgaaaaggtggaaagcaaaggaaggacaacttacaatgaggtacggtagtttcctttttaaacaaaaagcttcacagtatttatgctttgcaagatccattcacttctgtttatgttatatgatgatactgatttattgtgcttaccagtgtgattaaacacttgtcaagatcacatatgggaatatcaatttgtctcatgattagtactgcaaacgtgtagctctgtaatacggtatctaacaggtgatagtactttcaggttgcagacgagcttgttgctgaatttgcacttccaaataacgatggaacatcccctgatcaggtatgcgtttcttcgatagtttctaccctggaacgtgtgcaatactcgttgtgaactctgatgaaattatatcatgtgaaaacgttttaccagcaacagtatgatgagaaaaacataagacgaagagtatatgatgctttaaacgtcctcatggctatggatataatatccaaggataaaaaagaaattcaatggagaggtcttcctcggacaagcttaagcgacattgaagaattaaaggtttcaaccacatattctatgtgcagatgttccatagcttgtttagagaattttcctgaatttgaattattttgttttgcagaacgaacgactctcacttaggaacagaattgagaagaaaactgcatattcccaagaactggaagaacaagtaatgaacatcatcgatactctcggcttatctgcttcctgttacttttatcatagattcttacatggtccttctatcatctctgtgtatgtctgaaagtatgtaggccttcagaatctgatacagagaaatgagcacttatatagctcaggaaatgctcccagtggcggtgttgctcttccttttatccttgtccaggtaaacttcaccaacagcttcgtatgatcttagattgatccacaaggaaacctcagaaaaatgaaaaaatcacctgattgttgttgtttctctgcaccagactcgtcctcacgcaacagtagaagtggagatatcagaagatatgcagctcgtgcattttgatttcaacaggtaaaatccaaacaccagatttgatctcttttcagctaatatatctatggaaccgattactgacactgtgacaactgttttcactatttgcagcactccatttgagctccacgacgacaattttgtcctcaagactatgaagttttgtgatcaaccgccgcaacaaccaaacggtcggaacaacagccagctggtttgtcacaatttcacgccagaaaaccctaacaaaggccccagcacaggtccaacaccgcagctggatatgtacgagactcatcttcaatcgcaacaacatcagcagcattctcagctacaaatcattcctatgcctgagactaacaacgttacttccagcgctgatactgctccagtgaaatccccgtctcttccagggataatgaactccagcatgaagccggagaattgaaacacgtatgaaggccccttgtacaatttctgtaaaactgtaaagtagctcttgaaaaactttacctggttttttgacgaatagtctgtttagcggtaaatgtaccggtggtttatcgaatctaggatccttgtcgggtttagcgattttaagaatctttgccataggaaaaaaaaaacactttgctctgtggtgtagaaatgaattttattaaccatttggattagtccatgttcggttctgttattcggaaacccggttatggacttcaattttggaaattacgaaactgaactaatcgatttccggttttgttgaaccgaaatccggttaaaatattaccatatcaatcatatcattagaaatgtagttctgtttcatgtaattcggtctgaatgttaataaatgctgggaacatcggagcttgagaaagtccggccatg

SEQ ID NO: 28811 - DNA, 3000 bp, Unknown; identical to SEQ ID NO: 27764
  misc_feature (1)..( 3000): 2750-1469P.txt file - cDNA_ID_2998800; gDNA_ID_2926221; Annot_ID_142425

SEQ ID NO: 28812 - DNA, 3000 bp, Unknown
  misc_feature (1)..( 3000): 2750-1469P.txt file - cDNA_ID_2998804; gDNA_ID_2926221; Annot_ID_142426
cgactcaaccaagaataaaaaatgagtaaagtcctttcacttactttggtggcgttgtcgtttttagcaactggcttgaaaggacaagctggaggaactctcgctggcttcctgtactcccatccgagccacgcgtacaatttagcctagtttattttttagcatgaacagacagtacttgagttaacaaatgttcacaagtaaatactacctgcaagattcactaaagcactgttttttttttcacttaaaaaagatacagtctaaagaaatcgatatgaaacaccaacagaactaagatctaaacattgctaacatgttcaactttccaagagccaacctcaagcaaataacaaaagctatatagctcttcgtttttcacttttacaagcaaagattatgatcatgtgctctctcgcttatcctgattatcatcttcactatcttcttccctttctaatctctaattttgttatttctttcaaataaagatatctcctttgagactaaacgaattccacactctttagaaccctaaaattcgaaatttggatcctgacatttaatttcccatgaaatctgatcattcttcccatcaaaattccaaggaaaaatcaaaacttcaaggaatattaagaaagcacgagtcaattaccatgaaataatcgatgattcgaggcattaaattgatgagcgggacgaggaacagaggcaccaaacacataacgcaaacctacaaaattcaggaatttcttcaaacaatctgaaatggaagccgcaagatagacaaacggaagctagatccataaaaaaaaaaacaagcgatatcgaacaaatcttaccatgttgaaattagggttcttgactcagggaattgggaatttcgaccaaaagatgaaaattggagagagatcacaaattatgattgtagttctctgaagtcgtcgttgcttttgctttatgactttaaaaatctacaaaagaaagcaaacactctgtatcagcgagagagttttgacggcgttaataaagtaacgtgcctcttccagagaagataccgaaaaatccattattattttgacggcgttaagatatcaacgtggctttgacgctccacaaacgtgcaataccataaaagcccttttagtattgttgttgcaagtttggtgtttgtgctccatgtaaaccaaacatactgataagagattatttatgataatcttcattcaactttagtacatgacaatgtggaacatcaattaggtcccaatatggtttagtagggtttaggcgcaatcgcccttgcaaggaacctctgcacagcggcagaccggttttccagaagcttcccaaccgttaaagccgcgttccaagatcatgatgtttttgattccagtatcttctttcttctcatcaagataattcacgagccttctcgcacaagtagggccacgaacctgcaggaagaattggtttcaaggctttagcaatcacttcatgttgagtgcaacgaagtactgatttatgttaggaacaaagaaatgagaactgcctcaaatcaaaggttgctaaaagactgagcttgatgatttggggagctaagctaatcgttgttctttgttctttcttttaagaatataaaataagttcctactccatgacatacataagaatatatggactagtaggcaaacttatcggaaaacacttggattttgcgacctcgaatccactttttgacacatgaaggacctattgtagaccataagagatataaatcttctaagaaaacccaattgatgccacttatctaacctatgaaacatgaatcaactatgtataacatagagatgtacatctccttctacgaatagccaattgatgccgcttatctaacctatgtgttgtttctcaaaaaagaggaaaagaagatcttatggggaagtgaaaagagtgtaaaacacacacctggctcaaggcacaatggaagacaagtgtgtctttgtccttgacattttgaacaagatgtgagatcttgtcatcaaacgagccactcgcatagtgtagcgatccagctatatgcccgtcataattcctctcttcatcccttaaaaacatacaattcctccaatgtgagctatacaataggttcataaaaagtctaaatttgtttaagccataactatgtatcagaagaacctatataagtattacaaaaagtctgtttctttctcagcccatctaaccacaaaacctttgttccaagctcatgaggtccctaatagttgtttttcgacagagattctacaaaatatccagttttagaaaacatgttcataattaattgatccccagagttcaaaagtaaagtaatctcttaaaacgcatatcagtattacatagtagagcaaaatcaaacctaagaacaataatcgggattgattcgaactaaaatttggtaaaggatcagattagtgactaaaatcgacggaaataaatcgattatgttatacctgacatcgatgatggcgatgttgggacgacgatgaagagggagaagctgagtagaggtgatgtaagagatgcttctcgccatcgccatttttttcttcttagtgaaaaaggaaaatatgcttctccccatatctctccaaacaccttttcttccctaaaagtcacgaacatttcattgaagactgcgaccaatttgacgtgacgcttacgtttagagattattaaagtttaaatattaaatgataacaacaagcggggatagctcagttgggagagcgtcagactgaagatctgaaggtcgcgtgttcgatccacgctcaccgcattgttataatattttatcttttaactatttttttttacttttaaatattatttttattaattccgggagtctctcttattcgatacctctgcgactctgccgagacgttttggccttcttctcttccgaaatctgatacagtaacagaaacgaacctaatg

SEQ ID NO: 28813 - DNA, 3003 bp, Unknown
  misc_feature (1)..( 3003): 2750-1469P.txt file - cDNA_ID_2998813; gDNA_ID_2926221; Annot_ID_142434
tctagggttagggctagacggtgtttaccagtgcaaaacgtgtgataaaagcttccattcgttccaagcgctaggagggcacagggctagtcacaagaagccaaaacttggagctagcgttttcaaatgcgtcgagaagaaaacggcgtctgcgtctacggttgaaacagtggaagctggagccgtaggaagctttctttccctacaagtgactagtagtgatggtagcaagaaaccggagaaaacacatgaatgttcaatctgcaaggccgagttttcttcaggacaagccttaggaggacatatgaggagacatagaggtttaacaataaacgcaaacgctacttcagcaatcaaaacagcgatatcatcatcaagtcatcatcaccatgaagaatctatacggccaaagaactttctccagttagatctgaatcttccagcacccgaagatgaacgatgctgcgagaaaccgaaattcgcgtttgcatccaaagatcagattcttctcttcacggccgcgtcaaattctttgattgattgtcatcactaattaagtagttctttgtaattacttttttattacattgatatgttaaatcattaacccttctcttattattgtccattcattcttgtaatctgacattgattgaattaacttcaaattatttcattctttgaaactactcattgctccataatttagcacatttctaataatcatcaatatatacacaatagtatataagtatgtgatacttaactttgggagaatgatgaaagatgctgaggatgttccttggagaacggaagaagcatgtgacgatgactttcgcataaagtcacttcgtttgttagccgccactaactcctttggatacacttcacttccgtttggggtttttcgttttttcagattcttttctgatataataatacatatatcattttcattagagtaaatcaaaagactacatctataataatctacaaagactcgttcaaaaatcggatctaaagcgtgttttgagagtccaatgttgaagtatacagtagatgtgatttgatccctagcttcgactatatactatcgaatttttttattatcgaatgtgtttttcactagaaaatacgataatatactgaccgatgtcttgagattttggacatatatcacaagacattcatgtagcaacaaacgaatcttcatgatcatgttatgtagtatgggaaactaacagtaaactgttacaaacttattgatatgatatatgctacaacatcttctagaaataggagctattactacgctacgtactgttaatggtataatggtatctctatatcgatcatgtcatgtctttatatagtttatgactcaatgactcatctatatctttcttttgaaaataagaacatgatatgtagagaaagtgcaacttcttactactaacaaaacgaatgaatattcctaacatttaaatagaaataaaggacatttgaaaacgattgataggaaaagtgatactgtgattaacgatgtcttctacaaatacattggattatatataatgccttttatctccactaaaaattgttgacagaaaaaccataatcgctccgatcgaaaagctcagaacataaaattgaaaacgagagtggtaccctcaaactgttttatccatttaaagtaatagcactacgtttagttcattttgaaaaaaaaacgtcggtgagacttgtaactaatgctgtccttgtcgcattttaatagatatacaattacaaaatgtctatctacatttgtaataaaacaaaacatcgagcccatgtagtgtaattgacaacgattactcattcacttgggtgggataaaataattatgtttcactattatgaattatcttgaaaataaattcttatactgcgtttatacatcattttacgcaaagaggcgtgacaaattcaatgttgaattcgtaagaatatgtttatcaatgtatatagatagtggattattaaaaaaataaacatcaaattaataaagacttaaatttgattaagagatatgtgtggatgaatatataatttgactttttcttgaaccatgccacatgtaacagagactctggcatgactggatactttgctggattacgctagtgtacgacgtatatacagcgaagcaaccgttttcacccacttactgcttgacagctcaccataaacgacattattctactagtgtactgtagaccaaccgcacttgatcatatcaaacctacctttacctcttccccctgaactttcctaaatgtcatacaatcaccccaatcatttatattactccattcactctatcatttataaattttgacttttgttcatttaaaccattaagcaatctctagtcctagataagtagaaacgagtatttaaaccagttcttaaagaaaaaagacaaatattatctggtttggtttgatattttttttgttttgtttggtttagtttgatttagtttcaattctaattgagtaatttataacaaatttacggaaattgagttatttatcatttttgtagttaaatggtttgatttacgttttgttgtgaagaaacaaaaaatctctcattttccatccaatttcttgtcggattctaggtgtaaaccggattagaaacctcttagttgagaacttaataagttcatcccacaatcaaattagttgtggggtcaattgtaactattgaaagtttcgaggctaaaaactataaaaacatgaaaataatatttttcagcagctaatcaacttgttttcttcagcgagcgacattttggaaggaagcattccattagcttttttgctgtctccagaaaataaattttcaatctttcgtcggaaaaaagaagaagaagaagcagagctgggtttagttttttcacgagaagcaaagagatcaataagtcagtgagcttttttctcgtttctgacgatg

SEQ ID NO: 28814 - DNA, 3003 bp, Unknown; identical to SEQ ID NO: 28813
  misc_feature (1)..( 3003): 2750-1469P.txt file - cDNA_ID_2998813; gDNA_ID_2926221; Annot_ID_203319

SEQ ID NO: 28815 - DNA, 3000 bp, Unknown
  misc_feature (1)..( 3000): 2750-1469P.txt file - cDNA_ID_2998828; gDNA_ID_2926222; Annot_ID_142442
gtttactttatagtcatcctttatacatgaagtaatccttttctaaccatgatatgcgtgtttttttgtttctaattttctttaatcattcttcttgagtttaatgggttaaacttttatgatatgatgcaggggaagtttgtatagattactccatcggccgaaccatcagcttgatgagaagaggagaatgcggatggctcttgatgtggtataaatgagttgcgttggttgaaaagaaggctctaaaagttactgctatatcgctaaaaattatctgagacttgctttgtttctgatggtattgcaggcaaagggaatgaactacttacacaccagccacccgactgttgtacatagggatttaaaatctccaaaccttcttgttgataaaaattgggttgtgaaggtttgtgattttggattgtcccgcatgaaacaccacacatatttgtcctcgaaatcaactgcaggaacggttagtttttatcttagatggaactattccttatttctcaatcatgaattgcaaagataaactgaacaacttacttgatacaatgtcctgttaatgagtctgcagcctgagtggatggctccagaagtgttgaggaatgaaccggctaatgagaagtgagtgaaatttaacactatgagaacctttttaaatgttagtacataaatattgactggtgtgcttgctcagatgtgacgtgtacagctttggtgtcatattgtgggaattagctacttcacgcgtcccctggaaaggtttgaacccgatgcaagtcgttggagctgtgggattccagaatcgacgccttgaaatcccagatgatatcgatctaactgtggcacagataatccgtgaatgttggcaaacgtaagttcattttcaaaactcaaatccttaaaatttagcaaaaagtaattcactactccttattagagctgtatgatacatgtatccttatgattagctttgtagtgtaaaccatcagtattgaaataggtaatcggtcatcatacattttaggtgaggttaagcttgtgattgttatgcagggaaccgcatttacggccatcgtttacacagctgatgcaaagtttgaagcggcttcagggtctaaacataagcaacagagcgaatacgagtgaaagtttgatgtaagatacgttagacagaagatgttgccttacctggtctggttcaaagagccaacgggtggggattgccattcttctttgcttttttttgttctttttgttattacggtcagacgagaggagacaaacaaaaaaagattgatgggttggggaaaagcttgtggagttcaatcgaagtgggagctcaacaagaaaagaaaaagccctattcttaaccctttgtaactattattattatcatcattgttgttgctacttgtaacgataaaattaggtgaatgaacaaaaaaaaaaaaaaagaatagaaatgaaatgaaatgaaatagtaatggtagatgaaaagaatacacagtaagcctatggagtccttttcttattttagtttgagatttgccccaaaatctgtaaaagtgtaaacatgtggggattgttgtaattcttgtaaaagttacagtcaaagtaaactataaaagtaaaaagaatgatgagacattctagggaattaagttttcttaatggatgccaaatttggtcaagattgataaaaagtctggaatgactttttgctggcagaaattagaagttgaagcttttttagaagaaagaagaatcattaacggttgatatgtaacacttaggaaatgtaacgtgttgtgagaattgcgattctcaccgttaatcgaggcccattgggtatattatctcacccaattacccaaacttatatcatttgaccatttttcgatatttattataaaattgtttatgcaaaatgaaataaaattcgttggtatatatatataaccgttttagaaattgattctggcggagaagaaagaaaaagcagagaaattgtcaaatattactcaataaaatattttatcgagttgtgtttcgtatgagaatacaaaatctatacatatagtgataacattaacataatgttaacatctatataatgtaaacttttctaaacatataaggaaataacttgtacaagaggtaatagtgagatctagaatattttttgggtttcacgtactgctccctaagatattttcaataggaatctccataaaaaaggttaagaggagaacaatccacatatacgagaagatgactcatcattttatcttctacaagatctgatcatagagattttcgcgaagttgccgtcaaaacccgtagtcaagctcatcgtcgtctcgaaactctggtcttctataatccgcagcaaatacttcattgatctgtacttgaaacaatctttgactcgtccgtgttttctcttcatattccaccagcgaattcatattcacactaatatatctggatggctccttctttattatcagttacgatcgcaaagaagacatcagcagaagagttgagattgaaggagttggagatgccaagtatgtgaaaagcttcttggattatgtaaagtctcctatacttctccaaaagaagtctattgtctagtttcttaaatctttatataattaaatagttctcgcactgctttaaactaaattttagttttctctaaaactaatttttttttatttggttatattaggagagaaccagcaaattcttattcaatttttttttgtctttcatcatgattactccaaagggtttttctttgtgaagaagattttatttctcatcaaatttgtgtataaaacgagaaagggtgtatttgttgtaagcaaaaagttatggggtagaattgaaaatagactgaaataatgagagccgtcttattttttaagtgatggttacaaaaccgaaattggaaaaaaaaaaaaagacacggaagctgcgatg

SEQ ID NO: 28816 - DNA, 3000 bp, Unknown
  misc_feature (1)..( 3000): 2750-1469P.txt file - cDNA_ID_2998830; gDNA_ID_2926222; Annot_ID_142443
agaaagcggaaagattagatttatccatcgtttatcccagtaaaaagctttgatttttccacatgtcttttttccccccttttttcgtattaaaagccctagatatatatatcaaaattgaaaattatctgaaatcgatttcgtgggtttcagttccggttcggttctctttcttaaaatattgatttctgtcactttccgcgatgaaaagttttcgaattttgcttcttttggctccaaagtttttatctttcaaatattttaaatctgggtacttttttgttttggttccttctttgtgaattgtatctagggctttgctccttttctaatccaagatctgttttcgttctcagatagtgtatgagctagttgtttgtaatttgacggctctcgggaactgatctatctccggtgtctctgctttgtcggtagctacaggagtgaagagagtttctacaaggtaaatttgaaaactttatcattgaaccttgtacttgtagatttatagtagtgtttgggtatgaatgtgaataatggtcagatattgaaattgtggagtagttgcattaggctctgagttctgttgtctaattcagttacaagttgatgttaatagggttttaatggaagatgatgactctccttcttctcgggatttggatgcacagaacccttatgatcgattgcttgctctagatacaagtaccgtagatccaaattgtaacttggattcggtttctgccatttatctagcgatgaagagctctaagctggaatgtgttgacgagcgtggtcaagattcccttattacttcggtatgcatggaggatgaagaggatgaggagctcgatgagtttgatccttatctgtttatcaagaacttgccgaacctgtcttctgttgtcccaactttcaggccggtcttgcttcctaaacaaacccgaagctgtcctcctatttctcttgtcctagaccttgatggtaaggctacttttcagttgattcgtttgtttaaaattgtatctctctttgcaggttttaatggcacacaaatcttagttttttctcaccaggttttaaggctactataacatatatgttttattttgcagaaactcttgtgcactcgactctagagccgtgtggtgaggtagatttcacattcccagtgaattttaatgaagaagagcatatggtgtatgtgcgatgccgtcctcacctcaaagagtttatggagagagtgtcccgactttttgagatcattatatttacagctagccaaagtatttatgctgagcaacttctgaacgtgcttgaccctaagagaaagctctttcgccatagagtgtaccgtgactcgtgtgttttctttgatggtaactacctcaaggatttgtcagtcctcgggcgtgatttatctcgtgttatcattgttgataactccccacaggtattatactcttattatccttctacacagtgagtaaacacgtttagttctccattcttatgctttatacctaaaccgatcgatagatgcttttatcagctataattgtaggatacacttctagtataggaaaactataataactatgaaaggtagtatgggcgaatccagtagaagttctttgtttgcaaaagctatctcattggttttgtagggttgatgaaaagaagttgattccagaaccgccattaagaattctctaagctcgatctaaggctgttgcacaatctcattggtgtttttctttttctgcaatgttttaggcatttggtttccaagtggaaaatggagtgccaatagagagctggtttaatgacccatcagataaagaactccttcacttgctgccatttcttgaaagcctaattggagttgaagatgtaaggccaatgatcgccaagaaattcaatctaagggagaagattgatgcagctgtagccgcacctgaatatcctgctgaggcgggagatcctttcgaaaggtaaagtctatcgccaaaacacttttaaaggaagaatctggcacaagagcagaggttggagaagatatataagtatatcaatgttgttttcttattagtttaaattaagaacttggtatacagagaaagacaggatatgcctgtaaaaacagtttaaggcacaataactgtataattgttttctcgtttatttactagtacacatagattaacatttcaagtttcaaattggcttttttttttgcctaaatcctttgaaatcagacaataaaaacagaacataaagtgagcttaaagttttttttagttttatttaagaaaagtccaacgaaaaatttgcatatgaatcccaatcaaaaatcagtagcatagtgcgtgatccaataaattcattttgtacagaatccaagaataatttgtttcctccaatcaccaaacgccattctattcgaccataagtcttatttatctcagttttcatggccgtataaaaatattcctaggcaccaagctataggtgcgtaacgtttctaatatacgattggttttggtattattgttggttccacgaacggataattatgaaacttgtttggacatttaaaaactaaatagtagcttcgtgtaatagtcaaagctattcttaccaagtaagtggaggaagcttgacgaagaagagtagtgcgcattttaaccgaatctacctttcgaagatgtcggcgcaggttaagctctactactatttttcttatttatttataaactgtggaaactatttttttttattattattttatttatcggatgtttacgaggtacgcattatttatttctctataattaattttgctttgtgacaatattcacaattattttttttaaagaaaaaactaccaaaaaaaaaaaaatagcgaaaggaagcttcatttgttagagagataaactggagatttttagagagagaaagaaatagagagagagatcagttcgtcgttgacgatcgatg

SEQ ID NO: 28817 - DNA, 3000 bp, Unknown
  misc_feature (1)..( 3000): 2750-1469P.txt file - cDNA_ID_2998834; gDNA_ID_2926222; Annot_ID_142444
tcacaatgtgcttgtcaatatatacaattaccgcatcactaatcaagaagcaatgaatgcataactgaaagaagattcatgttccgaagaaaagtaaagtgagaaaaacgaacaggcaaagtgtcccagacgattctgttgtcatcaggtttgagatgataaaaagcagaaccaaaagccaagcttgcaatgcctgcgtagaacagtgtccatccccagatctcaccatttaaactgcattacaacaactcaaattgttaaactaactcaaaataaaactcaaaaaagggaaagagaatgataccttatgttgaagaagcttcctccaatgcaaagaacaaaaccaagaactccaacgataagaaagggaaagttggtcatcacattcaatgtattaggcactcctgttcatcatcaaacccacacaaaacacctgtctctcgttattacacatgcacagagacagagagagataaaaaaaaaagaagagagagtgtgatatgatgatgatacccatgaaattgcgtttatcggcgaagatatgatggcgaaatgaatcgagaggaactttgggagtgatgaacatgatgattgaccaacagaggaacgatcccacaaccaaaattcgtttccttttccatctccctatctgttgattcgtcaaccacaccattaaaagttctctctataaaggtgaagactttaaaggtttgtattgtttgaagtggataaatcagttatctctgttgtgtctgattgattaatcttcttccagtttaagaaagaaaagggaagacagatttattgagagtcgcttttttcgattagaacaacgtgcggcggaatctctttttttctttttccttgagtctgacgggtacgacgacgacgatcgatctctaatgttgtcgtagttgacgaggaccgctctaaacgtctacgttttgtttctattctattttatttgtaaagtaaccccttacatttttatatcttatatatatcccaccccatgtttctgaaagtaatattttcactcctatatatatgtacaacgtttcaaaacttggcgggagtggttttagttaactgtttcctggttagtgtttctaggagaaggaaaagttaactaagaaaattgctaaattatatatccttgatgtgttgttgtagttcttagaagtaacccacatagatagccatgtatgaaacaaaaacaaaaatgggattaacatgagacaaagttcaaaagagaatgaactaagagtctaaatgctctttatgctacaaagtattcaagaaaacgaaagagtataagagaaagatggggaagaagatgaaacaatcatatgtattctcaaattacaaacatatattctaaagctcaaattgggaacgtaaatatatcaatgttgttttaagccatcatgtcctctctgaatcatccattgtgccatgcttgaatacaagtttgatgttgttcatttctttgaataatattggcaggttgagtgtttttcagtttgtgttggatcaaattgtcttttatttggatttcgtcgtaaacataatcagcagaacacgtcattcatgtcatacctcttaatcttttatgtgtttggtaataaatctgcataatcatgacatgaaacaacattccacaattctatatagcattctagctataaccaatgaaaaatagatcatcctatatatagtagtactaaacaaagattattctaaaccaacttaacttgtaacatcaaatctaatcaagtcacataatcttgtataatttcatttttcaaagaaaatattcaaaagtcttcaaaacgttttttttattccaataatccataacatgcatgttcaatttgtaaaaaacagaaggttcctttttaagaaaaagacacttctctagttctctacggcatcgttgtactatcctccaaccggagatgacgtcatcatttaccggcctaatactcttcgaatgtttggggtttagtttaacaaatcaaaaactatcgaggttactaatgaaatattaataaagtatgagggcatttaaatgaaatatttcattgcttatgtagactatagtcgtctgtcattcatttcgagcaaatattttactcttttatttcgaagagagagagagaagaagacggaagctagaagaaatcgtttttgatcggaggtacttttttccgacgaatatactctctctagggttttcttttttctctctctccctctccgtttcttcttcttagctcttcaatctcagctcgaatttctgggctactgaagtttaatctaggtgtgcgcttcgttgaagaaattttgaaatttgcagagaaatttgcggagaaagcggaaagattagatttatccatcgtttatcccagtaaaaagctttgatttttccacatgtcttttttccccccttttttcgtattaaaagccctagatatatatatcaaaattgaaaattatctgaaatcgatttcgtgggtttcagttccggttcggttctctttcttaaaatattgatttctgtcactttccgcgatgaaaagttttcgaattttgcttcttttggctccaaagtttttatctttcaaatattttaaatctgggtacttttttgttttggttccttctttgtgaattgtatctagggctttgctccttttctaatccaagatctgttttcgttctcagatagtgtatgagctagttgtttgtaatttgacggctctcgggaactgatctatctccggtgtctctgctttgtcggtagctacaggagtgaagagagtttctacaaggtaaatttgaaaactttatcattgaaccttgtacttgtagatttatagtagtgtttgggtatgaatgtgaataatggtcagatattgaaattgtggagtagttgcattaggctctgagttctgttgtctaattcagttacaagttgatgttaatagggttttaatg

SEQ ID NO: 28818 - DNA, 3000 bp, Unknown
  misc_feature (1)..( 3000): 2750-1469P.txt file - cDNA_ID_2998842; gDNA_ID_2926222; Annot_ID_142446
tctccagctttttagtactccattcgttacaagtattacatttatatttctgtatccattaaatataaattcaagtaagaaagttccaaacaaaacaaaaatccaagaaatttttttagaagccgtgaattctctggccttcttctacttgacaataccttatctctctgactcttctctgaaattttttaactaacaactgaagaaatctccttttggatcattccaaaagtttcacaaaatccagaagaaaaaaagaagaagattatatagaaaatttcaattgtgaaattatcaaaattccctctagaaactccatttccagaccttgacactaagatcagacttacacttagtttttttagaagtagctacaattggagttttaccttttggtatagttccttcaaatccttcacatgtcactttgatctctactccttcactcttcagcttccccattatcatcttcactttagttctcatctcgatctcatatcctacacgcgcgcgcgtcagatctgatctcagatgcttagcttcatccggatctaactcacgcgccgctgtagacgtagcgatcacgccgtgaaacgaagttttgttaccgttatcgctgaagaaagcaggaacagttccgttaccgagcatcgtaccggatttagctgaattaacggtgacggtgaaaggatcgtaagagaaagagaggtgttggtttggattctctgagattagagtgaagttgaagaaggaagagagatgagagacggaggaatcagaggaggttgttaggttcacgcggctgattcttattgacgggacggagaacgacggcggacgagggtggtagatcacgtacatcgcggtggcggcgattgcagtcatgagagctaagatcagaattatcagaatcgaccagaaacagcaacaacagcaaattcgtcggcagcttggtcgagattggtggtgatgacggcgactgtaaggctgtggacggtaaaccggacggttagctggaatgtagacttgaggtttctgattagccattccgtttgttgttccgttgctggttacagtcgccggagctggaggaggtggtatggaaccaactggtggagctccattagtggcggttggtggtttggaagctgggaagactcggtcagtcatcttcttcttctccggttgtttctttctctctggtcagatctgagctcacaaaagagagagagatagtgagagagaaagagacaatacagagtttttgtggaatcttaatagcttttttttctgagtttatttatttattgctttttaataatttgtttttttttcggttttcagtttttcttagatttttgtgaatgttcatgacttccatgccaagtctgtggaatctttttattgggtggtaaaataattaatgtaagctgatttattacttacaaagtggccccatttatttctgaaaaaattatttacacgtgtagtattttagtaacgagtaatactaagatgtgtcctgtgtactcaaatttttcttgttttcagaatttagtaattcacaatagagtataatgtaatcaaatgaagaagaagaatgggcaaaaaagagtaacaattaaagatgtaattaaatatcaaaatgacggaaataataatccaccgacacatatagtgatagtggtagtagttcactaaagtgtgcacgcaattgaaataagtttgaatttaagtcagtgcaggttaaaaaaagaggaaataattaaatgagtgcagatattggagtattaatagattagggatccgaaattaaaaatataattagaataatctcgatttggttcagacttcagagagtaaatcccaagtcaataattatttcatcggcaatgctgctctgctttgaattttgttaataacctttgcttccgagctctcaattcccaagatttagcgtgattaataattcaagagctctctaactatgtagtatagttaccaattatcacccggtcaagtgtccacaccataaagtctttaaaaaaataaaaataaataacactcaagatcgatcacatttcattaaaagataactgcattacagagaagcattgtcggaaacatccacaagtggttccaaccagcaaggtacataaacatcaacaatggaaacataaagggcaaaacattgagcctacttcaccaaaccataaaagtgtctagacatcccaataacttatggtaaagtttgtttttaacgtcttacagtcaaacacctaaatatacatcccacaaccatcgacatgaatgcaattacatacatagtcagagattatatagtatgacgagagaagcaaagttgtaagaataaaacaaatcctaacttacaaaggaggcagagcacaaataaccagaagcaatggttgccaaacaaaacaaatcctaactaagaacattccttgctctttgtaatagatatagataattaagagagtatgataagcataacttcaacaaatgtggattctaaaacataacttctccacaacgtgcacggctagatagagcacttcatcgttagcattcaacaaaatgttttacattatcctctgaatatccgcataatacgaacaaatagaagtattggtaggtgatgagaaatggcaaatttttatagatagggctagatttccatgactgctttaggtgaccccttaagcatcaagattattacaacacacaactaacacaaccgaacaaaacaaacactagcagaaactatcccccaaggacaaaaaccatatccaaaagaagttaaaatcgactttgttctttcttcttttaaccatcggttcgactataaccaccggttcgatattgtcggatatctaaaaccggacccgacaggaactactcttaaacttgttgactttttttttctaaacccttcagtgttactgtaacagtcgcacacctaacaaaaatcctccagccatg

SEQ ID NO: 28819 - DNA, 3003 bp, Unknown
  misc_feature (1)..( 3003): 2750-1469P.txt file - cDNA_ID_2998850; gDNA_ID_2926222; Annot_ID_142448
ccaatatctgcactcatttaattatttcctctttttttaacctgcactgacttaaattcaaacttatttcaattgcgtgcacactttagtgaactactaccactatcactatatgtgtcggtggattattatttccgtcattttgatatttaattacatctttaattgttactcttttttgcccattcttcttcttcatttgattacattatactctattgtgaattactaaattctgaaaacaagaaaaatttgagtacacaggacacatcttagtattactcgttactaaaatactacacgtgtaaataattttttcagaaataaatggggccactttgtaagtaataaatcagcttacattaattattttaccacccaataaaaagattccacagacttggcatggaagtcatgaacattcacaaaaatctaagaaaaactgaaaaccgaaaaaaaaacaaattattaaaaagcaataaataaataaactcagaaaaaaaagctattaagattccacaaaaactctgtattgtctctttctctctcactatctctctctcttttgtgagctcagatctgaccagagagaaagaaacaaccggagaagaagaagatgactgaccgagtcttcccagcttccaaaccaccaaccgccactaatggagctccaccagttggttccataccacctcctccagctccggcgactgtaaccagcaacggaacaacaaacggaatggctaatcagaaacctcaagtctacattccagctaaccgtccggtttaccgtccacagccttacagtcgccgtcatcaccaccaatctcgaccaagctgccgacgaatttgctgttgttgctgtttctggtcgattctgataattctgatcttagctctcatgactgcaatcgccgccaccgcgatgtacgtgatctaccaccctcgtccgccgtcgttctccgtcccgtcaataagaatcagccgcgtgaacctaacaacctcctctgattcctccgtctctcatctctcttccttcttcaacttcactctaatctcagagaatccaaaccaacacctctctttctcttacgatcctttcaccgtcaccgttaattcagctaaatccggtacgatgctcggtaacggaactgttcctgctttcttcagcgataacggtaacaaaacttcgtttcacggcgtgatcgctacgtctacagcggcgcgtgagttagatccggatgaagctaagcatctgagatcagatctgacgcgcgcgcgtgtaggatatgagatcgagatgagaactaaagtgaagatgataatggggaagctgaagagtgaaggagtagagatcaaagtgacatgtgaaggatttgaaggaactataccaaaaggtaaaactccaattgtagctacttctaaaaaaactaagtgtaagtctgatcttagtgtcaaggtctggaaatggagtttctagagggaattttgataatttcacaattgaaattttctatataatcttcttctttttttcttctggattttgtgaaacttttggaatgatccaaaaggagatttcttcagttgttagttaaaaaatttcagagaagagtcagagagataaggtattgtcaagtagaagaaggccagagaattcacggcttctaaaaaaatttcttggatttttgttttgtttggaactttcttacttgaatttatatttaatggatacagaaatataaatgtaatacttgtaacgaatggagtactaaaaagctggagattgcagtgactgcgtgatagtgagcattaaagtgagatcgtagtagtaataaacagaaccttaaaaatggaaaagatgcgtggggtttgtgaggagaacaatgaagaacacgagagatgtgttaaatgttagatgttgaaccatctatcgcattatacaacaccatttaagagaaacgtgaatcgtctttagtactctataaagcaagcatatattctagcagttgcatgttataaaattaatacagatcgatcactcaattcatgaatatggtttgatataaacattaaattaaatgtcatgctgtcataaaagatgaattatatggttcatttatctaagaaactttttattaactaagtaagtaaaagtttgaagaggtcatttgcaagtgactccgaccagggatagactcctgaaatcttatccaactatggacgacgacttcatgtcggtgtgtccaaaaatgaggaaaaggaatctgcccaagggacaaatggcattacccgaaacggcaaagaagaaccgcaggaaaaaaagttgacaataacgtatgaggtgtgactgaaaaagaaaaacttgtagtttggtttatgacgtaaatgaataatttggaaatgacaataagtcatcatatctaatttagtgcatgacctccaacgtcggcatatatttgagtcggtgaccggatatccagtacaaagtaaagtacaaaccaaaaagaaagacaagacaataaaatgggtaaagaagacttgcatacacggacgtgatagaagaagacatgcatagtataattctgactttctgagacctttaatgaaaatatttggcaatgtatttcaagaataactatggcatatctcttagattttgtgaaaatagcccataatcgaagaagatgatagtaaaaaaccgaggcccaaatagaacccatttacccaaaatatcaaaaagattagtcgtttggcaatgaaattagaagcccaacacatgtcctaagcctttttcacttttcttcactgtttggttttccgacatcattaacttcgcgggggcaagcgactaacagaagaaaaaaagcgactaacagaagaaaaaaacgaaaaggattattccgccgtagaatccatattctctccctcatcactttgataaacaagagtctcatttttcgcttttccaaagggaacaacttcttcggattattatctatg

SEQ ID NO: 28820 - DNA, 3000 bp, Unknown
  misc_feature (1)..( 3000): 2750-1469P.txt file - cDNA_ID_2998852; gDNA_ID_2926222; Annot_ID_142449
aaatattacatggttttactgcatttacctcaagatttttatctgaatctattaaattatattttataaaatatgggattcctaacaaaacactatgagaaaacttacttgggcagcagtgatgcctgagatttcaaaggtagagccggttttgaattcatagcaatcatcaaggctaacacttttggtccggagattgttgatttcttcaattggccattgcatcagcttctttccacttgtgtccatccaaatttccctgggaagagtctaagccaaaaacaaacccagttcatccaatttcttacaagtaatcatactctactagtactttaaataaactatatatctctatttaccataaggccagcccatcctttcttaaaatcatcttctttgctatcagtctctatgacccatccccagttgatcctcctatttttaacactatcgaagaacgcctttgaggcataaaacgttccatgatcatatctcaaatctgcactagtgttagtgaactcataatccgctgaaaagtcttcagtctcagaagagtatttaccaatgacatagcaatcattgcctccaaaactcgccttcaagacatgcctcacactagcattgtttaccgaagtgtcaacaccttctttaccagtgatagaaaccgggaaaaaatcagggcattcccacattccggttccttctgactcaagtaaaggcaccggatactttgtccactggacaaaatcatcgcttcggtacaaaatcgccattcctttctcagtatctttctccttagctcctatgagcactctccatttcccatcttgccctttccacgcctccgtgggatcacggaaacaattaaaagggacattacttggcggaaccatcacaggattgtactttggcttaacccactcacgaagcaaagggtcagaaacgtcctttggttcggcaacaactgtgacttgctgtttgttgttgacgtcgagtccagtgtacaaaattacaggtctgccatcagggaggatcgtggcggatcctgaccagcagctgttgatgtcaaaggactcagaagggacaagggctggttcgagctggatccaattgaccatgtcttgtgaaacagagtgtccccatatgattcttgtcctactgaattcgggagccaaagggttattctggtagaacaaatggtagaatcctttgtaatacattggcgctgaaacaacattataaatatacgtatttcattatataaaacaactttggagttccttgtgtcacaagttagcaatttgtagagtatttaattaccgtttggatcttgagatttccaaaatgcatcagaggaccagaagtgacataaaattaagacaatcgttagttttcagtatcatatagtagaaattaataacctgattcaatagataaattgcaataaacagaaattaaccatttttttgttttggttttatgaactaataatataagagatctttgccaacatgatcttttcttttttgttcacaaccaacatgatatatatatatatatatatgaatataaataggaggaaaaagaaagaaatagaaccgttgagccaatttctctgaggttggaaatggaaggacgtccggttaagcacagcggtttgaagaagattctgttccattacatcagccatcgatgatcggtcttactctgcaacgattacgaaattgatgtgtgtatgtgttgctttaatttctttataaatgctctcgagatcttgccaagatcaaatgattatagagtcatcagaaaaattcatcgtacttatactgccattggagttgacattgacaaattcttcttattttgtcttaagctcgaagtatcgtggaagaaacccactgatagttgttaattagctctactgaatttttattataattattaattaagctttgcagtcgccagtctttgttaatactaatagtctaatacattacaggtaaggtctttggattattcactaaatgtgagttctattatcattgcggaaacttcatcaagtggtgttaattatattttagtcaatgtggtccttagtcattgtttatgaaaatacttatcctttctttagtatatgatagacctgtatatggatggtctttgtttgaggaaaagaccctttcaagttgtaataatctaatctttaaagtttgtattaaagagaatgagacggcatcgatcgtatggctcaatccttaagtcgttgaaagcaccaagtaatcacaccaataacaacaatatggggttcatgattagtaccaagtaattacaccaataataatagtagggtgtttttaacaaatagtatcatattattttgtctgatagctagctatttttacttgatatcatattatttgccatttgatatcatagctattttactttatgcgtttgattaacaaatagtcatgcttttaatcaacttggtcgatggtctttgtttatgtaaggaatttcctttcaatatgcaatcatttaaggccttcaaatttgtgattataacaaagagatatcatttgtgtcatgttttgacacaattttttcattacactgaaagggaaagtattattttgaaacttatacattttttttttttgataaaataatccttttctaacttcagatcaaaataacatgaaccgtcgaataattattttttattacacaaaaagtgaaagtgttatttttgacaaaatatttcatttataacctcaaatcaaaatgatcaagtactaaaaacgaaaaaaaataaaaaacaaattgtgataaaatcccaagagtcactttctatattcgacacattaatattgattttcttcctaatccaaattacgttgaccatatcatacattaattatttactagttggaattatataatatgaaaaaattccgagtcactttaagcttttcgaggtatctcctccgcgcgacgatg

SEQ ID NO: 28821 - DNA, 3003 bp, Unknown
  misc_feature (1)..( 3003): 2750-1469P.txt file - cDNA_ID_2998860; gDNA_ID_2926222; Annot_ID_142453
tccgagtccaaagccttctatgcttgatcttaatttgccttccataaccattccattcctcaaggaagatgtgactctcactagaaccgtcaccaacgtcggacccgttgactctgtctacaaactcatcgttgaacctcctttgggtgtcaaaatctctgttacacccaacacactgctctttaactccaatgtaaagatactcagctataaggtcactgtctccacaactcacaaatccaactcgatttactattttgggagcttgacttggactgatggatctcacaaagtcactatcccattatctgtcaggacacaaatgttgatgtacttcgaccagtgagtttgcatttttttcccaattaccatgtctttacttaacccagagcggtggtgtgtaaaaaattcaataattgtgggggaataacatatactatctaaaaaccatcatatactgcaacctattgttttctgccacttaaagaaaaacatggattcaaagttgaaattctaaacaaatagaaacacacaaaaccaaaattttgtgtttggatgttcttgataagcattacattatttttatatatctatatatatattaatatatgcgtttgcaataggtaacaaaatgtatcttataatttgctctcttttttttaatcattttttcattataatttccggttgtccaattttatttgtagggattattagaaattttcgaaattttcgggatatccgtgaagttgggccgaagcccattcgtctctacgtgtcaaaatgaagtgatttggtttttcttaataaataatgaagtgaagtgaatttcgatgaagaaagaaagacatgttataaatgctgactttttttatttcatacatttttaagcctcgatcgagcggaatacaggtacagagaggacaatcaattttaggtaagccatgttggggacatcacttttcaaattgtcttggaaaataaattcaaatattaaaaggttaatgtctttttctatataacagcataatccatatatatatatatatatatatatatatatatatatttttttttttttcgcaatgcattaatgaaataattgcattagaaatgaatcattcatgttacttttatttttatatcataaagaatcccatcgaattttagatatcgtaagtaaaagatacggccgtgaatgatacaaaacagaaaaaataaataaagatatatattggtgcatgcatttgggtgcttgcattggttttgtatacaaaattggcccggtcaatggtaatgaagacatgtatcatataaaattgttgtagatatatctaagattatttatttatgttggcatgtttaaagaatgataaacctacaaactcttggtaagaaataaaattattaactttcgaaaagaagaagaggctggtaactgaatgcattataaaattaaaatttcggccgccagtgactttttagtcttcatcaaaagtgtgaatacttagttctggtcacgcatgactcatagagtgaaaaaacaaatacgtacgggagacctgatactaagtttattttataagaaatgaaaaccaaattctgaaaatttgctacttaacttctctttttcccaacaatgcaaaattgaatatgaatggtgagataacaacactattaatacaatcattaggttatatatgcatgacatttatactattttaatttgtttatgtttatacgattatatattcgatgtttcggaagtgatgtgtcttatatgtttttaatttttctggtttttttcttcatatcgggttattatgggaaagataactggttgctatatcgatgtattgaaaataacctaaaaactaaatttagaataataagtaacgttgttttcgaatgatttccaaaaaatcggaatggaaataagaattaacttctcaacaacatgactctaagatctcaccaaaaataacaacatgactctaagaataagaatatcaatgcatcgttatatatatcagccagcaccaccataccatgaatgcatgatcaactataagtttataacagttcacatatccattaatctaaaagactaaaaccaagaatggatcaaggtagttccgtttaatttattgcctcaaccattaataccctcaagaaagcaaacacgttaaagaatttgatatatagtgatcaaacgagaaaaaaaaatggataccttatattacatagttgacaaaaaaaaagttggatataaaaatacaaaaggagacagattggcgttggacgagggaaggagctgtgggaggctcatgtgggcttcctctgttcgccatataactaatttcgattttagtgtatacgtatgcaattttttgtcacctatggccgttgtccctggatgatgaccatggcctacaagataaacaaagaaaaaaaaagatctgcagtgaataataaaagattcaaagtgttcaggtaatttggttgagtatgtgatgaaaattgtctaatggtttcaagaaaaaaaaatcaagtttttatttgaattttggatttttgaggaaaaaacatgtaaatacgctaaatgcaccaaagtgatgtttttcaacatcttgttaactgttattcggtagattaatttaaagtattttttttatgaaactccgatcgattaaccgccaaaataactttttatttacctccaagataccataatcattatccaccacattttcttaataattattattaagctctataattctgtaaaaaacccatttaaatacaaaagccgatttcttccaatctcaagttagagttttttctccattttgtttgcattctatatagtatcgtcacacaaaggtttcgtcttgtcactttactttgtttgcccccctttggttttttgtgcttcccttctcttttttttttgtttgacgacctgagggaataccttgatttgtagatttttatccattaatg

SEQ ID NO: 28822 - DNA, 3000 bp, Unknown
  misc_feature (1)..( 3000): 2750-1469P.txt file - cDNA_ID_2998864; gDNA_ID_2926222; Annot_ID_142454
aaaaggcctaagagaccattcgctgcatccagatgtcttaaaacttgtcaatttgtatgttacacatttacttttttcagttttcggttttggaccttagctatgataaatatttcggtctttttttttataatactatttatcaatttactttctgatacattaattatagaaaactatcaactactttttcatttgggaaaatgatagctcgtggaaaatgaagccattgattaaaagttgtgcagtatataatatggtcttaaatgttagttggtagtcacattcccaggaaaatgtgtgactactgaatacaaacatcacgcctatatttgttgttcaataaagaaaaaagaaaaaaagaacatcacgcctatcaattaatttttggattcgtgaacattatcacacacaacttgcccgttgaccgctaatgcagatcaacggtcaacggtcaattacacacaaaaaaaacaaacttctacttcatatttatttccattattcttaatttgtctgaaatttcacactctagtaaattttcttaattttattatcttctgtttcttaattattaaaattttccaaacgcgttagcgttataataatatctgttacattttttcttatttgctttttcttatctccatttgctttatttgttttctctcttttaaattacagaaaacaaatgaaaataattcatataacgtggagcaacaaattgagaccagctcaaaagacacgtccttttttgcgttactattattctcctcctttctctccaattattctctgagctgtaataacataaacaaaaaaaagattctctcgatcaaacttgccggcgtccatggaagatttcggccgtcaacgaccatacggagacggagggatgcagatccagccttaccacggtaatcaaggcggtgatttcaggagctatagcgcatcgtacgggacgagggagaacaatatatacgatgtgaaaaaggagaaatcgatagcaagatccaagtcttggggaataacggatccggagctccagaggaagaaacgggtcgcgagttataagatgtatggtgttgaaggcaaagtcaaaggctcttttagaaacagtttcagatggcttaagcagaggtacacacaggtcgtctatggttggtggtgattcttttttcatctttttctataatttttacttttttactttgtttttcttcttcttgagctttgttttgaattttgattttctcaagtaattatgattgtgctctctctctctctttcttatgtatctttgtgtttgtgtgttgtaatcttgaatgtaactgtggtggcttcatcgcaacaaaattatatatgatcatttattagtttcaaaaagtatgaatcttttgtactcagaaattaggttcgatggagaatcttcttgtttgatgctctttgctaagattattagttttctaaagtcttgttcaaaatagattgtgaaacggtctcttgtttcctccatccaatatcatgccatgatccatacttgcttggtttatcatctctattgtatacaattaggttttgacatggttgagtttttgtgattggcttgttacatctggtagttaattatgttcacatcattttggtgatcatccattcgaatcagaagctctgcttttattgaacaagagcagtttattttttgcgtgtttgaatgattcttaagtaccattttagaggcaatccaacatgtttcttagatctcaagttctgtttctgttagatcttgagatcttataaagcatgtttctgttagtatgatctcgagtaaaaagttggcttttgaaaagctgacaataactcggtttatttggggaccatttctctatttgtatgtgtcattcttatttagcttactttgtcgattttgacttttgatctgagactgcacttggaagactataatcttaattaactaagattaggtgaaatttttcactgattagttctttgaacaatatcacaaacttgtggcagacgcagactcatactatttccatatcacaactgtttcaagtctcttcaatatcatcaacaaaacgaattagataaccaaagcaatcaacgaaattatatatcgcctcctcgactatccagttttcggttaattttgagggcagaggagaggactgctaaatgcgttggcatggacgacttagctaaagcatgcttagcaacgttttcatgttgaacttgttgaagttgggttatttaatcaaatgaagcattctaaccaaaatatatatatatttaaatacccatcgggttcgtaaatgcatataccattaattttatactcgattcatatttcaagttgtgaagaagctgcctaaaagggtgtttgaggtttccaagttttaattatgatagctgctaaaatggttgaaccataaatattatcatattggtcttttgcaagagaatagccgaaacatgttttaaggtttagattgtttgtatacacatttacatttatatgtagcatgtatatttcataacgtaacattttttttcttttgctaggttttacacttgacatttgtagttacatttgcaaaactgttttttaattctttttgaagtattttgtacttttaaaatgtgaaaaaaatggacatgtgatgtaaacgccattagctgtgtctttttgccagcttttatttattttcttttgtattcaacaatataataaatttaaattttttaaagtcaattaaagtatagagatttttatttttttgaacacgaaagcatagagattaattttgtttttttaccatagaatacaattgctataaaaaaggaaattactatatacccacgacctgtcaaaagttaaaaaaacggaagtaaataataataacgtaagacatcggcaaaaatcattcctccattaaaaagcttcttccttcgtttctcgtcggcgttttgagagacatg

SEQ ID NO: 28823 - DNA, 3000 bp, Unknown
  misc_feature (1)..( 3000): 2750-1469P.txt file - cDNA_ID_2998868; gDNA_ID_2926222; Annot_ID_142456
tttggtacagaacgatgtccgttacagaaaatactctatagatgagattgaagtggctactgagaggtttgcaaacaacagaaaaataggagaaggcggatatggaccagtctatcatggcacacttgatcacactcctgttgccataaaagtcttgagacctgatgctgctcaaggaaagaaacagtttcaacaagaagtcgaggttctaagtagcataagacatcctcacatggttcttcttcttggtgcgtgtccagaatatgggtgtttggtgtatgagttcatggacaatgggagcttagaggatagactctttcgtagaggaaactcgcctccactttcatggaggaaaaggtttcaaatagctgcagagatcgctaccgcactctccttccttcaccaagcaaagccagagcctctggttcatcgtgacctaaaacctgccaatatacttctagataaaaactacgtgagcaagatcagtgacgttggattagctcggttagtacctgcgtcagtggctaacacagtgacgcaataccacatgacatctgcagcaggaacgttctgttacatagaccccgagtaccagcaaacgggcaagttaaccacgaaatcagacatattctcattagggataatgctgcttcagatcatcactgccaagagtccaatgggtttggctcatcatgtgtcgagggcaatcgacaaaggaactttcaaggatatgcttgacccggtcgtgccagattggcctgtcgaagaagcattaaattttgctaagttgtgtctaagatgtgcagagctaaggaagagagatagaccagatcttggaaaagaaatagttccagagcttctccgattaagaaacttggggaaggacaatgaaccaggtatattactatacatataaaaccctaaacaaagtcttgaatctatcaagtaatactaacttaattgcttacactttcattaggatgccataaataacaaccgggtctgaagatcatcatatacttattaaatattttcaagacttttgtgaggaactgaatagagagattgcttgcttctcaaggaagaaagtaagaaagtggtaagtgaagtgccatgaagagattactaactaaaatctaatccttgtttatattatatctctgtaacatattacttccacctttctagctttccgatgaaaagtattgaacaaaatgcaatggcttattgttaatgttctcgttgcatgaaacattgtcattatgttcctttgtaagttttaattctaatttttgagagtatgtgatattgatatagatttttgtgtgtggataggttagcgtttaaaaaaaaaaaaaaactcaaaagagttcaactcaatttgggcttcaacatataaaatcacccggttacaactaaaagtactacttttttcttggtatcaatgttaagctaaaagtactacttggttaccaaagaacagagaaattataaaactaaaacaaaaatttaagaaaaagataaactaatcaaaacaatggtgacctttataaactgggaattgatacaaagccacctttgaaagcaaagtataaaaagaaaaatgagtacataccgaaaaattttggagagtgtgacactttttagttctagaatcagttgtattgcttcataacataaactatttttgagtatgagtcgagaaaggaatatcataagtcatttatcaaaatgttgaaaaagctatgtttgcatctttaccctaagataaataaaaacatctaaagcttaacattgtctttttgatattctcaattataatattaactttccagcaaaacacaatccatcaagaaagcatcttagtatcaagccaccttatgatttataaatgtccaaccaactcagctaagcaatgaacattttactccaaacaccatcatcatcatgggcctcatcgtcatcatcattgcattggtcatggtcatggtagttgcatcatcaccgtccgatcaaacaaatgtcctcactcctctttgcatcagcgaatgctccacgtgtcccaccatttgctctcctccgccctctaaaccctctccctccatgtcaccacctccgtctccctcattgccgttatcctcttcgccaccgcctcctccgccacacaaacactctccaccaccgctttcacaatcgctttcaccaccgccgttaattaccgtcatccatccaccaccaccacggttttactatttcgagtccacaccacctcctccaccgctatctcccgatggaaaaggttcaccaccatcagtaccatcgtcaccaccgtcgccaaagggacagtcacaagggcagcagcaacctccttatccatttccttatttctatttctacacggcatcaaatgcaactcttctcttttcttcttcattcttgattgctcttgttgtatcttctctatctatttttcttaacggttcgttagtgtaaaagactcttctatattttgtatacttattaatattgtttattcatttttttttggtgtaatataagatttactttttcatcaatggacatcgaacggcaaaacctacccttaacctattttgtccaagctaaccaaaacctacccttaacctattttatttttttggccaaattaaaccctagattaatctagctaatgcaatttacatgtaacataaaaaaaaaggtgaaatgcatgacagtaatcattttgccgggtacgttggtttattttcctaaccgaaccgaagtctaatggaaccgagtttcggttaaaatcaacttggtttactccttagttcgaagagaaaataaaattgaaagagaaatttcagatccaaagcaggaaaacaaatcacagaaacattttgatgttaagtttttgaaaaaatcgcgagtttctggatctgtatactttcttagaggagattttgatagcatcgtttacaggagtaagatccgggaatg

SEQ ID NO: 28824 - DNA, 3000 bp, Unknown
  misc_feature (1)..( 3000): 2750-1469P.txt file - cDNA_ID_2998872; gDNA_ID_2926222; Annot_ID_142458
tgctttttctgtaccgctgtctaaatatttgtccaaaaaaatactaaagaatgtaacaagaataaaaatgagtaataaataacaagaatttattaaaaaggaaaaaagagtacaatagctctctagtaaagtcaacttgcgtgttcacactcgtcccacaagtttcgtcttctcatccccaaaaaaaatttcttcagatttcttatttatgaaccctcaaaaaaattaatcttcttctacactccaaaaattcaagacctttcagagacaaaaacgtgaaacaacacaacttcgatgaaagccgccgttttccgtaacgaagacggagacgaggaggaggaagaagaagaagaagaagaagtctgtaatgttttcgacggcggcgaggtagagtctaagagaaacaacgaaaccaaaaacctcaaaggatttttcacttctttgcttttgatggaggagcacgagaagcaagaccaggaagctcgtaacgctgcttctcgccgtgaaatgtctgattttcaatctaattaccggaaaagagctagaactatgtccgattactactccgatctcaacgattactacgctgatgctgaggaaagtggagatatcaatctgaagaagtcacgcgtctcacgcgccgtcgcttccgttgctgttgctgctgcttcggagattgaggcggagagcagtgagataaccggatccggatcggttcgtggtaccggttcgggtcagcaaagacggttatgggttaaagatcggagcagagcttggtgggaagagtgtagccgattggattatccagaagaagatttcaaaaaagcgtttcgaatgtctaaatcaacgtttgagttaatctgcgatgagcttaattcagcggttgctaaagaagacaccgcgttaagaaacgcgattccagtgcgtcagcgagtcgcggtttgtatatggagattagccaccggtgagccacttcgtcttgtctccaagaagtttggtttaggaatctcaacttgtcacaagcttgttcttgaggtatgtaaagctattaaggacgttttaatgcctaagtatcttcaatggccagatgatgaatctcttagaaacattagagaacgtttcgaatcggtttcgggtattccaaacgttgttggctctatgtatactactcacattccgattatagctcctaagattagtgtagcctcttatttcaataagaggcatactgagaggaaccagaagacgtcgtattcgattacaattcaagccgttgtgaacccgaaaggtgtttttactgacttgtgcatcggatggcccgggtcaatgccggatgataaggtgttagagaagtcattgttgtatcaaagagctaacaatggaggtttgttgaaggggatgtgggttgctggtggaccgggtcatccgttgttggactgggttttggttccgtatacgcaacagaacttgacgtggacgcagcatgcgtttaatgagaagatgagcgaagtgcagggagtggctaaggaagcgtttgggaggttgaaagggcggtgggcgtgtctgcagaaacggactgaagtgaagctgcaggatttgcctaccgttttgggtgcttgttgtgtgcttcacaacatatgtgaaatgagagaggagaagatggagccagagctgatggttgaagtgattgatgatgaggttttgcctgaaaacgtattgagatcggttaatgcgatgaaggctagagatactatctcacataatctattgcatcacggcctcgcgggtacttctttcctataaaggataatggaaatgttcttttaatttccttctatatgataaactaaacttactttgattctttggtttatgcataatgtattattgtacctttagatcacagatgttatatgaggcaatagaagaaaattaaattatatacacatactatacatttatttccagtctcttttgatgagtgttagacatgaatgtataataagctcaatgagattttcattctctggtgtggactgtgagatgagacaacaacaaggttagtttttaacacttgtgctatgttgttgctttaaaaaacgacatgtttggatgctaattcagtagaaaacgacacacatgtcatcttcttcctagtgtttaggttaccgtcactggtttgcagtctagtggctcttacttagcgtgcgagtcaccaataggagccacttcttttcttttcggacccactgatcagatgtaaaccgacatacgatagaagatttatatcttctcattttcaaatcttgatggtgttataatttcttagaaccaaaccaaatttacataaatgttttaacttcattttcatttctattttaatgaattttgtttgaatatttgtttatttatttttacttcatcttttgttcccattattcatgaatatcatgtaatccatgatccatccatatagaaaaaaataagtttatgtttttttggtgatttaccgtttaatgtgacctatttttgggaaaaggatacaaatgttttgtcatattacttgtatccaatccaaacttgaaatgaagaagcaaatctttatatatgaagaaaaaaaagatttgcatgtaatattctagaaaaaataatctcttgttactaaaaaccccacaaaaaaaaggatgaagaaatagagaatctccttaaaaaaaggcagtttaaaaaacaatggttaatataaatcttgattcccgcttttttctctgactttgctctaagggaaaaaaagaagttagttattcgtcttctttcggagcaacaaacattgaaacaggaagaagagaggagagaaagttaaagaccagaagaagaaacctttcacaataataaatcttctatcttctatcttcttctctcctctcttcttgttcccagacacaactagagaggtctggtaacacctgttcttattcatttcaacatagatcggtaataatg

SEQ ID NO: 28825 - DNA, 3000 bp, Unknown
  misc_feature (1)..( 3000): 2750-1469P.txt file - cDNA_ID_2998888; gDNA_ID_2926223; Annot_ID_142467
ccattgcttatcattttctctgtttctttattcatttgtgttttcgttttacattctttctaatgttttttatttaacatcgagtcttatgttgctcgatatatatatatccatctgattgcaaatgatgagttaaatcaccattgataaaagaagctcaattgagcagtgttggaaatctaaaacttccatgactctgatgcaaatttggatcaagaaaaatcatatccttgatctttttgtttctgttctttctcagattttgttaataatcactgaattttgcttttcaaatgtatttttctgtttaatcttaataattctctgcgtatttctcactagcgttcttaaatctattttttctattaatctttagtgatttttactaacaaggctgcctaaaaataaaattgaatttgatcaagtgcaaattgtactgtacaatatgtaacgaatttgatcactatataagtcacaatgatgagaaagtgaaccaaaaagcttcattcatatacaccaagacgaaaacatgaagaagatggaatcaatcagaagtggttttggtgccccatagccgttaaagtgttgatatcattacaaatctcataactaaacaaaaaaaattaaccaacaatttctaagaatcgatgttttacgatgcatcgttatcgttgtctccatcgaaatattcatcatccctctggatctgcttatcccgtgaacgctctgaaacattccatatataacattagtcactaagaaaacaaagggactaaagtagagccttgaaggtggttatcgatacttacgatccacacgtacatccggattttgttcgtcttcatcaaaatccggtatgtagaaatccggtggaacctaagagattcaagtaaaaaaactgatcagtgttagattgataaaagcatcaatttgtcctatgatgatctgagtttacctcctgcatctgtacgcttggagcgtgttgaatgtatcgcaaattctccaaaatctgcactttgatggaactgatgtatgatttggtattaagattctcctgttttcatttcaaacacaaaaaatgattctcaatctctctttagattttgttaaagcaatgaggaactataagttacataagagctccttacaatgtgaccacccggtatcttcaaagaaaaatccggcgcaaaatactttatgtagtcgttttcagaaatctctgcagaaacaactaacccctgagctccaaagactgcaacattaaactttctctgacaaaatattgaaacaaacttttaataaccattaggaagttctgtatccaaaagaatgccagtctcaacggtccaacaacgagctacattctcctttgtgtatcctccacctcctgtaacctaataaacaatcggaaaaaaactgacttattcgtagaggaacttaattacaaaaagtcgtactagatataagtcaagagagattagataccagtaagggaagattgaacttcttcacgaatttaacacattcagcatgtcctgtgaaaagcatagagaaagccatttcaaaacccgattcgcaaagaaattagcaaacgggagatttttgattacaagaagaaaaagcaccatcaatagagagattaaagcatcctagtcgataatatgagtttgaatgtttgtagaggatatattaaaggcttataatgtgtggaaagccagaggcagataagaaggtaccgttagtgtttttttggtttttgctggactttggaactctttttaggagatttttcagagcattttcattgaatttttaggtctagctaatgtgagtatgaatgtttgatgtttgcagaggatatattgaaggcttataatgtgtggaaagcgagagggaatcccacccgatgcagataagaaggtaccgttgttgtttgttgttgtttgctggactttggaactctttttagaacactttcattgagttttcaggttaagctaatgtgttcgtattgcaagaaacacaatgcaagtttgttcctgatccatatgatggtggagctcaaggttttgagaaggtaattaccattagagactaagccagttgtggattagtaactttttggtttaggcagatgctacctataaaatttcagctatgttgtcttttcaaaatggttgatttggtttataagactttactatggcattagcataccattgttgtcactcccaaattgccttccgttcgagaattttgcaagggggaatgcttatatttcctgtttgatctattttgttaggacaaaagtcacttcgaaagttgaatcttgatctgttacttgtctacctgtttctttcataggtactggacttgctagaagatgcttgtgagtctttgctggacagtattataacagaaaaatgatgtgaagcttgaaacttgctgatataaatcttgttaaactgaactctttacacgattgaatgatatgaactctttacaagattgaatgatattaactcttttgttttatcattattattattaggagagaaatagaaagaaaaaaatatatattgtgtggacgtaactttgtttgagacagtgaatggtggagcatagggacagtaattttgtcgtttgcaatattttccacaaaatctcactatattttccaggaaacatccatggagtttagagtcgtcaacgatctatatcttcagtcacacaaatcgtttcaactacaaaaattccactaaacccgtgtgattcttcaactctctagagatttctcatcctttcatgtatcggtgagattttccaactatttttaagttttgcttaaggttttatcactgtggaatcgaattgattggactggctcttgatgattatgctgatattgatgctttgattagtgttttgagctcatttcttgattatgtgttcttgattttatattaatttcttgattcttcgataatcaaagttctcatg

SEQ ID NO: 28826 - DNA, 3000 bp, Unknown
  misc_feature (1)..( 3000): 2750-1469P.txt file - cDNA_ID_2998896; gDNA_ID_2926223; Annot_ID_142471
acccaaagaaaccatcatttttcgcccaaaacaataaacatttttgaccattcatctccttttttttttaacatcttcctttactttattaagattgaaacagagattacatagttattttttagacatacacataaaccaaaaatgattaacgtttttaaaaaaatacaatcaaacaactgaattacacactgttttctttcgtaagctttacacgctaatagatgatcaaatctattatcttacaactgaattacatactgttttctttcgtaagctttacacgctaataaatgatcaaatctattatcttccttggagatatctccaaccggactgcaaaacaccaaatactgtatagtgttcataatactccaatcgaacggtataagcaacaccaaatatttttttttagtgttttgtgaacagtattacatcatatttggtgtaatactgtagttcacaaaacactaaaaaaaataatagtattttattcatgtttttgatttagtattatatttaaattgttgtttttcactaaaagacaaatacactatcattatttttgggtgattttatttttattaatatgaacttttatttataagtagtatgatatgaaatagtaaattcagacaaaaacatttaattaaaaaatacaaacaaaatatttttcttgtagtttcaatttatcgattgcaattttatattaattaagttaaaataatttagttataaaataagttgtgtatatcaaactataacaaaaataaagaaaatattttgtttaataatataataataaaaagtaatacttttagtgtgaaatttggtgttattgttggagatgataaaacaattgaaacaccaaaacaccatatttggtgttaaaatttggtgttttggtgtgttgtggttggagatgctcttatccgtcttcttcctttatccaacatgatcatcttgtttggctatcgtcttttgacgaaactccaataatcgttaaaatgatccttggttgcgatccatcttttacatagtttcccatcaaaacatctccaacaacaggagatggaatctttcttggctatagcttgtgcccataatggctgaaatggttaataccatcttctgaatctcgttccatgtagatattcccaaaggtccgataattgatgagcgttcataatccttaatcaataataatatccaaggaaaaggtttgcagagatatattcataacatcaaagataacatgttctctacagtctccaccatatccttagacactgccacgaaccggtgctatgaaccggtgaatgcatgaaacatcactccaattcgccttcactgtcaatcccaatacccagatcaaatatacaaattacatcactgtatagtaccacttggcagagggaaatgacaactatcgaaaacgccacttcattcttgggccaatgacttgtacattttataaacgatcaagtcaaatatatcacaatcaaacacgaataaaagccatatttcctcataaaataactaaaagtcacattttactcataaattaactaacctattcatgttatttctacgttgactcaaactaactttatccaagaacaagatgaacgataatcaggaactcaagattcatgtttttaatacatgacttaaattaagaaaatttttactgtaaaaacctaagacattcaaccaaatatgatcaaagtagggattaaaatgagaaatttgaaaactacatgaagccacaaatgtcatattctcaacttggccgatctaccaatctagagactgtggatcgtttatgaaatttcctccgatctttgacctcccatcctccgtgcacaacttctttatctagaacgtgggacgaagcaaatgaatatcacaaaatattgcaaagcggagaggaagagtaggatcaggcccggcccaaggctaaagctcatgaagctgatgctttaggcatcacagatatattgtaaaagttgaggacatcattccaaatttaacttgtggcatagtggtacaactgtactaaaacgtccacgagatgactggttcgtgttctttattttcctttttttggatttttcatttaagttttgtttgttagtgggcttaaaaaaaattttgctttaggcatggaaattgtttgggccggcccttagtaggatgttagccaaaaaaagaaaagaaattaagcttaatgaaaaatatgatacacactagaattggattctcaacccttaggccttggtgcatggctggcttagaataatttcaaacctaaaaaaagaaaaaatatatttaggtttatctacaaagacaatatataattaaattgtataaaagtttttgaatgattttattttaaagtttggcatttttatagtggaaagggtttggagttaactagtattacaccacaactatggtcctaaaagcaatactagtgttctcggttgatagttttaagtcagggcccggatttgcctaagtgaattgccatgagagcaacccaaatggagcactaattttgaacactcgttttacagctttttttttaccgcaccattaattatttacgaaaccgcctaagcaacactaaacaattctgaaccgatgaagactgatgtgaatatctatactaagataactattgatttgagtgaatatgtgttcaattctttaaattgtcctttctttctctggccccctggctttctccttcaaagtagtagtccgaatattccagtgattcttgaaatattctattaaaaagattcataatcgaaccaataagggaaaaccaattatgtttatataaaataaaataatactattcaaccgtttaataattagaataatgattctactaacaattccagctagatctaccttccctccttgtcctaatgcttaacatattcttcttgatcttcttcgtttttcttcttcacaaggtcaacaacaatg

SEQ ID NO: 28827 - DNA, 3003 bp, Unknown
  misc_feature (1)..( 3003): 2750-1469P.txt file - cDNA_ID_2998899; gDNA_ID_2926223; Annot_ID_142474
acttcattctagtaaagtatagtatatagctaaagatttgtctgactaatttagcgatgaaaaaacactctagatttgtagctaattcatagcaaatacattgccatttagcaacaaattaaatccaataaggaaattattggtatggcaatggatggtgataaggaaatctttgccgattagcaacgatttagagtcctagccaactgtcactatagggtaaggtttggtgacaaagttgttgtgactacttctttacatgagttcttaaaacgtttggacacaactacgatggagaatcatttatatttaaagagatttatgggtagctatattgcatgaatatgtcatgcataacgttgtgttttttctggcgaaacatcatcaagcatggtaggaaataaaagaaatataaagaattgttgtcctattccagttgaagttgatcaggttgacaatagtgttgatgcgaaaacaaccatctcacgaatttctttaaccaatcatttaatcaatctgctttggactctagccaaaaataataacggtgagcttttcaaattgcatttgcattgcatatgtttgttgtgtttttatattttttgacttatagctctgaatggtcgttgttgtgatatcccaactttagagtgggaactggtcgtgattatgatcccattagtagagttgatactggtccgattggaacatccggtataacacccgtgcttcatatgctcataaggttttatggctcatgtccaaaaaataattggacccttttttgtatatatctctttgccccttttacatggataccattttgatcttacaaggtgaatatataatgggaatgaaaaggagagcataaagaagagtataacttgtgaataatagtagagagagagagaggttgagaggtttaatttggacttaatttataattcgtattcactttgatacaaaatgagggaaatcaattttgaataaaaatggagcatttattggtatggccgtacgatgttacaagccgcgtaaaatgttttttgataagtcacaaaacactgtcgtaacaatttgataaaatcaaactgaccaccgttgattacgtaggagagccacatgggctcctttgaaacttataccacatgcaaaggaataaaagtcctttagtcaaatatacacatgtattatgcacaaaatttatatcaatcagaattcaatatgtactattgagtattggagcatgagtttttttttgttcttttactgttgttgcatattgacctatattgttgacccatattatctactatttatagatctaccaacattaggaaaatggaattaaagttattagttttctctatattttaatgaataaatagaaacacataaccccgcttctaagaataataactatttgttggcctatattcgtccatatatttcatatgtacatatctgtatgtcaaagtagttgtaaaaaaaaaagctaacgtatcattctctaaaccaacacagaaattagttttacaatttgataatccttggaataagaaatttaaacatttgttccttaagaaactcagtttctttccatgagttatatgcttttaatttataaggtaacgaatatataatctcttacgaaagaaaaaatcctaaaacagtttcagacttactaaatttaataaggagtgcttatattactcttacactaaattttcttaatcgaccgacttagagagaaaaacttacaaaaattgaaaattttcatacagattaattgtattaataataaaattttattcaaaagaataatcactaattctaaccaccggtattaattaaaaagatagtcaaaatttggtagtactatgctgatgatacccatttactaaactcaccattcaaattttgttctttccttttatattaattaaccacacttgttcagctttttcattctgatccaatttttccttatgtaccgtccatcatattacaaccattcggaccttatacatatatagttcttcttattatagaataaattactttcacagtttcacgttaaaccaaaacaaaatgtacaaatactcgtaaaacatttaattgatcaagcataaattcgtaaactgtttttttttcttttgatgaaaatagtgtaaggcaagtttaatacattaaatattacgcatagtcggtgattcgtctatacatataaaagacttggagccgaacaaatagattgtgttgttttcaaacaaattgcccaaaatcttgcaagtagaaaacaaaactgtaccgagtcaaaatctgtcgtcagccggctatcaagaacttttcttttacaagccccttcttagttagctcaagctggcatatctataaatttatgatgtatgattttatttttgttatatatatattgtacggattaaaaatgtacggatttaaatctagaaaataaaaataatctcgttatgaacatttaattaactgataaacattctcagtgttttcttctttcagattttattcagtttttataaccatactttaaattaaaccttacaaagagtttgatacaaacaaagccaaaactagctttgcaaaaaaaccaagtttttcaatgcactaaaaaatatctgccaaaacaccatggagctccgataaaagggtcttcgacttgattgatgtaaccaggatcaaagttgttttttgcactttaaattgtttgaaactagtaactaatataaataaaagacttctcgctaaattatggcaaattttcttcttaatatattaaattctgatcatataaggtcagaggacattggacagatattggttttgtttattttgttaggcttattggaggagggtacaatagactttcttgcaacgtccttagctgctataaatactcttatactacaatgggtatatttgcctcattaataacttcttccgaattagaccaaagtccagacaatg

SEQ ID NO: 28828 - DNA, 3000 bp, Unknown
  misc_feature (1)..( 3000): 2750-1469P.txt file - cDNA_ID_2998909; gDNA_ID_2926223; Annot_ID_142479
gatttataatactattttaactagaaatacgtaaataaaaatggtttatcagttttattcgatttaaaattaaatcaaaccgttcagttgaaggaaaaacattgatgaaagttcgatttgaatcggtttatgttcactccggttaaaatgcataccctaatctcttggtcaatatattacattccttaaaatatcccgtcaaagtaagagatttaataggttcattcctaaacaaaattagtcaaatatttgaccacaaacatggtagtcaataaaagcaaattagattaataatggtgccaaataagttggcaagagtctgatatgcagtggcagaaccataaattatctcatatatatgtatgtatttacttgttcaattctaagtatcacactcaaacaagtatatgaaaaggtacggtatcaggattcctagactatccacaagatattttttctttgtagctagctaacaatattctattttttttacttatcattcttttcttttttttcctcaggttagtaaaagtttcataagtcgcgggtggaagattttttctgttgttgatgaagttttgacaaaagcattttgcatgtttggtaggaaagcctttacatgcatccaaaggagagtatgagaattagacaacttctcgataatttcccaaacttggtaactctctctctctccctcgatattttttctgccaaacactttcgaagtaagatacttataaaatatggaataaagattagtcgcattactgttatgaatttttatatttacattagtagtaaatctcataatttttatttgctattttgtaaagagctttgtgatatattggtattgatcaatgtatacattggatgcaaaacataacaaataagtgtttgagaagacacttaaggttgttatggttaggaattttcatagtcatttgaacaagttagatgtaacaatacctcaatagatttaactcgttcaagccaccactaaagtttctaactaccacaacattaagtgttttcctagccacttatatgttatgttttgcaaccaatatgtttgaggatatattgatgcgaacatatgccctctctttattttataaacattaattcaagattatgcgttttattattaaaaaatatgactactctttattgcatacattgaaagctttactaggaaagggcgttgagaaaaaatattgaaagtgaaagtcttcaaattaaggagattattgataagaatcctaattccatcgaaatccttcgtatgcatctttgttctcaaaaccaaatcttatgtttattcaagatgcagctaagagtagaacgttaaggtcctagctactcgaagattgttaaggttacgagaaataactgcatcgtttgtttgtgttgattgatttggttcatcatattctccctttgctccaaaatccaagtatacttcttttatgatcatatttatttttttaaaataaattctctagtatcaagagaatgaatgtgatcataaaagaactgtacctgaatttttggacagaagacgaatatgatgaaccaagtaaattatcccaaataaccaataaaattatttctagttaccttaacggtcttcaagaaactaagacctttacggtctataattatatgcttcatgtatatttaagtgtttacatccttacgttacattttataataaggattataggactttatttaaatttgaaatgatgtatgttaagaaatagtttagaactttagatagtatataatcatgttggttattaaactcaaattatttggattcttcagtaacaaaattttggtagttatcaccacgtcagttgcaaacaaaatggcctcatgacgaagcagcaagtaagtttttacatgtccttttaacggactatttgtacataatagaagttgaaacatagactgctttcaagtttcaccaaaattgagtttaggtattacgttgaatctgacaaatggtttaaggctaaacccctattaggacaaacactgaaactgaggttgaccaagaaacatctcgaggataagagtccatagtcaaataagaacaaacagtaatggataaagtaagtgataaggaggccgattaggagcagctgctattttttgttgtaaaaactttggttattatgattttaattgtaaaaaattggctgtagagattttgactatggagaatttaattattaaaatctgattagtaacaaaaaaaaactgtaacaacttattttattattattaaatatttttttataaatataatttatgctaaatatgaatttatttgaaaaattagtgactaaaataaatttattatgaaaattacaaaattcataaataaaaaaaattattttacaaattcactattttaaatactccatctgtttcacaatataagttgttttagctaaaagcacacaaattaagaatatttacttttaaaaagttctaccaatcataaaagagagtgcataatatagataatcataaaatattaaaataatatataatttgtattgaaacttgaaaacaacttatattgtgaaacaaaaaatttgatctaaaataacttatattatgaaacggaaggagtattcaaattggatcaaaaataaaataaaagtctatttaattaatcaaaattatttgataataaaatataaattatttatatatttatttattattctctctcaagataaaactcgatttattacttttatgaattaggagctgaaaattctgcaaaatacccaattgggtcaggctcataaatttatatatgggcttaaaaataaggcccaatagatatatttagttcatgaatctacttctcttctctatttatttcactcactgtctctctctgacaattcgaagttgtagcaaaccttgctttcaatcgacgaaggagttttgagttgaggaagtgagtagaaatcaatg

SEQ ID NO: 28829 - DNA, 3000 bp, Unknown
  misc_feature (1)..( 3000): 2750-1469P.txt file - cDNA_ID_2998926; gDNA_ID_2926224; Annot_ID_142486
gagatcaaggagttgcgtttgcttgatgcatcaaacgaggagactacttccctcttacacaacgctcgctatctgattcagaatcctagcattgagcaatgaggtaaacagtctaaaaccctatcaagaagtactatcagccattactaagaatagattatcttctgtcgtccagtggtgtaagaagtcatatatataactttagatcaacatatggttggtttgagaatttagatttcttcagtttcaaaaactttatgatgttttgaaggaaacatagaaatagcttatcatgaacctttctcagctaattaaaaccagaattgtgtttgcttctttattagattttggagtgaatatagaaaatgactcatatctctagttcgatcaaaaaccagtaactcttcattctcttttgcaattcttaaatgtttttctcagttcttgtttcaactcaatctcccaaaaactctcatgctgaacgtaaccctatcttttaaaaaatattattataaaattgttttcttataactataaatattattttaaatgtgtatgtttaactgaaaaaatagatgaactgaagtagtaacaaaagttgaatagtggtgaaattaaattctctgaggtgatatagatggacatggactaatctatatatgaagttgtaaactgttaattcaattaaattcactgggaagaaaaaggtatggcgttatcatgggttcaggtttaggtgttagccaatataggaatcttctaccgttgctctgttacaaaacgacaagacttaaatgtcgggtcgttaccaaactcactggctcatctaaatatctttaaaacgctaacggccctgaccttatttccatgccccacttacatttcagataatgccaaatggatttttcggttcaattttggtttagttatcttttttttcccccggtttaattaacttataaatttcacttgctagaatgcaaagaccaactcaaagttgaccgacggggagagaaattttcataatagcttataattattttttattttattggcaacgacaaagtttgaattatacattaggtggaatgtccatatccccaattcaactaccgactttggatatacagatacctattaatattataagttatcagaggcatatctttatataaacagttatacataggactttgatatgttggacatatgattagctaaaataaattatcaaattccaacggctagttctcacttattttatatgaaaataattttagggatgttatactaacgaaacagagaagacgccacatggagtgattggacatatatatgctttttttttttttttttttttttcttaaccacaaaaattacaggaagactggtacaagctggccaccgataaggaaccttttgggtttatctccgaaaaaagtcaatgatttcaggcagataatacttaatccagtggacaaaaattatatactctttcaatcatcgttctagttcactgtatgtcaatccatataatttgggaaattgcttttgtggtggatatacacgatcatagagcaaaatacagtctgctaatagctgttgcataaaacgagtttttccaaagcattatttatggtttgtgtcactaggtattatgagtcaaatattttctttgttcatccatcggagattaacttagtagtgtgggtggatctgaacataaaatatgatatggtgtacaagtacaatgaccaactaattttcatgatttatcaaatccagaaagtattaagtatcgtatatggtggcttgttaacgagtatattttaaaatgataaaggctgtctcactggtggacatattttgttcacatgttttgtcggttgtagtaatgtaagcgtgtattaaaacacacatactttatacggattatgcagatgaattaattcgataaacaattggtatttgacgacaaaaaatacgatcttaaatcttaattcgattaataacagatatttaacggcaaaaatatagtgttatattttaacccgcctaaagacaaaaattaaagacgaataaaaactttttattgcaacaattttgttttattaggtgaaattaaagaccaatcttaccggataaagttataaattaatttaaaatttatatggtcactgttttatcgatcctcataacttgttcattaaattatctagtttcaaaaaaggtacaaaatccaatacattttccagtttacacgttatccatattttaagaaaatttcaaacatttttagagaaaacaccaatataccatgtcaactatgtatactatttttgaaatgcaccaaataataataaatctaaagatactatactataaaaagaaaaattaacaaaacagtgtttatgaaacttaagaaataaaactcatcactaaaaaaaaaaagtgaaaagaatagagtaaaagagagacgaagttggtaaattaagaagaagaaaaggaaaaaaagaagagtagaatggggcccacaaaagaggcccaattaagtggcatcacgcacaaacacacaccgtcacaaatactcttcttcacacagctttgaatccatctgtcttctcctctctctctcttctccatttgcaattatgataatgtgaaagcaattcgaagaagaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggtacgattcattctctccctgattcagtatcaattggtgaattttagctctagatttcgagatctgtcgtaatttagctactgagatcagtagattcagtttccttgtggaataatttgtttcttctctgtgaaggattacatagagatg

SEQ ID NO: 28830 - DNA, 3003 bp, Unknown
  misc_feature (1)..( 3003): 2750-1469P.txt file - cDNA_ID_2998934; gDNA_ID_2926224; Annot_ID_142490
agcaacaatggcattacttcagtagaatgtatcattctcttgtgttcaatagatcccgccgctatattagatagcacccaagcagcttcctacagaatcgagtatagtgatgaaagcttcatataattgtaaaaaattaaaaccacaacgggaatgtgatactgaccttctttaaaacacggtgctcgcttcttaagcactttgcaagcacaccaatgatgctttctgaaatttagtttgcaatataagtatcttgaatatataggattaaggtgatgatgtttaacccggaaaagataatagatactagccttcagtgttctgttcacggataagaattgttaatactgctttgggatcaacagcgacaaaattgcctaaacttcggagaacctggattcacatttttgttttagagataatcaagaatgcaacatttgaaaattaaggaccacgtagtgagtattctgattctaatcattcatgctaatatgagtataaatgacatcgatgggacttggaactggaagcaattgaatagcataatctgaggtaatattttaactagaatcctgtttcttttggacgataaggtctatctgaaagttaccgggatgagaagttgtaggctacttgaggttgctaatctgtcaataagtagttgaagaatgcctcccttcaagagcatacttgtagcgatatctgagagggcagataggtaaacaatgatccatgcaatttccgtggcagtttcctcatccctgaatccaacaatcaataatattttgatcaaattattcaccaaaattgaacaatagaatatcaatggcataaaacagacccctataaatctaaagaatcactaaaaagcaagacaccacaacacgctaagaaattgttgaaattcagagagatgtaactttgctcacgttttcttcaagtgtcgaagaattgcatccagtatcccatcaattttaacaagttgtgctgctgcctttgactcaggtccctgtattaaggtataatgaaaatagtttgtaacaaaggcttgtaaattataaccaaggtgataatatccgtgccaggtttttccccaccttaatcagatttgacaatgcccatgcagctgttctcactgttgaacccttgtcgggaaaaatcatacgtgctagaggtggcaaagccccttgagacaaaagaacatttctcaaatcttctccttcaccggcaacattaccaattgcccatgcgcactgctcagccaccggtgcggagctcttttctgaatataaacttggaatcatatgaaatctaatccaacaaaaacaatagagtaataacagacttggttggccagtacaacaaacctccaaggtgagcaatgagtaacggcaatgcaggtaatagagcttttgtttcttcaggttttccagcagcaatgttggtaagacaccaagctgactcaagtaactgcagttagacagaactgtgatcaaaagattacaactctccttaatatatcttctttcaatgcatgagttacttgtcaaaatctacagtaaagtgccggacgaatatataagcaaataaatgcaagaacaaaggtatagtattaaagcatatataaggcaaatgtaacctgttcgtcgggggagccaaatgaaagacactgcacaagtaaaggtattgcaccagcacggagcgcagcttcaacaggagggaactcagattttgataataaacgcctgagttcccgaagagcagtcaccctcttctgcattgcaccttttcccctgaaaattgagataagaagtagatatcagaaaaaaatcacgaacaatacctgaaacagtgaagaaaacgaaaagaatgacaaacaaaaattgacagattcacttactggtattgaacagcggacttgagctcttccacagatttactggcttgagcctccaatataggctgctcttcatcaaccatcatctcattctcaacaagagcatcctcaacatcgccattagtacccaccctacaaagccgctttgccctaaccagtaattcccttctttccttcgccactgtaacagcttgttttcgtcttctttgtcccgcaacatttccaactacacaccaccatttccagaattacaatcaaatccatgccaccaattgtaaatttatatggttctgaactaatcaatatacatgaaaaaccaatactaaaaggaatgaagcatctaaatttgttcctaccctaatcaccaactaacctaattatctcgagaagcaaacaaaaacactacactaacactactcaggtgccaaaatcaagttgagggtttacagtaaaagtcagaaggaaaatcacctgaagactttattgggtcccttcgattagaggcggagccatcatccgccattgaagaagcttgagcacagcaagtttcttcgagagtagggtttttgattcggtaatttcaccggagtaagaataggatttcgccgaaaacgaattggttaatttggatccgttccctcgcgcccgcccagcaaaaaaaagaaacacgaaaattttgccgactcatatttgcatataatttcatattagtccctagtatttccaagtatacaataaatagcccatttaactttattaccaatttccgaatggatcaacgatcgtggtttcacgaagtctttgacattcgcctatgttgcaaactaaaataatgacatggcgactcatcattggttctttacgtacaccgtaatctaatgtgacgcatgtggtaataactcttgtgtcataatacacgtgtcacgcatccacatgatcctcttccctgaacatgatgagttcacaccggctggctttttctcacccacttttccgtcactttctcggttcattttctcgagaaaataaagaagacgaagacgaaacctgaaaccaaagccaaattctctcgattaacagaaattcctttggatctatcgtcaatg

SEQ ID NO: 28831 - DNA, 3003 bp, Unknown
  misc_feature (1)..( 3003): 2750-1469P.txt file - cDNA_ID_2998946; gDNA_ID_2926224; Annot_ID_142497
agaaaaaaacaaatcaatcgtcaatgaacccatgcttgttctacttctaacaaaactttcgttatgattttggctaactatgtacatgtttttattttattttttgaacaaagatgtacatgttttactaggtgaagtttattactagactatcatttcatcgcttctgaatttatttattagtgaaaatagaggttagatttagtgccaatatattgttcgatatcacattttgacttctctcgggtgtacactaaattacgtttaattcttcgtattacttttcttggctttaattttgtttacgagtaatttgtacttccaagttttgtaaaatctttatataaaaagtagtggaaaaataaatacaaattacaaaaaggcttttttgagttcctaaaactttttgggagtcaaagatggtgctctctttaaacaacgggaactttttgcatcgacctatatgctttgttcttgggacacagaacattttcctttgccaaatacaatttcttgggtggataaaattttccttttatattaaaataggagttgaaactatgtccaattaaattaatatgtagatccgaaacatagctagtacatatcaacgtagattttttataaaataagtaataaataaagagctactgtttcttagtctcaaaataccttataaaaagatattgttttgttttataaagaataaaatgaaatttgttaagaagatatatatatatatatatatctcaattagtctatatatagggagtatatatatatatagttattgattactgcttctaaaatatgcaacaattatattggtacgtatataaattgtttttttttaaaaaataaataaattcaatttgtagaaaaaaaaaacttattacaaataacataaaacaataaaatgccgaaactaagaaaccctttaaagttatgaccgtaatagttaaatgttgtatctacaatcctttgaaactatatctatgtgaatgaagattttagttgaataaagaataaatccaaaaatatcatcaaattatgcatcaacattaagggtgtcaaaatggatcaaaattcatggatcaagtcaactcaactcaatccgtaaactctaatgagttcaaaattttgactcaaatgagttgatgagtcaaatgagttgatgagtcaattggtttgatgagtaaaatgagttgatgagtcaattggtttgatgagtaaaatgagttgatgagtcaattggtttgatgagtaaaatgagttgggttgtaatggttaatggtttcaatggtttacccaattaacccatcaagttttgtaaaattgaattaaaccaactaaaatctctaaaccaatgccaatttaagtttaaccaacacaactaaaccgatttaataaaattaatatttttctaaatttcttaaatatacaagcgatgaaattgagaaaaaagtaaactcgtaattttccaccaaaaaacataaacccgtgattttcctgccaaaaatttaaacccgtgatttttcccccaaaaacgtaacccgagatttttctgccaaaaatataaacccgtgatttttctgtcaaaaacttaaacccgtgattttcccgccaaaaacgtaaacccgagatttttccgccaaaaacgtaaatccataatttttccgccaaaaacgtaaactcataattttcccgccaaaaaacataaacccgtaattttcccgccaaaaacgtaaacccatgatttttccgccaaaaacgtaaacccgtgattttcccgccaaaaacgtaaatccgtgattttcccgccaaaaacgtaaacctaagattttcccgccaaaaacgtaaactcgtaattttcccgccaaaaacgtaaatcttttaaacaccgtgattttcccgccaaaaatgtaaatccgtgattttcccgccaaaaacgtaaacccgagattttcccgccaaaaatgtaaacccgtaattttccgccaaaaacgtaaacccgtgattttcccgccaaaaacgtaaatccgtaaaaagtggaatccgtaaatatcctaagtttgatgataatgaattaataatgataattatttattattgttttataatagtaattaattaaattattatttaaatgggttaatccatttaacaactcaacccatcaaattaaatgagttatgggttgacctaacccatttaacaaaatgagttgggtcaacccataactcatttaaccctaaactcatttgattatgagttgagttgagttgggttacccattttaacacccctaattaacatacactaattgatgatatatatttttcaaataacaatatcatctaaaatataatttagattacatcccttaaatatttataccttctcccaacttataaacacaccatagatgtacacatgcacgtgtgtctatctaaactgcaagaaaggaagagactggccttttcgaagaaaataattatttacaaaaaatcactttcccttttagaaaataatttactagtcgactacaaaaaaaagggtagatctctatatgtacatctcccagatctctcaacattatttatacaattttttcttttattcctgcaagagtttttttttgtttataacaacaaatcctctttcaatataatctttatatatacgtatactttcgtgccttgaaattttcttcctcatcttctttggtcttttcttgtcatttggcataaccaaagagtcaagcacattcaaacattctcaagccctaaaacccaaaaaaaacttatatgctcttgttcttgttcttcttctcccctcagcatattaaaccctaattaactatctcttttgtttgtatactgttataaacctcctgatcatcttcttgttttcttgcaagattttataaaaaaaaaacaaaacccagctgttcttgttcttgttctttagctccgatccgttttaaattaaaacacagatatg

SEQ ID NO: 28832 - DNA, 3000 bp, Unknown; identical to SEQ ID NO: 718
  misc_feature (1)..( 3000): 2750-1469P.txt file - cDNA_ID_2998950; gDNA_ID_2926224; Annot_ID_142500

SEQ ID NO: 28833 - DNA, 3003 bp, Unknown
  misc_feature (1)..( 3003): 2750-1469P.txt file - cDNA_ID_2998964; gDNA_ID_2926225; Annot_ID_142513
taatgatctattacttgttctcttgtacaacacatttgagaacagaaccgtgaaggctcatcttttttcttcttcttttggttaaggttattgattcctacgttgctgatcagagagttggctacgcagagccagcttcaggagtggagctttacctttgcccaacacgtggggagactctagatttgctaaacaaagtcatctctcaagaacagctcgatgaggtcaagtctttggatattggattggttggagttgttgtgtggagacgagccgtcgttcccaagcccggttccggttcaaaacgtcagcattctttttcttcttctattggttctaaaacctctgttttgcctgtaaacaagaagcagagagtgcatgttacagagaaacctcttgttgttgcatcaatgagaaatcaccatcatggttatgtgaaacatgatactgctgctgatgatgatgtgccgcctggatttggtcctgtggcttcaagagacgaagatgatttaccggaatttaactttaattcctcggttgtgccagtttcttctcctcagccattaccagctcaatctaagtctttggatcaagtaagaaagctcatacacaagtatggaaaatctgcaagcacttatgatgatgatgacgatgaggacgacatacctgaatggcagccacacgtccctagccaccagcttccaccaccgccgcctccacctctcggcttcagacccgaggtatttagaccgcctcaagatggttggtatgataatcaaaacggaggatcagggcaacactatgagcggaaccagtcaagaaacagaggattttaatatctctgttgagtgttctctgtaattgtagttttttggtttcctagtctctctttagtttttcgttttcaaaaaatttgtagccatcgtagaatgcaaatgttcgaagagtcccaacttttcaaataaaacatttcagagtttcctcaagaaaacgaaaatcagtattgctctgcttttaaagacaagtttgattgtggaatcttgctaaaatgtcaaaatcttgtttgaacatcaaatttaatccggaaatcagcaagtaatttcttctatctaggtttcaccatgaatctaaaaggattattgaaaatgaggctaacgagagtaagattttttgatgggccgctcggctcagagttcaagcctgcaggaaaatttgctctaaacggatgaagatttcagtttatttcggtttacaagttaataataaggttataacttataaagattctcctttgtcaaagttactggtactagttttaaaaggatgattacatatacaccataataaacatatcaatatcatattattcataggaaaatccaatccacagatggagctgcaaaataaaaaaaggggtcaaaaaagaccagactaatctaatctgcccaaacaacacaccactcagatttgaacttccaaaactatacattttccaactactcacatatcatcatttctcttagataccatcaacttcattgatacaatacccccattactgtacttattatgggtatgcaaaccaaaacaaaagaaaaagaagaagaagcaaaacttcacaactaaaggattcatgagatcaggccgatacaggtgcattagggataaccgatgatgtggatgcagcgacttcagtagattttgatgttgaaggccctgactcagagatatccccaatatcaagtgtctctggcaggttttcttcagattcagtgctgtatatctatatagaaaaagagtgatcaaaatcatcacttaagatcattacatcaaacaaaaaataaacgtgagtaatgaatatacctcaagctgattcagcatctcaatggttgcttcaagatcaccgccattagcgaggtaaacatcagtgatagactcttgtgagagaccagagaaagtgacaagaaggtattcaatatccatgtctatatccatctccaaatccaaatcatcatccctgatctgcttataagccatttcagaggatttcttcggcattgacacttcaaccgtgggggactttgctgcaaacaccaaaccatcatcaccgccaccataatccactcttttggagattggtacatacgatgctgcatgtggattcaatgcaaatgctcctggcttcattgctttgtcttgctgataaagttactgctaaatttagaagttaattaagagtcagagacagaaaagaaatacaaaacaatgatatattgattagaaccaaacatgtcgtatgcagcaaaatctaacaatctcaaatttggtctaacgaggtatgatgaaacaacctttaatgatttcaacaaaaaaaaataaaaaggatatgaagagacctaactcctaagccaacgtttcgatggcgtaacacagagtatataaggaatctaaaggaaataaattgaagatattaaaataaagaaatgtggttacattagaatctggctcgcgttgttactgcatggaaaaatcgatgtcggaaaatacagaaaacagggcaaaagtaaaagattcttgacaaagaagaaatgatgcgaagaagagtggattatatgcaaaacaaaatgaaaagaaggaataatgtttgttgaccttgtcaacgatcgacgtaaaaggagaagaagaaacgaaacattaggagagaagaaaatgagcttaccaaacaaaaactagcgttgaagatcgctcgaataaattgtagagacagagacctaaatgatgcgattaatgtggcaaacccatgtatttatggaattattatcgtataggttagtgtccgtttacatgaaggacaccaaacatcacgatggggttcgtttggatacccggttatatttatctttaaccgggatactaatatacgtgattgaaattaattcggtttaataaaccgattgataaccaccggtttaaaaagtatcaaaacgaaggagtgaatggatg

SEQ ID NO: 28834 - DNA, 3000 bp, Unknown
  misc_feature (1)..( 3000): 2750-1469P.txt file - cDNA_ID_2998972; gDNA_ID_2926225; Annot_ID_142516
tccaaaacataaggagcatcactcatgtcctgtgcatactcacccaacatccatataagagccgccttggctttcggttcctggatatttttgctgctgatacccccaacaacagaaatgcagtcatggctccattgtggatacttccttagaaggtcctttacaagaacctagaagaggaaccagacaagtggaattgttatgaaaatgtaaacaatataagtatcaatgtgatggccaatcatctccgtgaatagttcaaatgatagtttaccaaagtttcagcggtcacatagtccttttccatctccagaaattgaagaagtctatcaacaatcgcatttacatcatactgttgcaaagcaatctttccaactgctcgaattgactctctcgcaattgcaatatcaacgtttgcagcatactcacacagttccgtcactgaaaagaaaaaagtacgaattagtccaatcaaagagccggaaaagaaaggttttctagcttcagattccatattgacatagtttgaaatcattaccgatttcgtaagtgttgctctcgtttgcaacagcagtcaacatctcaagcttcaactttttgacatatgatggttcattgtactggcagtagaaatgcttatagtctgcagcaaagatgaatggcgcacgaacaaccaaaagatgaaggtggctcaagattgcatacgattgctctggacttccagaactgacaagagttagaagtggggatttaatacgctcatatacctatacaagatcatttggcattagttagacagtgatcatcttaaatgataacaaatcaatgatgactatgattgttaagattagattttaagcttccagactatgtttccaaaagtaatataaataatgcttcactatgtggacaatgcagagactattttacaaatttgttcatgaaattccgcacataactaatttcattaggaataattttcgatgattaaagatagaggaggtggactttaaacctgttgatgaacatcagtcatggagagagttaattgtaaaaacactttgactgttgccaagacaacagctccattggcatgctgcagtctgtcttccaacagattcataatgtcaaaaatatcattactatctgacggcacatattttactgccaactcaagtataagacattgtgcccattcattgaattccttgatcctgcagtgaaacaccacaatggtaaataccactacaacaacaagttatactgatagacagttgaaggaggagcttaagtacataccgattcaagaaataatatataactggcttgctgagcaaggactccttttcccggcatgcttcctcagagtggcttgcttctaaactccaaatttcttgaagtgcagacaggcaattggcaactacctgacaatatattttatatcaaaacattaataattatacaaaacaagtaatatgctagggagtcaagtccaattccatccaacaaaacattatacatacaaaacaaaattaacctgagcatctgaatcatgaagcatcaaacttttcaacgttgcaggaaaatcggcatcaatgcatgttgagggtgagatgtgataaagctttagtactccagtaacagcgatagttctaacatagctattattgtccttgagcccgctccccaagggaccaaccagatactccacaaggtttggcactcgtaaagaacacaagctcctcaatgcaagcccacggatcatagggtcctcatctttgcaatccctttgcagaaaattaatcgtcaaaagagaaagatcaggattgccctttgcatagtttccaacgtaaagataacacatcttcttcaggacaatgtctgatgttgccgagcacatgaccatctctccaaatacagatgagacgtcaatgccaatagtcatgtacgatattactttcttgtagaggtcacgtttggaatcatcaactcctggagctctgcttccagctagctggcgaagctgggttttcagatctgacacttcgcttttcctgataaataacaatttctattttcaattcatgcttcatttgaccaaatagagatcagatattatcgaccatactcactgcatttaggaatcagattctaagtggggaaaattcaaactaaatggcttcttctgattccacattagctttttgacataacttagctcggactggtaaaactaggcactaaaactagatctgctaaatgagagcttctgaatttctggatttcgtataggaataatacagatcataaaattcgagaagtaatgagctgacggaccacgcatgaaaagagatgatcgaatcataaagattgatcccagctaattatctaaaaaatgtaaggtgaattcagtgctattgatcgagagaggatggatagaagcataagttaccctgaaggttgggacggtgacggataacgctgtgaagcggccggaggagccatggttaataagattgcgattcagatatgataaattattacgccgtgagatccaccggagtatgaaccacgatatgtcaccgatcggagagaatcccaccgtgatcagaagcacggggtgataaatttgagagagattttggttcactggtcgaagtctcgtccgtgcttggagaggtggaaggagatgccaacgacccgattttgctatatactccttatactttttgttttctttctaatttacccatttactctctaattagaagatagtggcgaaatgatacaatcgttaaaatagagcgggcaaattgtaatataaggaaagttcatcgtccagattaccaccatcaaaacgtagcgttttgatgtggatattgtttccccgacctcctccgcatccgtaagttcagtcctacatccatggctgctcacagaatctaaagagaactaaaaagctcataagactattacttagaagagaatcgatcagatatg

SEQ ID NO: 28835 - DNA, 3000 bp, Unknown; identical to SEQ ID NO: 28834
  misc_feature (1)..( 3000): 2750-1469P.txt file - cDNA_ID_2998972; gDNA_ID_2926225; Annot_ID_203465

SEQ ID NO: 28836 - DNA, 3000 bp, Unknown
  misc_feature (1)..( 3000): 2750-1469P.txt file - cDNA_ID_2998974; gDNA_ID_2926225; Annot_ID_142520
acaaaataattctcgtttttaatctttaaatcattgtttttttttgtttttctttaattacattttttttggttgcaaaataaactattactacatttagtttgtggtaaagattttttgctgatagtcttagctgagattttacgaatggaaaattttctggaattgcatagtttctttctagttttttccttttttttttttttttctcacaacaccttaagcgtccacgagcagctttaccttacacaaatgacaagtctatgctaatcataaccgaagtgtgtaatatattgatttgtattaatagtcatatcataactaatgttcaaaaccgacattgtatgtgaactagagatgattaacaaaaatatcttattgttagacattaatatatactataagaaattaaactactattttcatatatatacaccgcaaactaactttgataattcgtatttggtgctgcatacataaagaagcatttcaaaattgtttacattatggataataaatcgttaacatgaaattctaagcaaaaatatttaactaaatatagagataattttaaaaatttaagaattaccctttttgtgttgttttcagattaccatactctaaaactttcacaagcatttggtatagaaaaaccaatattttctcctattagttattcttttcaaaacagaacaaaatgtaatatttctagaaaatgctccattattttataggtcaaacatagattgccaaattaaatttggaaaaaaaaatcttttgctgtcatttcttatgagcttatataaatcttaaaattttgaaaagacaaaaaaaaaaaaaacacagataaaacaaggtgttactaattactgttaccactttggacgacctcgtaagtcgtatctatataaacactcgaattttgtgaaataatgaagggagactattagagctcaaacacgacataatatgaaatatgtaccgtttgcaatattattacatcacaaaattccaacagtttcatttgtcgtgtaagcaattaagttttctggtatcattttcagcatttatggtttcgtttttcttatgatcaaaagagtgtcaaatctaacgtaacgatccatataatctcttcggtcgaaaactaaaatatgacaaaagtttaaaactacatcgttactgagttgcaatataaaatacaaagttaagaaattctattgtatatatctaaatacactaaactatctatcaaatagaattattgattcatttcaacttttttgcggtttcagaatattccataaattccactgcaacaaaaacaacatgcaaataattaatttcttctccatggtcgaactcaaattaaaattttgtctacccctctcaaaaacatatatggaccaaccatttattctgtagaaacattaaattaacttattttatccattaaagtatcagttataaagcaaagcatcccaaaactcatcagaaaccggccactaaaaaacaaaggtatatgagacataattggcgtcttgaataatctcttcacagcaaccagtttttacaacaaatcccaagctcaacgaagccatcgacgatccaagtaattggttctctattcttatatcgggtcagaatccatttgccggacccaaccaaccacccccactatgggataggaaggacgtacaaaaacatttagacgataaaaagtggatttcgcatatcaacccaggacgtgttacaattttgatgggttaacttaacctggccgtggatcagtaaaccagccctcgaaccatcaacacctgataagtcaagtaactgagtaagtactttcgaggatacaaatttctttcttggagaagataggagaacgtcctcgtatcaacgaaaaaatatgaagattataatttgccggatttttaaattaatcgaatgctttgcttttcagcaataatctggttttggactaaaatgatcttggattggaaattgtgtggtgaagtaagaagctctaatcttggagctcatcttattgccaagagcgtgacaatggaggatcgccgccaatcgtatgtagcaagcggatttcctttttggctgaaacatctttttgagaaagaaagaagtattgcttagtgtaatattcaacgtggttgatctagaatgattgtccttgatcctaactttttgtatatttggttacaatcttgaatataaaatatatctttcagtgaaaaaaaaaaaaaagagactaaaatgatccattatccaaaattgtaaatcatataaaagtaatttaaaataaagattaaattatactaataaactagaataatcaacataagcttgatatggggactagaccaaacaaacttctatcatcgtaagttcgtaaccacaagtaaccatcatcaatcagatatttaatatatttcatgttacactaagtattaaatcacatattcatcctcttcaacaaaggtcgttgacaaaatcaaaaacaactatacgttgatcatattaataatctctagcattttggttgtttgttattttttattaataacagataaataaataatttcacatttaaccaaaaaaaaatactagcagctaaacaatgagcattgtaaaatctcccaaacaatcaaagagtttttctctatataacattattggtagtgtaaaaaatgtaaaatttatgttagattttcaacaattaaaatgcgaatataaaccctatttttggagtattttaattccctgttttcccggctttttcatggataatcttacaaagactttttaatatcttgatgatgatgatgatgatgatgcttcaggcacgcaactttatgccaagcttacgtggcaaatttggatagccaaaaataaattagaagaccaaattgatataaagaaagagatcttcgtattcaactatttcttcattcgtaaacaaacacacacgaagcaaaaacaaaaatg

SEQ ID NO: 28837 - DNA, 3000 bp, Unknown; identical to SEQ ID NO: 28836
  misc_feature (1)..( 3000): 2750-1469P.txt file - cDNA_ID_2998974; gDNA_ID_2926225; Annot_ID_203469

SEQ ID NO: 28838 - DNA, 3003 bp, Unknown
  misc_feature (1)..( 3003): 2750-1469P.txt file - cDNA_ID_2998976; gDNA_ID_2926225; Annot_ID_142521
acgttttggtatatacatcacaatttgtcaaacccgtaattaattgcgccaaacaagaaaaaatgatcttatggggcaaaagtaaatcacatatatggcagtgggaagaaaaaaggagattatatttttcccctaaaatagactaaagtaacaaacctaaatttctctggaaagaattatatcataaaacctcgaagccgacaaaaactaagaaaaaaaaaaacaatttaccgaagaaagaatattattaaaaaatacaggaacaaggagagagaaatgtgttataaaggataaagcccactaaaggtcattcacttatctaactgtatactattattttcttcgaggcaatatataaaatttacttgatctagtaatttattttcactaaggtttagtattcttatacatttgtataatagttaacacaacttaacgatacttacttctaatatgtatcaacacgtacgtacagagccacgtaaagaaaaaaaacacacacacaatcgctgtcgaacagttaaatcccgaatctagatttgtattagttatctaatcgtattattgttaattccgaaagtagagtcaacatccaattaattgctttatcaaatatcgaatatgcaaaaggtctaaagaaaaacaaagtttttttttgttgttaaactttgcttacatcataggtatcccattaggttggtgtaccatgtgatgattctaccaccgaaaaaacagaagccaatattaaaaaatacatctatatagtacatgtacaataacaataattaaggattattgtattatattttaagaaaaaaactaaatagggttatgtgaaccagactttttttaacacttttactgtggtaaactttggaaagggaaaaaagagtgttagggttaatatatgtatatataattcatttattggggaaatgggctcatctagggtaacatcacctacccatacaattttatcatgcttttagggcttttatttatctcactggtccctcaattcctccactctctcttcccttcgcgtgaacaacacgctccaatgtctccccttcgtatgtgccgacgctccttacctctccgcgccacggacgaaacgtgcccacacgcgaaaagtaaacgccgtgacatccacgcgcctagggttttcttttcatcaggacacaagtgaaaaatgggttgtgataagaaccgcacattgcggccacgtggttaattctcattggtttcttgtgccccatcctatcacacacaaaaacgtctaatacgatttaaataaaaatcgggttctttcctaatataaagaaaaacactgagatcttttacttaatcttgttgtttaatttctggatactgttcccctaagccagctattttctactaatgctcagatttctttcttaactaaacatatgcataaaattttctccttttattcacttttgacagatacagagatacaaagaacagatacagagatgtacaaatacagatacgtgtacacaatagaagtaaaaagatacgtaactttgtttcgtgtaattggaaataggcagaccagatggtgacatggcattgtcatgttccatagatgagttgttctttttttaatataaaattattacaataaattaataaaaagattattttattgaaattaaaacccttatatcgacgcaaagccaaacaaaaaaaaaaccctcatttcaaggataagagagctccactttctctctcctctcctttctccaacagtctctctctacaagccataggaaaaaaaaaaaagtccccctttctctctccctcccctttcgtcttagggtttctcgaaaattcgcagtcaaattctactcatctcccgacgaatccatccttcaagctcatctaatcttcttctccgtagctttctcaatctaccgatatagtttttatcccttgccgcttaagatcgagctcgaatctcgcaaccccttttaatccctaatttctggtcggattaacccaggtgcgttgtttccgacatgaatctcagatgtgtttcgatttaaggtttgagctaaggtttgatcttgttgggttgagatttggtctgacttgtagctgacttcgtgtcttttaagcttcactgttcatttatacgtctatcttcctcggaaactcttgatgttcttactttttttttttttttttttttttggggtttcgtcttcacggactattcacgtgcggatagatctgacccgtattaattggtgggtcttggttaatctttgttaatcacatacggttaatttaagtggtttattatcttttaattttgttctaattttgattttaaaccctaaattacgctgattaataatttgacctttcttgggttttgtaattccgaaattatattgaatctggtccgatcttcttttttcttttgctggtcatgtagataaggttacagctttggggtttctcgtctgtctgaaaaaccctaattttaggtcgtctaagtttaggtttacttacatgttaattgttaaatgtataaaattcacttgcacgattaattttttgttatattagcgtaattgaattgagatgctagtatagaatttcattcttgattttatgtagaccttagggtttaatttttttttatttgccgtgtaattgtgaagtttgatgttggttatgaatgttattttatgtgggatattcatgtgaaatgctttaacactatgttatagattagttatatttattgcttgaataaatttagagttatatttggtgtcgtatatatggaaagttaagatttatgtcttgatatacaacaataatgtgatcattaagcacaattatacgatgtgttatataacttgttttgatgtgttgcttttgtagctctagttgcggagagagtataatggtgtatgaaagttaatcatcactgaggcatagtatctatctccttcaagcaaatcaatg

SEQ ID NO: 28839 - DNA, 3000 bp, Unknown
  misc_feature (1)..( 3000): 2750-1469P.txt file - cDNA_ID_2998980; gDNA_ID_2926225; Annot_ID_142524
tttcttggtcatctcctttttgctcttccttggtctttacgatcttgttatcgtcccattactttcttgggctctaagagaaccctttcgattgggagttatggtgagaatgtgggctgggtatgtaatatcggttttgtgcatctccgctcttgcggctacggagtacgcgaggagaaaaacagcggtaagtatccaatccggattattgttcgattcttgtttggtttttacatttttttttgtaatgtgaagctcatacgtctgttttattttgtttgtgattgattacttcactagagagacgagagtggtaccaagttgtcggcgatgtggctattaccgtacatgatattaggaggcattgcggaagcacttaatacaatagcacagaacgagttcttctactcagaacttcccaaaaccatgtcaagcgtcgccaccacactctccagtctcaacatggccgcagcaagcctcatctcctcctggatcatcaccatcgttgacgttaccacttacgggagctggatcacagagaatatagacgagggacacttggactattactactggctcttggtgggattatctttgctgaatgttttgtattttgtgtggtgtaagaaatcttatggtaaatgtagtatataaatataacaagtgttgagaaaattttataattcataaaatttgattacacttcaaaaatccttttgtttttggactttaaaatttttgaggactactagtctggactaataccacaaggttgaatgaaaccaaagtattctaaagcagaaaataatttgcttttagtttattacgttctgttttaacaatatgttttagttattcctctattgaaggggaattcgtgggtgcatttcttccattattccgctcaaaaaggttttacgttagtgtgttgtgctttggtactatctttttttctttttttgggtgtgtaaattgctactaccttttgttttatacaaatgccacaatcaatgaatgaattaggaagtaaaactatatatcaattggaatgccgctgagaaagattgagacaaatggcttcattcctaacacattcacaacattgcaaaaaagaaaagaaaaaggagccttaaatgttggaacgttaaatgttgtgttcttgacgaatctttgaaaggtttgggaagatcctaaacttcaccaaggaagctgaatgggtttacgcatactacacaaatgctgctccgttccgtacagctaactaaaccaactgatttatgaaagtcaacaggatcggatgttagagtcaattccattgtactatgtcttttggcttcgtcttgctgaaagaaactacacaacacgaacacatctgtcatatgtgtaataaaatagataaaaaaaaatgctggttttatttttcagaaatctaacaattttgtttctattttggttgggaataacaattgtatttttttttttttttttgacaagagtgttacttcatatatgagccattacaaaagtagacaaagccacagtaagcaaaagcctatcaactagtacagaacaagattactaagacaaagcttgacaatcttttgagtatacctttgcctacttcggccagcagtcatgactcttatacttgggaagtagacaacctctcttccgacaattctcaatgaagttaacttggaactacttcaggtcccgtgaagaggaaaaaccttgggttcctacggtttggtttaagaatgctgttccaaaacatgctttcaccttttggattgctaatcttgataggcttcctgttaaatcaaggctccatgattggggaatgcaaatctctcctctttgtggagtttgtaacactgatgtggaatccagagatccctccttcttcactgcaactttgcagaggagatttggtattctatgatgagaagactaggtcaatctccatgtatctttgccgactggtcctctcttatttcttggctgctgtcaacgactcccaatctctcttcaaacttgaagcgaattgctgtacaagcaactatctacttgttatggaaagaaaaaaacataaggtaccatgataatgtctctgttacttctgcgatggtctttacccaattcgacaaaagcatcaaagacatacttctagcaagacgtttccgcctcggctgcacaagtgtactctccctatggtattcccatgcttaacaaactcaactagtttcagtttctctgtaacaattatctcaggcttttttatttggatagttttgataaatattgttgcgtttcatatacaatattgagaattaagaattcactaaaaatcttaattaactatttcacagatatacaattgtaaattcttaattaaaaaatgtttttgataaatgttgttgcgtttcatacgtggcatttaatcattggcttgatgccaacaaacataaaataaaataaaatattcgcttgttctgcagaagaagaccttaaagcacctcgacgattatcttccacaccaaaagtctctctttcatctccagatctgctgctgaagataaattagtcagcaatcgtcatagctatggcgattagggtttttcttacccttctcctcttcttatcatctgcaattctatctttctctctttatgaagatcaagccggcctcactgattggtacttcatcctatttcttctgtctctctggaaaaaataaaattagttgacaaagtttcgaatcttactacttttcgatttcgaagtctaactagagctttcaccaatctgactaatccgaattcgcagtgtatctagaatctgtgatttagtgttcttagatctcattagctagataattgttgtagtgatatctagtggatttgagatgcgatcggggtcaagctatgatttgatgagttctaaggaattaggattgaatcaactagaatctatagaaattagaagtgtttttgattgatg

SEQ ID NO: 28840 - DNA, 3003 bp, Unknown
  misc_feature (1)..( 3003): 2750-1469P.txt file - cDNA_ID_2998988; gDNA_ID_2926225; Annot_ID_142526
attataaaattttctcaacacttgttatatttatatactacatttaccataagatttcttacaccacacaaaatacaaaacattcagcaaagataatcccaccaagagccagtagtaatagtccaagtgtccctcgtctatattctctgtgatccagctcccgtaagtggtaacgtcaacgatggtgatgatccaggaggagatgaggcttgctgcggccatgttgagactggagagtgtggtggcgacgcttgacatggttttgggaagttctgagtagaagaactcgttctgtgctattgtattaagtgcttccgcaatgcctcctaatatcatgtacggtaatagccacatcgccgacaacttggtaccactctcgtctctctagtgaagtaatcaatcacaaacaaaataaaacagacgtatgagcttcacattacaaaaaaaaatgtaaaaaccaaacaagaatcgaacaataatccggattggatacttaccgctgtttttctcctcgcgtactccgtagccgcaagagcggagatgcacaaaaccgatattacatacccagcccacattctcaccataactcccaatcgaaagggttctcttagagcccaagaaagtaatgggacgataacaagatcgtaaagaccaaggaagagcaaaaaggagatgaccaagaaaatgccgtaagagcctggaggaatctcgaaaccctgaatgaaggtgtggcgatccatggtcttagcttgaaggactatgaaggagacttggcaagccgtgacaagtgacaagatgatccctgttgaccaaattggtatgacattgatgagagatttaagatcttctacttgttgcaccctacatagcttccatggattccttgagttccctgttagggctaggtcttgcttcgaattagttgtgacgcaagctttattcaaatacctatattagacaatatttatgcatcaggtttcgttacacaatcatatttttgggaacgaataatcaacaagaagagaaatactattgcaacttgcaactatatataccagcttaaaaaatccagttatagctaaatttgtatttagtaaaatatctttgaccatacaatttgatttacaaagacctatagaataaataatatacctcaatttctggctaggaattgaaaatgaagaccccgtttcgtgatgatacgatataatatgctcttccgatgacaaatcaacgtgtcggtttctgaaaccttacatagtacggagacgccgcgaagaacaaagcgaccgatagagccatggcagcgacagaaactccaaaaccgatctgccaaccatacgttgtctgaacgaagacgagcaaagactgagaaagaaagcatgcgaccatgacggagaagtagtaccagttgaagagcgtttctagggatgatgtggtgacacgtgatgtctgattaggttggagctggtcggcagcgaaggctaagcaggaggatctaacgccgccggcaccaatggcggtgagggcaaaaaaggaatatagaagaacacttttgagcagtgtggtgggttggcacacgtttgttaatttatcgcattctggtcgaattattgttgtcagccataacaaaaccattccctgttactcacaagcaatattaaattaaatacaactaataaagcaaaagttacataaataaaataatagccacggaaaatataggatgattacatattttttgaaaattctacaaatgattattattaatgtatagtataattacatgcatcattagaatatatagttatttgtttttttttatcaatgataatatggactaggacttttgcaacaattgtgttaagacgcaaggttctccagttttcatatataatttcttatctttctccaatttcatttcttgttctgattttgtgaggttatgacatcaaatatgtaccgtaaggctgatggaggatccaaacccgatcagaggaaaccgaccggtgtaagaatcagcgataaaagcaccaacaagagggaagaaattggtggcggcagaccagaggaaaaggatgttggccgcttccgctgttcccatgccgtattccaccgtcaagaagagtatcatgttcggtaccaaaccaaaatatgcaagtttctccaaagcctgacttgctatccaaaaccatttaattaccaagaattaaaaaaaaaatacgtaaatctatctatttttatgaatacggagtttatatcatatataagaatacaagaattgattatacctagaatgaaaggaatggtcggaataccgcgcttcagaagagttcttccgacgagaagagcttcttgatccattttcagtctctttctcttgaaggtttttttactcttggtggttttgataatatatgccttatgttatgacgttgttcccatgtcgcgatcagattagcgatcagaaaaatcattttaacgatatctaattgaaaacaaaagtaagtatcctacctaacctaaacaaggtccatggaaatatttttaaagttttattataaggaataagaaattaaagttttgttctcctttttcgtttgtttgcggcatgaatcttatagaaaagaactaagatatatgctttctccacgaaaatcataattttatttatttatccaacattcataggctcatttacgaataaagacttgagagaacaacgacacaataacagatttcttttcaaaatcatgtttactattttttcgttgaataaaactgtttactaaagactaattatgggtcggataatttattaatgggcctatttaaacttataggcccatgtaaataaagtagaaaacaggctacatcttgagtttgctgctaagactgagactgaagatattttaacttttttaagcacagagtgctgatgatcggtgaagccttattttagaaagcaactgaggacgaaccttatccgtcacagtggcaatg

SEQ ID NO: 28841 - DNA, 3003 bp, Unknown; identical to SEQ ID NO: 28840
  misc_feature (1)..( 3003): 2750-1469P.txt file - cDNA_ID_2998988; gDNA_ID_2926225; Annot_ID_203474

SEQ ID NO: 28842 - DNA, 3000 bp, Unknown
  misc_feature (1)..( 3000): 2750-1469P.txt file - cDNA_ID_2999002; gDNA_ID_2926226; Annot_ID_142534
tacaaatcacaaattatgtttaaatatattaatccaagatctaccacaggtaattccctcgattttttttaatataatacaataagaatatttaaaaataacaaaaagaatatttaatataaatgaagttatctggtagaacgagtttgggttgatattcatacgggacgataatctacgagtgaaatcttagaattaataattataacacaattatacaatcttaaacactaaacaaaagaaacaatatttacaaaacaactataactgaaaattcgaatttttagttacaaaaaaatcgaccaacggtgtaccgcaaagtaaatttcacaatatatcatctagttgatcaaagtctaaacaaaaacaattaatttgtatatatatcaaactaacaaaaatacacagattttccaaatatctatatattattccgcaaactgaaacaaaactaacattcgatttactatgcaaaatacaattgaaatataaataatataaattaataaaacaaattagctattgtatcataaataacattaaacacattataatttatacattccaatattttttattaaaaatgtattccaatacatttcttaaaatatgaaaccccgcacgtatgtgcgggtcagaatctagttatgaattaagatagatacgaacaattaactaatgtgaacactaatctacacatttaaataaatcaatattttgggtgacaagaaaatatgttatatcatatttttcaccagtataatatataaatttttaaaaagaaaggtaatttatattacctcaagaagagccgacaacatgtaccgattcgaaccactaaggaacacaatgaattggtaaaaagctttaaatatttctagaactacatatatttttgatcagaaaactataataatatgaggtttagaagtaagaccaatgatgataaacataatattattttttagttatttgtttaacaaaaatttgtgcctagaaaatttaaataaattaccaacaaagtgtgtacttaaaattaataatccctttattattaaaagggaagtacaaattgaaattttgtctaatttggcctcaattttgatttcaattttggattttgttctttgctattcaaaatcattaagggtaatttggtcttaacaatctcctaaactttatatgatccgattcaatttaaaccgttcaataaaattaattcccttcaatctaaaccgttcaacaaaaataagaaatctatatcgtttttgaaatcaaaatatgatcacaatccatccctaaaaacactatattcaatcatgaagtcaataatcaataatatccaaatcatatattacaattcttcactaatcattagaaatttatatttataagtttaagatatcaaatttattcatatatttagtataagaaccaaataaaccgattgcccgcggtaaaccgcgggttaaaacctagtttattagtattaaaattgtcactatggtttaggatcttgtggcttccttttaacttttaaggtgaccggagagtaggagaaagtgtgtgaggacgagagaaagagattgcttgagctttgggaggatataggagaaggagtagtaagatgatgactcagtgagtttgtaaaatgtgactcgctatatgggatggagttttaaccatagtaaatcaaagaaagtgagtcgaagaatgagtgccttgattgagttcgttgcagggctggctcgagagatcttgaacacgttttacgctatttggattctcgcactctttggagacagattttgatcggaatagtcattgttattctcctatgagattagtgtttggtgtgtcaaatttaaatatgagtatcattatcatatgaaatatgtttttttggtaaagctaaaacgaatcacattaatatttaaggtctcacaattatgttagcacattaattattaaatattgttattaaaatagttggtaggaaatcgatcaaattttttttttcacttataccacagtttcctacgaaattctttaccaatttgttttgtaggaaaagtctcacgaaagttttaaccatttttgcttttcttcaaacaaatttcgtaagaaaattgtaagcacagctctttccttactgtttcctacgattggccattagtaaatgcaatgttttaggacatatcagcaacaacctcgaaaagttttgttccttgtactcagtgatgatataagttgttttgtggtagtagtgaagctattagcttaagtatgcttttaaacacaaatacattacatgattaattacatgtcaaatcttaaaaaaaatttaatgaacttgcactgttacatctcaaaacctccgacacattcacattaattattgtactcaaatgaagtgtgaatattcaatggcctcgtctcgtctccggctactatcaatgggttgagacttgactttaaaattctcaaacgctttaattaatgatattattataagactggcctaatattttgaccaaacttaatatataatgactcaaataattcctagttggtcttaaacaatcaatactttgttgtccgaaaatcgttaaaccaataattcaactaccattttaataggtgaagtagttctctttttgttgctaattgaatggaatggtatctatttgattactatatatatataaaccacataatgccactttgtgactaataagcaataataatttaggcattaaaaataacaactagcaataatcatcacgcgataagatttaactattgatatcttaaagaaattttagttgtatggtgtgctgagtagatgatgaagccacttcaacaactggttgtaaaatatattttcaagaacttcatatacgcacttcgatagagatcacaacaattcataaaccaaaaaaaaagacaagaaaaacaacacaaaaacaagacatcaaaagcttcgcctaaggagccatg

SEQ ID NO: 28843 - DNA, 3003 bp, Unknown
  misc_feature (1)..( 3003): 2750-1469P.txt file - cDNA_ID_2999032; gDNA_ID_2926226; Annot_ID_142547
agtagtagagcttttagggctatggctaagcctgttgttggtgttgacaaataccttctcaaacaaggcatcgtcgacgttgaataccaaaggttcgatgcttgaaacacttgacttattggtttttttatagtcacttgatgtactaataagaaggtttgggaaatgaaaaacagagttccttgcaattacggtaaaaggaatttgaacgtgagagtggaagaagcaagcaaaaagccaaattacttggcgataaagctattgtaccaaggaggtcaaaccgaagtggtaggtatcgacattgctccagtaggttcgtcacaatggagttacatgagtagaagccacggagccgtttgggcgaccgataaagtaccaacgggagctctacagttcaagttcacggtgacaggcggctacgatggcaaaacggtttggtcaaagagggttcttccggcgaattggaactctgggaggatttatgatgccggcgttcagatcaccgacattgctcaagaaggttgtgatacatgcggtcacatatggaactgactcattacaattctccttatttaggcaaacaacaaacaaacaccctttataggatatatacatgtatgtgtaacagagttcattatttaatgagttgaagaattcacaacaggagtggcttatataatctggattaaacaaaagaactagagagtaaaggtcatgctaaaagctagagtccatgtcaccaaaaaaaacaagaaaaacaaaaaatgtcacttatcattgcaagcaagaatccgacaagaaaaaaaaaacatatcttagagatgtctaacaattggaaaacaataatgtatggaaaggtttaagataggtcaaagaagaaactgttgtgtctttatataaattagtaaggaaacatagtcaaaaaggtttcgtggtgtagttggttatcacgtcagtctaacacactgaaggtctccggttcgaacccgggcgaagccatttattaattttgatttttttttgataaatttccggttcaaatatgcgttgaacgtagagatttgattgaatctgaaatctaaaaatcgcaggcttaagttagtacttgaatcattgttatattcgcagttatcttgagattttcgtactgtacatttcaatattttatccatcttgatacatttacatatgttgtgatttataattagctagaaaatcccctcacaaataactatttaactaaatggaaatcaatcaaagataatgtctcattctcatctataaagtcttaagcatctcttcagtgaaatttctaaagttaaagctggtgatatatacatctatcctataggtttcaagttttttagtatgtcaagcaatgcaaccgctgcaatataagtgcaactattttgaaaataaaacatttctaatgtcatttgaagtggcttgaatgaacccaactacacgatggactcacttaaacaatactcacctcactggactcctttaaagcccgcaccactaaaaaaaatatactcttcttgttactagacattagcctataccaaatcccattagccttaattttcgatatgcatcattaataaaagtcagtggttgataaagaaatcttacacacaaaaaaaacttatatattgtatatcccgacaatgaaaaaaaagagatatagaggggagtattatgaagatatcttcacatgtagtaatcaatgccgtatgagtcgttctcacatggatgttttaaggtaccaatctttgaatattttgaagatttcaataactcaaaatcaacaaaatctaacatacaaacttttgacatgtccgaattaatactaacacatgtatcgatagagtttagtgataaatcacttagccctaatgctctacatctaattattaaatgtgtagactttcatttttataagctggtttgttagtggaaatgagttgttatgaactaaatcctagctaatccctagggaaaaaaaacttgggtagatttttcattttaattaacgaacgatacaaagacgtgtgtagagtctatagacgaagtgatgaaaagggtttaggcaaaaagagaaagatagaaagaaagtgaaattggttttggaatttgttcttatctttcccctacttcccaaagcaatcccgtttttcaggtttgtctctattattaaaattcattcttaacttgatatggtaagacgtgtttatagatacacttactgattttataataaaaatgcaaggatttttgaaatctgttaaaatcaaatctttatcaaaatgtaataaaatcaataaacgaggaataccatatttcaaaagtattaagcgaataaaaacacgattttatttttaaaaactttggtatcaacgttatgataacacatgattatgtttagatttttaaatcaattaaaatccgataactctcactaatatttttcttttatatgttttagttggcacaaattaaaaaaaaaatctatcccaaattttttaaatatatgtattattattggttaggttttaaaaaagaacaaatatgggttatttcgtttattaattagtttcgacactctaacaaatgttttgtcccttacctaaagagaagaccgtcatgaacaaagcaaagaaaagagtcggtgtaacgccacatcatcccatgactcatattggtaaaactatcttctctctttcacacttcttctttttactttggactaatgatttaatcaaagatgtcattttaacatatatgtataaaacgcgtaattgggaagatacacacacacacataccagctatgacgtgacagtgtgtgttagatattgagatgatgagctggcatcaacctctctatagtctctatataatccattctttgtcctctcttctctttacatgtaaattcacatatctctctctcttatttgatcataaagatattattgcttcttcaagtaaacaaaaaatg

SEQ ID NO: 28844 - DNA, 3003 bp, Unknown; identical to SEQ ID NO: 28843
  misc_feature (1)..( 3003): 2750-1469P.txt file - cDNA_ID_2999032; gDNA_ID_2926226; Annot_ID_203509

SEQ ID NO: 28845 - DNA, 3000 bp, Unknown
  misc_feature (1)..( 3000): 2750-1469P.txt file - cDNA_ID_2999036; gDNA_ID_2926226; Annot_ID_142551
agcttgcgaaacatgctgtttctgaaggaactaaggcggtgactaagtttactagctcttgaattgtggatcttgttgaaatcgatgtttgtaaaattagggttttttagatttgatggttgttgttgactctttgatcgatttctgtttcgttttcttgttgcgatgttaatcaaatcggatccgatttctttcttaaatcaaatctatcaagtaaaatcttttgctgaaacgtctgctaaattatctcttcttcactgcaaatgaatcggttgttgaattagcctctcgcagcatttaaaaacgtcgtcgtttcgttgggtatctgtgtttcttctgaaaacggcgtcgtccgctcgagcatttaacctagaaaagctttatttttgagtcatttccgaaatccgtttggattactgttaaagatggctaagagaatctcagctcaactcttcgtaagcagtacgagaatggtttcttctttctgattttagtctcttgctctttttacttgctctggtttctgaaattgttctcttgcagggttatctgcttataccacagatcaatctctgaggcaattgttctctccttttggtcaaatcaaagaaggtaaaaacctgaaattgaatttgtttaaggctcggttatgaactaaatttgtgtttgtggggttgtttagctcggcttattagagattcagaaacacagagacctaaaggattcggctttatcaccttcgattctgaagatgatgcacgaaaggcattgaaaagcttagatgggaaggtgagtaaaaaaatacaattgaatttctccattaacaacacttcaataggtttctagctttcttgtttaatgtacgctaataagagattagcttaagaaatttgttctgtaatgaatcattaacatatccataagttccatagggctctaaattcattgtagaaatgccaattagggtctgaagctatatcgattttgttcctctcattgtgactaataacgttgttttgcttctttagaaatgtattgaagttgtattgggttattttgtttgtgtcagattgtagatggtagactaatatttgttgaagtagccaagaacgcagaggaagtgagagcgggtattaacagtaataaagccgaggaccgcgggtaattcaggcatctcacactcactgttgtcatcatgtagatttgtctacaaaattgatctaagatcatgagttccatgttacaaactctaaagctgtatgcaatttgtagtctagtgactagactctagtctagtttgtagaaaaatctttgacactgtctgtactcttgagctgattctgggcctcttttcttaaaataacattattgggcctattgagttaacgggcttcaatgttatatgcggccaggctctagagtcacatgccggtaggaaacctgtcgcacaaagcaaactcctaactctccacgtgtctataaacgattggttgtaaccagcgtcactcagctggttcccatcaccgctataatcaaagtttcagcggaaaattggagctaaaagagccccattgattcatgtacctttcatttagtttcgatatttcaaaagataattagcatgttcttttagttcacgctgcggcagcggtagcaacggtaacgtctgagtaaaacgacgtattatgaaaaataacaatttaaaacgacaccaaaacttgaaaataacagatttagatgattcgctgatgacggacgatgagtcgcaacagcatcaaatgagtcgctcaaatttaacagcggcaccttaatcttcatcgatgttcatcggctgtgacagtttttctcattttcttctttctgcataattgattttcttcttttctcccgttgccgctgcgttaaacaaaagatcgtggctaataaatatattcgacgccaatcttagtggcatttctttttctatgtaggaaaagaatagtattatttccctttttctttgttacattaaggacataccaactagaatattaaaaatttgaaaccgatacatgaggtaccaagttcattcaagatactcctatatgttaataaattatgaagagtggccatcttcttaaatcgtttagacaacaatatttttgaaaacggtcaattaaagaagaacccaaaaccttgcgaactattttataatgtagtttatggtcaactgcaaagtctgcaatgcataattatgcagtagattatgatttagaacaaaataacaataattactaccttttgacccaaaaaaaattaacaataattttatattttaattttgtacatttttgagtgatttgctttttgaacttgtgatgttaaaaatatattataaaatagatatgtgttttaccatttatttaatcagtatttgaatttttttcctatcatcgtttttcataaatcttagttatcttttttttggagacgccgaacttattgtgaaaatgaagtatattttttgtagttgttgtggtgttacacatcaatattttttacttcttaaaagttgaatcaagttctcaaaccaacaaactttttatcgaatcaatggtacgacgaaattcaaaaatgttattacttactaattttatagatagtttaaaaatataaattaaaaattcagtttatttatataacaagaaaaatcagtgttattattgaaacacctaccaaaataatgaatcaaaaacataaaattaattatagtattgaattcataattcaacaatattattgaaaatttgaaatacataccaaataataatagttttttttcgtctctataatatggtggactcccgaataaagttgaagaaagaaagagaaaagaaattgagaagaaaaaagaaaaaaaggtgaccgtattctccgtcgattgtagccgcccgaagaaatatcttctcctctctcgtttaaccacgaatttgctctgatattagtgtttctctagccatg

SEQ ID NO: 28846 - DNA, 3000 bp, Unknown; identical to SEQ ID NO: 28845
  misc_feature (1)..( 3000): 2750-1469P.txt file - cDNA_ID_2999036; gDNA_ID_2926226; Annot_ID_203513

SEQ ID NO: 28847 - DNA, 1723 bp, Unknown
  misc_feature (1)..( 1723): 2750-1469P.txt file - cDNA_ID_2999039; gDNA_ID_2926226; Annot_ID_142552
atcataacctgcctctttcctctcttctctgcattgtacatactcttaagaccatcattgagcacactgattctcaccattcttcaaaatttcaaaaactgcaaaaacataaatcaacagcttcacgaatcttattgacatgtacataaaaacatctacagagggaacgaattcgattccctaaaaattacacactctgaaaatgacattggaatctagattctctggagaaacatcaaattggggagattaactaagccggtgttccaacaaaacaataaagcagttcatcggattagaggagagatggagattccggcgattactaacctgaaacctaagtagtagccgccgctccgacgtctcttgctcgcttggccttgaaaaagagattaaacagaagacggaactatttttagggttttcgcttttatcgctttcacgggacagattcatgtataactaagcccattataaatacataactaggcccattattgatacataattaggcccatttgtaaccaaacatggactttgtatcaacattgatggcattctcttaactgattcacgtctaggactaacagattattatttaggtattaagcccattttagcccgttaaaagataaaactcgaaattaattttgattcgctgcttaatggcccatttaaaaaggtgagagatgcttagccgttcactgccaacgacggatttattctaatctaacggtacgtaatatattccacgtcatcaatcctcgtgaaacgagaattaaccaatctgtatctaattcatggtcatatatatacatgagctaccgaatcgtctaaacaacaaacacaaaacttgatctcacgactccatcttctaaaattcagaatctttctttgaaacttttttcgtgtgaagaaaatggcaccaaaggcagagaagaagccggcagagaagaaaccagtagaggagaaatcaaaagccgagaaagctcctgcagagaagaaaccaaaagccggcaagaaactcccgaaggaagccggtgccggcggcgataagaagaagaagatgaagaagaagagtgttgagacgtacaagatctacatcttcaaggttctgaaacaagttcatccagatattggtatttcaagcaaagctatggggattatgaacagtttcatcaacgacatctttgagaaattggcatcggaatcgtcgaagctcgcgaggtataataagaagccgacgattacttctcgggagattcagactgctgttagacttgttcttcctggtgagcttgcgaaacatgctgtttctgaaggaactaaggcggtgactaagtttactagctcttgaattgtggatcttgttgaaatcgatgtttgtaaaattagggttttttagatttgatggttgttgttgactctttgatcgatttctgtttcgttttcttgttgcgatgttaatcaaatcggatccgatttctttcttaaatcaaatctatcaagtaaaatcttttgctgaaacgtctgctaaattatctcttcttcactgcaaatgaatcggttgttgaattagcctctcgcagcatttaaaaacgtcgtcgtttcgttgggtatctgtgtttcttctgaaaacggcgtcgtccgctcgagcatttaacctagaaaagctttatttttgagtcatttccgaaatccgtttggattactgttaaagatg

SEQ ID NO: 28848 - DNA, 2360 bp, Unknown
  misc_feature (1)..( 2360): 2750-1469P.txt file - cDNA_ID_2999044; gDNA_ID_2926227; Annot_ID_142555
gaattcttcaatgagcttaatccgattgtcaatactaatagcagataaacatgacatatatcaggagatgagagaatcatgcgtacagattcacacaaggttttttttaacaagaaagaatatacagatatacagatagagaagagaaaagaagaaagaagaccttgagggagtatcgacgatggtgataggtatatagtcagggaaagcgtcggcagggagagtaatcggaggaaggacgcgagggacattatccgggaaagtctcggaggcgacggcagagatcaggctggatttaccggttcctttgtcgccagcgacggcgactctaaggcttgtacggcctccggcggaggactttccaccgagcatcatcggagagatttagagaggaaggaaattggcggttattgtttcggagatgagattgatcgatctaccaacgatgtaacttgccggccgaggatggatgctccatatatctaaccgggttgacccgacacgtgatccgcaaagctcttattattactgtagtatctctatcttcgccatcacggatttctcataattgggccttcctattttcagtttctagaacccaccacaagtgattatgtagctcagtagcttttcattctacgccgtcgtttttagttttagaattttaatagatgaatgacaattttccttaccatttttaaaaaaatcagttttctcattatgctaatatgatcttttattgccatttatctccatattttatattgatagattacacactggcttgtagatattgaggaacataaataattaagcagagcataaacaatggagctcaatttggcctgtgttactaaactggtaacttcatttaaacttccttcaacgactttgtttattctttgcgcttgggaattagccagccaaatttatgtttccttattattttttaaattttcgttttcttttcatctttcttgtggtcaataatttactttttattctttacacacaatattatttatatattttcttataattaccacataaattaaacaagtgccaatcagtatataacattctatagaaaatgatttactgttacaggttagaaacttttaataataagatcgaatattaaactgatacgaccaacaacaactaacacgaaatgactcataaaagaagaattttttttaatcaagatttatttattaccaacaaaacccaagacaaacaagaaaataaaaaccaattacatcgtatctctcattgattttattatccttgtcgggattttatttgaaaggggggataaattaaaaaaggacatcatcaaagcagtacgtaaaagtccgaacgatattacaaaaagaaacacaagatttgctaataaaatgagcttcaacacacgtgtctcccgcagaggctttgttaaattctcactcaccatattcaggcgcccgacgggggagggacggtggcatcgtcggaatcggatttgtccttggaggagctcagcttcttgaacaatggcttaaacacgagctctatcgccagccatcccaccgccaacactcccacaacaaccgtcgctgtctgtttcttgcctgttggtttctccaattttgggaaattgacttctcctcctgacttctccaccattgctgctgcttcttcttcttccttatttttcttcttcacttacacaccgtttgtcttcagactgaattatcttcaactactttaaaagaaactaaaaacagcgatacatttcaaaatatctcgactggtcacgttatagaccgtcgatggaataattgacggtcaaattttggtgagaacctttcctaaatttgggcctaatatgggctgaattgggtttcttactagaaaacaaatcttggtgtcgtgaataagacaagtttggatgattccttctaatatctaaatgaatctcaatcgaccaaggaagataagacgcaaatatagtggacctctcatcatgacacacacatcctttaattggattttgattaaaatattctattcattcatctccccaatatttttccagaaaaaaaaaagcaacgggggcctttctataaaatgagcaaaagaaagcccaaatagatcctgtccggaatagtaaaacgaggaaagcccaaacatagcatgtccggaagaatcgaggtcacgtgcaatacacgtgtcaattaaagcaggagttattgtcgctgaatcatatcaatggcgtgtgaagtgtttatcaatatgcctaggaagaagaaagagtgtaacaaacaaacaaaaaagttagtgaactactaaacaacactcacaccaaaaagacgacgatg

SEQ ID NO: 28849 - DNA, 2360 bp, Unknown; identical to SEQ ID NO: 28848
  misc_feature (1)..( 2360): 2750-1469P.txt file - cDNA_ID_2999044; gDNA_ID_2926227; Annot_ID_203535

SEQ ID NO: 28850 - DNA, 3003 bp, Unknown
  misc_feature (1)..( 3003): 2750-1469P.txt file - cDNA_ID_2999044; gDNA_ID_2926259; Annot_ID_204687
cctgcggaggcggggtttcaaacattgtttttcttgatcaaacaagggaaatgttggatgaaggaccgcttttgatgcaaaatagaaaacatcagggacctgaaagaaaagaatccagatattttagtggcatacaataaggatcactctaggcatggttcagttttgcttggtctttcagcattatctgttctaaaggttcctagtatctatacggaacattttctctcttagccaaaagataatctttaaactgtagcagaagatatttcggtcagagaacaaaagcaagaagatacctgtataagggtcaatgcagaacactcaatgcaggtttctatctctcggtactccttcatgattggtgacataatatcctctagtctggcgggagatcgttcatcacgtaaatcaagcttgcagcccaccacaatcacaggtgctttgatctagatacattacatacatatataattataacttgaaaacatacttgtaggagaatgcgaagatacgatatttcagcaataaataaataagaaacctctaaacgccggagctcagggagccaataagaactcaagcgatcaagagttgaaggctgatcacaagcataagtgagaaggaccacatcagccttcctgaattcttcaatgagcttaatccgattgtcaatactaatagcagataaacatgacatatatcaggagatgagagaatcatgcgtacagattcacacaaggttttttttaacaagaaagaatatacagatatacagatagagaagagaaaagaagaaagaagaccttgagggagtatcgacgatggtgataggtatatagtcagggaaagcgtcggcagggagagtaatcggaggaaggacgcgagggacattatccgggaaagtctcggaggcgacggcagagatcaggctggatttaccggttcctttgtcgccagcgacggcgactctaaggcttgtacggcctccggcggaggactttccaccgagcatcatcggagagatttagagaggaaggaaattggcggttattgtttcggagatgagattgatcgatctaccaacgatgtaacttgccggccgaggatggatgctccatatatctaaccgggttgacccgacacgtgatccgcaaagctcttattattactgtagtatctctatcttcgccatcacggatttctcataattgggccttcctattttcagtttctagaacccaccacaagtgattatgtagctcagtagcttttcattctacgccgtcgtttttagttttagaattttaatagatgaatgacaattttccttaccatttttaaaaaaatcagttttctcattatgctaatatgatcttttattgccatttatctccatattttatattgatagattacacactggcttgtagatattgaggaacataaataattaagcagagcataaacaatggagctcaatttggcctgtgttactaaactggtaacttcatttaaacttccttcaacgactttgtttattctttgcgcttgggaattagccagccaaatttatgtttccttattattttttaaattttcgttttcttttcatctttcttgtggtcaataatttactttttattctttacacacaatattatttatatattttcttataattaccacataaattaaacaagtgccaatcagtatataacattctatagaaaatgatttactgttacaggttagaaacttttaataataagatcgaatattaaactgatacgaccaacaacaactaacacgaaatgactcataaaagaagaattttttttaatcaagatttatttattaccaacaaaacccaagacaaacaagaaaataaaaaccaattacatcgtatctctcattgattttattatccttgtcgggattttatttgaaaggggggataaattaaaaaaggacatcatcaaagcagtacgtaaaagtccgaacgatattacaaaaagaaacacaagatttgctaataaaatgagcttcaacacacgtgtctcccgcagaggctttgttaaattctcactcaccatattcaggcgcccgacgggggagggacggtggcatcgtcggaatcggatttgtccttggaggagctcagcttcttgaacaatggcttaaacacgagctctatcgccagccatcccaccgccaacactcccacaacaaccgtcgctgtctgtttcttgcctgttggtttctccaattttgggaaattgacttctcctcctgacttctccaccattgctgctgcttcttcttcttccttatttttcttcttcacttacacaccgtttgtcttcagactgaattatcttcaactactttaaaagaaactaaaaacagcgatacatttcaaaatatctcgactggtcacgttatagaccgtcgatggaataattgacggtcaaattttggtgagaacctttcctaaatttgggcctaatatgggctgaattgggtttcttactagaaaacaaatcttggtgtcgtgaataagacaagtttggatgattccttctaatatctaaatgaatctcaatcgaccaaggaagataagacgcaaatatagtggacctctcatcatgacacacacatcctttaattggattttgattaaaatattctattcattcatctccccaatatttttccagaaaaaaaaaagcaacgggggcctttctataaaatgagcaaaagaaagcccaaatagatcctgtccggaatagtaaaacgaggaaagcccaaacatagcatgtccggaagaatcgaggtcacgtgcaatacacgtgtcaattaaagcaggagttattgtcgctgaatcatatcaatggcgtgtgaagtgtttatcaatatgcctaggaagaagaaagagtgtaacaaacaaacaaaaaagttagtgaactactaaacaacactcacaccaaaaagacgacgatg

SEQ ID NO: 28851 - DNA, 3000 bp, Unknown
  misc_feature (1)..( 3000): 2750-1469P.txt file - cDNA_ID_2999046; gDNA_ID_2926227; Annot_ID_142556
tgttgatacgacaaaaaagcgagagagagaattatttgatggttaagtgtggctgactaaactttgatttgattggtaatgacagaaactaattgatgtatacatgaagaagatagaggagctctacaaacagaaagaaaaggtaacagttttgtgtcaatgtttctagtctacttttgtatctgatccatcttgtggattgattagccattaattactacacacatatatgaatccacaggaattgatgaaggtgtgaccataatggttgttaggggaggagacgtaattcaacaatctggtaaaatcccgcaatttccaatgccttcgtttcttttactatttgccctgatgtttccttggggtacaagcatgtcttttgggaattgagagcaactttgtttaaattttcggttgcaaaatttttagaagaagcctctgatattttgtttcttttattaaaggatccctctttgtacagcaaaactcttgttaattttggttcatcaccccaattatcaaatcttatttttggcttattgtgtttggaactgaaaatttaaaagtacgtattacaatattagattaagatattctttgtattataatctgataaaataggttattggagccacttcaaatgcgtttatcttattataatcacacctcgccgcattgagaaatccgtcaaacccaaaatatgtttgtctatgtttgcaaagcatcgaaagttgggatcagtgggttaaaattgattaaaaatacaaatcatcgaattattttaattgtctattaaactgtatagtacacgtttttccctccgtagctggcgaatttgacttctctgaacctacaaaaattttataatgataaaaattctatttttttcatctttaaaacgctattacttcatacaggtttaattttctaaacataaatcgctacttcattcaacttatccttccaaatctttcaaattgagaaaaaaatgtgacaatttcacgttttatctatatagcaaacggatgcggatctcgatttaaaaactaaaaagtcccaaaatgacaattagtttattcgtggttgttacttgtaacttgtaacttgtaagacatgcatgcatcaatattcaatagtggtgtgttatttaatactccatatagatatttagtctctactaatattctaaagtgttgttattattattaattaagtgatcccataaaccgagggttaacccatgatgattattttaattagtaggcttcatgggagagtatattttaatttgtctagtcacaataagaaaacattttatgtcactaattattatactggtaatctttatacaaaaaagcatcgatatactactgactattctagtactatatgacaagtggctgagatgttggattccttacatcggaactccaactaaactttcgttaatttgtgcttcaaagtttcattacaataaggtttttatttatttattgatttgtgtttatataatataggatagggtcaaaaacattataaaagcactttaaaaatagtctatgaagattattgtacttactttggttctcccttcatttaactgcataaaacaccgttcgtcagtcaacacttcaaagataaattaactcatactagttgatatatacatataccatcatgtagctttagtcactagtcgaatattttagttaatcttgatatgtttgtttcattcgcattatcttcgtcaattattttattcattcatattttttataaaatagtttaatcttggtacataatttaagttaaagctcgctttgataggattttaagtcgtttgaacccagtcatacacaaaagtggaatacaaaataagaaaaatggttaagtagttcatgacgttatattggtgtgcccaacggtaatctgatgatgatgagccatgatcccatgagagagcgaatcaccgtggatctgtagcttattcgacacgtggcactatgaatggtgaaaagagtgagcctcgcgagtgtacgtattctctatactcgccgtgtgcccgtggcgcagtgacaagttagtcatccaaatatactaacataatttgtacttttactaaatgatcactcttccaaattttttgtttactagtatttaataacatgttttgacaataatatcgttgtaaatcagctttatttttgtttttatataaatttgagtgcagttgttttcaaattgcatatcagttataaaaagacactgtaaaataagcagtcccaaaattttcagtgacaatggtacgtgggtgtcgttcccacgcatatagaccgcgcgtggttagtagtacaacttgctaacattcatataaaattacaaaaaattgttcttttaaaatgtgcactctttttttatatattagatttgttcatacggtcatggagtgaaataatattaaaaatacagcaatgaacatattatattcatatgtttttgggtgggcacaagaaatcaataattattatatatgatagacttgtattaaaaaaaatgtagtcatagaatatatgaataagataataattatagtatgtgatattaaaaaaagggaaacagataataataatatatgtgactaaacattgagcagtggctttattccataagaaagtgacgtttctgccatgctggcatttcgagatcgcagccgtccaaatcacggtaagatccaacggctaacattaagacattctggtcatttgaagatcttgaaccgtcgtctctcttacatccttttttccaggggtaggttttttctgtgcacaaaacatttgaggagaaggagacgacgagagctctgaaactgaaatacagagaaggaagcttcaaaactttgaaggagtggaatctgattttactcagttgatgggagcttagtctttctagcttgcattaatggataaacccagggaagctcgaagatcaacgacaaacatg

SEQ ID NO: 28852 - DNA, 3000 bp, Unknown
  misc_feature (1)..( 3000): 2750-1469P.txt file - cDNA_ID_2999050; gDNA_ID_2926227; Annot_ID_142557
ttgatccaagggaatagcaaatacagtactagtattaaaaaaaatggttagagaagctgctagctagcaagtcagtgataaataagtaaagactatcattcattaaccattattaattcctcaactaaagtcattagaaaaaaagaaaggctaattaattaactcgaagatgctggctggggttaaaaaattaacccaggggtttggttacaaacttcttacatcacggacggggagggttataataataaaggaaacttaacggccgtcagcgagagggttaacggcagattccttgcaaggacttggaggtagacttgactttcctgacgcaacaagacgttgcacgaaaccctctattctttctccgttactctccgttagtatccgttttaccccaaacggcgccgtttccacacctctctctttcagcaactcctccgctccgccgctcgtcaaaccgttcgcctgcatgcatccaccacattttaatatattcgagacattttgatcggtgatctctgtggtgacgagaaaagttgagaatacgtacctggattctaacgtaatcagtacggttccagcagaaagcgttccccagcatctgatcgacggtatcggaaacgccgtcaaccactatgtccaccacacttgacgttgaatagtctccgttacgacggagtttcctccctggtgatgatgacatggtcgacggaccgtttcccaacgacagtacaagcaagtcatctacgccgtttactgacgggaaatctcgtttgttgtgtagcacgtgcgtgacggcagctgctgttggattgttcatcaccaaaccgccgtctacggctgagcatgaggttttcccgtccaccgacactacactgaacggcttgaagaggcttggtgttgctgacgtggcacggcagactttccacagctcgaagtcgaagctcggagactcagacgcgccggcgcgtgagaaaacgaaaggagcagaggttttgaggtcgtagcaaggaacaaggagaggcttacacgtgtccttcatcgtcaacaccttaccgtcctctctcctaaacgccgtctccaaaaccctctccatgctcttccccgagtatctcttgttcctcctgaaaactccggtgtacctgatctcgaagagctccgagttcttctccgcgacaaacttaaccgcgtctctggcagtgaacatcggcctgccggagccgtcgtcggcgacaaggagggcggcgagaatgcctccgatgccagttccggcgacaatgtcgaagaaatcagagatgtgagcgtgagggtcgccggtttgaaggcggatctggtgctcgaggtggagaatagaagcagcggcgacaatgccagtggtaccgccaccgtcgatgctaaggatacgagtcttccgggaggagtcgcagtgagagagccatttctgttcaagctttgtgaaaatgtcaagagtaaccttgctgagatccatctccataagaaaagaacaaaattatacacaactagggaaggataaaggcaaaaacaaacaacgtaaagagtatatcacggtttggagcagagaggctttaattgggggaatgcgcgcgctctctctctctctctcacagtgacgataacgagtaaatacagaggagagactatgcgtttgagtcgtctctctccaagagtgagtggatttgaacaaggaagaagaaagggtttatgagtgattcagagataattccggaatggtgagtgggtggtggtagttatatactcccactgacgacgatgcactgttttgttttctttttctatttatttcccatcgtttacatattttacaatgatattagtatttgttttttcttcttcttttaaatggtgtaatttctctgaagaaaattacaaatataattaacacaaattgaaaaagggcatactataatttttggtaacaaattattatctcacaaataactaaatctcgtcaagtcaatttttattttttaattagccgatgtgaataatcctttttttttgacatatttttttcttttgtttgggcagctaatatttgttgcttgataaaaaaaattatatgttctactaaacaaaaaatgcgacacgagatagttttcttattttttttcccaaacttgtatattatacatgtataattaatctatttttaaaagccttaaactattgctagacacataaatataagtaattcacgaattaaaagaacataaatcaaagtatacttgacaggaaaaaaaatcaaagtataatcagaattttactaaacaaaaaaacattgatggggtggtaggactgttctcgcacgtgtgagtaggcatgtcagtatgaaggtcaaggagtaagcgcgaacctcggctgccttaccggctcggctcccgctaatcacattgttgcctcttcttactaatctactagtatctttttatttaatgctaattaactcttctttatatatctcctatccatcataaatgaaggacgtggaatcgacgacgaaccggcaaaagtatataaatagtttatgaatgatgatatcaatgcaccatttcatttaatatatatttttgaataccctttgacaatttaccctttgatttggaccatgacataaatatgttagaatttaaaccttttagttttacttttcttctggtacaaatcagaccattgatcaccgtaccttcttcgacccaatacaaattttgttggctcaaacccatttcaatatgggctaccatgtaaatagcaaatgggatattacggcccattaaggcccacagaaaagatatatctgaagggattatagttagctgtccatccaaacagagcaagctttccttcttatcccgaacaattcggtctgcttcgtctccctccctttcaattttcgtagacgaaccaacgaaaggtcttttctagtctagtcacttcacttctacggctactgccatg

SEQ ID NO: 28853 - DNA, 3000 bp, Unknown
  misc_feature (1)..( 3000): 2750-1469P.txt file - cDNA_ID_2999054; gDNA_ID_2926227; Annot_ID_142559
ggtcgttgaggacgtgctttacgtgatgagccatgggctggtgttcaagcaagaaggtgacacgtggaagatggttgcatcggcctcagagtttaagcggaggatcggaatggcgatgacgagtttgagtgatgaggttttgatcgtaggaggagtgatcggacctgataggctcaattgggacatcaagcccttgtcagatgtcgacgctttgacagttgggaatgatcgtccggcctggaggagtgtggcgccgatgacaaggtgtcgtgggacgatccttggctgcacgcagttgacaatctgatggatgggaatgtggcttcattatgacgtctttcagttcttttttgttttgtattttcttcctgtttgttaactgttgtgagcattattgtttttaaatcttctttgagaaatgaaaataaacgaatagcagctatgtcttgagaaaatgtcatcaaagcctggttattgtctataaacgaatagcagatttatgtcttgagaaaatatcatttatgagtctggtgaaaaaaaaaaaaaaaaaataggtctattgattgggctatatgtgggaatgatatcaggttgggtttggacaggttgcataagttattttgtgttgggccttaaacaatctgaaagagcaatatgggtttgaacatggagatatttggtcattgaacagaaaaacaaaattgtggtattcaagctctaaggagtattttgtagtgtataagagtaatgattcggatttaagacatgttgacaaagaagcaatgatttaagaaaatggacctctcattatcttgctcatttgctttctttatctttggtaattagggtgatatgactatatccttgataaacacaatatatcggtgccactttcgaattaataataaccatgattaaagatggcgagtcatcaaagaaatcatgaaatggaaagaaatataaaaatttcagtatcgaatcaaatgaatgattagtgctgattccactccaattatattttataacctctacgtcaggtggtttagaaggaaatcaatctatcaagagtcacgtctatggattgggagtcaaaacatatacgtatgcttctggtagtagtcgtagtgattaagggatcaaagttgttagactgaatgggttacaaacacaattacggaatcgatggacacactcattacattaaaaagaaatagcacattcaatggcatatatggatgagtagtcgctatttgtttcttcttatttgtaagaaaattaatcagatggatattcacaaaattagatttatccgaaagaaaaaaaaaaaaaaaaagagaaacccaattgaggcaagaagagaccttgaggcatgaaaacaagacacaaatacacaaaatttccttggctaaacaaaacatagaaaataaaagcttgaatcgacagggggagaagaaaaggccaatatgatcacaacgtcatagaaatagcgaaaaccgtagaggaggaggaggagaggacctacacactcctgtccacatccttttagccccaccgtgggtctatcactaattccttcctctatcgtattatatccgaatacgttacttttctttccctactaggctaccaagtaatatttatgttttcttttgcgttgattatttgtaagtgaagttatgattatacataatcttgcaacttgaaactctttttgttttttcttgaatcttggtatgaatcagaagttgacgagcttaaacaatgaaaatgcgatagttagatgggattcgagaaaaacaagatcaacaacaataaaagtggttcgacgagttatataactttttgggtcaaataagtgattattattatataatttgtcttgtaatggagtaaaacgcatcaagaccattcaatcaaacgtttactagtagacaaacacacgtggcgcttatctagaacttaattattggattaagcaaagcaggtgcaactgtggacccccctctgattacatttgttttttatccacaaactgtttataaaatatttagtagtatagattaacatgtacattattcactgattattgttcctacatttttaaataacgtcactgattctttgattaataaaacaagaaacccaaatgaaagtgaattatgatttgagaaagacaaacgaaataatgacaaaatgccgtattatataataatggatacaaattgtaagaaataaataactcacagttttttttacaaaaatgaaaaatagtagtataaaataaaaggagagcctgtgtttcagaggcccaaacatcaatgcacaaataatgaatgtatcgccgttcaagtgtatacctaataaactaaataaaagtttgtacatgcaacaaaaataaagagagagtacaaattcgataatcttgcaaaagatgtttccaatcttttatcgtcgacccaaaatgtagtatgttgttgttaaaatacacgacgacaaaaaaaagagagtacgatacacattcaatcatatccggtccctaatatgaataatggatcgaaaataattgagatctctatgtgttaataaatgtaaggggtaaatccgtaaagttgcatgcatttcttggttaaatctacaacgtcccgtctctcgagatcactctctctctctcgctctttggaaggaataaagaagagaggaaagagataagtgaaagcaacttttaatctgatttttgcgagtgaggagaggatcatcatttcataggagtgagagaccccattaataccagaagcagtcagagtttctcaataattgtaccaaattctctctattcttcttctctttcattttagatattttctcttacgcagactcattgctttcctctctccatggaagctactgagttatgatccttaccctcaccggtctttaactatgcttagaaacaaacctagagcagccgtgacgactaagaaacaaacatctctgttaatg

SEQ ID NO: 28854 - DNA, 3000 bp, Unknown
  misc_feature (1)..( 3000): 2750-1469P.txt file - cDNA_ID_2999054; gDNA_ID_2926227; Annot_ID_203539
gagcgttaaactcgggtgggatgtcaaagactatggctggccgcaaggtccaatggtggtcgttgaggacgtgctttacgtgatgagccatgggctggtgttcaagcaagaaggtgacacgtggaagatggttgcatcggcctcagagtttaagcggaggatcggaatggcgatgacgagtttgagtgatgaggttttgatcgtaggaggagtgatcggacctgataggctcaattgggacatcaagcccttgtcagatgtcgacgctttgacagttgggaatgatcgtccggcctggaggagtgtggcgccgatgacaaggtgtcgtgggacgatccttggctgcacgcagttgacaatctgatggatgggaatgtggcttcattatgacgtctttcagttcttttttgttttgtattttcttcctgtttgttaactgttgtgagcattattgtttttaaatcttctttgagaaatgaaaataaacgaatagcagctatgtcttgagaaaatgtcatcaaagcctggttattgtctataaacgaatagcagatttatgtcttgagaaaatatcatttatgagtctggtgaaaaaaaaaaaaaaaaaataggtctattgattgggctatatgtgggaatgatatcaggttgggtttggacaggttgcataagttattttgtgttgggccttaaacaatctgaaagagcaatatgggtttgaacatggagatatttggtcattgaacagaaaaacaaaattgtggtattcaagctctaaggagtattttgtagtgtataagagtaatgattcggatttaagacatgttgacaaagaagcaatgatttaagaaaatggacctctcattatcttgctcatttgctttctttatctttggtaattagggtgatatgactatatccttgataaacacaatatatcggtgccactttcgaattaataataaccatgattaaagatggcgagtcatcaaagaaatcatgaaatggaaagaaatataaaaatttcagtatcgaatcaaatgaatgattagtgctgattccactccaattatattttataacctctacgtcaggtggtttagaaggaaatcaatctatcaagagtcacgtctatggattgggagtcaaaacatatacgtatgcttctggtagtagtcgtagtgattaagggatcaaagttgttagactgaatgggttacaaacacaattacggaatcgatggacacactcattacattaaaaagaaatagcacattcaatggcatatatggatgagtagtcgctatttgtttcttcttatttgtaagaaaattaatcagatggatattcacaaaattagatttatccgaaagaaaaaaaaaaaaaaaaagagaaacccaattgaggcaagaagagaccttgaggcatgaaaacaagacacaaatacacaaaatttccttggctaaacaaaacatagaaaataaaagcttgaatcgacagggggagaagaaaaggccaatatgatcacaacgtcatagaaatagcgaaaaccgtagaggaggaggaggagaggacctacacactcctgtccacatccttttagccccaccgtgggtctatcactaattccttcctctatcgtattatatccgaatacgttacttttctttccctactaggctaccaagtaatatttatgttttcttttgcgttgattatttgtaagtgaagttatgattatacataatcttgcaacttgaaactctttttgttttttcttgaatcttggtatgaatcagaagttgacgagcttaaacaatgaaaatgcgatagttagatgggattcgagaaaaacaagatcaacaacaataaaagtggttcgacgagttatataactttttgggtcaaataagtgattattattatataatttgtcttgtaatggagtaaaacgcatcaagaccattcaatcaaacgtttactagtagacaaacacacgtggcgcttatctagaacttaattattggattaagcaaagcaggtgcaactgtggacccccctctgattacatttgttttttatccacaaactgtttataaaatatttagtagtatagattaacatgtacattattcactgattattgttcctacatttttaaataacgtcactgattctttgattaataaaacaagaaacccaaatgaaagtgaattatgatttgagaaagacaaacgaaataatgacaaaatgccgtattatataataatggatacaaattgtaagaaataaataactcacagttttttttacaaaaatgaaaaatagtagtataaaataaaaggagagcctgtgtttcagaggcccaaacatcaatgcacaaataatgaatgtatcgccgttcaagtgtatacctaataaactaaataaaagtttgtacatgcaacaaaaataaagagagagtacaaattcgataatcttgcaaaagatgtttccaatcttttatcgtcgacccaaaatgtagtatgttgttgttaaaatacacgacgacaaaaaaaagagagtacgatacacattcaatcatatccggtccctaatatgaataatggatcgaaaataattgagatctctatgtgttaataaatgtaaggggtaaatccgtaaagttgcatgcatttcttggttaaatctacaacgtcccgtctctcgagatcactctctctctctcgctctttggaaggaataaagaagagaggaaagagataagtgaaagcaacttttaatctgatttttgcgagtgaggagaggatcatcatttcataggagtgagagaccccattaataccagaagcagtcagagtttctcaataattgtaccaaattctctctattcttcttctctttcattttagatattttctcttacgcagactcattgctttcctctctccatggaagctactgagttatgatccttaccctcaccggtctttaactatg

SEQ ID NO: 28855 - DNA, 3000 bp, Unknown
  misc_feature (1)..( 3000): 2750-1469P.txt file - cDNA_ID_2999069; gDNA_ID_2926227; Annot_ID_142563
ctctctgcgttgaaaagtttgtgattctacggaaaggaatatgctctggtggatgcgtctcggttttggttctttgtgctcacaagtaacgacggacgaagattcccaacaaattcacatgacaaactataaactatagtctataacaaattacgtaatctgatttatttctttattatgaattacacaattaaatacagtagtcatcttaaagagagattattacagtggaccttttggtttcgatagattgcgtcacaaaccaaaaaggttattcatttctcgatgtacaaatattattaaagtcgaatgtaaatttacaagaaatttgggggaaacgaataaacggcgacggaagggctgccactagaccgagaagaagcaaagacagacgagctctgtttttgcaagagagagttttttataataaaaactggaaaagggcaacaaaacgactctttggccggtgaaactgtcaaaaagacattaagacttggtctctctcccactgcaccgccgatccttctctacttgtcaaactataaaagaaaaagagtatttttttttgtggagaccaccaccaccaccttcgatcgatttctactaacttgttcttcttcttctttctcaactctcttgtcttttgtctctccaccaattttttcttgttctttctctctccaccacataaaaaaaaaaaacctagctttgtcccctcaactcactgattgaactgcttgattttcgattgatcatctgggtggttttgaatcgaagagtattgttgtattagtggctggtggctctccaaaagagtaaggccggagagagaaatcaatggcctctggcggcggagaggcggataaatcacttgaaatcgggtccgggaccgcggatcccaaaataggcggtactgggagcaggagcgccggagaagaacgatacttcagggcagatacactggatttcagtaaatgggatttgcatatgggtcaaacctctactagcagcgtcctcaccaattccgcttccacgagcgctcccgcaccggcgatgcaggaatgggagattgacctctccaaactcgatatgaagcacgtcctcgctcacggtacttacggcactgtctaccgcggtgtctacgccggccaagaagtcgcaggtccgtcttttctcctagactaagatatatatgattcattaggatagacactggtggtcttttttggggatctcccgtctgatggatgttatggtttgctgcagtgaaagtgttagattggggagaagatggttacgccacaccagctgaaactacagctctccgtgcttccttcgagcaagaggtcgccgtctggcagaagctcgatcatcccaacgttaccaaggtattctttttacattcaccgattaaggtagaagaagaaccttttgatcaaaggacttattcatttgacctctctctctctgtggcagtttataggagcatccatgggaacctctgatctgcggatccctcctgctggtgatactggcggacgtggtaacggtgcacatcctgcgagggcctgttgtgttgtggttgaatatgttgccggaggcacgcttaagaagttcctcatcaagaaatatagggccaaactacccatcaaggatgtcattcagctcgctttggatctcgctagagggtaatctctcctttactttatgtttcctgatttgccattcatttctgaaactattcagacaaagatgcttcctttatcaacaaaactcttcctaccttttttctttgtctcaggcttagttacctccactccaaggcgattgtacatagggacgtgaagtcagagaacatgctgttacagcctaacaagacgctgaagatcgctgatttcggggtagctagagttgaagctcagaaccctcaagacatgacgggtgaaactggaacacttggatacatggcaccagaggtatgtaatgttgttcctgtagagtcaaaatccttgtgtttcgtaataggaaagatgagaatgttagcttttgttgcataggttcttgaaggaaagccttacaacaggaaatgcgatgtctatagctttggggtatgcctctgggaaatatactgctgtgacatgccctatgctgactgtagttttgctgagatctctcacgccgttgttcatagggttcctctctctctctctgtctatacatacaatctctcctatgttaaagctaatcaggaaatctaatgaagtcactgtttggtgcatcttgctcagaatctgagaccagagattccgaaatgctgcccgcatgcggtggcaaacatcatgaagagatgctgggacccgaatccagacaggcgtccggagatggaggaggtggtgaagctgcttgaagccatagacacaagcaaaggtggtggaatgatagctccggaccagtttcaggggtgcctctgtttcttcaaacctcgaggcccctgaatctctctccctctctttcctttttgctccgtgtctgatatattcttgagagctgcgtgattctttggattttgtatttactttgagctatgggagttggattggtgtgggttttgtcataagaatctttctgcgctctatgtatttatatacttaacacagtcgtgtataattcgattaagctttattttattttttgatgttgattcgaatttcatatatacacgacgcacacatgcaaattgatcatcaaaatctgataagaaaaaaacagagagttaaaacttacttacaagaggggtctgaaggaaacatagaaaaggattgggccgatactgttattagtattcaagataaaggtctaaacctacaatttgtaaacaaaattagtactaaagattttgagtgtttctctctacagttttttgtgtttatcgtatgtttcacacagtacacgcttcagtgggagttgttgggtgatcggtccgaggcgacatacaagatg

SEQ ID NO: 28856 - DNA, 3000 bp, Unknown
  misc_feature (1)..( 3000): 2750-1469P.txt file - cDNA_ID_2999073; gDNA_ID_2926227; Annot_ID_142564
taactgaaatattgtactccggtttttcttttcaaagcgatcccaattaattagctaatgcaaaactatattttattcaagatgggctgtataatgaattttaaaactgttaagatgtccatgaatcgagatggcccagtgggcccgacaagaggtatttattctgtgcgttgcgtctgtgcgcctaataaacgactgagctttaagtttacttattttctatgaaatgtgagaagcccactagagtccagcaagccagcgacgttccaattcccatttttacccttgttccacctccagtcagacgaaccgcttctccccggcttgacccttgtcgtactcgtcgatggctccggtgaagcagaagaagaagaataagaagaagcctctggataaggcgaagaagttggcgaagaataaagagaagaagagagtcaacgcagtgccattggatccggaggctatcgactgcgactggtgggatactttctggctccgaaactcttctccctcaggttctcctctctctccttccccgcttttcagcctgatttcagtttaattcctcttctcccccatcagttaccactagtcaatgtcgttttgctattgcttgactagattgttccatccttttgattccatgcttttgtagctcctctagggttctttgaattgaaccgagagattgttgttgttttcagtcccctcagacgaagactatgcgttcaagcacttctttagggcttctaagacaacttttagctacatttgctcgctcgtcagggaggaccttatctctagacctccctctggtctcatcaacatcgagggaaggcttcttagtgttgagaaacaagtcgccattgctcttcgaaggttagcttccggtgattctcaggtctccgttggtgctgcctttggtgttggccagtccactgtttctcaggtaccaatcaacctctactcagctccctatttccctgatttcaatatatatatgctgtatcctgacaccatccatttgtttccccaggttacatggagattcatcgaggcactcgaagaacgtgccaagcatcatcttagatggccagattctgaccgaattgaagagatcaagtcaaagttcgaggagatgtacggtctccccaattgctgcggagccattgacactacgcacatcatcatgactctcccggctgtgcaagcatcagatgactggtgtgaccaggagaagaactacagcatgttcttacaaggagtctttgatcacgagatgagatttctcaacatggttaccggctggcctggcggcatgaccgtctccaagcttctcaagttctctggcttcttcaaactctgtgaaaacgctcagattttagacggcaatcctaaaactctatcccaaggagcccagattagagaatacgttgttggagggatcagttacccgcttcttccctggcttataactcctcacgacagcgatcatccctctgattccatggtggcgttcaacgaaaggcatgagaaggtgaggtcagtcgcagctactgcctttcaacagcttaaaggaagctggaggattctgagcaaagttatgtggagaccagacaggaggaagctacctagtataatactggtgtgttgtttgttgcataacatcattatcgactgtggggattatcttcaagaagatgttcctttgtctggtcatcacgactccggttatgcagaccggtactgcaagcagaccgagccgcttggtagtgagctcagaggatgtctgactgagcatttgcttaggtgaggatcttaaccttgggaattggacatcttcatctcttctctaaggccgtactaagcccgttagaccattcagcatcagtttagtggtagcccgagacatatcggacaaaagcaatgttatgaaacttttcttcaggtatcaacaccagattaacatcatgccagttggacctacaaaaatagattcatccttaagtgtgattaccatactttgtgaactactaatcttttgagaggagtggactatatccccaacggaactgtttgttttggcaatgtaaatgttatttttttaataataattggtgttttcttttagtattgagttgttgggttccattatattcgctctctgcgttgaaaagtttgtgattctacggaaaggaatatgctctggtggatgcgtctcggttttggttctttgtgctcacaagtaacgacggacgaagattcccaacaaattcacatgacaaactataaactatagtctataacaaattacgtaatctgatttatttctttattatgaattacacaattaaatacagtagtcatcttaaagagagattattacagtggaccttttggtttcgatagattgcgtcacaaaccaaaaaggttattcatttctcgatgtacaaatattattaaagtcgaatgtaaatttacaagaaatttgggggaaacgaataaacggcgacggaagggctgccactagaccgagaagaagcaaagacagacgagctctgtttttgcaagagagagttttttataataaaaactggaaaagggcaacaaaacgactctttggccggtgaaactgtcaaaaagacattaagacttggtctctctcccactgcaccgccgatccttctctacttgtcaaactataaaagaaaaagagtatttttttttgtggagaccaccaccaccaccttcgatcgatttctactaacttgttcttcttcttctttctcaactctcttgtcttttgtctctccaccaattttttcttgttctttctctctccaccacataaaaaaaaaaaacctagctttgtcccctcaactcactgattgaactgcttgattttcgattgatcatctgggtggttttgaatcgaagagtattgttgtattagtggctggtggctctccaaaagagtaaggccggagagagaaatcaatg

SEQ ID NO: 28857 - DNA, 3000 bp, Unknown; identical to SEQ ID NO: 28856
  misc_feature (1)..( 3000): 2750-1469P.txt file - cDNA_ID_2999073; gDNA_ID_2926227; Annot_ID_203544

SEQ ID NO: 28858 - DNA, 3000 bp, Unknown
  misc_feature (1)..( 3000): 2750-1469P.txt file - cDNA_ID_2999077; gDNA_ID_2926227; Annot_ID_142565
atgtaaggctgaagatgaggatggttaagcagctcgttagcctgcagcgagttaacaacaatgcttagttcaaccacaaacggattacttatcatcaaaagcaaataagcattataggaaccatacgcttggcctgagttcaggatttttcctcaacatgcttttaataaggcctcggctgcagataagggaggaaaagaggttggtacagcaacgccggttaatgttgttaacagaggaaatgatttcaggcttacaatgagccggaatacatggcgggaataggatccattatcaacttgtgtattttggtgatcagtgtctgcacatcctgcaatcaagatttcacattttacattatgtgttttaatgccaaaatcaaaaaccaactgtaaggatacttacggaagctttgaaaggaggtttatgagcagccatttcatacatgcagcatcctgttttccatgatgatccatgaaacggtagtcacaaggtgaacaagtgtaggagtaaaatatcaaagaagaatgtattgttgttatacccaacgaccaaatgtctgactttgatccgtaaggtatgtcagcaagaagctcaggacacatgtagcttggagttccaacaacctataaacacactgacttataataacagtgtcacaaaatttaaattagtttcattgtacagaacttacagaggatgtaaggtcatcagaagttagaatcttagcgagtccaaagtcacctgagaccgaaattgtggatgcgttagtaactgacaaaaaggcttaaagatacatgaatctacaaaacataccaagccgtatgtcttgctcttttgtcaagaatatgttagaacactgaaaagacatttagatgttaatttagatgcttggaacataaaaaggaacaaaattctgaaaattgatagtgaggttacatgtttaccttgacatcgcggtgaagaatatggttggagtgaagataatcgagggccattaatagttggacaagccattggcataatttctgcatcatttagtagttatttgttcaaatattagatccagtgatagattgtaagaagtgaagggatgggtgagagtgagacaaacctcctcaggaaaatgaacaccacatgctcttttgatggtatctgtcctgcaatattcaaaatgaaaataagagccaatttcttcaaactaaacacaacttgtctgtagttgaaaatgggcaaaaaccaatttacatgtccccgccttggcaatatccaataacaatgcacacatagcaaccctgggaaacaagagagatgatgagtattgactattgagtagagtaaggaggcagaagaagaatgagcaaaaggagatgagaaggagagaccttttcaacccatgaatctttgtactcgacaacaaatggattgcggacagtagaaatgagctccatctgaaacatgaaggggagggaggtccaaactcatcatcatcatcttaatccaacaccaccaactaatttcatttggtccaataagaaaaaaaaagaaaaacaagaacaaacctcctgatgagctgatcgtcgagccctatcagactggcgggcgagacgaatctttttcaaaacgtatctgtaaatggtgaagatgaatagagcaaatggaatcaccagagaagcaacaagagagaagcaaaagcagagaatgaatgaatgagagagaatagaatacttcttgcgttcttgtttgtgtctaacaagaagagcagagccaaaggaccctttcccgatctgctccaagacttcataccgctccatctgacaaacacacttgcttgaaatttcagcagaaacgtcttcaaaacaaaaaccatataacaaaacaagtcttaataaattataattttttcttaaaaaagaaaagagtatacatggagaaactgctacatacagagatgaggcaatccaatcagtgtcaagtcatgcaccagattaaagattaaaacaaataaagggtagctttcagcgagatttatgattgctttcatcaaacagtgagagtgagtaattttcataaacagcgaaaaagtgggaaccagctcccgcaatcatcatgatgcacaaaattaattaaaatatacctctgtacgaaggctcttggagggaggagcttcaatcgtaccgacaccgtggtgaagagaatcaaactactaatacactatttgtattatatcaccaaaaatggaaactttatcaaaagataaaatcattttcttaaggccaaaaagcaaagactataagaagaaggaaaaagaagcagaccagacgattcgtccgagagcggcaaaagaacaatttcccgtctacgattcgccttcctttttttcttaaatttcaaattagtagtatgagattttccttgctcaattcctattttagatatatatatatatatatatatatatatatatatatatatatatatatatatataaagatgaaaaaaaaaaagatatatatatatatatatatatatgaagagaaaaaaatacaaaactttgctttttcagttctcttttctagtaaaaatgattttgctcgcttaagtaacgtagagccatttttttgcccatttttgtacgcaattattttccgtaactgaaatattgtactccggtttttcttttcaaagcgatcccaattaattagctaatgcaaaactatattttattcaagatgggctgtataatgaattttaaaactgttaagatgtccatgaatcgagatggcccagtgggcccgacaagaggtatttattctgtgcgttgcgtctgtgcgcctaataaacgactgagctttaagtttacttattttctatgaaatgtgagaagcccactagagtccagcaagccagcgacgttccaattcccatttttacccttgttccacctccagtcagacgaaccgcttctccccggcttgacccttgtcgtactcgtcgatg

SEQ ID NO: 28859 - DNA, 3003 bp, Unknown
  misc_feature (1)..( 3003): 2750-1469P.txt file - cDNA_ID_2999081; gDNA_ID_2926227; Annot_ID_142566
gagcgaatataatggaacccaacaactcaatactaaaagaaaacaccaattattattaaaaaaataacatttacattgccaaaacaaacagttccgttggggatatagtccactcctctcaaaagattagtagttcacaaagtatggtaatcacacttaaggatgaatctatttttgtaggtccaactggcatgatgttaatctggtgttgatacctgaagaaaagtttcataacattgcttttgtccgatatgtctcgggctaccactaaactgatgctgaatggtctaacgggcttagtacggccttagagaagagatgaagatgtccaattcccaaggttaagatcctcacctaagcaaatgctcagtcagacatcctctgagctcactaccaagcggctcggtctgcttgcagtaccggtctgcataaccggagtcgtgatgaccagacaaaggaacatcttcttgaagataatccccacagtcgataatgatgttatgcaacaaacaacacaccagtattatactaggtagcttcctcctgtctggtctccacataactttgctcagaatcctccagcttcctttaagctgttgaaaggcagtagctgcgactgacctcaccttctcatgcctttcgttgaacgccaccatggaatcagagggatgatcgctgtcgtgaggagttataagccagggaagaagcgggtaactgatccctccaacaacgtattctctaatctgggctccttgggatagagttttaggattgccgtctaaaatctgagcgttttcacagagtttgaagaagccagagaacttgagaagcttggagacggtcatgccgccaggccagccggtaaccatgttgagaaatctcatctcgtgatcaaagactccttgtaagaacatgctgtagttcttctcctggtcacaccagtcatctgatgcttgcacagccgggagagtcatgatgatgtgcgtagtgtcaatggctccgcagcaattggggagaccgtacatctcctcgaactttgacttgatctcttcaattcggtcagaatctggccatctaagatgatgcttggcacgttcttcgagtgcctcgatgaatctccatgtaacctggggaaacaaatggatggtgtcaggatacagcatatatatattgaaatcagggaaatagggagctgagtagaggttgattggtacctgagaaacagtggactggccaacaccaaaggcagcaccaacggagacctgagaatcaccggaagctaaccttcgaagagcaatggcgacttgtttctcaacactaagaagccttccctcgatgttgatgagaccagagggaggtctagagataaggtcctccctgacgagcgagcaaatgtagctaaaagttgtcttagaagccctaaagaagtgcttgaacgcatagtcttcgtctgaggggactgaaaacaacaacaatctctcggttcaattcaaagaaccctagaggagctacaaaagcatggaatcaaaaggatggaacaatctagtcaagcaatagcaaaacgacattgactagtggtaactgatgggggagaagaggaattaaactgaaatcaggctgaaaagcggggaaggagagagaggagaacctgagggagaagagtttcggagccagaaagtatcccaccagtcgcagtcgatagcctccggatccaatggcactgcgttgactctcttcttctctttattcttcgccaacttcttcgccttatccagaggcttcttcttattcttcttcttctgcttcaccggagccatcgacgagtacgacaagggtcaagccggggagaagcggttcgtctgactggaggtggaacaagggtaaaaatgggaattggaacgtcgctggcttgctggactctagtgggcttctcacatttcatagaaaataagtaaacttaaagctcagtcgtttattaggcgcacagacgcaacgcacagaataaatacctcttgtcgggcccactgggccatctcgattcatggacatcttaacagttttaaaattcattatacagcccatcttgaataaaatatagttttgcattagctaattaattgggatcgctttgaaaagaaaaaccggagtacaatatttcagttacggaaaataattgcgtacaaaaatgggcaaaaaaatggctctacgttacttaagcgagcaaaatcatttttactagaaaagagaactgaaaaagcaaagttttgtatttttttctcttcatatatatatatatatatatatatctttttttttttcatctttatatatatatatatatatatatatatatatatatatatatatatatatatatatctaaaataggaattgagcaaggaaaatctcatactactaatttgaaatttaagaaaaaaaggaaggcgaatcgtagacgggaaattgttcttttgccgctctcggacgaatcgtctggtctgcttctttttccttcttcttatagtctttgctttttggccttaagaaaatgattttatcttttgataaagtttccatttttggtgatataatacaaatagtgtattagtagtttgattctcttcaccacggtgtcggtacgattgaagctcctccctccaagagccttcgtacagaggtatattttaattaattttgtgcatcatgatgattgcgggagctggttcccactttttcgctgtttatgaaaattactcactctcactgtttgatgaaagcaatcataaatctcgctgaaagctaccctttatttgttttaatctttaatctggtgcatgacttgacactgattggattgcctcatctctgtatgtagcagtttctccatgtatactcttttcttttttaagaaaaaattataatttattaagacttgttttgttatatggtttttgttttgaagacgtttctgctgaaatttcaagcaagtgtgtttgtcagatg

SEQ ID NO: 28860 - DNA, 3003 bp, Unknown; identical to SEQ ID NO: 15958
  misc_feature (1)..( 3003): 2750-1469P.txt file - cDNA_ID_2999085; gDNA_ID_2926227; Annot_ID_142567

SEQ ID NO: 28861 - DNA, 3003 bp, Unknown
  misc_feature (1)..( 3003): 2750-1469P.txt file - cDNA_ID_2999089; gDNA_ID_2926227; Annot_ID_142568
agtgttagttggttcatgagtgttactgattcggtgtgtttactgccaaaaggagcaccacttgggtagcgacgttcctctcaagaatccagaacgagatgtctcctcttttgcaatgcagctcaattatgaaagaacaacttataaatcctcactgggaaagctgtggttcgatgaggctggatcaaaactggacttgcaggaggatgatgatgatgctttcacaaatcttggtggtgcttttaaagaactcgggttctgcatgagggagttgggcttgtccatagctcgtctatgcgacagggagattggcggaggcttgctggaggagagcttactggattcttgcacagccaaaggacgtctcatacattaccactccgctgctgataaatatgctctcagagaatcccagaggagaaaccaatctggtaaccgagtatcaagcaagaggagagtccagaacgctgctgagcaagagctgaaccgtagaaatggagctggtttgagtgggagtcacttcaatctgtggcagcagtggcattacgattatggcatctttactgttctcacggatcctatgtttctatcgccgtattcctatcaggaattcagtttgatgagcagccattcttacctgcagatctatcatcccagcaagaacaagttctacatggtcaagactccacaagacagttttttggtccaaatcggagaatctgctgatattttgtccaaagggaagctacggtcgacccttcactgtgtgtgcaaaccagagaagctggatcacgtaagccgtgagacatttgttgtcttcttgcacccaaagtggagccaaactttctcagtctcagaatatacaatggaacatctaaggtcggatgaggtcgtccctagaccagatttacagaatattgttccacctctatcgtctcggttaagggatgggatgacttttgccgagttttcacgtgaaacgacaaagcagtactacggagggaatggtttgcaatctaatagatagccgtgccccaggttaatagcttgtctaatctttaggtagttaaattcaaaataatctttaggtaatgagtagtggaaggcaagaggaatgagccaagagggttagttgtaaaagagattagattaaagggagagttgggattcgttatgtgtacttcgatgttggagccaaaacaacagtgaaagctgttacatcgttttcacagtcaaaagctctccctttcaaacatgctttttggttgtggttgctcttctttagtctctctctgtgactcagtttatgttcctgttgtgtctcccctgttgctgttccaaacttacatctctttgtttgctttcaagcgtcgcattaagacaaaagtggtgttattaaagtaaaagctgcctctctccctacacacagattgattcctttagggaatcaatcatcttttctttgacacttttgatttatagttttttttcatgaatggttttttgtacgtgtagatcaaaccgacaacagggtttagctcgcaagtcttttcttttgtgaattcaaaacaaagtttcaaactttgtcccttcgaagatgcttgctttgacctaaagaggtgctttttgcatcgaaagtgacctcggtttcaaaaccctaatctaagaatagaaacggatatggtgtaggtatgtaggtgtctattgtaagcaaatcaaaagcaaaagaagatggtacctaaaaactaaaagtagtttaaagaaacaataaaatggaaaagagggttcatcattcaaagtggcagatacattcaatttttaattggtagtataaaatacaaaacgtccaaacaagaacaatgattgcaaggcaaaggaataatcagagagacaaaatgactagtatttttctaagggattggttataaagaatggaaaatgtgggtatccctaaaaattagacagagcaaaagggaataaaggatgtatctttattcagtggtcacccacctatagtttccaaagtgcaaataaatttaatatagatacacatgatgagattttgaaatatcttatatatgcgtttttatatatatcaaaatgctctagtaccaaagaatatagatcaacaatcatgttaatttgtacaaagatgaaagaagatcagaagttttgattgtgtagcctgaagaaaaccttggatggatgaataaactaattgccaagttttgtgtcattgaagtggaaaagagacagagagaagaaggtgacgtaagggaaagcacgccaaggcagcagcatgtgtgaatgtacgcaaaggtcgcagctttgtgtttcaaaaccgaagcagaagggaccaaattaagagactgactgatcatcatacacagtcgtttcattcctttattctcatctttctcttcctcccattttctcacaccaaatttcagcacctaatccgttagtttaaccatgatccacaacaataaaccaagttgtttgattggtttaaacaagacactctaaacgcaaattcaaccttcttttcctttcttttttggtcaattgaaacataaatgtctgataacctatgactgactagtcaagctatcctaatgtttctgattaaattaagaaaaggcaaatacaaggatgacttgattccctcctttttctcaagactcgttgatacatacatctaaagtaatatttatgtgtaataaaaaatgggattggcaaagatgcggccttattattgaaaagcgacgtctttgttttgtatagtagtaatccattatttatgcaacgactatatattatgtcaagagtagtactactcactcctactctcatcgaaatataatcacatatttctttaaaagaaaaagaaaaggtgaaatacctaaacgttactttgtctatctatatatatacacacacataagtttcctagtcaagctctgaagtcgaagcaaagttaattacagagagagagaaaggatg

SEQ ID NO: 28862 - DNA, 3003 bp, Unknown
  misc_feature (1)..( 3003): 2750-1469P.txt file - cDNA_ID_2999105; gDNA_ID_2926227; Annot_ID_142573
atgacaccataactgaaagagatatcaaaactcacactttatctctcaaaatgtaaacgagttcagcattaatcatgttcagatgcacagagagacactaacatacaacaaggaaggcctaccttctataagtaaggtcaccaattgcacgggagacagtcagctggccattcactcgtggcacaccggcccactcagtgacataacctcctgcagcttcaacacgaatcttttcatcctctctatttgggtgatggtcctttgtcaattctttggcaatgaaacgcagtagtccattgccatgttccagtttaaagtcagagaaccttgatggtgaagagccccgattgcgtcttcgctctctgtacaacttcaccaaagtagctgcaataaacaaacaccattgcaacaaactgtttataaataaatacaacactggctttttgttaggcagcttgattttagaaacagatgttgctaaacctctagcttcttccagagtctcaaatttttcagaacagagaagtgcttttgagtcaccgatactagcaaccattagttgaccatctgcaataagtgcaattgtagccgttgaacctgaattcagctttctgtttgatgcttcctggagaaaaacaaagtgtagctggttatatccttatcatgatagtaacaacgctcgacggagtgtatagaagatatccactataccttagtaaatgtgacatcaatgtcatggatcgctctcagcaatgcttccttcataatatccaaggggagagaatcatcaaaatgaagtggcaatgagtctcgaaacctgcaagaaaattgggacactgcaatgaagcgaaaatgacgacttgataaacgaaagagaaataaaatgaaaaggcactcaactgcatttgaaaatccaggttgtatagatgcatgatttcatcccgacttacgccgtgcaaaatgacactgtggtctcctttagttgggaatcgtccaatcaacttcctcgtcatagcagaaaatgtagcgtccaagagaaagttgatatgcaaagcaaagtaatccaataaaagttttgaagccatgtcactggcttctgcaccattatgtccgtcaaagactgctgcaattccaaccaaaacatcctttggtgttccagtcttgcctgtgagacgaggccatcagtattccctccacagctagcacatagatacaagatagaaattttccataccgggaaatggaatgcgaagatcaagagcacagagaagacgatcctcttggtagttcctccgaccttgaatagctgcggtatggcaacgaccagctccactatgagtaggagaaccccaattctggagaatccaacgagggcatttgggtgattgaaacacagctggagctccgccttgtttgtaaaccgccaaacacgtagaagattcccctcgacagttaatcaccaggaagaagaagacgaaaaatataataaggagccctagatttagcagacttgatttgatactggaggtcatcttcttccttacatggattgtgtgagatttgagggatttctctgctaaatctagggattaaacaaaacaaatatctaaccgacaacagaatccgagagtcctaaccaaacctactgatattccaaattcttctttattatcaatccgagagcaaaatgtttaaatctcaagtaaagatcgccagaaaatgaagctagagtagacaaaaatcaagctaccctttcactcttttgctcgtaaacatgcttgaaaggaacaattgcttcatgggaacaaaaatatgtaataattgtgtggcagaatcttgtcggtaataaaaggttggttacctctggaaggctctgagctcctccacccgcctgaaaacgaagaagaagaggaagaagaaagaagtcgagaacctttgacttcatccaaagggtttcttttgggccttttaatttcgggtttagtaaatatgatcgaaggggaaaaggcctctttaaaagcccagcccactaggactacgtggcagtaagtttgttaccaaattggatgactagtgtgatgaggcttggaatgttctgttgcggtttgtagtacttgttcttctcctaacaataacatgataatacagcataatccaaagagtttgcatcgagaggtgtaaagcggccacatggtcaccatgttcgcaagcacactccacgagacaaccaaaatacgacgtggcaattttttaccttttgtgacgtgttaacttaacttctttcccacatccgaaaggaaactttggaatctactccttcttggaaaaatccaaatgtgccaatcacttgtgtgtatatcgtcttttctatttaccaagacctcaaagctactactatttcttttcttcttttttttacctttgtagctagttttactcgtcagtcgtcactttactacattaaagctatccgattgatgccacgtagtcccgaccggtccggtgaggtggtcaactttttgtatacctggtttcaatatatattacttcgatatgtaaatcatgggatccaccacatacgattttaccttaatctcctcaaaagtataagttccggaactttctaagaagatatgcacccttcctccctctggtaaatagctctagaaagttcgaactccacttggtgactaaaagaattttaaggatcaccagctccccgctatatatatatatggatttaagtcacctacgtggccattgtcttcgccacatttcctgccccaactgccataaactaagtaactaaccaccagcaaaagcagagtactctgttttaaagaaaaaatacacttcccgctctttcttcttttggttctgtgctgttttggtcttctccaatacaggaaccccaaatgcatcgtttccttccttggattataatttacgaaaaatccaatcatagatcattagacttctagcattagcattgctaacaagatg

SEQ ID NO: 28863 - DNA, 3003 bp, Unknown
  misc_feature (1)..( 3003): 2750-1469P.txt file - cDNA_ID_2999116; gDNA_ID_2926228; Annot_ID_142578
tctgatgaaactctttctatccttctctctttttttggtaatttatatcatcttatagctctcatcactacatattatttaacatctccatggccaaattttaaatttctcgatttttgatataatattttgtgcaggagtagtaatcaatggagtaatgggttcaaaccagcttcttcgaccaagaaaagtaccgaagctctttgtgttcggagattcttacgcggatacgggaaacacaaagcgcgacacagaggcttgggctatcccttacggtatcactttccccggtaaaccttccggccgttattgtgatggtctcatagccaccgattttctaggttcatttctctctctccctctccatgatcaatgttaaacctctctctttagtttagtcatgtacccttccaacgatgtctatatgattttatagtattatcattatattatacattgttacggatgttaattaataaaactattatgttggttggtgcagaaaaagtattgggggcagaatcaccgtacctctatagaactcacggacgagataaagggctaaaaagaggaatgaattttgcgtttggggggtccaaaatgttggactcctctccgaatagtccattccccaatataactgctcaagtgaattttttggtagaccttgtcctcgccggccgtgtctacggagacattactccctccgatgtttctctcatcagctacgctggaggcgactatatttattacatcgaccaaaatcgtcctgccgctgtaagaaaaaaaacattaatcttagatgtcaaggctaattaattcagaaacattattacaccaagttctctgcctttacatgtgaaagaacacttttgtttgtttgttattagaaaaaaatcataacgccaaatgtatatatacttttattttgggtgattatttgattcttatcttcattaaaatttgcatgcagggcttaaaagcactagtagagaaagtcgtggataatttacgcgttaatatgatagtattgggtggcctgctatttaagaagatagcagtaacatcgctgcagccgatcggatgccttccttcttacacctctgcatcctcgttcaagagttgcaacgagtcacaaagtgcattggtggaactacacaacaaattgttgaaaaaagtggtggccaagctcaacgaacagtccagggttatgaagaaggagcagcatttctttatcattgatatacacaacgccttcatgaccgttatgaagaacaaaggtgagaatccaagtaacaaaagtttcacgtttgattcaatatcaaaaccctagtcttatagggttttttgtgtgatcggtttatgaaaatgtagggagcaaaagatttaaaaacccgatgaagtcgtgttgtgaaggctattgtgggcgttcaagtgacggtgggaagttgtatacgttatgtgatgatccaaagtcttttttcttttgggatgcagttcaccctactcaagaaggatggagatcgatttactcggtattagggaaccctttaaccgactttttgaccaaaccgtaaaaccagaatcttttttcttttggtttcaaatgcttgaagcaattttttttttaaataagttaattgggttcataaattggcttacttctttaaacacgtttgaagaactttaaaataatgagaggatggtaataggtgtcaacttgaaaataatgaaaattggtaaataacgagaatgttttaaacattcattagggcggctggacatctgtaactcacgtgtgtcatcgtgttaaatacaaggtatatccatttttcagggagttttgcgtggaatttttgaaaacctagtatttaattactaatttaaatagtagtactatatgtagtggactagtggtatttagcaaaaattattgattcgttattattcttttaattttcttaaactatgaaaacctgaaaaggtaaaactttaaaatcaaaacccatttggtagtagtaataaagaaacatacgaggaattaataaatacttcgttgggacaataaataaaatttaaacaaaaataaaaatagtcaataatcaaggagggtatgccaatattccattgacgtagataaagaaacaaagtctttttgtttctagattacgcggccacgttttaaatctcgatgcaatctttgactgtgtaggaaacctagtcttacacaaactacattttattcacaacttagcccacacaaaaaaatcacaactagattcaaaagaattttgttatttatcattcactactataattattcatttgatatatatttttcaaaagtttaaacaaacgatacggacatgaacagttagtctaccgaagtatgatttcagcctacaaatttgaagtcgtaccgtgtcatgagaaatataagtttttcccacaagttttagggattaattttgatctggaattttctttttatgaaaaaaattgaaagtcaataacgaatgaaaaaaatgttaatgattgaaaattataacattaaaacgccaaaaatcatcgccccgtcaattttggcaaaatattccattgaactccatggtctataatagtactctaagtctataaactcaatacctacaccaatcaaagccattgtatctcttgtcccatgcaattgtatagtagtcacactcagacaataaacaaacgtaattaagaaactctaatggtgcaaaacaaaattgaataaactcaaggaataaagatacaaaagttgaccagatcatagtcgtttcacatctctaaggcttagtggcttactatataaagccgcaaagacattttagtgagaacacaaattcaattccaattctcaaagtgctctctttttaaaccaatctgctctcttccacttactctctctatctctctcccatctcgtttcttttttggtcattaaaagagaaacctttgctctgaatcttgaaaatg

SEQ ID NO: 28864 - DNA, 3000 bp, Unknown
  misc_feature (1)..( 3000): 2750-1469P.txt file - cDNA_ID_2999120; gDNA_ID_2926228; Annot_ID_142580
acaacacaatacctatgaaacagtcacatatctcaaactgtaacaactgcagatggttcttttgatattaatgggttcatgtctttagttccacagagatcatgtcaaattcaaaagtgagaatttttcatatgaaacataatcatcgtcaaatcaaaagttcaatctttttgaaacaagaaaaatgaatataaactttatgcaaagtcgtgtttctatgatgttacctttttcttaagcagacatgtactatcgcataacaaagcataacaaaagaaaaactctagtttcatcatgatgaatcatctatgatcaagagtaagacagtacctgaagagattattgacgaagcagagagacaagaaaagctgttgtttgggcttctgtctcttctatctttatgtttgttggggttttttgtcggtatatttttgaagaggtttcaaaaggattctgcatttttctgggcagtttgaagaacaaatcatgggacccatattcatatgtttgtgggtctcatgtaagaacgagattattaaatatttttgttcaattcgatggagactatattgacatgttgatcactactgatttttccgttgacaagtgtcttcgaaattttaactcttaagcacaagagtttaatcttgttttagtagattattatgaaccatgtcacttttcaatgaaaactccagattttttgtttggcaagaagattgtttttccagaattgtgtgattcatgtatatattaggtaagaaaatgatcaaaacttaagaaaaaggtgataatgatggacctaatgtacattttgacaataatgctggtctttcatcactataaccctagaagtataatttactacatatcacttcgctcgagggaaattataatgtttctctcttgaatattcaaaagttaaaataacattaacttattgaaatttttactagttttcttaaagataagctgatttttaaagcattttaaagtattcttaaagtttaaaatgttcgcaaattcaggaagatatggaccacaacaaataatttagtaaactttgtatattaattagggttgtcaccatgtttttttaggtagaacatagaatactcaatactctcataccgaaataataaagctttatgtgaatcacatccgcacgtaaaagtgtcaacaaaatttaagtaacttaatacgtgaataatgtaacaattgcaaattatcacataccctatattaatatcggtcttctaaatagtaacgttgaccttttcttgacttgctaataagtttatactattaagttaaaacatctttcattatggtcaaatatttgagcccttgtgcttagcactaagtctgcatctagggtacaagtgaaagttatgttcgcatttttgaaaatttatttctaacaacaggtcagttgacttgggagttttggaataatttgtaatattgtatatggatccaacaaagtgagtacttcataaaaactattcgtgggtattcttcgaaatctgatagatcggaccggcccattaacagaagcccgtcaatatctataaccacaacaaaagtaaccgatgaatttagtcagtcatttagatcctttcttctacatggttgtcacttgtcactgtaagaagtattcgtcatcctagcatcttccaagaagatttagtaacaaatgtcaaaatcatgcatgcagtaaactaaaaatagtactctttgtattcgagtgctaattactaatcttccaagaagattggtaacaaatgtcaaaatcataaggaataattataatacaaagtacattttaacttattaacatatgtcaaaatcaatagggtacttttgatacgtccggtaaattagtgttctagtacagccctatctctgttcttttctcattaaattggatttgaaactctcattattgtaggcatggaagagttttaggccgccaaggtccacatcattaatagtttaggtctttaatacagtgacattacatcattaatatttaggtcccaatttctggaaattctatctggttggaatttaggtcatcattcttgacaattttttctcctcttttgactaaaatccaaatcatctttcctctcaaaactattaatgtaatactcttattcacattaggtcatatgttaatgttattgtaatatactaattatacaaaactaggtagtttctttctttactgtagtagatcttaaaacataagataacgacataaatcatttagattattagtagtttgattaattactataatttatggtcttaaggttattcatctttgtttatgcaaacaaaatcatatgattagtgtagtaaatacatatcctttttgtactatcgggtttagggatcaagataaggtccttgttttaactgtctttacattatatccaaataaattatggaaatgattcactgacacaaataatcgaattaaacttaaagtcttaaactatacataaaactacagattggtctaataaagaaattaaaaccaaccaacaactccataaagatattctactatattcatcaatttgactagtggttgctgacactagatttatgattcctttcatatattttctcttggtaattggtatgtaaataaaattctccaaatatgaaagactgaaagtgaaatgtaatcagtaaaccgagtaataccggaattttaaatctgaatgtccgttttacatcgaccagatctgtcacgtgttaaataagaccgggtcaaaaatataagacgctgacttgtaacggttcgatttcgatttgtgcacgaagcgggatatctaacggtttaaattaagccacgtttaaagattccttctatactggacaaagtcccctataaaaacctctgacccaatcacatttctcggatccaaaaagacgaagaaaaggaaaaaagacaaatcaaagagagacgattcgatcgcatcaatg

SEQ ID NO: 28865 - DNA, 3003 bp, Unknown; identical to SEQ ID NO: 15516
  misc_feature (1)..( 3003): 2750-1469P.txt file - cDNA_ID_2999124; gDNA_ID_2926228; Annot_ID_142583

SEQ ID NO: 28866 - DNA, 3000 bp, Unknown
  misc_feature (1)..( 3000): 2750-1469P.txt file - cDNA_ID_2999135; gDNA_ID_2926228; Annot_ID_142589
acctggttgatttagtaggaaagccaggtcacttatgggagcctgattccttgctaaatggtccttcatctatctcaatttcttctcctctgcggtttccacgaccaaagccagttgaacccgcagtcgattttaggttactagccaaacaatatttctccgatagccagtctcttaatcttgttttcgatcctgcatcaggtattcccatacaaaaaacctgaataatatgttaactttttgcatgctgcttacatctcgttttgtatttcccctaaaagagtaatctcctatcatttagggtatttcttgatcatgtctcagtatctgaagtgttagtagtcttagaatgattctattgtttgttttcttgtctcttttcactttagttgtttttggctgttgatgtgtatgtttgttggtgggttctttgcctaatgatatttaaggttaaacttgttagtctgctgttcaagcttatgaattctagtgcatttatgtgcaagacttgtcttctggactctaatttcttatatctgcttgtttgaatggttgtagatgatatgggattctcaatgtttcataggcaatatgataatccgggtggagagaatgacgcattggcagaaaatggtggtgggtctttgccacccagtgctaatatgcctccacagaacatgatgcgtgcgtcaaatcaaattgaagcagcacctatgaatgccccaccaatcagtcagccagttccaaacagggcaaatagggaacttggacttgatggtgatgatatggacatcccgtggtgtgatcttaatataaaagaaaagattggagcaggtaataattttacggaaaaattaatgattcggtctaaaaatgcaaagaaatatgaaattcttgaggaagtggttttgctttggactctgttctcgaacaaaataaggaaaaagtgccacccattttgagattacattcttctctgttgcctttaattcttccactctaatttgagcgactgctctttcaggttcctttggcactgtccaccgtgctgagtggcatggctcggtaagaacttttttgtcagaatttacgcagctgaattttttttcgctctaaaaatttggttgtgacttttggatctgcttggtattataaaaggcaaagttattgtatatgtgactctccgttctgtcagaaattaaacacggacaaaaggtgtcccattttagatgtatatgtgtctttatatcataaatttgtcttcctgtttgaattttacaattctatcactagaagaattctaattttgattattgcagtaatattctctatcaatttcaggatgttgctgtgaaaattctcatggagcaagacttccatgctgagcgtgttaatgagttcttaagagaggtgcacaaataaaattttctcttgattttggtaatgaacttgttgtattaatgtctccaatgatcttgattcgctgtcaggttgcgataatgaaacgccttcgccaccctaacattgttctcttcatgggtgcggtcactcaacctccaaatttgtcaatagtgacagaatatttgtcaaggtacaattacttggatttggaaggtttgatgtactgagtgtagaattttggcctataatgactctaataccatgatttctttcaaacagaggtagtttatacagacttttgcataaaagtggagcaagggagcaattagatgagagacgtcgcctgagtatggcttatgatgtggtatgtttaattccttatgttacatgtatgggtgattacttcctgatcttggtgtttcttcacatggaactttctttccaattctctgtcacaggctaagggaatgaattatcttcacaatcgcaatcctccaattgtgcatagagatctaaaatctccaaacttattggttgacaaaaaatatacagtcaaggtttgaatctaaattagaaattgttgtgtccaatgttttgattttgatattttattcctcttgtgagacaagcttatatataaattatgatttttaattctaaattggtttggagacattacaaaaaggcgttaatctgctgaaacttaaaagatacagcagcctcaagctgtcgtcttaaaaacaatcagaacattattattctaactcctcaatttgtcttgaaatttcaggtttgtgattttggtctctcgcgattgaaggccagcacgtttctttcctcgaagtcagcagctggaaccgtaagttcagtttgtttgaaactaaaacacgctgaacaacgtaactttcttctaggtcctatttccaatggaagctaaataattactgactttgatatatcagcccgagtggatggcaccagaagtcctgcgagatgagccgtctaatgaaaagtcagatgtgtacagcttcggggtcatcttgtgggagcttgctacattgcaacaaccatggggtaacttaaatccggctcaggtactttccactctaaacatctcaaataataatgatattattttgcatttggaagtccctcactctacatttcataacatgctatatatgatcatacaaaaaaatgttccataggttgtagctgcggttggtttcaagtgtaaacggctggagatcccgcgtaatctgaatcctcaggttgcagccataatcgagggttgttggaccaagtacgttaagattttctatctcttttttgaattcttcttgaatagacttcatgtttatgtatgtgtttcattaccagtgagccatggaagcgtccatcatttgcaactataatggacttgctaagaccattgatcaaatcagcggttcctccgcccaaccgctcggatttgtaaaatacccccggtccattcaaaagttgttataatcatgatatgcacatatactctcagcattcttttgctgcccaggagggagacactagttaagatatagctttaaaggtacattcctcatg

SEQ ID NO: 28867 - DNA, 3003 bp, Unknown
  misc_feature (1)..( 3003): 2750-1469P.txt file - cDNA_ID_2999139; gDNA_ID_2926228; Annot_ID_142591
gcttaacaggaacaaatacccagaaacgatgtgaaacggtttcggctgaacttggcgaagtccgtaaagcagactcgtccggtacaggatccagaaagttcggatcgtcggcacaagtagcctccgacgaaagccttaacgccaatgcaagctgcagctgataactctcctccgtctgctgcgcccagctcttcccagatgaagaccctccagcggagtccgccgccatctgtatcctcaaatctcctccaccaccaccaaatccaagcctaaacccatcatcttgaggaaatccaacagattcgatctcgttagccgccgcagaaagcgtaggcatgtaataatccccagacaaagagctctcaccgaaactactcccactggattgcctttgcaaccctagagacgaagcatacatattattcccaacccgattcggttgattattcaacctatgatcaccaccaccaccaccgctaggatcccaatcaaatccgcctctctccgccttagctttcccggtgttcccgctgttatggttgctcctgttttcgctcgacaaggaatcatagtgaggcggaggagctccggtgacggaaactgacacctgatcgtcagaaaattgactaagcaaagtgtaattagatcttctaccgggcatttccatggaaaagagagttatcgcgatctagatgagagagtttcccgatcatataaacatcaaaccctaggaaaccgccattgttgaagaagtttggcgagctagctagccacttgtttctctctctagtttttcattttttttttgtactttttaaaaaagtctctctctctctctctctctctctctctctctaatggaattggattttttttttgtttttgcgttatcataggaaataaacttactcggtgcgtttctgttgataatttcgttatattcctcttttgtcctcctttttatggaactttgacattttttttattttttgtcaaaacaattctccaatttagtttgttttttagtgtattattatttgtctaatttttgtattcgactatgatatctattcatatgttttgtgctaatttaatcgctaataaaactgtttaaacaattaatttggtatttcatattttggtgataagcaactgaaattggaagataaaaagtagtatcgtagtgaaagtagaaaacgcaaagctaaaagaggaacatacacagtgtaaaatactaaaccatcttgcctatcaaatccaaatactatcaaatttgatcttttacaccaatctgaatccgtaacattggatccaagtttcgtatacctaaacatgaaattttcattcggctctacgtagtctaaaaaactcgacataaaataaataaaaagcctttataacgtccacaatatttagaatagaaagtgagagaatggactataataaaataattggagtcgagggggatgtattcgtgtatgcgaaaatggatgggctcttctgtctttatattccttaatttgtctattcaaacacattcgtatttctggtcttcggcctgcgacttctataccatgcatgcatcttatctctctctttttttttttttttcgttttcttttctacttctccatttttttttaatttggttatttttattgcctttatgttttttgtgtattatatataaatgaactaataatacttcattatgtttcgtgttattataagtgaatttttcacaaccattacaaaaaattatcttttgcttaaaagttaactttggattatagtacttcataaaaatgtaaagattttgatcaagtacttatcaacgcagcttgggtagtcaatgtgctgtcattaatttatctatcaagctatccacgcagcttggacaataaataaatatttaaattctattgcatatttatatcatttgatccgctaaggttcatcgaatactgccaggttcattgcactcaacgcatttttgtcattaacttacgttttttagccatggctgctgagaatataaagttgctactatgtaaagaaacttttgggtttgatcatatttgtgcacaaaaaaaaataaaaaaaaaatcatacttttaaaactagtattaatccaaaaagtgctaaaacataacaaaaaaaaattctccttaactactatacaaacatatatttttttatgcgcataaattaaaacttaacaattgattatgatcacatatgttgaaaaaaatcgaaattatgtgtgatatgtaaaaccggagtataatattggtaaactataaatttaagagcattggaaaatgttcatgattcatgccgagaactcttctaaatctaaacacgagaggccccgaatagatctaactaaaatgaattgtgtttaatataataatagtgttccttaattctcactcgtgcaactatccatttaataattttaattattcgtagtcggggaccgtacttagttttatcatataaactcttcacagattttgttaactggtttttctttggattagaaaaaaattaaaactttgcgatacattatgctcaatttatccgtgggacttattttgaggaatggagatagatattgtcatgaagacatgaatatatagaccccacatgttgacgaaaactccgtcagtcaaataaagtgttaaaagtccgttacgatccgtcctgacaccgttaaaaaaagccgtcaaaataaagtatgggcttgaaacgttagttttgttgggctaattttaaaatcatggcccaactaaaggagatattcgagtggaccgcgtaacagaggatccctaaaatcccttcctccgattaataaattccagcggacattttagccttctcacatcaacacgccctaaaaccgctctcgagagacgaatcgctctcagcttcttctagaaccttctccttctccttcgacgcatcgtcgccttcaagatcacactacctcgcacaacaatg

SEQ ID NO: 28868 - DNA, 3000 bp, Unknown
  misc_feature (1)..( 3000): 2750-1469P.txt file - cDNA_ID_2999145; gDNA_ID_2926229; Annot_ID_142599
gagactcagcctgcagagccaacaccctatctacaaaatccatgaagctctgcctaatttcatccctttccggcttgccctcttccggatgaagaaagacaatgtcatcaaaagcaagattaggaacaaaagcaatgagatagcgccacctcttggagagaagagaagtcaaagcagcctcctttgtggtaaggaatgacagtatatgagaaagaagctcgtctggtagactgccaacacgatccatctcctctgcacgaaagaagaggtatactaagtacacaaatctcaaagcttttataagaacatcagcagtaacatgattaccaaacagttccagtgataatgatctacaaacagagcaagtggaaggaaatacgtgaaactggtaaaaacaattgattcaaacatgaaatttaacagatgagtaaagtccaggcaatcatggtttgtgaaatatcgaaatagaggaataagtgaaacttgaaatcaaacagagcaagcggaagcccaattaacaacgcaaacagaaatccaccaaaaggaaactttgaactaagaaatccccaaaaggagaacagaatcagtagaagcagaagagatgagtaaaagtcggtatctacctcgttccaagccccaaatttggtgatttcagtgaatgcgtccagcgagaagggagaagggagaaagtgagagttgggagtgcttaaatcgctggttcgcgaagatgcccagcgagaggtaaagggaataaagtctcaatttttaaagaggaagacggcagtaaaccaaattgagggttaaagttgaaaatgtcaattttgattcaatgttacccggttccttgaaatccaccggtttaacagaaaagtgaaattgagtggtttaaaattgaagatgtcaattggttctattctacctggttcctccaaaatccaccggtttatctcggtaaacaaatcaggaggacttcttgatttttggtttaaaaatcggtccaaacggaaaagtaaatcaagccaagaatttagaactaaaccgaaccaatccaaaatattacctaaatttattccttgcgttttggatgttctcatattccaatgcatttggaaagcgttgtgattgattgaaaatttgacataatattataattcttacttccggatttttatatagatgagctaaacatgacgaacctttaagttagggtataatatgcgtatgaaatcgtaaaaatagtttttgtttcatcctataaacagaactagcaaaaccctcactaaaattacagtttgtagatttgtcgcaaatatggtcgtcgtcagtcgtcactcgtcagccctgtgaagttttgtactttcggtaattttaactacttcaatttcacacttttcataaaaaatttttttccgtataccatgagtgtgaaattcatatttgctgaaaattgctggaaaaaataatcagttcattcttttgacttcttgaacgctgagttagtgtaatatttttaaccaaattaacaaacagataacaacgaaagagtccacgttttagtacacaacgaccaaccttcgtgtctcaatacgcacgtttaggacttagaatggcgttttcgtaaatactaacttatagtcgtaattaaaaattgtatattcattttccctctataaatgactctgtttcgtttcctgcttcacttaagaagtagcagaacaatggcgacttctcagcaatttttaaaccctacactcttcaaatccttagcttcctcaaacaaaaactcatgtactctctgcccatctcctttcttgcaactcaagtccgcctccacaattttcaattacaaaccacttacttcctcctccgccacgatcatcacacgcgtcgctgcatcatcctccgattcaggcgagtcaataaccagagagactttccacggcctctgcttcgtcttgaaagacaacatcgacaccgatcaaataatccccgccgagtacggcactctcatcccttcgattccagaagatcgcgagaaactcggctctttcgcgcttaacggcttaccaaaattctacaacgaacgtttcgttgttccaggagagatgaaatcaaagtactcagtcatcatcggcggcgataatttcggttgcggatcttcccgcgaacacgctccagtttgtctcggcgcggcgggagctaaagctgtggtggcggaatcgtacgctaggatctttttcaggaactgtgtagctacaggtgagattttcccgttggaatcggaggttaggatttgcgacgagtgcaaaacaggggatgtggtgacaatcgaacacaaggaagacggtagtagtttgctgatcaatcatacgacgaggaaagaatacaaactgaaaccgctcggtgatgccggtccggtgatcgacgccggtggaatcttcgcttatgcaagaaaagccggcatgattccttctgcttgaatgtaatcggatccataatttatcggttctgagtttaatccggtttggtttatttggttcgagaaccggtactaacgaaataaattattaccaaaccaaaatttcttctggttcgactttgtttgccacgtggaaacagcgatataaacaagtgcccaaaaaggcttgcaatggtttttgtacaagaccttcgttttcttcaatgttcctcttttcttagatgcatttgcatgtcctctcgaactgaaagtttaaggttcttcttctgccttcgcatctgtactaaggttggtttcgaagatttctcatctctttcaattgtaattcttatcacatatactctatctgttgtataattctgtttctgttgaagttaagtgtgtttatctccgctttgaaactccttttcctgtttgtattattttgcagtgggtgaatgttagttgaatttgtggtttgaagtctcaattgaaattaactgagtagtgaaaggggttttctagggtttgacaagaggatg

SEQ ID NO: 28869 - DNA, 3000 bp, Unknown
  misc_feature (1)..( 3000): 2750-1469P.txt file - cDNA_ID_2999149; gDNA_ID_2926229; Annot_ID_142603
catatcccaattcaagtaatacatgctgcaaaatgactcaactagtcaagaaaccattgagattcatcggtattttgataagtaagtgaaaaaataccaaatcgaaatagcgtctagagaaattgtcggattggagagtaaaccagagataatcactagcccttggttgtaccatatctccaaactgaagaatatttcatttcaaatttggtatcagctttctttaaaccatatactcaaaacgctcatatcaaacagctttatgtttaccatagcataactgctgaagctaccgtgagcttgaagtaaggccatatccctctaaatgccctcgttgaaaaccctgtccatgtctccttacaattcgggctcatcaagatatacataccattcacagctactagcagccaccatgagaaactgagaatcagagccgccccaagcaagccgaaatccagcacgttggtaaccagccacgtgagtaacgtgtggagcaagaaaactcctaaggacatgtaagccaaagggttcactatgttctgagcctgaagaaacctctgcatcgggcaagcgagggcaaatgcgtaaatttgtggaatcattccacgtgcaaagatctgaccctcgtgtgctatggctacggattggcccattgttttaaggattggacccgagtaccagtagaggaacgtgaggaagactgcagctgcaaggtgcaagaccatggctcgttggcagattattcccattgatgagtactgtctcgctccgtacgcttgaccacacactgtttggaccgcgctcgccattcctaactagtcaatttgattaacaaaactttttaaaactcaagaatgttcgataaggagaaaccgatcaacatatgaagtgtacaataaatatagaattaaacgacgttgtttcgtgttcttcactctgttttttactttatgaactcaaatgtgccttcgtaccatgataccgtaagctaggccttggattccgacggtggcgatggaagcgccggcgagctgaagagaaccgagatgaccggtgaacatgacggtgacgaagctgagcatgtaattcagaacagagaccactatagaggctccagagagtgtccatagaagctttgactcccacactgccagctttagccaccaccgtggtgtcactgtggatccacgacggcggagaaactcctctatctctggcgaagaccgttcagttatctgagaatccgagtggagtcgtgtcaataacggctcgtatgtctctgtggagctcatggtccgtttattagttcctctgttttttttttcccttttcttttggtgttgttgttctgttatacgcctaccggggcgtctttttattacgactgactgttttggttatgttgggagttcgagtcgttgaccaaaattgaatcaatggttaagatctcttgtgactgtttggtcttaatcttgatgatcatagtgtaacaaccattctctggttaccgtaaatggacttagagattttactgccgattaatatttttcttgtatatttgaaactttttcttttgtaaacgatagctaaaagtgaaacttgttgacaaaatgtaaaaagagaaacatctgatctgcactgaaacttatgtgtgtaaaaagataaagagtaacactaggcatgtcacatgcaaatgcacattgggtgagaaaaaggttgtaagttttaacagtacctaatgttcttcaacgaatgtgagtagacccatccaacggctagtctcacattgacacattgtacatcctccaaatgaaatgggggtaagatgtattgttttccacgtagataatttatcaagtaatgattattaaaaaaagactgtgatcaaagaacttttcacagaattaatatttaatatgttactagtactacaacttaccacttatatgtactcttttttctaccctaatgataatgagcttttgagaccaaaaggaaagcttttgacttttgagagcagtgaacaaaagaaaaaaagaggaagaaaagcttttgagaattgtggcccatcaaatgttctacaggcccattttatcccgcgctactcctgaagcccatttgcaaccaaccaaagaagtagctattattttaaaatttaagaaataattcgcatttgatgaactgtacctgacgtaagatgaaatcaatgagttgtctattaggtcggattggcccactaaattcagaagattactcatcattttttttctaagctaattattataaaaagtttttgttctccaatatcttttataaatagtgttccctaccatattaaaattttaatacaacatactccaattagagtatttgcatgtatagaagtattgttttgttatgattaatatcatttggttctttaggatatttctaatttaattattttatgtacttttcacaaattcattcctatccatgatcataatggagtttaaatatgaagttaggatattactattttgaatataatcattaaagaatcaaataagaaattaaaaaatagtgaaaaaattcaatcaattcatttattgaataattttgaaattttgtcctgttattataatatttgtttaatagtctacataataaacccaattatttacggaccaaaaaaaacaaaagcgtccatcgaccgtgtaaactagtaaggcgtgaaggactactagctccaggcaaagtctcggtttttgtattgtgtgtgtcacgtgctggtttttattttatttttcacttattaccacgcgcgtttgagagagagagagagagacttaaccacaccaacgaaccatttaaaaccctagaccttcttctcttatacctctctctctctttcgtcttcgtcgtctcttcttcctcctgatttgactctctcgagtctcgtcgatttcctccgggaggagacttgaaattcgtgactttccgattgtgaattccccgatg

SEQ ID NO: 28870 - DNA, 3003 bp, Unknown
  misc_feature (1)..( 3003): 2750-1469P.txt file - cDNA_ID_2999153; gDNA_ID_2926229; Annot_ID_142604
aagagttgataccatggcagaaacataagcaggagatggcaacaaagatatgaactctctatgactatcaaaattgaccagagtagataaaatctacatatcactattaagtggcaaaaggtgtagaggaactataaatggccagggttgttttcagaggaagaactaataataataataatatgattggccaattgccaatcctatgcttataacatgaactatgaatgagaaggcaaaaacctgagctagaattcttacgcacatggtgatttcagacaaacagattcataacataaatttaagttgataaagcagactaactcgtattttgaagatagtatcctcaagacaaatagcgctccataaacttgtggtttttgcaagttttgcttcacccagtccaggagttcgggccattgctcaggatagtcagcgtaaattatggtcttcaggcactctcccatctgaactctgcatcatacacaccaataacgagcaagaataaggaccaaaaacagaggctagctttcctatctatacttcattgttaacatgtatgtgtaaatcaagcccatttcactctacataacacaaacatatcagtccgtagacaaattaaccaaaaaaagtagattggtcttaacgactgctgcaaggtgtacacaaactgctacctcaaaatcgggggcacttgagagacaaatacaagaatctggttcctgacaacattcttatcacttggcaagattatgttctggtcacctgcataacaaaacaaaaacaatgtaatccaagcaaacaggtaacataacaatatttgattaataaacaaactaaataaacaattaccagaatgaggttcccagtgcttagcaatgaaattcttgaaatggatactagcagattggcgtacagaaagatcagagccaccatcaacaattatttgcaatatccttatcaaatgctgtggagtgtgctgcaactgaaaaaaaaaaccgaaatttcaatcagattttaaaccttaatagcagataatacaaccacagtcaaatcaagtcaatctaatgaagaaaaaaaacatcgatactccgaatttggataagcttagttctatcacaattctaaaataataaagagagaaattgaactaagcagagaggaaggaataaaaaccagaaaaagaaaaatttggtgtatacctgattaaggctctgctcagcagctctgcgctcgtcaggattgggactgaaagcagccgcgccaacgattaaagcgaggctaggcagatccatcggggaattcacaatcggaaagtcacgaatttcaagtctcctcccggaggaaatcgacgagactcgagagagtcaaatcaggaggaagaagagacgacgaagacgaaagagagagagaggtataagagaagaaggtctagggttttaaatggttcgttggtgtggttaagtctctctctctctctctcaaacgcgcgtggtaataagtgaaaaataaaataaaaaccagcacgtgacacacacaatacaaaaaccgagactttgcctggagctagtagtccttcacgccttactagtttacacggtcgatggacgcttttgttttttttggtccgtaaataattgggtttattatgtagactattaaacaaatattataataacaggacaaaatttcaaaattattcaataaatgaattgattgaattttttcactattttttaatttcttatttgattctttaatgattatattcaaaatagtaatatcctaacttcatatttaaactccattatgatcatggataggaatgaatttgtgaaaagtacataaaataattaaattagaaatatcctaaagaaccaaatgatattaatcataacaaaacaatacttctatacatgcaaatactctaattggagtatgttgtattaaaattttaatatggtagggaacactatttataaaagatattggagaacaaaaactttttataataattagcttagaaaaaaaatgatgagtaatcttctgaatttagtgggccaatccgacctaatagacaactcattgatttcatcttacgtcaggtacagttcatcaaatgcgaattatttcttaaattttaaaataatagctacttctttggttggttgcaaatgggcttcaggagtagcgcgggataaaatgggcctgtagaacatttgatgggccacaattctcaaaagcttttcttcctctttttttcttttgttcactgctctcaaaagtcaaaagctttccttttggtctcaaaagctcattatcattagggtagaaaaaagagtacatataagtggtaagttgtagtactagtaacatattaaatattaattctgtgaaaagttctttgatcacagtctttttttaataatcattacttgataaattatctacgtggaaaacaatacatcttacccccatttcatttggaggatgtacaatgtgtcaatgtgagactagccgttggatgggtctactcacattcgttgaagaacattaggtactgttaaaacttacaacctttttctcacccaatgtgcatttgcatgtgacatgcctagtgttactctttatctttttacacacataagtttcagtgcagatcagatgtttctctttttacattttgtcaacaagtttcacttttagctatcgtttacaaaagaaaaagtttcaaatatacaagaaaaatattaatcggcagtaaaatctctaagtccatttacggtaaccagagaatggttgttacactatgatcatcaagattaagaccaaacagtcacaagagatcttaaccattgattcaattttggtcaacgactcgaactcccaacataaccaaaacagtcagtcgtaataaaaagacgccccggtaggcgtataacagaacaacaacaccaaaagaaaagggaaaaaaaaaacagaggaactaataaacggaccatg

SEQ ID NO: 28871 - DNA, 3003 bp, Unknown; identical to SEQ ID NO: 28870
  misc_feature (1)..( 3003): 2750-1469P.txt file - cDNA_ID_2999153; gDNA_ID_2926229; Annot_ID_203606

SEQ ID NO: 28872 - DNA, 3000 bp, Unknown
  misc_feature (1)..( 3000): 2750-1469P.txt file - cDNA_ID_2999157; gDNA_ID_2926229; Annot_ID_142606
tatagcttccccttagtaagagtttactatatatagaattagttgctttattaaatcatttcctcctagattgttggagagggttgtttggtttaattattttctaatcattaaactgttgggatttcgaataatcttttctaagttgattgctttcatcatcctttttcctcaaatctcctgttaatcattatactaattatgaatcaaatcatttcttattcacttacaaaaaagtaatatattctttatttaagtgtctttacagatctgacatggaacaagtgtttgctgattggaattttgaagataattttcacatgtccactaataaaagatcaatcaggtatatatcaattttccaattcaagtatttcataattatataccaatttcacatcttaatcatagctatttaagtattgtttgtttaaaatatgtttgtaaacattcatatgttgggacagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaagggtatacatatactatttctgactagttgatcaaccattcagtaataataattctgatgtgatctttgtctattaattacagaggaggagagatcggatcaatgaaagaatgaaagctcttcaagaactcatacctcactgcagcagagtaagttttttcatcacaaaaaaactgagttaattaagctgtaattgattggtgtgtttaaatatggttttgtcttcttctttttttgtgtagacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcaggtcagttgcagacggcatcgttttgaagaaagacaaatatatttatttaatatctgacgtgtcatgttttaaattagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccatattactgctcaaaacgcatacgttatacaaaaaacggaaaacgctaacgtggtttactccaccacgattcgtacgtaacgactagcgagtcccatacctactcgatttttagtttcctcaagttaacggtgaaatcaaattaccgattatgtccttctaaagtgacacgtgtcttacaagaggagcgagtttatcctaatcacatactcgagcgtgtaggtttccgattaaagcgaagcagaaaaaaattactaaaataataaaaacgtatagaatgtgattaattaagtcaaccaataagcatcttacaaatcagcactctgaaaacaaacacgattattaatagaaaaagctgcgacccgactcctgagcctctctctttctatcgctctttgattttgtttctcattgttttgcttcaaattacgcattcgaatctgatcttcgttgatctctgtggaagaaacagataagagaaaatcgcatgaatttttttagaaaactaggttttaatccttcgattgcaagctacttcactaatacgagtcttctgatctcaattcttagtttttctcctcaattgccgatttctctctttcttttcgagcagaaatcgttagatcctttatcgctgtgtaatagtagtactaattttaataatcttgagagtaattactccgttcattgttgaatcatg

SEQ ID NO: 28873 - DNA, 3003 bp, Unknown
  misc_feature (1)..( 3003): 2750-1469P.txt file - cDNA_ID_2999173; gDNA_ID_2926229; Annot_ID_142611
gaatcaaattgtacttgcagcctttcccaaaattctgtttctggcaacttttctcctgcttctctctttctggtatgtatattctcaatactctgatcatattgtgttgtccctgattattttatcttaataatgatctgagataagacaatgatgcttcttcatgttatagggtagatgtttgccatcagggaaatggagaggaggatgatgatgatgatgaagaaaatagcatccaacaagtgttgcttgaaaaaagcaagagcaagccaggttcttcgaatgcaagtgatcgtagaaagtgttgctctttccatggtattcatgttggaacccggcagaagtttgttgttgcggtatgggatactttcagttttgtgcattaacctctagccaagtcatttctatgatctttataaaaatgtttatcttttttgctaggcaattattcttgtgttcatcttaatgatatcatttgcaatccttatctggatcgcttccggaaagaatcctatgaattcttcattattggctgaggtatgtggtattcctctgcacattgatatttcctctttcactaagttcttaagctcgagaaatagaagacttttgtctatattttttctggttttatgataaactcacttccttatataggtgtatgtcgatatttttgctgcaataatcctaatcactggaggaggaatctgcttctatggtaagtgatttcttaagttcttttctggtttcagctattcatatttttcttctagcaattcgtgagatgttttggtcagtggtttactggcttattgctatgattgaacagcgtatattcacaaactcttttatgttctttaggcctgcgtctgctctttaatctaagaaaggtgcggtctgaacaagtttcatcagagatgcgaaaggtaactaatgattctttggctcaacaagcttttctttctttgcacatgtcagtcgaatccttaccctgaaagtacattttaaccatttataggtatcgggtctagcaggagtctcagttgtttgcttcactgttagctctttaatcgctcttctcacacacattccagtaagtcattatcactcaaaaaagtatgtctgtaaaccgaaacctaacattcgtcgatacatttaaccaaaaccaatctttgatctcagctcttttatcattggaacccaagcaaattacacggcatcaaagcattggttcttctgatcatatactatttcataggtgaagatttttttctttcgttttgttgttttgaagaccttcaaatgcagggttactgataagaacgctttttaaaggttccaccgtcccattggctttcgttttatgggttttgcgggagttaccccctcaaaacattgtgagtaggcaagaagacaccagaaggattacttatgtcaactatgaaactgttccaaggcaacctcaaggtcctcaacaagactgggcctccgccacagtgtcgaaaaatcaggtatacaattctcttgatgaacatctaaattaggaagtcatgtctgacacatacaaggagttttatagtaagctgtaaatgcatgcatcagataaactaggggtgggaatataaaccgaagcaaaccacaatatttatagctaactaactctatttagataagaaaaactcaaaccgtatgctcacttttaagataaacgcaatgttgagagcattcgagaaaggtttgaacgaattgcggtctgaacatgaatacatagttgaaacactacgaaaaatcctcaaatgagaaagaagttttcattctattagtgacttctgaggttatttcagagtttcctttttatcgaccatagattgtttagggaggtcacttaacagtttttggttcggaaacgacggcgcaggtgtctaaagcaagtcctatatgaaccaaacaatcatcataatcattgacctgaagcaaacatccgccaatcttcttttgtagttaccgggaaaaagcctcgtgggattgcagaatggttcttaggcccaatgtggtgtgttgtggtggagtgaatgaaagtggaaacaagctcgttttcttctctctgagtcgccttggaatacaaaaatttgtttataagatagaaatggaggtttgaatctgagaaagctgtctgtaaatattaacttttgattgcaatttatagtttagcatcatgtgttggggggacttgtggatggatataaaatgtgttccaaggaagatataattttgtcttcctttctaaacagcgtcgtttaagctgctttgttatcatttacatatacgacgacgcatcattctggttttaaagatggcatattacgtttgagattaaacgccaccgttttcgaaagatagcacgggcattatacgatgtcgtattgcttcctctttcgaaaatttgttagcgcgattttgttaaacttttagcgccattttttttcacattaaaaatttgagaccccgaaacggtatcgtttgttggatgttatcctaaaattgacggatctgatatgaaaaaaaaaatccttaaaaaaaccgtttgagaactttttggatatttgtggtcttctcttttcgtctttcttctccactgtcaccttcctcgctaagcaaaagaatttagagagagcttcgtactatgcccagagaaaaaagcaaaaagcgagagccaaaaagataagaaagatcaaaagatgaaaaagcttagacgtaaaaaagcagaaatatatgtatatagaattaacaagtctctcgaagaaaaccctttagccatctttatcaatctcttttcttttgcgttctctataaagttggtataaaaggagatcaattaacaaatatgttaatcgattactttgatttcagtgagatttttgatttcacgaataaattattgggtttttgtggaggaggagagggtggtagtagtaattatagtttcgattcacggtggatatg

SEQ ID NO: 28874 - DNA, 3000 bp, Unknown
  misc_feature (1)..( 3000): 2750-1469P.txt file - cDNA_ID_2999184; gDNA_ID_2926230; Annot_ID_142616
aaggccaagacacataacttcaacgtttgatttggagcagtattgtatcgataccgtgatgactatttatcattaccatggaggttgtcaagttggaaaagtggtcgacaacaattacaaagtattaggggttgatgctttgaggatcatcgatggatccacgtttctcaagtctccggggactaatccacaggccacaatcatgatgctcggaaggtaaaaacacgcagaaaccaattgatacaaatgatctaaacatgtttttaatctttttttttcaaaatatgattgttggaaaattgtaatgtgtagatatatggggcagaagattcttcgagagaggatggctttccgaggaaaagaggaagaaacatgagatttctaagtacatatgctaaaagatattgttgtttggtgttcgttgctccaaacgaagacattcactatagtgtatatcacatatttcatgaatcttacaaatggggttttctgttgcactaaagtcatttataaccgactgaaacacttgatacatatccttgttgataatggccttagacaataaaaggatgaattgccttattgttgcaaatttaagaaatttgttcttagtaaggatagattaaatgttgtaaatatattcttatgtgttgatatatattcctgataagattgcctaatttatcccgacattgcaatgaaaatccaaatgaggtgtaaggcaaaaactatcaaggttcaagcgtattttgcaatcaaccttcatattcattttttcccatgccatcgttgattatatttttactttttagtaacatacttctgcacaagtataacgtcaacaaatttgattatgaaaggtcaatcctcacaagtctcactcaatgtatagtaatagtgaacaagacggtagggcagtcaattgcatacacaaaattttaaaaatggaaaatttattatttgggatctggcctactagagagctccaaaatggagctgaaaaggactacaaatcctttggtgtgctccaaaattattttcatatctttttcgcattctttgtttagttggaatatatatttcatgatttttcttaatccaatctgctaggatcatattcgatgatgttaaatttgaaaatatttgttctcctaattgaataacgagttagagaattatcttttagttatgaggtatgcatggttgtaaaaaagagattagaacatgtaaggttttgaaagaatcgtatatcaaaagttaaatcaataacataacatataaagtatataagatgtgacgtcaaaaataaacaatctaacatgcatatgtacgcctaacatgtgattgcagcttaagttagtttatactcaaaaaaatattttattaaaagatctttaataatattttcatatggtcctaagtctaccaaaatatcaaataatattttctatactatggttttgaatcctagatcattcacacagctacgtaccatatgcattgttggtaccaattaataagtcaatgacaaatttaactaatgcatggccctttaaggtttcgcaatttttttaatcccataacgcccagtttttaagtattgtgccgcagcaatgtcaatttatttaagcaaagtgcccatgaatgtgcttgtgcagactctttaggtcaaaacaaagacagcatagaattacgtaaggatgaagttagattacgtacgacgcgtagatatgccggtgaatttgtaaattcataataataaaaatgattgttctttctttcaaccaatcaaaacccgatggctttcaaattacggcgaaaccgttactagtcaaccttttaatatactattcattcctaacatacatttccgaaaatgttctctgattgatctgactaatatggataattaactttacttactataaaatttgctcttaagccgataaaaaaataaattgatagatcaaaacttcgacggacattcgatcgtgggggcgaaatttgagctttctctccttttaattagataaatcatcagaaaacgtgggctgtgtgaatgcaacaattatggaatacttctatctacagtatacagtatatatacactaacaaacatctgagaaatattgagaaaagtatacataaataaattaaatgaaaatatgtattaatggggcatattcccattacatccatgactctacccacatggcaaagacttggattgaaaacgaagaaattaacaacgaagcaacaaaacaaaaacaaagaaaaaacatccacgttgaattggtcatcagaaaactccctccacattttcttaatccataatgccacaaacacaatcattcatcttcaatcattccattatccaacacatcataactatattccacgtggcatttatacccccaccatcttcaggttttctcctttgtaaaaaaaaaaaaacacattgcacaatagagagagcgagcctaaacgattttccacaatagtgctataacatcaaaagtctttttcgacggtgtctttggcctcttcttttgaatcctcttagctctggcatcttcaggtccatagattcttctattttatatcattttttatgtattttactatacaaaaatatctaattgataaatggttactctagtgttatacagttgaatactatagaaaaaattagaaatagatactctttcacgagattgtttttttcttattgtcaacaagaagaagtaaatgcttttactattgtatccttctttaatttattatcgggccaaaccacggggacacgcgcttttaacaaaagttgaaaagtcatgttactcctcctctcaattcgtctcctccgccatgcgaactcaaactcaaagctctctctaactttttgcttttcttcgaatctgtgatagatcgagacttggatttatcagcttctccgtgctcctttagcttctgctcggttttgttttttttagtctgacgatg

SEQ ID NO: 28875 - DNA, 3000 bp, Unknown; identical to SEQ ID NO: 28874
  misc_feature (1)..( 3000): 2750-1469P.txt file - cDNA_ID_2999184; gDNA_ID_2926230; Annot_ID_203622

SEQ ID NO: 28876 - DNA, 3000 bp, Unknown; identical to SEQ ID NO: 28874
  misc_feature (1)..( 3000): 2750-1469P.txt file - cDNA_ID_2999184; gDNA_ID_2926237; Annot_ID_203924

SEQ ID NO: 28877 - DNA, 3000 bp, Unknown
  misc_feature (1)..( 3000): 2750-1469P.txt file - cDNA_ID_2999190; gDNA_ID_2926230; Annot_ID_142620
tctcagcaataacttgctctctgagattattccaccgaatcttgctgactcttctaagcttcttaggcttaatctcagctttaattcactgtctggtcaaatcccagtgagtctctctcggtcttcttcccttcagtttcttgctcttgaccataacaacctctctggtccaatcttagatacttggggtagtaagtctcttaatctccgtgtcttatctcttgatcacaactctctctctggtccgttcccattttcactctgcaacttaactcagctgcaagattttttcctttagtcataataggatccgtggaaccctaccctctgagctaagcaaactcactaagcttagaaaaatggatattagtggtaacagtgttagtggccatatccctgaaaccctagggaacatttcttctcttatacatttggatttgtctcaaaacaaactcaccggagagattcctatttcgatttctgacctggaaagcctgaacttcttcaatgtctcttataacaacttatctggtcctgttcctactctcttgtcccaaaagttcaattcctcttcttttgtcgggaactcactgctttgcggatacagcgtttcgacaccatgtcctactcttccttcaccgtctcctgaaaaagaaaggaaaccatcccacaggaatctgagtaccaaagacatcatcctcattgcgtctggagcactcctcatagttatgcttatccttgtttgtgttctatgttgcttgctgaggaagaaagccaatgaaaccaaagccaagggcggagaggctggacctggagctgtagccgcaaagactgagaaaggaggggaagctgaagctggaggtgaaactggagggaagctggttcattttgatggaccaatggcgtttactgcagatgatcttttgtgtgcaacagcagagataatggggaaaagcacttatgggactgtgtacaaagctacacttgaagatggaagtcaagtagcagtgaagagattgagagaaagatcaccaaaagtcaaaaagagtttgagaatgagattaacgtcttgggaagaatccggcatccgaatctccttgcactcagagcttattacttaggccctaaaggagagaagcttgtcgtcttcgattacatgtctagaggaagccttgccacgtttctccatggtaagtttgatactaaagtcttaaagttaaagacaattttgctttacaagtaccattttgtaactctgttttcatatttgaaattgcagcaagaggaccagatgtacatatcaattggcctacaaggatgagcttaataaagggaatggctcgaggcttgttctaccttcacacacacgcaaatatcatccacggaaacttaacatcaagcaatgtgcttttggatgagaacataaccgcgaagatctcagattacggtctctcaaggctaatgacagcagcagcaggatccagcgtgattgcaacagctggtgcgttaggttacagagcacctgagctctctaagctgaagaaagccaacacgaaaaccgatgtgtacagcctcggtgtgatcatattggaactgttgactgggaaatctccgagtgaggccttaaacggtgtggatttgcctcaatgggttgctactgcggttaaagaagagtggactaatgaggtttttgatttggagctgttgaatgatgtgaacacaatgggtgatgagattttgaatacactgaaactggctttacattgtgttgatgctacaccatcaacaagacctgaagctcaacaagtgatgacacaacttggagagattagaccggaagagacaacagcaacaacatcagaaccgttgattgatgtccctgaagcttctgcttccacaagtcaatagaaagagtggagaatttttgtagtgtggaaatgttgcagagtagtagttgatttcttttgcaattctttaattcttccaagttgtttttttgttctttgtttgtttcagtgttttgaaccatttcttcatcagtttatgtttgtaaatagtgtctctttcatcaagtagtctctgtcttttgagcacagtgaaaaatttgggttttgaagaaggtactactagaaatgagtttcaccatctacagtaaaaatttaggtaagttttaaagcaccatttacaccatatactgaaaaggagaggacattgagaagattcaaacaactaaccaaagtccaacaagaatgaaagtttaggtacctatgtaaagaatgaaaatgctcacacatttgccaaaacataaacacataagagtacaaagatacgcactagccagaaaaatgtaaaccagtatataatcaaagttaaagcaacagccaacaagtgccaagatttcatttttagaagatgaaatgaaatggatttcaaagatggaattcttttaatctcaggagagaaatttgagaatttataatttttcatgactaatcaaattgttaaggttcgagattatttaaatccaataaaatttatattaaaaaaaattagtatcactcataataaatacaagtattaataattgtacaatttagagaaattttgaacagtctaaaaaatttctaaacactataagaattactattttcaaacctatacatattttattgagtttattcctttttctcactaagaaaaatgtattttctcttgacagaaaaaaaaaaagccgaaaaggaaaataagaaaaatccaaaaaaagagaggccaaaattacacaaataccaacggaaaaaaaatatctgccagcaaagcaatgcaccacacgcctgacacgcgcccaaacccacctctcaatcgtatccatccacgtgtcaacaatccacagcctcatcatcccatatcacctcactttatattccctcctccgccaccaccaatcgcctcaccacaaaaccctttctcctccaatttcgtcgcacacaggaaaacaaaatg

SEQ ID NO: 28878 - DNA, 3000 bp, Unknown; identical to SEQ ID NO: 28877
  misc_feature (1)..( 3000): 2750-1469P.txt file - cDNA_ID_2999190; gDNA_ID_2926230; Annot_ID_203626

SEQ ID NO: 28879 - DNA, 3003 bp, Unknown
  misc_feature (1)..( 3003): 2750-1469P.txt file - cDNA_ID_2999201; gDNA_ID_2926230; Annot_ID_142628
caaattgctaagcaattcggaaatatagaccaggaaacaatcttactaaaaatacccctgattctgcatgatcaactagtttcaaaggaggaacaataatatgcaagtcgttcggcttacagttaaaattcctaataagttagatgccactgtcacagcaagagcaagagcagcattaccaccagcaagctgaattggcaatatgataagtcagtggaacgcaagaaaaacagttttgcacaaaatattgattagacttatatcaaattgagtacgtgagtaagggcaacaccacttgataaggtggttggcatacagcaaaatatacccagccctgtaaagagcaaaaggacatacataagttttggactcctcaatcactaactcactactgagctggaactgaagaataaggtattcaaaattgaaccataaatgtaagaaacggatcaagattcaaagacaacgtcaaagtggaactgttggatacaagatcacaaaggcaatcagattactacttaataacgcagctatagttgatcaattagttgtcagatattatataacgagagacaatttaacaaaaactgtagatgtaatgtaaatcaatggaagccgatacaatataagcagtaacaagttcaggaaagaacgtggtctttgaagttttacttgacactaagtttaagatagagaaagagtaacctgtaacaagttcacgaggttggagttggaccaacataattagccttgagaaggatggagtgagcaacaaaatagagatctgaaagaaaaagagaaatagtttgcgtttaagtatgtagtataactaacaggagttaaaaaaaggaaaagcattaccaaaaggtttctattcattagattttcttattttcagaacttagcagaagagatctacagaagaggaaacattcacagaacatatgaaagctaaagatgagtcaagatcatactagcccaaagagtccaagaggccaccctttgacagcagcaccaatcgcttcggtacgtaaagtcaaccctgctccacaatacatgaaaagagtacacatttgataagctattcgacagaaacaaagtgattgcttccatcaccctttaacatagaaaaagaagaagaacaaagcaattgtacacttatgccacagctgatagaatcacctgatataataaatatcccgcatgtgctgatcttagtgaaagagtacttgtctgcaagacagcctagagtcggatttgcaaagcccaaccccactccactaacaagagctaaccaacaaagcacaacatgaaattgaaatgtcaaaagtaacaaagtgaggcataagaggtcactagaagcatcacattaaagtgataagtaatcttcatggaaaattgaattttgatgcagtcaaccttgtcatcagactttaaaagatctagcctaaactttcatctcaagaatcgttagggaaaatgaggattacgtggaaaattggaaaggaaaaaaagggcaagagcaatgtgtaatgttacctagaggcaagaaattatctgaagcaaaactcagcaattccttgccaaaatataatctttgagctgaagctgaaatgcctccgtcaccaccaagctgtgaacacaaaaaaaaatctccacattcacaataaagtttgatcatttacatgaatccgattccattctccacacgaacttggaataagcatagaagaatacataaaatcgaatggaaattgaccagagaccttgtcggaaggttggcatgctctaatggatctggaaatccatcgtctaccacaggggtcttgacagcgacggaagacgacggagcggttccccggagacggtggttgacggagacatagaaaggggttttgggttgaagccagggtactagctatcgccatgggagtagagagaattagaatccaaaagtgagcagaagaatgatcaaagtttggctgcttagttctgcattactcagttctcaagtatctctctcagtttaaacaaactccggcttatcggaaccacttcctgtctagcttcccactaccactggctcctgttatttatttattcttttaactcaaaaaatataggaatattcattttcaatttgaaccaatcacaatgagtttgtctttcagcctcaaacaaacaattgggtctaaacccaatattggagtagatacattgggccaaatcagagggcataaaattaaacataaaggctaaaggagagcgaacccaagtaaattaatctcacttatttcaagtgcattattattattttaattgtatcaccaacattcatatcccctctcacatggcattgatgagcagaatatgtccaatgtatgtagtaatgaagtacatttgtgttatatagcccatttgctcaaattaaattgtaagcaaaaaaaattattttcaaattatgttcattccacaatttatagatccgttgaatcaactgtatataattcgtatgtccataaatatttttaaggaatctagttctcctaaactacttaaaagaaataaaaatgcaatcagaactagcatttataagccaaaaataccaaattacgggccctgctcaagaaagaaaaaaaaaaaaaaaaagtgctaagcagaccatagaagagatattttgagctgtagaaaaactcaatgcaccattaagattgcttaaaccccaagcttgtgacttgtgaggagtttaacaaaaagtcgtcaaatcctgattacgacaaggcacctaatactttttagattgcaagaaaaaacaatataaaacaattattttgatcacattagcttcttacccaataacaaaccgccacgtatgacttcgcttgttcgataaacaatctctctgctccatataactgaatcaaagactttcacacgagatcaaggaagaaagatcaaaactctttctttcctttttttgttgaaaatcaaatctaagaaatg

SEQ ID NO: 28880 - DNA, 3000 bp, Unknown
  misc_feature (1)..( 3000): 2750-1469P.txt file - cDNA_ID_2999203; gDNA_ID_2926230; Annot_ID_142632
caattcacgtgtgccgattaatcatcaccacaaaaaaaaaacactctacacaataggcatgctcttccttgtcacgtatagattcatagatatccctaccatttctcatattcttctacttttacagtctgttttctcctcattaattaattgtttaataataaaaaaacgatagatatttagggtttcaattgctcggatttaccaaagaaaatggcagtcacgtgatttgcattttgggaagtacattcacatgcacaatttgacgacataataagaaaaacaaaacctattaatctctaaagctgagaaagaaatggttttgttgtccacatagagtagagagaaagggacgtgagcgagagagtttggacatcaaaagttcacatacaaaggagatttggtctcttcccatatattctgcaagaaaatatatttgtactgctgcatattattcgtgttttacttcggcttatatagaagtgggtttgtgtccacacattaatattattgtatatataattaaaaaaaatttaaatgcgtgtgaaaaaacagtcgagagtattttagataaagaaaaataataatacaaatatgatatgtactacacactacactcgagcagaaaataattttacaactctgacatttgaggttgatgtgtagactcaggttattttatatagagataaaaaagataggaacgatctttacaaaaaaaaaattctaagaatgtcaatgatttgtttgtttttcttacagccactgtcaaatgagtttttaaatgtcattttgtaaagcagtcaattttaaaaattgccaaaaccacttcacttgttttttttgaatttttttaatataaccctaaattgtttcgagaaatttacgatgtatagtcaaagtataggccataacaaatgtataaacaaaaatttccacccacacacacacacacacaaaattcgggtgaaaaatgactaggtaatcaaaactaataaattagtttatttccttattcatttcttcaatctttccttgtataagtaagtataactgtataaaaaacaaaatataaaaatgtaagaaggtctcgtgttcttgacagctatatatcctttgtcttctccccatatgaatcgtattcccttgtccgaatcaaatatcattgtatgacacctaactgcacatcttgataattttatgattttaacaaaaacttaagaaatcctgtgaccaaaaagaacaaaaactggataatccaacattgcagaggctactagaccaataccacgtgtgaagagatcattagacggcttccattgtattagggaaatgatattcttgtacttagctttgataatattatatgactaacgtctaaggtctaaccgctatgttaaaatgcgttgttttgttcaaatcaaatcacttcatacgaatttaaatcctcatacatatattcttgggatgctgcattgtcaatgtctctctcagactctctggttacatatatatatatgggtgttgttaaagacaagtcattagttaaactacaagatatgtaatttgtatatatggactgtaattgaaaaatttagaaaggaccaaaaggacaaaataacattgagatcttaacaagaatgtacaaaaataaaacccattccatctgccccactctcttcttctctaagtgacaaaattatcatagagaattaggtcacgggggcggctttgggctaccaaaacatcaccttttcttctttttttaatctatattttataaaaacatatattttgcacatagcatgatttcaccgtaacaaatatactgtattcgtagccgactagaaaagaaggaaatgaagataaacagatacagggcccatataatcttcaacatgaaagcacaagaaggcccattagctattttacgggctctatgaggcccaggttcttcactctacctgagctaaacaagccagtctcaaagtttttttatttttcaacaatcaaaaaactcttctccaatgcttaagctgaaatctagtttattttttctatttactaaaacctcccaaggaccaaagaacatcgacaaaggaagacgacgaagaagatttcgagcttcgacaaatcatgcggattcttactgctcgcatagctaacgtaattacccaaaattcttcatctgaaatttcctctctttacccgtttataagcttttccttgtctttctcttcatcaatgggtttaacgggtcgttaccgattcttctggaatctgaagtaaaatttgcagcatttttgcagggcacgaaacgcgaatcctcgatctcgaaatttctcctcgtcgaacaagaaaggtgcctccttttttccttttgtctttttttcaatcaagtctataatctgtgaaaggatcgactcatggtcttaaatttacaccagattaagatagaatgaagtagattgattcgaaaatctgatgagcttttggttaagtagttgtaattgaagtccatttctcacttcacactagtagtgagagtctcgatttcaatcacatttgcttgtaattttactccaaagtggttgctttgtttgatgaatccgtactttagtcttagaaacaatcatgaagtagtcataagagtagagaagagtgtgacttggactcatcaaaagaagtaaagggcctttaggtttgggtgtgttatgttcttagctttgctttcattttctagatgaccttacattggaggaagaagctgagaggaaaataggttggtgtctcaaaattttctttgcgggcacagcaacgtatattggataccagtttttcccttacttaggtatgtgaatgaatctctatatctaatcagctcttacatttttttattaatggtggatcactgattgtcacttatttgggttaggtgataacttaattcatcaatcaatatcgcttttacatgtgaaggatcctttgtttaagagaatg

SEQ ID NO: 28881 - DNA, 3000 bp, Unknown
  misc_feature (1)..( 3000): 2750-1469P.txt file - cDNA_ID_2999210; gDNA_ID_2926230; Annot_ID_142634
gtgatagataagatattcgcaattttgaatgataacaatgtaaaaccgcaaattgtgaaacttttgtccatcattcaaaaaatttagtttttggcaaaacaatccgtgaaaaggacaacattatttatgtatcaatacaccccactacctagtcacctaaagataaaatgagttagttcggcttaccattcaaactccacatgtataatatgatatttttatagattgacatataatatttgtgttttattgttcatgatattctttagaaagcttgaaaataaaatattaggataaaaatagttttctctaagttcatagtcaaatactactatctaataaaagtaaactttgattgaccccatatatataaaaattaggtaattggtactgcaacaaaacatgtgtagtacaaggagacctcatagaattctttgtacttgtactttctgttagtggattttaaagttggtaagcttttttccacatcaggtataactaaccttcctaaacctttatactttattattggaaatatggtaaatgcactaattcataatgttctcgtttcctttacgctaacttctccgaatctttgcttttgcgttactataaatattcagaagacaccatttcttctcattcaacaaacaagcatctcattctctgattcggtccatcgatctcaaaggctcaaagcttaatcgtttcctttcttcttattctagccatggctcaggtaattttgtgactttgatattcttcttctttttttctccatttcttggccatgaaacgatggaataatgtttttgagagacattgatctggaagcaggaatgtctttttgtgtccatctccaaaaaagatgctagcaattgtctatatatatcggttatgagagtccgattaatcagtttttatgataataaatattttggaatgaattaatatcaaatttcaagagggaagaaaagagattgattggtctaggtctaggttctatctgtaagtactataatgtccgattagcaccactttgaaatattcatcaaaaaaggtaaatattattaagctagagcacaaaagataacagttaataattgtgataaaattagctgttgatatatttggaccgaattggtcctatgtatatggatatggttcttacattttcggattaaattgtctaattaatgcagaccgttgtcctcaaagttggtatgtcatgccaaggctgcgttggtgccgtcaatagagttttaggcaaaatggaaggtatttctctctaatctttttttcatgtctttcaaatactttctactaatcattgtttccctttattttaagccttataatttattgactctataatttattatataatctcaggggttgagtcatttgacattgatatcaaggagcaaaaggtgacagtgaaaggtaatgttgagcctgaagcagttttccaaacagtttcaaagaccggaaagaagacttcttactggccagtggaggctgaagctgagccaaaagccgaggctgatcctaaggtcgaaaccgtgactgagactaaaaccgaggctgagactaagactgaggctaaggttgatgcaaaagctgatgttgaaccaaaagccgcagaagccgagactaagccatcacaagtttaagtatactaacgatgaaaaggaaggctaatctacctttacaatgcttctttatcttttgcttttgtgtgttgttgtaagaaatgcttcctctaaatacctaatatctttatgtatgtatacctttttcaactattgataacaagatgttggacccatgttggtccgactttcttttataagaagttttaagtgttttactagttaattaaatactgcgagagtcttaactttgacttattataaaactcaatccattcagacatctgtctgaaaataggcaaaaacagaatgaaccattttcaagagaaaattgtaagatgagccggcctgaagaacttggaagccccaagcaaaagtttttctggtctatttacatatttttgtaagaagttggacattaggatgggatttgaagtttgaactccccttggtatttatataagcccaaaaccaaatagactaataacttattttgttatatatgtggccctaatagtacataatattcatgtggattcaaatttgagttatcatcttacctgaattactatatgggtgtgattagtatacactaatctagctaatccattcagaaaacaattcgtgctaagatttggattgcacattcttacaaaattaatgagttattaattaatatttttcccaaaaattaagtcaattaatgttgaagctataggagcgacgtgcttacactacacatatttgctgttgaaaggttggaaagtccttttcttctttaccaactttttacgtcttttagcttttgaagctatctatcgtatctcaaatctctgtattcttatctactctctaaatcattcttcatgagttaactttactaaattatgtacggttagcatcgatcatatacatgcgaagcatatacatatatccagtcaagcatataataaacaaattaataaatatattggatttgtttcattaaattaattaagtatataacatcccatgaaggttccaagttccaactatacaactgcccctaaaagattccttcatgtcttaatcatttcatctacgttgttttatttgttaaattatgctcaacaactctttacggaaacaatcatgtaccgagttgattattaacgaaaaatatatttaaaaatgtttcaagaacgtagccatctctaaccaattcttgaaccatactttaccaacttgcgttcgaagcaagaaactgctcctccatcatcttcctctattgatcttcttcatattctcaagtttactccaaaaattgcgaggtagagaagaggaaactacaaaccaagaacattaaatg

SEQ ID NO: 28882 - DNA, 3000 bp, Unknown
  misc_feature (1)..( 3000): 2750-1469P.txt file - cDNA_ID_2999210; gDNA_ID_2926230; Annot_ID_203642
ttgaatgataacaatgtaaaaccgcaaattgtgaaacttttgtccatcattcaaaaaatttagtttttggcaaaacaatccgtgaaaaggacaacattatttatgtatcaatacaccccactacctagtcacctaaagataaaatgagttagttcggcttaccattcaaactccacatgtataatatgatatttttatagattgacatataatatttgtgttttattgttcatgatattctttagaaagcttgaaaataaaatattaggataaaaatagttttctctaagttcatagtcaaatactactatctaataaaagtaaactttgattgaccccatatatataaaaattaggtaattggtactgcaacaaaacatgtgtagtacaaggagacctcatagaattctttgtacttgtactttctgttagtggattttaaagttggtaagcttttttccacatcaggtataactaaccttcctaaacctttatactttattattggaaatatggtaaatgcactaattcataatgttctcgtttcctttacgctaacttctccgaatctttgcttttgcgttactataaatattcagaagacaccatttcttctcattcaacaaacaagcatctcattctctgattcggtccatcgatctcaaaggctcaaagcttaatcgtttcctttcttcttattctagccatggctcaggtaattttgtgactttgatattcttcttctttttttctccatttcttggccatgaaacgatggaataatgtttttgagagacattgatctggaagcaggaatgtctttttgtgtccatctccaaaaaagatgctagcaattgtctatatatatcggttatgagagtccgattaatcagtttttatgataataaatattttggaatgaattaatatcaaatttcaagagggaagaaaagagattgattggtctaggtctaggttctatctgtaagtactataatgtccgattagcaccactttgaaatattcatcaaaaaaggtaaatattattaagctagagcacaaaagataacagttaataattgtgataaaattagctgttgatatatttggaccgaattggtcctatgtatatggatatggttcttacattttcggattaaattgtctaattaatgcagaccgttgtcctcaaagttggtatgtcatgccaaggctgcgttggtgccgtcaatagagttttaggcaaaatggaaggtatttctctctaatctttttttcatgtctttcaaatactttctactaatcattgtttccctttattttaagccttataatttattgactctataatttattatataatctcaggggttgagtcatttgacattgatatcaaggagcaaaaggtgacagtgaaaggtaatgttgagcctgaagcagttttccaaacagtttcaaagaccggaaagaagacttcttactggccagtggaggctgaagctgagccaaaagccgaggctgatcctaaggtcgaaaccgtgactgagactaaaaccgaggctgagactaagactgaggctaaggttgatgcaaaagctgatgttgaaccaaaagccgcagaagccgagactaagccatcacaagtttaagtatactaacgatgaaaaggaaggctaatctacctttacaatgcttctttatcttttgcttttgtgtgttgttgtaagaaatgcttcctctaaatacctaatatctttatgtatgtatacctttttcaactattgataacaagatgttggacccatgttggtccgactttcttttataagaagttttaagtgttttactagttaattaaatactgcgagagtcttaactttgacttattataaaactcaatccattcagacatctgtctgaaaataggcaaaaacagaatgaaccattttcaagagaaaattgtaagatgagccggcctgaagaacttggaagccccaagcaaaagtttttctggtctatttacatatttttgtaagaagttggacattaggatgggatttgaagtttgaactccccttggtatttatataagcccaaaaccaaatagactaataacttattttgttatatatgtggccctaatagtacataatattcatgtggattcaaatttgagttatcatcttacctgaattactatatgggtgtgattagtatacactaatctagctaatccattcagaaaacaattcgtgctaagatttggattgcacattcttacaaaattaatgagttattaattaatatttttcccaaaaattaagtcaattaatgttgaagctataggagcgacgtgcttacactacacatatttgctgttgaaaggttggaaagtccttttcttctttaccaactttttacgtcttttagcttttgaagctatctatcgtatctcaaatctctgtattcttatctactctctaaatcattcttcatgagttaactttactaaattatgtacggttagcatcgatcatatacatgcgaagcatatacatatatccagtcaagcatataataaacaaattaataaatatattggatttgtttcattaaattaattaagtatataacatcccatgaaggttccaagttccaactatacaactgcccctaaaagattccttcatgtcttaatcatttcatctacgttgttttatttgttaaattatgctcaacaactctttacggaaacaatcatgtaccgagttgattattaacgaaaaatatatttaaaaatgtttcaagaacgtagccatctctaaccaattcttgaaccatactttaccaacttgcgttcgaagcaagaaactgctcctccatcatcttcctctattgatcttcttcatattctcaagtttactccaaaaattgcgaggtagagaagaggaaactacaaaccaagaacattaaatggattgctcaatctgcaccacaatg

SEQ ID NO: 28883 - DNA, 3003 bp, Unknown
  misc_feature (1)..( 3003): 2750-1469P.txt file - cDNA_ID_2999218; gDNA_ID_2926230; Annot_ID_142638
ggaagaaaacacgtcaagctagtgaaaacaaaaagaagaccttgaaagtggctccaaaaaaggtgaattcaggaaagctctggctgtttacttatcagaactgtaataattctatgttgttatcatctttctgcgaaaaagtagtcaatactttgatctattggttttatggctctagcaaagtgtatatcagtgcattgtatgtttcaacattgattgttcacaacgttcttctgccacatgtctgaaaccagtgctacacatagtttgaagtgaattgcctagtccttcagtttcatgtatattcttctttttttcaaaagttggatttagaatattgtcacgagatacagtgggattactgtttaatgagatatgcaatttggaactcccattgttcagttatagagccttatgactattggtaacatataagtttgctccaaatctaattctgcatttgtggttacattacagagacagcggacggtaaagcaagagaaagaggatccggttagtgcagcttgtcaggattatatcgagaagcagaaagcttactttgcagagattgatgcatttgagctgccagtagaagaggtatctaatagcgactcagactaagtaagaagagataacaatcttaaggatatcatagagacaccataacccgttcgtaatcactgtatagctaaggagtattctcacaggaaatgtttcactggtcacttagtacacatgacacgtcaaatctgtgtatacaaaatatctatcggtttataatatttaacatcgtttcagtgggagaacgttcttggttctacttagacatgaattgacgaaaaagcctgtccacaatacacaggtaaggccacgactgagagacaaactatatacttacattcacacaccaataactataacactctctgttcaatgaggcgaagcagctcatagaaaaaaccaagctttattcacataatcaagctttattcatgtcgctgatgattagagctttacctgtggtctcatgtctcttcataccctccattgacccagagaacagagctcttgtcacactccccattgaagaactacagccaagtcttcccccgttggagcaacacagagtcgaggttggtgaagacctaagctcatcctcttcgtagttagcgtacagaagtggcgattttttgtcgtgactcatacgttttttcaaagaatgtggtggcgaggaggaaaaggaagatgaagatgacgtagaagaccaagaaaacgatgagcttgccgtcttcttgctaccgtgattgctcctcctgagatcactgaacatggagaaggacagaaacttacttagttttgatctcaccttgctttgcgtccttggtgtcgacaaaatcccggaggagtagtatgagggcggcggtgtgagaggcagaggaagagaggaatcggagcagaggtggtttttgggtgttcctggccttgactcccatatgaatggtatggaggctccgccatagtaggaggatctctcttcatcgattgcaaagtcatcttctagtctttctgacatctgttttttataaactctcggtttatgtttgagtcggcttttgatgagaattgatgtacgaaaattgaaacaacaagtgctagtttcgaagcttctttagaggtgacaaagagtaatatgtattgcgagtaaaacaagtttgccgatgaaacaaaagaatcttctttgcacggttgtatataatcgtggatatttattctgcttttttattttctttaggaaaaattcatatggatgagcatattacaagtatatggaagatcatacataggggaaaaaattggttagataataaatgaaaggtggctatcttactgtatgcattacttaatgcgttttcattaataataagagagtcgtgaggtgaggatcacattattggtaaacagttactgtagtaagcattgcttagagtatttaatatgttaccttttgtgggattccactctataaacctttttatttggtgttcttataattaaggaaataattattgaccaacaaatccacacgttttaatatatatcaagactactaaccttgtttgtcgtaatttgaaactactgaccaaaagtttggggcatgttcatccaaaagatataatggtttacatttaatgaaatgataatttagataggatataatagggaactactcagagtgtcagaccaaaccatctgaatacgtaccaatgtcaagtgctaactggtaactcccaacaatagtaattagaaaagatatatatatttgtcggttctaattagttggaagaaacgtatgcggagaaataaatagaaacgtgagagatcgaaagacgacggtgatgaatttggacggttgagtgagggaggtcgtataatttaatggtcgtttccaatcgtattcgtacgtggtccgttttctcctactcggattttgctttaatgtgatggccacacaaattggttagaaaactataagggaaagctccacctatttatttcactcatacatttactatacactaatatcgcacgggaaaattataacaattttcggatattcgtatttgaacagaaacaaacaacacatacgtaagaatttccttcacaaaaaagcccaatatagacgaacttgaacttcgtaccaacggcccaatatcgcttccttaatcaacggcccaaaattttcatttattaattaatcagataaccaatcaatagaagccacgtcgccacagccattagtagtagcatcatcaaagcctgcattcttgttcttcgagtctctctcgtgagtgactttcattaccgagaaaaacacaatcatagagaagctctcaatcttgtttgcttctgatcagtaactatgattactgtaaatagatcactctttcattatctttccctttcacttgtacaaaccaattcgttctcgagctaacggaaatg

SEQ ID NO: 28884 - DNA, 3003 bp, Unknown; identical to SEQ ID NO: 28883
  misc_feature (1)..( 3003): 2750-1469P.txt file - cDNA_ID_2999218; gDNA_ID_2926230; Annot_ID_203646

SEQ ID NO: 28885 - DNA, 3000 bp, Unknown
  misc_feature (1)..( 3000): 2750-1469P.txt file - cDNA_ID_2999222; gDNA_ID_2926230; Annot_ID_142640
gattagatttagttaacgaacgtttttcacaaaatgtgactgactacatataaaaacgtttgagatttggtgatccaataatttttcagttgcaggtcaatgtttaaagttaataagtttaccacacactaatacaacacaatctaaacaaatagtgaaataaataaagagttcaacggctatagaagaagaagcctaagaaagtaaaaacgatagcaaaaacgatggctgtcatgcctaaacctaaaccagatttaggcttggtcaatggggtggaaggtctccacacagtgtctccaggaacatcctcgaggaagattcctttaaatgccaacagctctcgaatccgatcgcttctcctgaaatctttgctcttccgggccatattcctttcttcaatcctctgcaagacctcttcttctcccattcctgctcttgttaatgccttttgtttcatgtctttcaaaagctcaccgtagcttagagtcgtgagcaaaccaagcacatcaagaacttccctcactgccttctcaacctcgaccagtgacactaccagcgacatccgctgcttcttctgcattttcttgagcttggagattgaaacgttgatgaatttcaatgcgtcttgaaaagcaccagtgagtatatgggcagtgttcaagtcgttttgacatttttgtttcaaactcacttttcaccttctttatcatctctttggcttctgcagactgttgagtctttccaacatctccactcatttcttctcgatatggcgatagagctttaaagttaagaaacattcataccgttttcccttaagagatgctaaaaaatattgtgaaggcacccacctgataaacacagtataaagcatccgatgaactctcaagctgcgaaaccgaatagttgagaggagaacggtactgtgcactcatcaagaaatgtctcaaagccagtggatgatagttagccgcgatctacacagattcaacaattttgcattagccgtgagaaaacacacactcaatttatgatattgaaacaaataagaaacttacttgtctaatcgtaaaaaagttgttcaatgattttcccatcttcacattgttgttggtgacatgcccgttatgcaaccagtagttcacaccactatcttcacaagcagcacatgtctgggcgatctcattttcatggtgcgggaatttgagatctgcgccaccaccatgaatgtcaaacctcggagacaggttaatgagcactcatggcactgcactcgatgtgccatcctggtcttccatgaccccaagggctctcccaacttggttcaccagattttgcagcctgcataaaaatttcagcataaactccagctgctctagtttaataactgaaataagaattgaacaaaaagattaaacttgtcaaaccttccgtaatgcaaagtcagcaggattacgcttccttgagtcaacagcaacacgcttaccagcttgagtatgatccagccgttgaccagataactgaccataactcggtgatttgtccactgagaagaacacatcaccacccacagcatacccacatccattctcaatgatctgtaccaaggaagcatcatcattataccaccatattttaacaaagaacattgcaggaaaccaaacaagaagaaaaaagacaacaaaccttttctatcatcttaatgatctgttccatatgatcactgacacgaggctggtgggtgggaaggaggcactgaagagcagccatatctaaaagatactcctcgcaaaagcgattactcaaatctaacggcttctctccacagtttttagccttttcaattacttgcaggtacagtattcagagtttgataaacaggaggattatttggtgttcattgctctagtttcaaaacgcagaaaaggataccagaccttgtcatcaacatctgtaaaatttctgacataagtaacttgataacccaagtgccttaagtatctgcataatcaaccagtacactagagagataaataccagcttcaaatgtctctaagcttagtacattgttaatcgaagctaacaatagacaaaattagttttaaattgttgggatttttccccaaattcgtgacctaaagaaattcaaattaaacaacaatcctacggcgaaaactatggaactgacctgtaaaggaggtcgaaggacacggcggcacgagcgtggccaatgtggctataatcgtaagcggtgataccgcatacatagattccgattttgccgggattcatcggcttataaacttccttcagttgagtcattgtgttgtacaatgtcaaatccggtttctccacctccatctccgacatctctccgtcgcttggaagaatttctcaaaaactctgatgatttttcacttctcccgggtaaagctttcacgagctcaatttttaccggcggcagcgtcgaattttgtttaggaaaattgaaattgcttaaatagccctagatttttctaagatttccatttttctatataggaaaattatatatgattttctgacccccaaaaaaatatatttgactctaaaacaaaggaaataaaggaaattgctaaataaccttgattttagaaagatttccatttttctatttaggaaataatctatgattttttgtctaccaaaaaatacaaatttatatggctgcgaatattattgactttagttgatctctgagatgtacaaagaaaatctcgtattagcaaatacacactagtaattaagtaaacaaaattggacacctcatatatcatcagatcactaaactcccacgtaaacacattaatagtcacagactcacagcaatattcttcatttgtggcccccgttacatttcaatccccaccacacaaccacatgtatgttttgccaaatttataaaaatgtagcacaatttggaatctctttacttggaatttgagtgaaaaccataagatg

SEQ ID NO: 28886 - DNA, 3000 bp, Unknown; identical to SEQ ID NO: 28885
  misc_feature (1)..( 3000): 2750-1469P.txt file - cDNA_ID_2999222; gDNA_ID_2926230; Annot_ID_203649

SEQ ID NO: 28887 - DNA, 3000 bp, Unknown
  misc_feature (1)..( 3000): 2750-1469P.txt file - cDNA_ID_2999232; gDNA_ID_2926230; Annot_ID_142645
aagtctgaggtggcttaagtaggtgattattccctgtaaagtgttgacgatatagactaattagatatcagatatggaccgttcgatgtaaatctaacggttgctattacgtgaagccggtacgagatggagaacgtggcgacgcggtttagctgtgtgcatggcttgggcgggcacacgctggtactggatttaaattgtggtgaacacgtgttatctctgttatttataatctagaccataagatacgccacgtcagattccacggtggacaatgtcttttagaatagattgggcccgtcgttttttatttttgaggaaagtttcggccttttcggtatggcccagaccactaaactattgttatacttatgtgcgttgatctttcgcatataaggattggatcattggactgaggtttggaatgttaggtgcgttttacgtttctcctgccataaactacacaaagacaaaagcacatgcaaaaacaacataaatatgcatcaacctaaggttgcgacacaaatcgagcaactatgcaaaacgcttaaagccatgaagccttagagattgacaagtagatcagtcaaagtttacgtggcttagtaaaattatatacttttgtttgctaagaaaatacttttatatacttatctgaataaatccacctctcgctttatttctattttctagtgtctacatatataaaaagatcatgacgaccaccgttattatcattatcttcgttgccatcttcgctacgactcttcacgacgccagaggagcaaccatggaaccgtgtctcgaatcaatgaagactgcttcgcttcctgatcttccgtatgcttatgatgcgctagagccagcaatcagtgaggagatcatgcggctacaccatcagaaacaccaccagacttatgtcactcagtacaacaaagccctcaacagccttcgttctgccatggctgacggtgatcactcctccgtcgtcaaactccaaagcctcatcaagttcaacggcggaggtcaaaccctagctttaaacgactaagttctcattaaattcttccgataggtgcttgttgatcgtaaggattttgatttttttttttctgttgctttgcttgtagggcacgttaaccatgcaatcttctggaaaaacctagccccggttcatgtacaaaaatgtttttttgtcgtcactccatgtgtctatttctgatgagtttaattgtctcttctaaggggtcaaattgatatataggaaggaggtggcaaaccaccgcatgatcctttggcttcggcgatcgatgctcatttcggatcactagaaggattgatccaaaaaatgaacgcggaaggcgctgctgtacagggatctggatgggtggtaagttttttttcagaatctcattaacaatgttgggaacacaattattggttttcagatgaaagtttataaaaatttctgacagaatatcaaaattcatttcaatttgaattggatatgtgatgtatataggactctgttcgaaatgaaattgaaaaacattaatttcaaaaaaggtgttaaaaaggaaaatctaaacgggacaataagtttggttagtgtatagtgtagtattagaaatatctataatttcatttttgttaataaacaggaacttttgtatttccttgtgtagataaaaccaatgtttatattttctttgttttatagtggtttggattagacagagagcttaagagacttgtcgttgaaaccacagccaaccaggtagattaatgtagtgattaagctaatttgtaacatggtctatctcacaaggatttgggaaaaagaaaagaaaaagatttgatagattggtcgaacatacaggatccattggtgactaagggatcacacctagttcctctaattgggattgacgtgtgggagcatgcctactatccacaggtactctaatctcaattataatactccttgatttgatatcaggtagagtaatatcggttttattagtaaaagaactgtttgattgaatattaacattgatcaatgggtgcgggtaatgcagtacaagaatgcaagagcggagtacttgaagaacatatggactgtaatcaactggaaatatgcagcggacgtcttcgagaagcacactcgtgatcttgatattaactgagttttatatgtctgtagtagcttttgttttttgggtttcttgtcttgttgataaatacggcagtaccgaagatgcaatattaagtttaagatgctatgtatgtaccttggaaaataacgtttgttaagcttttttttcttgttttagaagtaaaaataaaaataaatctatatttcttttgctctggtttgactaaatgaaatatttgtaaatatataagatgtaacaaatctataaatatataataattaaagtttaatatttaagattatataaatgaaatttccggagcagtttttttagttttcttccataaatcagtactcttaaaattgagtagattatttttttcttcttcttagcatctcacttttattagactgtaaaagggtggtccaaatagttcgccaaccaacttggtgttactgtaaaagtttgatatattgggtacatcgtagaagcatgtcttgagagcatatccgcagcaccatcatttttctcctgattcacatgtcccataaaaaattacggtagtttcgacatccagtgacgtatatgatatatgcatagacacgattagttttcaacatgtaaacaaatttttaaaaagttttagtgaattaatttctcaaagtttcaatgtactgggcttgctcaggcccaaatataacccattcctaataaaacctagaagagtctgcatatataatagaatatttcgcaaatattagggttcctgcactcttcttcttccctgtcgccgcatcaaagagaactgaagcaataggcttttgaagctctctgcataaacatg

SEQ ID NO: 28888 - DNA, 3000 bp, Unknown; identical to SEQ ID NO: 28887
  misc_feature (1)..( 3000): 2750-1469P.txt file - cDNA_ID_2999232; gDNA_ID_2926230; Annot_ID_203655

SEQ ID NO: 28889 - DNA, 3000 bp, Unknown
  misc_feature (1)..( 3000): 2750-1469P.txt file - cDNA_ID_2999238; gDNA_ID_2926231; Annot_ID_142649
ctgtttacatggagaacttctgaggaacagtatcgaaatcgtctccaaagtcgtacctttgtctttcccttcctacctgaaaaaaagtagtcaaacggcttagtcagagaaacatgggtttccaggacagaagactaatggaatatggtattaaattacctttcccaagtataaagggtcacatgataagctctcatccatggctaagagattcttcgacagaccaatagtcctgaaatttttatcaaaacacataacttgtttgatgctactactttcctttggcaaaacagtcatctccatatcaacttgattccaagtgctaattatgcactccttattacgagtttcaacattcaagcaatgtttcccaaaaaaaaaccatatcaaaacacttagttctgtagacatacctttgtataacagaatccatgatctcaatcatctcactagatttgtactgctcagggtcctccaagaatctgaccatcccgtctttctggttgataagggcatgtatctgaccatcctggatctgcaggtttgtaaagaaaaaaatgatattgtccaacataccagttaaactaataaagctagcttccaaaaatcaagtgtgggacacaataccatctgaagcacatgcatttccgcctccttagcattaccaagttggaccatgttggctatatcttgaagcgacagggtcaagtacttctgtgtcaatctcagaatgttacgcttgtaaagggatgacactgcttgcttaactaatccaaggttcttatcctgaaagagcatttcgcccaagttatggaaggggatgaatatttaatattggtacagaaactatggtaaatgtttagaggcaatttacctcttcaaattctgcattcctggccacaaccaatgcctctagttcaccaatcttcccgtcgttgtaacaattacccagttcaatgtaaggctgagaaaagggtgaacgataaaatcataagcctgaaaatagatttagctggtatggagtacaaaacaactgaaatctttggactgaagtgaaaaagggaccagactccattcaaacatgaaaaatacaactaatgatcgggttcaaacttactccggtatagttcttgaagctcctctgtgctgctgtagaagcacacttggggagagtgttagtaaactgcacaagtaaaatcaaacaagattataagaaaaacatcataagattaaccaatgcttgaaattaaaatcagacacaggatgtaattgtgaaaccaacatttctcaaaaacatacagttgattcagactcgtgcaatatgctcccatgaccgaaaactagataaacaaagaaagtaaaatataaagaacacagccttacctgcccattgtgaatgagagacaccaatatgtactttttgtacgcctcaagagctatggcattgacttgatgcataggagcagtcacaacctgatacaagtacttaggttgagttaaaactaaaacgaaagtccttaatgtataaaaagcacgtaagaaaaaataaaaatgccttacattgtaaagaagctctaatgctttctgaaatctcttcagtccaatacaaatcattcccctatcaaaagtccaggtaatcaaggaccagaataagaaaatactataaaacaaacccaacagggatggatttaatgtgtttacacatctattgatcaaaggaaaaaaacagatagcaatgaggaaaaattgcttacccataatagctatagagaaaaaagtctcttggctggtcaatctccacgatatcatcactaagaatggagaaaccagatttgtacgatttcgcctgcaaacagagttgaagaacatctggatgcaatgcagtcaaacgcttggaggagacctgaagcttctgaacagcgtttaacagtggccctactcctcgcaacggatctcccagtgctataacatggtctttcaatatcttacaaagagatacaactgcaaaatcaatataataacatcatccatctccccaaagaaaaaagaaaagaaaacacattaagacaagataagctctcattaagtgtcagtaaattacatttatagctcgccaaacgaatctgcccagcatcacaagaattgatgaaccgtgcaattatcggtatctcataagcagctttctccttcgacactggaccacaggtaagaacctcactgtaacaatcaaaccatacaaaaaactcaaagatcagaaatcgaataacatagacaattctccttgttaaacttcgacctaatcacacacatcaagttccaataaccaaaatcatcaatcagcctcaaagtatacacaaactagtaacaaaaacctaatctaccaataggttaaaactcacaggaaatacaggtaaccgagagagtgcttcgaggcgtcgagctggtcaagagtagagaaattaacacctggttcggctcggagcgagtcttgagctcctctcaaaagatcgtgaagtgcagataaatcctctggactccccgataaaccttggattgacgttatcacagcctccaccgagttcacagctccgatcatcttcgatactaagacgaaaacacaaaaaccctaatcgatcgccctttttctccctctcaaaatcttttgctaaactgtttgtttaattatctctggatcttctccataaaaatacatgctctcataatatatatacgaaccctccgaacggttaagagtctaatacattactctagaataataaaccaatatctaaccggcttttaaaccaaatattcccggttcgaaatgtaccagatggtaattgtcggtttagccagaccaatttcggggatggccttttatcattcgtctttccagagaaagaacgagattgcgatcacagagtgtcaaagcaatctgctttttctcctctcagattcaaaggttctctttgaagcttcgtaggtggttatactttgatg

SEQ ID NO: 28890 - DNA, 3000 bp, Unknown; identical to SEQ ID NO: 28889
  misc_feature (1)..( 3000): 2750-1469P.txt file - cDNA_ID_2999238; gDNA_ID_2926231; Annot_ID_203673

SEQ ID NO: 28891 - DNA, 3003 bp, Unknown
  misc_feature (1)..( 3003): 2750-1469P.txt file - cDNA_ID_2999240; gDNA_ID_2926231; Annot_ID_142650
tagcggccatgaatggccacgttgaagcatttagagtcttagtctacgcaggcgcagacgtgaagctgtataacaactctggcgacacggtagtctctctgtctgaacagaacggtaaccgtgacgtgatagagaaggtgatgctcgagtttgctctcgagaaggacagcagaaacatggcaggcgggttttatgctttacactgtgctgcacggcgtggagacgtcaaagcagtgaagcttttgagtggaaaaggatacagtctagacatcccggatggagatggctacactccgctcatgcttgcagccagagagggccatggacatatgtgtgaatacctaatctcctgtggcgcaaactgcaatgctaagaacggaagaggggaaaagctgctggatctcgcgactggtgatgcggagaaggtgatccgtaatgagttgtctcggaggtttgtgatagaaggaagcagtgtgatgaaacacaccaagggagggaaaggaaagaagcatgggaaaggattgagaatgttggaatcaagtggagtactaagttggggaaagtcacggaagaggactgtggtgtgcaaggaagtagagatcgggatgagccagcggttcaggaagaaccgtaaggggaaaggcgatggagcggaggaggaagggattttccgggtagtgactacggaaaacaaggaggttcattttgtgtgtgaaggtgggttggtgtgtgcagagatgtgggtgaggggaatacgacttgtgaccagagagacaatttgtggaagaactcagactcagaattagtgttgtttatgtatgtatataaagaagttttgagaaagggagcttcattttgaaggtagtgtgcttctattgtgttggggatgtttatagttcttgggtttggtatctgcagtatatttgtgaactgtgaagtagttcgagttgcacatgaatgaaaactaaaacatctcagttgatttgagattctccaaatttgattattactttgtccaaaacaaagactattctaaacttacatggattcacaggcttagatccagcactaaaattcggcatgtgatacctggatatcaaaaaacaacatgaagttcctgtctctttcaaaagaacaaaagttacaaaatgtttaaaaaacattacatcacacaagaagtcagcacttttgtttaccagtcaccaactcaacaagcaataaccaacagagataaacagagaagctttgaagttctaatcactattgtaaccaccatcatcgttatccttatcttcgtggtccttcaccactcgttctatgaactgtcttcgaactccagccatcacagcttccctcgaggagtcatcgtctcctcctttgccatcgttaagaactggctctgattgacacagaagtaaggctacacctgaaaaaccaaatcagttgcaagtatgttagacatgtgcctaagaccaatctgctcaaagcatgatacaatcgccaatgtggtcacatcaggtctcagatcagacaaaggctagagatgagacatgacataatcatcaaacacaaataagcacagattacatcagacaaacaagggttcattcaaacttactctctggggtgcacctacggccaaagctctttaagcctacatgagttcctttgatggcgccatggtggtacaccagcaaggtaggaagattgcaatcagggtagttcggaatacaatcagtagatattatcttaacgaactttgttgctgggtatctactacccaattcgtctagacaacccaatagcaaactacattctgcaacactatcagagaacaacaagaaataaacatgagttaatagtgtttcaagcatgtagtaaagaatggctcaacaagagttcacgaatacttgaaaaaacatacccatctttatagagacatacaacaacccaatcttcagcagaagcttgcgtaacctccctcacgaaatcagagcccgagatgggagtcactgttccatatcttttaactttagcagcctctcttagctcagacaacctcttcttcctatgaaagcatcaaaacacattagtgcctgtgaatcatgaagtgtgttgcacaattatgtttagcctattcatcaacatctcaaataagatactaccctcaattgcattcatatccaaaacacaaacgaatcgagaaaaaccagagcttgataattgcattccctagctacatggcaacagatccgagaaaattgaattcacaatccaccaaggcaaggattctccagggaaagttaagattgtaaatacaaaaatcagaatgttcgattcgatctacgaacctgtattcttcgagaaagcgatcatcgtcgagatctttgtcgtcctcaagatcctcaagctcctcctctgtcttcttatcaaaccatgcctgatccttaggagctgaagactcgtcttccgccggagtatacgccggaggtttgaaagccggagccttctccggtagattccccaatttccgctggatatcatcccattgagttgacgctccttcaatgtccttatacacgaaatgataatccgccatcaaagtataaccacctacgaagcttcaaagagaacctttgaatctgagaggagaaaaagcagattgctttgacactctgtgatcgcaatctcgttctttctctggaaagacgaatgataaaaggccatccccgaaattggtctggctaaaccgacaattaccatctggtacatttcgaaccgggaatatttggtttaaaagccggttagatattggtttattattctagagtaatgtattagactcttaaccgttcggagggttcgtatatatattatgagagcatgtatttttatggagaagatccagagataattaaacaaacagtttagcaaaagattttgagagggagaaaaagggcgatcgattagggtttttgtgttttcgtcttagtatcgaagatg

SEQ ID NO: 28892 - DNA, 3003 bp, Unknown
  misc_feature (1)..( 3003): 2750-1469P.txt file - cDNA_ID_2999248; gDNA_ID_2926231; Annot_ID_142652
tcaaaagagaatacaatgagcttgacactgtctggttcatggctggatctttgtttcaggtgtttggctacctacgatttcggcttcttcttgtcattttaatatatggaatgctaaacatcggcctcggacttacaccattttatttgtgttttgcagcaatacccatttgacataccaactgaagctttttcatttgagattttcaaacaggcatttgttgccattcagtcatgtgtggtgcatttacaagtaattttcattcttttggggtttacttttcacaacttgaatgtctttctgtatttgaaagaatagttagagtaaaatataataatatggtcttacctctattactctatcgctgaatctaaagtttagcttgcagctcatcatttaagcaagtagtcaggtggtgcttgttgcttcttctaatttagattgttatgcttcttcttgtactcagaatgtcggtttggctcgtcggtttgctttggttcctcttggtcctcccttgttggcctattgttccaactgcaaggcaatgcttactgctgttgatggtgctgttgaactcgtggtagataggccatataaggccggggatcctatagttgtctggtgcgtctgtaagccaaattgcttcctacagctagctttttcattctgatctatttttcatacttttgcatttcctcctttatttgaaggtgtgggccacaaccaaatgcgaaattgcttctgaactatggatttgttgatgaggataacccttatgatagagtaatagttgaggtaattacaaaactttgttgcgttactgtaaacactagtgtagtgttcatgtaattcctcactgtttgcatgttttatgcgtcatacacattcaaggcagcgttgaacactgaggatcctcaataccaggacaagagaatggttgctcaaaggaacggaaaattatcccaacaagtatttcaggtatgactttcccatggcaacaagtctactttgagatgttctgtctgattttggttttgcatccatctcaggttcgtgtgggaaaagaaagagaagctgttcaagacatgcttccctacctgcggttgggttacatgtctgatccttctgaaatgcagtcagtaatttcatcccaaggtccagtttgtccggtaggtagaggatgagtgacctggcaaaacttttttctaagtaatctttgatatttccttgattgcatcaaatgttcagtccctacatgtgaggcctccaatgttactgctacatagaaagttgttgacacacttgtaaaggtttaactctcaagctcttttgtagatgagcccttgtatggaaagagcagtactagatcagcttgctaattacttcatgagacggttatctggctaccctactactccgaaagaagatgatgcattggtatgtctttagactttgtgatcgctacagatcaaacacatttttttgtttggttttcctgcatgacatgacattgatagaattcccaatcaacagttggcagatcctagtttgagtcctaggaagcgagttgcaacccggcttgtccaactggagaagaaaatactagttgcatgccttacgacaacagttgatcttttaaatcagttgcccgatacagccatctctccatgcccagcaccatatgctccttccttgaaataaaaaggcacgtatctctgccccctgcctctctcacttaataactaatattttctgaccttctaaaactatgttggttcaggttcgtgttgtagctgcaatttgtgggacatggcaggagtaatttttggtcgtgtccttgatcattacaatctgaggtcgcttaactacggtcagtttttgtgtgtacaagtctagatctgatcctttgcggctcgaaaacatgactaggaagtttccaaaataattttgattttgtaagatttcttgctagctacaaagccgaaatctatctccttatagatggtttattgttgtttatgaattcagaagttgatgatttcaaagttttaatgcattgcaaattgcaattgcaggtagataagggtactaggagcgttatctgccgcttgacacgcaaatgtttcagcatatgattgtcctttttttcttacaacaatgaagccttaagtcgcattgttcaaagtgtacatacatgaatgaaccttcttgttcttccccaactccctctgtaatgttttatctctgttttagaaatttagaatttatcatttccaaaaaaaatgaataacgaaattgagcattttgtccattggatacaaaaacgtcaggacgagccgatagagtgaacaaaaacggcaagcggttcgttgaatgcgttgactcataaaaatcttcgcatctaaaatatctattggtgtctcactacactagtcactagatctgttcgattaaaatccgacggtgtttattgattgttcctgagtgttcccgtaccgaaactcgttaaccgattcaccgttaagtgtggaatcagacagtgaagagatcaacagatatttatctctctacttctctcggtcgtattcgtcattctgccttttatctatttccatatcaacattttagggtttttactcctctaaggtttcgcttcttcttagattctctgtcttccgcttcagttggatcatcgattttctcaattgctctgaagttcagccggtgagtttcttccttttcacgattttggtgtttacttccatcgggcaattcgaagtcttcattgcaggacgagttcagatttgaatcgcttaaattagggttttgaatcatctatctactatcggatcgagattatctgatttagagtcataagagtcttcggagattagctttctgaagcaaatccgtcatacgagatgtttcgtttcctgcaggattagactgatccggagctcttcacgagattaagggaatctatttcacaatttcgtcgatatg

SEQ ID NO: 28893 - DNA, 3003 bp, Unknown
  misc_feature (1)..( 3003): 2750-1469P.txt file - cDNA_ID_2999252; gDNA_ID_2926231; Annot_ID_142653
agatcacaactcaaatgaaggagggattggggatgatgagattgagattgacattaatgatctcagtgaccatgccttgtttcagttgcgggatctcttagacgagcatttgcgtgagatccaaaacaaaaaatcaagtgttgaaccctgtgagatagaggtatatcttcgtctatatctcatgtttgaatcatctaattgcatcatcactgctaatagggaaacttttatctattgcagcttctgcatggatcagtgccagggaattcatcaatgcaacattgtgatggttagttcacagcctgcttgtggttcgataaagttttttgcttggctctttaatcagagtaacattttttactgtattcgttgtagggagtgaattggatgatgaagttgttgacattggtgaaaatgaacacccaacatccagcatttctcctgtcacgatagagaaggatctggtgttaggaaactctaatggtatcttttcttttgcttgtttatattgacattcttgttctccatagaacttttgttggggtatggttgttacatttgtcatttccaaactctcgtgacctcagattttctcagaagtggccttggagccatattgttgttgatatgcagtgaacgttgctagcgcacttattttataatttttaaattaggaggccttttacattcacttgtttactaactaaaactaaattgcctttcgtgttccctttattgattttatggtgattagactatcccctgggttgtactactgattgctcctcttttgatgcatataatctaggtaatagcttgggaagtgtgtccggtgatcctaaaatgtcaagtttaccgagggcatcaaaggtatatagtggtctggaataacatgcaaacatgaataactgagatttggtgcgacacaatgcatatgtcgatgtggatatctttgttaccttgtcataaagttgatataatttgatatggaggaactcttggaccacaattttttactgttgcggaaccataacaatatgaaatggatgtcatagtttgtttgaatcctgatatatataaaattcaacttacttgatggttcccagatttgttaggataacctaattgtttcttcgtgctcctgtcctgcgctgatacaggggcttggaaccatcgatcttgaacctatgttggatggagctacaagcgcttccccaacaagaggatgtgagtggattttttgttagtggtcaaaagtttagtttttgggtgtggaacttatgttttgttgctttatacaagtagcatctgttggtggattggatcagctggaaagtgcatctccggagaaaataagttctgttgaggcggattgtcagcaagatggtaagaaaaggagtatggcagaaaaatgtttctgctcttctgtctgaggtggcatctcactcttgaccttgaccctttaatacactaggaaatagtgctcagaatgagaagcaattacctcctgaaaagagctacagggctgctattttgaagaaccgatttgcagacataattttgaaagcccgagagaaacctcttaaccaggtttgttgtgcgttccaagttccaacccactattctgggtcctttttgacctttgaattgatttttcgtaaattctatgtgttcctgagatcagaatgacactcgagatccagagaagctgcagcgtgagagagaagaactcgagcttcaaaagaagaaaggtttgcttccttgatttgctaaatcaactgtagttggtgacatttaccagttgtaagtgataaaagcacactgcaacctgagtttataatatgtgccctttcttaacagagaaagcgcgattacaagcagaagctaaggcagctgaagaagctcgtagaaaagctgaggcacaagctgcagctgaagctgcggctgaggctaagagaaagctggagcttgaaagagaagcagcacgccaggcattgatggaggtaaagatgttcattacaacgaaatagtcattactatattataatgggtgaactctatcattaagaaaattggaatatctagtcccattttttcactgaaacataagttttcatggtatttggtgcagatggagcagtcggttgaactcaatgagaacgcaaagtttctcgaggatctagaactgctgaaaacagtcgacacagaccatttgacaaatacaatagaggaggaggatgggcctgatgttgggttgcgtagtttcagttttgggggtagtaatcctcttgaacagcttggactgtttatgaaacaagatgaggatgaggaggaagctgacccgctaacttcgccagcccctgaaatagatatagaagagggagagattgattgaggttgtatgctgatccccaaaaccaaacaatagatatatctgaattctgaatccagaatccatcccaaaaaaaaacatatactgtgagcttcaagtagagagggccgttcagactgaggattggattttattggtactgagagtgggaacgtagtcattcatgagttaagttttgcttggaatggtcgtgagaagtgggtcatcgtctttttccctttgcgttgtgttgtgtgatgttggtacgggttatcttcgtgcttcttgtcgaattgagtatattgtatcagtaaagaatttataacttaaaaagagccttatgtcaaatacgacgtcgttttgtatggaaatggattttttacaccgctgaaaaaataaaaagaaaactcggaatctcttcttcttcactcaagaagtcgctctgaaacttggaaaccacatttttgttctctcaagagtctgttttttttttctggcgtaagtttgaatttcatgaaaagttgttatcgctagtcgatttagtgtaattgatatcctgattaaggcttttctctgcatgccagccaatcaggctagaattgtgaagtataaaagtaagcaaattgacaatg

SEQ ID NO: 28894 - DNA, 3003 bp, Unknown; identical to SEQ ID NO: 16497
  misc_feature (1)..( 3003): 2750-1469P.txt file - cDNA_ID_2999260; gDNA_ID_2926231; Annot_ID_142656

SEQ ID NO: 28895 - DNA, 3000 bp, Unknown
  misc_feature (1)..( 3000): 2750-1469P.txt file - cDNA_ID_2999264; gDNA_ID_2926231; Annot_ID_142657
atcaaatattagaaatctatctaattatagatcaattctgaaagacattaggctatatgtcctagtctattataatgtttaattaccaacctaaatttagaaatctgttaggaaaacaaattatataaccaaattgcattagtttttccttaattgaatatttaacccttcatgccacactcttaattaacacccaaagaaaaaaaaacccgccatgactcatatataatgtaatgtgataaacagataatgtaaacattacaatttccattaaagtactatagaaacctaggtaaccgatcgattattacttattagacgttaaaagaaattagatatttgatttatagtcgacgtgtatgtatatatatatacatacatctttcttttccgtatagcttacattataggtagtcaacaaacttactatacttcaatatatttaacttttgtgtggtacatcaagaaaataaaattgcagctaaccaaatattcgtttttgttttggtgcactgaactgaactaaaatttagaaaaatgtaatatagaagagtattgttgtatatgagagggacctcgacaaaatcacaaaaacaataaataatacgtgagagaccgttgggaaaaagagtatatacggagcctacgatgtgtaagaaaaattattaatgcaagggaccagaatcatatttaggcccactaaaaagcactgtctctttaggtccaacttaatcttcatatagtcactaattgggcctaaaaattgtaactgtagttatggatagcgttacgtagaatattcgtttagcatatcagtttctcctttccattcgttaactaattttttctttgcaaacatactgtatctaccgttttatcaaataattttctttttattatttgtttgtttactagaattacagttttttcaaacagataaataatcatattaataataacatttgctaaatttagttaaaagaatcatggtgttactttttaagttttactggtttgctttcaagtttcaagaatgattgtatagtactttcggatgtttgatctttaaaacttgttggtacagttggaatgctttattggaaatatcaaactatcaccaacgctaacatttctattctttttgaacttcatcaagagccaaagcccctgatcggcctcacaaaagacaccattttctttggtctccggcaacagaacatggattggaatcaatccctaatcaaaccgggtcaatttggcttagtcaagaaacgtccctcttatgtaacagctgttccagaacggcagaacattcacgaacatataaatgggtgtccactaacaaattcaaacacataaccatgatcactctgtccttttttccatttttttaaatattcaagtaaacaacatgtaaattataacgaatttaggtcgtctcaacatcatgactcattcacatgcgttgacttttaacccactaaacattttttataggacccctctctctctctataaattcgaccccctttgttgatagatcatacagagaacaacaaagaaagaaaccaaataagaagaaaaaggagaagaacattcaaatggcaccaagaagttctttgatccgcttcgccttcatctgcattgtcttggccgtgatggtcatgactgctgagtcgcacaacggaacccaccaccatggtccggctatggctccaatgccacccatggctaaggctccgtctccaagtgccgccactttctccgcctaccctcagctcatcgccaccgcattggtcgctgctatgtctttcgtcttctgatgagatgtgttgccattcatcttcagaatatgttttactctctatgagattttattttaattttcacatgtattccttctttttttgttaattcttcaaagattgtgatgttgtgttcctatcataataaaacatttatctcttgatgttttttttattatcttaatcatattttcctctttttcgaaccaaatcttctaatcaaggcattataatggcccgtttgagaaaaggtggactttctttttaaaatcaactaattcatcttaaggttatagaatagataaatatccgaagtaaatatataaaataaattgggtcagcctaaacaaaataatgaaatgcaggccttacgtgacagtaatgggtacgcctcaacaaataatggtgtattcactattcagacgttggtgtcaaaatcaatgagtgatatccttattagaagaacgacaagctttaaactagtttcatgtgtaaagtacgaaacaataaacatcatgaaaacactcgaaatattgtagtaaacttgccaacaaaaccatgagtacaagtgtacaactccaatgaatcagatatatatgcaagatggaaaaaatccccaaacaccttaaaatacaacaacatgtgacaataacgaagtgaacgaccatctcgataaatagttaacaagactcattctcatccgttgacttttcatctatacacttaccattttttttatacaatctttttctatcatgactctatcctcaatagctacgtgcccacatggagccaaggctcatgcctttcgtcttctgatcaaatgtgtgtcattgatcacaccattcatcttagttgttaagaaaatatctgtaaatcattttttttttcattttatagttgtatcactttattatagtccactcggtttttgcatttttgttatagtccactagttgggccgtgttatacaatagcgagcctatctcaacaaaaaacaaagcccaacaagtatttattttgccagttttgtaagcaattaattgaatagagtaagtagagacggagcaaaaacaagagaagcgtttggattcgacgtttgccttatccgttcagctcatcttcttcttcttcttcgtcacctctgaattagtttcccagaatccgaaattcctaggaagagaacataacaatg

SEQ ID NO: 28896 - DNA, 3000 bp, Unknown
  misc_feature (1)..( 3000): 2750-1469P.txt file - cDNA_ID_2999271; gDNA_ID_2926231; Annot_ID_142660
atattatttcacaaagaaattgacaaaacaactaatttgacaattttgtttagttttgtttatacgattatagtcggacaagtagtggaaatgctgttaagatcaagaagctttttatctttgaagccaggatcttctaacaacaacactttgtctttatccccaacaccaaccatgtgtagatattcatgatcctctctttctttccctttgaatactagcctttgttgttttggctctaaaccggtaagcaatgataataccatcttaagttctcctgtaaacccataaatagaatcttatgttatgaatctgataaagagtcatttaaaagtctcccaaaagatgaaacataaaggttgagaaatgctgagggacaagaaacttaccaaaagtggaggtggcttcaatggaaagatcatgaaaatgagcaaaagtagagactctaatggagatcaagtcttcaccaatactctcttgtcttttttgaacaagcatgcctcctggcctaagttcccatttgatctcacagttgctgcagctactattgttgttgttgttaccaactcccttttgttgttgatcttgttgtgtgcctttgttgttgattcttttaccaaatccaaatctaatcccaaacctcttggtcttaaacttcatcatttctttctacttttgatttctatggagttttttcttttctgttttctctcaagctttgggatacatagaacatggaaacatttaggtggtttatataagagaccagaggttaagataagaacaaaaaccacatacatacttgcatgtgcaagttgttttttatataatgaacaagtcttcctcttttatataccttttttgtttatgttatgtaattatgtatgtggagtcaattattatagtacaagatattagccatgaataagtgccgacaaaggataaatcagatttaaataggattgatcgagactgttaagagaagagtttcagcacatgggcgatggttcgactgctgataaacaatgtttccttgattggaggatcccgaacacgacaaaacgtaaatagaaaacaatcaacattatggtattaatgttaattaatcaaaattatatattatgggtaggctttgttttgtctaggaatttcggcgtaccaaccttgttgtattaaagtttatctcagtttgacaaattattttcatacttatttttttcttctatcaacactattatgatactaaatgcattacaaattttcgaaggcttttgtatggtgctagattaacgaatacatgaaaatattcacaatgcaaaaatgttgagaaaaaaaaacagagtagaaataacatacgatataattatataaccatgtatgatgtacctaatcaagtaaaaaggacactagtttaatttgtttctttaatgtcaatgaaaagtgattacgtttctttcggatgggtaaatttgaatcttgtgaaaagatcgccatgtggtaggagaggaccgtaggagtaggaccattttgaaaaattaataatgcatggaaaccttgtgaaatagcttattaatcaggtcaaggttataagaacatacatatcagtgtgtgagtttgtatatgatgaatctaaaaataaaatcttcattcttcgacaagatattcttatagagatcaaacagctcagcttataatttggggaatatcagtctgtctgtctactacaaatccaaatcttaatcattttgcaactttttattaatcttaacaaaagacaaagatattttaccgtacgtctagtgattaccttcagtgtgttacatgtgattaatctccgactaagtcatggatcttcaacataaccaaaccatacatacacatgcatatgtatgtgattattcattcattattgatagacaagatgaaatgacatagcaacatgttgtcatagctagaagacggctttagagatatggagaatccacatttatatttctcctttaacaatcgtgatccaccaacatggttgcccatcataattatatatacattcacatatgtaaacataggaaggggaaatatatatataagtacacaataatgtttgtggacattttatacatgcattatatgtttatgtgcatgggccagacatgtttattggatttttacaaaggaacatatatcctttgtacccaacctaaagcatggtcttcaatgcatctatgtcatgtggaacttgtaatctattcacgtttgaatgataataattaataaacataaaaatactttagaatataatttttgtaacctaaaattatagttaccacttacaaaaaaactaatttatcaaagctaacacacgttcatacacaaatttttttactttattttatttttctcaaattatagcatttatgtatagatcaagtccatattttgcagtaaaataaaaacatagagataaaaattaaaaagtaaaacgtaaaaaaaactataaattatcaccgtaaagggccttaaaacacgagtattgggccaatgtattgggtttaattgtcaaaacgacactgttacacttacatgtttttcctcttgcagcggttgtagcttacccccgctcatgggagatgattggatggccacaagagcaccacaccatcacttaacccaaaaccatatctgtttgggctgcgtctgagttttcgaattccagattgttgaagaatatttattcggggttttgttgtgttaggtgatgaattttacagaaaagttgcgaccttttaaaaattgtttattcctgtgaattttgcgagtgtttggtttctctttgattgttcttgctggtgaatttgtgttggaaaaagatgcaagctttaagcatttggctattaaattctggtcatttagttggatcgagattggaatttgagttggattgttcttgttttgtagttagtcctctgactagaaagaggcattgtcttgttgaatatg

SEQ ID NO: 28897 - DNA, 3000 bp, Unknown
  misc_feature (1)..( 3000): 2750-1469P.txt file - cDNA_ID_2999275; gDNA_ID_2926231; Annot_ID_142662
aaaaaaatggcacgtcaatttgtcgttttggttctattgactttaactatcgccaccgctttcgccgccgacgctccctcagcttctcccaaaaaatctccatcacccactgccgcaccaaccaaggctccgactgccacaaccaaggctccttcagctccaaccaaggctccagccgccgcacctaaatcatcttcggcctcttctccaaaagcatcttctccggctgccgaaggacccgtccccgaggatgactactctgcctctagtcctagcgactctgctgaggcacctaccgtctcctccccaccggctcccacccccgacagcacttccgccgctgatggaccaagcgatggacccactgcagagtcacccaagagtggtgccgtgacaactgctaagttctctgttgtcggcacagtcgccaccgtcggcttcttcttcttttctttctaagttaagtcgtccacgttttggttggatggatcagagatttgtataatcttttgagttgaggccgtaaatttattttatatatacgtttataaatcgagattaattggagtaaatataaacctaaatgtcattttgaaatttggttagaacaaattttcatattttgtttaataaacttattttttttggaaatgcttatgatttgtgtggtctaatggtcttttagttcctattgtcatgtgttgtgaattagatatcatgaatgatataaatggatatttctacatttttattttaaaattttgttggctaatactaaattgtgtactatttataatattcatgataaaggctattacacatttttaatcaagttaataaatttaggatgctttaatgtactaacctcttttggtgccaaagtcagccaatgtgtaaatacaagcttagaaacatatttaaatatttcatagaaaatatttaaattttggaaatatttgtttgtgtgttttttgactgattattaaaaaaagttatgtaaaaatttaaattaatagataagttgtactccatccgtcttaatttagttgtcgttctagcactaaaatattgttttgtaataattgtcttttttttttttaaatgtaaatgtttggtacaaattttaattatatacttattatttaaatattttaactaataaaaaattagaaaatatattaagtagataaaattaaataaatatttttttataattgctgtgcaaaaactttagaggataattattttaaaacagagaatattataaactatttctattattatcttgtttcaaaaataaaaataaaaatttcgtagttaaattaaaacatcttagagagaatgtgaaatcaaataaatcagtatattatcgtatggcatttttacaattaaaaaataaagcaaaaaatattataataaaaaatataaaaagaacaaaaacgttaaaataatataattaatctttgagccgaaacaaaaaataattagtcaatggaggtaggacccgtaagaattgctctttttcccattcgctctgattggttccttctctctcccaaaccttttctttttttttttgtttcctcttcagcttttctttttggccaacgtcaggtttcttaaatgggctcattcgtaactccaaattttgcgtaggttttaagttttacctgtaaaatactagtcaaacctagcaattattaacacgaattcatagacaattgtcatgtccatttcttgttgttctatcaaaaatgtgaaaacccgtaatactagaatattctaatagatcacgtttaaacggcattagaatatcaacattgttttatttactacagaatccactttttgaagggtaaaaaatcgatccccttgtgcatatgaattttctaaagtaggctttttaaatctctcaaatttacacccatcaactttatgagaataaatgacgttgcaggccttgtagagaaaatgtacaagacaaagaaaatgtatagaactttatttttttggtttcacgtgaatgttatcacaaaagaaaatctatttccacgaaaagtgtcatcaaaagacagtaatagttcaggatgctactgtactatataccacttcatttgtcattgctgtcggtggtggtagccaatttacgataaacccaagttcaacagcattatttcccttacgaaattaataaatgaagtgggttcatttttttttgttcttgtcaatttatgaattggattcggattttaaaattttagagttcacaattcccttgcgtttgattacagcgtggaatacaaataatgcaaatgatatcttctcacggaggaatgtcaaaagatatttatatcactttagatataatattggatcaaaaaaatctcatgttaatctgttgatgcctaaagaaaaactgatcatgttaattacctttgcttaatgtcaacctcatgttaatttgaattaaaatatatttaaaatgtcaactttataaaaatgttggttactaatgcacatatcccaaaccttttttaaaaaatgtgaacattataaaaatgttggtatctaaaaagtagaaaaacaaggtgctttatgaaaagttgaaaataagaatggagttacccaatatataattaactaatcagaagtttaagacacagatgtaatgtagtaatctaatccaaccttattatctcctgcacatccaaacagaatccaagattacaatagctttatccaatgactgatagacacgtgtcaaaaggtaccatcactgtcagctttccctctcgctccacctacatacttctgagtgagcgagaaaatgagaacaaaacttagaaagcagagaagagttaaagtgttagagagagagagagacagagatcggagatgtgtagcaacaaagcaagtccggtcgtcggagaagaaaaacagagtacgagatcatcgaagaggatcaagaagagaaaaaacagagaagctaccaccaccatg

SEQ ID NO: 28898 - DNA, 3000 bp, Unknown
  misc_feature (1)..( 3000): 2750-1469P.txt file - cDNA_ID_2999279; gDNA_ID_2926231; Annot_ID_142664
aaagattgcacatactttgtctaattctactattgacataaacagtacacatttttttaataataaaaaataactataaaagataacaatatatttagaattgacaatcaaaatggtaaaacggcggtatgcaaaacattattatttttattattattattattattatttatgtacaatcccaaaacattgttatttaataataattttcattgggaaaaatagtgttaacaaaaactagaacacataaaaaaaaaaattgaaattatgaaaacaataattttttttttttgatactgagaataaaataatgttttatatatattcttgtcctctcaaatgatttcatggttaactagctagtaaaataacaaaggaaaatctaaatacttcgtgtaaacatttttttaagagaacctcgtaaatttatcgagtcaatcagacaaaataattgagaatgcagatcgcagaagaacaaaaaagtatataagaggaatgtaagaaacttttattttttttgtcaaaagaggaatgtaagaaactaaatgatgaaaaattgacgcacgtgtacgtaatttgggaccctcatgcaataagtttgttggtataaatttatgttctttcaaagtaaactctctatcttcgtaaatgacacttttcgttatcttttgacttttatttacattcgttgttgttttcatctataattcgcttttcattcacttgatcgcatgctattcacaaaaataacagctaattaaaatcctatataatcgtttgattatagatatgtgatgatgtactcaacagacataaattatttatatatattaagatttttttttgtcgaagtaagcaagtaagaccatctccatcggtggtttctcactgaaaaactccaaataaaaataaatcaaaaatatgaaaataataattttttaatcagtttttctcagaatcgtttttgaaatgagaaacttggagaaactttctctctcttccatatgtcaccttgttattaatttcttttctttgttataaataaaattatctatactttataacatcaattaaatactttatatgtttgttattttttttatttttactttaaaaattcataaaattaaattatctatataacaagctctatcatgtatatgtttaaattatatacgaatattatttaattggtgttagttaagcattaaacataataataacttaaaaatacaatagctttttttaattagaaaacaaacatttaaaattttctatttttattttgcaacattctcggcaatcgaattcgacttcgtgatagagatatgcaccaacaactaaaagatgacctagttgagcatatatgacaaaagtttggtgcatcatcaaatgaagagtaaaaccataatagataatatagttagctttgatttatgttatcatggttttatatgtaatttctgtttaatttatatattttttctatttaatttatgttatcatggttttatatgtaattttatgtttaatttatatattttttattatgattttatatgtaaagtaatgtttaattatgtttaattatggttttaaaaataataaaactatttaataatataatttgtaaaaataaataattgatatgtttgaaaatattgtagagatattaaatttaatataaaaacatataataatatgttaatgttaatgagatactcataccaatggaagcacaattttaatataagtttttctacttaaattaaacataaacatattaataatatattatgagatactcatgaagtatctcaccaatggagatgctctaagattcttcttctaacaggttaaacaaaaagtatgtgagtttcacttgtgttcttttaaggttcatttttcacaagcttgacttgttgccaccacgacgttaaggttttcctcgacgaagcccatgagtacaacttcttaggcccattatataacaagatttgtgttattaattaatttatcattttcagaataatatcgttttccagaggtttgattttttctaatagcttttttttttcaacaacagtttgtaaaataattttaaatagtatatatcatgagaagaagaaaaatagaaatataagaaattacagcacaagtttaaaattctttttacgaataataataattattaaattgataaaataacattaaaaatgataagctgtcacacaaggcatgaatgagtgaagacccaccactccaaaatttgctttccgcttctaatttttcatggacccgcattaagcaaaccaacatacatacataccccttccttattcttttatttttcttaacaataaaaagcttactaatattattattcattcttttgtcatcttatatttatatttttatcgttagttgttgatatttatttcttgtccaattaaatcataacatttaagtgcctttcatgttctctcactcttatatttcgccattcctagctataaaaatacacatgtttatgtttaatcataagctttgatttatcactccaccaacgctaaattattactctaaacccctttttatctgcaaaagtaacattataaaaaaaatgtaactccattgacatataaactctaactcgtctgcgaatctctatagttttaatatcttaatctcttttaatttcagattgcataaaaaaacatttttcagggaaagtaatcttcaattttctgtagttaaaatatggcaattttaaaataataataagccaaagctcgaaactttaataaacagtttttgttcattctcttgctttaccatttcaaagtgccactttttcttcctaaatcctctctctctctctccgttcccgagacaagcaaaagcttcaatctcaaatctttcagcagctacaaaaatgttcttcatctaaaagagactgtgaagcagagagagagagagagagagagagagagagagatg

SEQ ID NO: 28899 - DNA, 3000 bp, Unknown; identical to SEQ ID NO: 28898
  misc_feature (1)..( 3000): 2750-1469P.txt file - cDNA_ID_2999279; gDNA_ID_2926231; Annot_ID_203689

SEQ ID NO: 28900 - DNA, 3003 bp, Unknown
  misc_feature (1)..( 3003): 2750-1469P.txt file - cDNA_ID_2999287; gDNA_ID_2926231; Annot_ID_142668
tgcaagagcctccgtcacctaaaacgaaaacagaacataatgtgaatcttttctgtcaaacccatgagaatctacagttttcaagttttgtaatcatcaaagaacacacactagattccactaaaaaccaacgcgagactcagctaacctgctccaaagaagagtaatcatcagaaattttcgaatacttgcgctccaacctcttcttattatcactaccataactttgagaaggcggtgcagaataagacggagcagagtaaggctgagtactatataaaggaggaggaggttgcgtatactcaggaggttgggcataagaaggtggaggagggtaattatagctttctgcaccatactgaggataactttgttgagaagcccatgaagatgaagatggtgatgctgatgaagcagaagttgacctaaacgatgactgtctccagttttctttagaattccctgtccccatcaaacttaacaaaaaactaaacctttttagattcaaatcaaacctctcaggtcagttccgtaccctgcaaaacaaagatttagcctttagagtatattcatgaaaccccagaaaaaaaaagcagaaactttgtttaagattctgacattattagaagatgcaatttacctatacctaattcgttaagaaaaggtgaaagctttatctttgacagatgttgaattatctcaccgctctttaaaatcgaaggttggtagagatgtttatataaagaaaggagattcaatcacgtcacgtaattttccacaacaatacgcgatttagtgacttctagattaagataaaagtcctattacgaaaacctactccaacactctaacccacaataagtaaaacaaacaaaaaccagtttctgacaaatctacgagctttccaatttcgccgaattgaactgaaacattctctgattcatcaaaccaaagactaccccaaaatcgaaaaataacattaattcgagattgaatctcccgacattcatcagaaaatgacccaattcgattgagaggaaaagttgtctacctttaaactaaacgaagcagaggaatgacgaatcagagaagtactttgagagagagtcagaggagcttcaatggcggatcgaatactaaagagttcgcctttaaagtttcctccttttgttcgaaagcaatttcacttttcttctgtttgttgtatttggtttgtttctatgaaatcattaggagactaatcacttttctgtttttaaaaaagtgtgaagcacgctaatggtggaaacttcttctaattttaccccacattttattctctcttccaacaattggccctataatattattatcgatatccaaagtcataacatggtatcaattgacaatttcttttgattacttgaaattcttaaattgaccatttcttaaaaagtacaaatagtcaataactaaactaacattttttaattccaaatttttaatctagaggattgtattatacatatgtaaattatatgaataaaaaatacttaaagaaggaaaacataatcaataattagtttaaaaaattgcaactcagaagtttagaaatgatgtatcatataaataggactgccaaacaaaaaaaacttcttctgtatgatttgggcaaatactaatagtataataacaatgcaataaatacctttggggatgaaatggatggttatcagaagtttccgaccacgtgacaatcctatcctatcttcaatatctttccttcgtcgtgcggttaaattgtcaatgttccttaactacgtcaattttttcccttttcggatttactcgataggtactgttgaatattgcaccttgtagactacaaatattgagagtttgacttttaaattatcatccattcgtcttcttttttctttgctcgagagttctcgctcatgatgcactcatgcttataattgattaacctttttttcttcttgtgtgcaaattattgattaactaaagttgtcttaatttcagtataaaagtttttgcttccttcggtgagcaagacacaacacgtgaaacttaaatggacttacattaaagtatgaaacttcgtacccgtgatttatgctactcttttttttctttcttggacagttccttcaaggagcaaacaagaaatacgtggactgcactttcaaaccaaataattatagaataaaatcgtattagttcctctatatagttcataaaagcatttcgaatctaatggactggagtaaactagaataacgaatgttaatatgcattatataagtgtaatactgactagtgaacgccacgacattcttaatatccattatataaataataaatgtaacacaaaccactatattcatggttgaataacaaatgtatttattttcttaacatttacaccaaaaaaattaaaacaaatgttacctgaagaagattcactgaacctagtaattaataagtactctccattttgtttggtcaacttattcatatactttccataatagtataggaacattaaaactgaattgaaatcaaagaaatctattgatgatttattatcttctacaattgaatgtgttcgagtgtttgaccgtttcataaaaatatataaaagttacaactataagatacaaaaactaaaaatcgaaaacacaagtataaagcccaataagaaactatataaagcccaatattattctttaaaagcacatgtatgctacctacaggcccatttagttttaaccgcgtgttttagttaaggagcatagaaacaaccctagtccttgccacagaggatcacagctaaccaaatattcccttgcacgtaaaatccgacactggtctatttcgtcgtcttcgacctcgagggaatctactgtagctctcacactatccactcttcatcggcagctagatttccgggtcctcagtatcgggtcagatctagatccggatccggagacgctgagaatg

SEQ ID NO: 28901 - DNA, 3003 bp, Unknown
  misc_feature (1)..( 3003): 2750-1469P.txt file - cDNA_ID_2999303; gDNA_ID_2926238; Annot_ID_142800
cagtttcgctgggacgtgctctattcagtgccattcccattcttccaataactcatggcatcaagtgcaatggtaatgtttgttaattttgatcttctgagtcattctttggcacgggttacacattattaacagtattccctaaaaatatgtagatctgtatgctttcgtcattggcacatatgccttttggactaccatatctggggccaggtatgctatcgagcatgtcaagtcaaagaggacttcagtcttgcttaaccaaatatggaaatggtgtgggattgtattcaagagctcggtgctgttagccatatgggtaagtgttttgtgctgttaaattttcaatatacgagaaactctaaactctactaaatgtggattctgtacttttcaaatggtgattgaacaggtttttatcattccggtgctaattggacttctgtttgagcttttggtgattgtcccaatgagagtcccagttgatgaaagccctgtgttcctcctgtatcaagactgggctcttgggctcatctttttgaaaatctggactagactggtaagtaattttctccaacaatcagcaacttatttccgcagaagaagatattttgtcactaaaaaacaacgtcaatggacaggtaatgctggatcatatgcttccaatagtggatgatagctggagagcaaagtttgagcgggtaagagaagatggcttctcgaggcttcaagggttatgggtacttagagagattgtgttcccgatcgtcatgaaactcctaacggctttatgcgtgccttatgtgttggcaagaggagtgttcccaatgctcggatatccgcttgttgtgaactcagcggtctacagattcgcgtggataggttgtctttcagtgagcctcttctgcttctgtgcaaaaagatgccatgtctggtttagaaaccttcacaactctatccgtgatgaccgttatctcattggtcggagactgcataactttggggaagctgctttagctaatcaaaaccaaaaccaaagtagtgaggatgcaggagatggtgtcttgataggacgagagggagatgttgataatggacttaggctcagacgtgcaatccaacaagaagcttagaaagaaactgtgcactgaggcgtttaacattttgtgtacttaagccgttaagagatggctttgaaagatttattattagtcgatgtgtaaattattatatccgttgatgattctcttttttttgtttttgtgtacgaaactaaaagatctttagaataatgcttcgtttgtccatatgccttgtgtgtttctatgataatgcttctagaataccttcgcttactgcaaattcttgtcttttgtctcttatgttagtgcatgtaagccttaaggaattggcgttgaagatctatttggccgatgtgtgattgtagacatactcgttgatactgtttttggttttttattttccaacagaataaaaataagaggaatgttataaccccattagatagatgtccatatcaggttcatctcagacccatatgcttcaagggttatgggtacttagagagattgtgttcccgattgtgatgaaactcctaacggctttatgtgtgccttatgtgttggcgagaggagtgttcccaatgctcggatatccgctagtagtgaactcagcggtctacagattcgcatggataggttgtctctcagtgagcctcttctgcttctggtttagaaaccttcacaactctatccgtgatgaccgttatctcattggtcggagactccataactttggggaagctgctttggcaaaaccaaagtagtgaggatgcgggagatggtatcttgataggactttagggagatgttgataatggacttaaggctcagacgtgcaatccaacaagaagcttagaaagaaactgtgcactgagtcgtattaacttaggcttggaaatatttactagtcaatgtgtatcccgttgatcctcttttgtttgtgtataatatccaaaggatcttaagaaatgagtaatgacgcttcgtatatatatatgccttgtgtgtttctactttctattgtaatgctttttgaaatgattgcgtattgcaaaatctcatctctcatcttatgttctttcgtgtcacaattctactggaaggccaatcgtgtattaagttgaattgttttgataagtcaaatcttaacatattggttatttaattaagatactttttgcataccatataaaatcgtgcggtaaatattaatattaacaacttttactttaggaaaatcaaaattcatcaagatccagtgagaatattgctaatcagagttaagaaatgttaagataaatcaaagaaaatatcatcactgtacaaaattttaacaaacttggttactaattagattcgaaagtgtcaaacacgcgcgtatctgtttgacttttccgaaagtgacgagaaggaagacgaccttatcaattcaccagcaactctaaaatcaatcctacgatttacttcagactcgatccaacggctgagatcaatctcacactcctagggttcttctaggggaattaaaggtttcttttttttgttgggttaataatataaaagcaaagaaaaggagaaaccgtaatgcttctttttcatctatcgtaattgtgcttgtttcgcctagaatctctcggcccccaaatatctcactcgccgtcgcaggcttcgccgccggcaatttcttaccctatttcatcttccctctcctctgatatacccataaaaacacaaaaaaaacgaaaagataaaaactttggctttagttttgttgattttgtcattcgattcgatttctttttcttctttcaaattctagggttttcgatttggtttcagtctaataacgagaggggagggaagagtaactaaaaccccaaaaaaagtcaaaaaagtttcgaaaatccaaaaaaagataatg

SEQ ID NO: 28902 - DNA, 3003 bp, Unknown; identical to SEQ ID NO: 28901
  misc_feature (1)..( 3003): 2750-1469P.txt file - cDNA_ID_2999303; gDNA_ID_2926206; Annot_ID_141760

SEQ ID NO: 28903 - DNA, 3000 bp, Unknown
  misc_feature (1)..( 3000): 2750-1469P.txt file - cDNA_ID_2999314; gDNA_ID_1621108; Annot_ID_56015
gaaggtggagattgtggtggcggaaacaggttgggcgtcaagaggggacgctaacgaggttggagcaagcgtggataacgccaaagcgtacaacggaaacctaatagctcatctaaggtctatggttggcacacctctcatgcctggaaaacctgttgacacttacattttcgcactgtatgatgagaatctaaagcctggaccatcttcagaacgggctttcgggcttttcaaaactgatctttccatggtctatgatgttggccttgccaagagtagcagcagtagtcaggttagatactagaagttgtggtttttatttagggaaagtaatttattataacatgtaaacgcaaatgcagataaataacaatgttttaatttgtgaggttatgttttgatcataaaattagacaccatcaggaaaagtgacatcgtcggggtggtgtgtaccaaagaagggtgcaacgaatgaggagttacaagcgagcttggattgggcgtgcggacatggaatagactgtggtgcgatacaaccaggaggggcttgtttcgagccgaacaatgtggtctctcacgcagcatatgccatgaatatgtattttcagaaatctcctaagcagcctacagactgcgatttctctaaaaccgcaacagtcacttcccaaaaccctagtaagatttctctccccgttactttcacaccctaccaatagtagtttcaacttagtaacttagtataaaaagttgtaacaaagacttagtaattgcttttgtttgttgaaggtaatgatcaattctcttctactatgttttattgtagctaggccttgtaaatgctttaattgaccaaataatcggttttctacatgctttattatactaattgggtttcttaattatcttgaatctgaatttgataggttacaacaattgcgtatatccgggaggaggaggaggaggaggaggaggaggaggaggaagtaaagcagtaatgaacaagtatgtgagctcagacaaagtagagaagaagaatggagcaactgaaccaaaagtctcttcttctctatcttttctactcatctttttgtcccttatcttccatgtatatatgtaaatggctcaattagctcttggaggtaagtaattaattaattacgcctacttgttaatctcctctccttcctctgtattaagtgtaatcgagtttgttattagtttataatggttacacacattctatctcaattgtattatatagtctgtaacggctatatctactagacttcttttggtttcttataaatgaatctgaatattatctttggataaagtttcctatattccaatgtatatctatatccctcttaaattgttacattttacgccgtacctttataattgggcctattgtaaatttaaaccggtttagctggttcactttactgaatttacattttctgaaaataaggatttgagccgaacctacaacaaaaaaatgaaaatttgacccggtttattttggtttactcatctgaaattaccttttatgaaaaggagtcgacaaataatttacttattttcttcggttaaggaaaataactatttccttcttaaaaaaggaatggttgatctcaccgactctagctagggcttataaatacaaagacgcatagggtttcacaacttcatcaccttaacacaatttgttcgctctctaaattcttaaatctttcatcaaatttgcttcacagtgaaaaacctcctccacaaggaacacacaatgtcttcgaagatgatcgtgttgatgagctccgatggtcagtcgtttgaggtggaagaagcggtagcaatccaatcgcagaccatagcgcatatggttgaagacgattgcgttgctgatggaatccctcttgcaaacgtggaaagcaagattcttgtgaaagtgatcgagtactgcaagaaataccacgtcgacgaggctaatcctatctctgaagaggatctcaacaagtgggacgagaagttcatggatctcgaacaatccaccatctttgaactcatccttgctgcgaattacctcaacataaaaagcttgtttgatctcacatgccaaactgttgcggacatgatcaaaggcaagactccagaggagattcgttcaactttcaacattgagaatgattttacacctgaggaagaagaagctgttcgtaaggagaatcaatgggcttttgaatgagcccatgaatcaaaaacctaactagctttctttttcttttttccttttagtgttcttttttttttttgcaacttcttgatcaataatgtagatgatgatcacttcgtctactttttaaaatttttttttttgatttgtattctcttgagataatcttttgttggatattgatatgcttaaccaatgtgtttttattttattttctcttgagacaatcttaattttattggattattgatgttcttgtagccaattcagaaaaacagaatctattagacaaattaaattcacgtagcaaaataactaacatgttttctcttttcttgtactgtaaattacgtttcttaaaaagaaatatgtagttaaaaatccttcaaattcattatattgaatcgaaaatctcgtccaaaaccaaaaacaatcatagctcttaaacgatatcgtttaatcattgtgagagggtccactttaatgggaacagtcaatgtctattgaccctcttctctctctctagctagtctcaggtcagagaagccatcatcaacattcaacaagagagccgtgtttgtgtcttgactgattcttctctcaagcttttttaatctctctctcttttcccacgtaattcccccaaatccattctttctagggttcgatctccctctctcaatcatgaaccttcttctcttctagaccccacaaagtttcccccttttatttgatcggcgacggagaagcctaagtctgatcccggaatg

SEQ ID NO: 28904 - DNA, 3000 bp, Unknown; identical to SEQ ID NO: 28903
  misc_feature (1)..( 3000): 2750-1469P.txt file - cDNA_ID_2999314; gDNA_ID_1621108; Annot_ID_171659

SEQ ID NO: 28905 - DNA, 3000 bp, Unknown; identical to SEQ ID NO: 28903
  misc_feature (1)..( 3000): 2750-1469P.txt file - cDNA_ID_2999314; gDNA_ID_2926207; Annot_ID_141795

SEQ ID NO: 28906 - DNA, 3000 bp, Unknown; identical to SEQ ID NO: 28903
  misc_feature (1)..( 3000): 2750-1469P.txt file - cDNA_ID_2999314; gDNA_ID_2926207; Annot_ID_202316

SEQ ID NO: 28907 - DNA, 3000 bp, Unknown; identical to SEQ ID NO: 6837
  misc_feature (1)..( 3000): 2750-1469P.txt file - cDNA_ID_2999318; gDNA_ID_1621108; Annot_ID_56031

SEQ ID NO: 28908 - DNA, 3000 bp, Unknown; identical to SEQ ID NO: 6837
  misc_feature (1)..( 3000): 2750-1469P.txt file - cDNA_ID_2999318; gDNA_ID_1621108; Annot_ID_171685

SEQ ID NO: 28909 - DNA, 3000 bp, Unknown; identical to SEQ ID NO: 6837
  misc_feature (1)..( 3000): 2750-1469P.txt file - cDNA_ID_2999318; gDNA_ID_2926207; Annot_ID_141811

SEQ ID NO: 28910 - DNA, 3000 bp, Unknown; identical to SEQ ID NO: 6837
  misc_feature (1)..( 3000): 2750-1469P.txt file - cDNA_ID_2999318; gDNA_ID_2926207; Annot_ID_202334

SEQ ID NO: 28911 - DNA, 3003 bp, Unknown
  misc_feature (1)..( 3003): 2750-1469P.txt file - cDNA_ID_2999324; gDNA_ID_1620655; Annot_ID_47845
tttctttccaaaagcttgccttgacaccgaagcacaacaagatatgctcaagtctctgtctgcgacccttcagcaggatttcaggagcttaaatcttttcattgataaagagcttgagctagaagttgtatttcccgttagagaggaagttgtttttgcagagaacccacttatcaacgcaggaaccggagaggatatgaaaccattgcctttggaagaaatttctcaggaagattcttcatggatctcacacatgataaaggcaaatgagaaaggtaaaggcgtgtcactttcttgggagtaccaaaaagaagagccaaaagaagagtttatgcttacatctggatgggataacaatcagattggatcaggccacaataactttctttcagaagctgagcagtttcaaaaggtgacaaattcaggactcagaatcgacatggatccaagttttgaatcagcttcctttggtgttgggcagacattactaggcagtagaagaccaggtgagaagagaagaacaaaaacagaaaagacaattggtttagaagttcttcgacaatactttgcaggaagcctcaaagatgcagccaagagcattggtggtaagaaagaaaacttatagttattatgtctatcttatcaatctctcagaaagtgatgattcattcacgcagtttcattttcatgttgcagtttgtccaactaccttgaaaagaatatgcagacaacacgggataacacgatggccttcccggaagatcaagaaagtggggcattcattaaagaaactccaacttgttatagactctgttcaaggtgttcaaggttctattcaacttgattcattctatacaagtttcccagaattaagctccccacatatgtctggtactggcacttccttcaagaatccaaatgctcaaacggagaacggtgtttcagcacagggaactgctgcagctccaaagtcaccaccatcatcttcttgtagccacagctctggttcaagcacctgttgttcaactggagctaatcaaagtaccaatactgggactacctcaaatactgtaaccactctgatggctgaaaatgctagcgcgatcttgaagagagctcgtagcgaagtgagacttcataccatgaatcaggatgaaacaaagtccctctctagaaccctgagccacaaaacattcagtgagcatcctcttttcgaaaatccacctcggttaccggagaatagtagcaggaagttgaaagctggaggggcctcaaaagtgaaagccacatttggtgaagccaaagtacggtttactttgcttcctacttggggcttcagagagttgcagcatgagattgctaggcgttttaacatagataatattgcaccctttgatcttaagtacctggatgatgacaaggaatgggttcttctgacatgtgaagcggatctcgaggaatgtatcgacatttatagatcatcacagagccgcacgatcaagataagtgttcatgaagcttctcaagtcaagctgggaggttcttttggtagcatcggtcttggtccctcgttataagctatcaggtataaggttgttacctgcaagaaaagaaaagaaaagagcaggagattcgactaatttactagtgtgttagaaaaatattactcaccattttatagcaatgggcatcgtttgtaaacatattttcagtgcccccattttgcaagcagcagtagtggactggtttcctgcatcggcttagcagattttttgtataataaggcgatgcgtaccagagaaacatgcttatatgtatgtattattattgtctgtacatcatttgtcttctggattctactaagctctgcaagtatgttaaattgatatatcttctacatcgtcacttgtatttattttcttacttaactatgcatgaaattcttaagggtgctttttggggcatcaaagcttactgtgtacaaacattacagtcaataaggagttagtattcagaaagaaacaagaaaaaacattatgccagtttgaaagtaagaaaaggctagacgttttacttatataggcaatgatagtcatataaacacagaagctatttttggcagaaaaagtagagaagaaagtgtatacttggatggtgaggacacatgatatttatagagattctcttggtttttaagcaggaatatgtgttcaagagagagaaccacctagtggagtgatcttccaagttcctaaccagagtatctctgttaaatcctcaaatcagtatttgttaaagaaacaagtaagcctgcagacaaaaggttctcgttttggtttgtttttgtttctttctgattcagtgagtgacacaaaggaagatattgatcctgaacctatcattgccacctaaacttcagagacaggagaaaacaacatggaaaacaaaaaacctatgtcaagagaatcagaccaagtgtacctgattgtaccatttggtactaaaaatcaggatgacgaaggagttgattcacgtgactatgcttcgaatctcttaacattgccaatctccgtgtttctaagacttctttcaccaaagccttgatgaaattcgagggtgcaagttatgattttgcaaataatgtagtactctgcatgatcaatgattttgcggcaattttgtaaatatctgaagtgaaaaataagcaaatgtcaaactaaattaattactgagtaaatgttgatgaagttaaatgattggggggatttgtataaatatcttaattgacgattctgaaacaaagtggtctaatcggtgattatctattgttttatggaaatatcttaatgagatgaagattttggggcgaattgtgtaaataactaaattttaacaataaacgcttttcgtccgcctccagctcccaaaagccaaagggcgaatcttcttcttctctttcgatcaaatcttttcagattcaacccaaaattgaagacaaaaatg

SEQ ID NO: 28912 - DNA, 3000 bp, Unknown
  misc_feature (1)..( 3000): 2750-1469P.txt file - cDNA_ID_2999324; gDNA_ID_2926209; Annot_ID_141875
ctttccaaaagcttgccttgacaccgaagcacaacaagatatgctcaagtctctgtctgcgacccttcagcaggatttcaggagcttaaatcttttcattgataaagagcttgagctagaagttgtatttcccgttagagaggaagttgtttttgcagagaacccacttatcaacgcaggaaccggagaggatatgaaaccattgcctttggaagaaatttctcaggaagattcttcatggatctcacacatgataaaggcaaatgagaaaggtaaaggcgtgtcactttcttgggagtaccaaaaagaagagccaaaagaagagtttatgcttacatctggatgggataacaatcagattggatcaggccacaataactttctttcagaagctgagcagtttcaaaaggtgacaaattcaggactcagaatcgacatggatccaagttttgaatcagcttcctttggtgttgggcagacattactaggcagtagaagaccaggtgagaagagaagaacaaaaacagaaaagacaattggtttagaagttcttcgacaatactttgcaggaagcctcaaagatgcagccaagagcattggtggtaagaaagaaaacttatagttattatgtctatcttatcaatctctcagaaagtgatgattcattcacgcagtttcattttcatgttgcagtttgtccaactaccttgaaaagaatatgcagacaacacgggataacacgatggccttcccggaagatcaagaaagtggggcattcattaaagaaactccaacttgttatagactctgttcaaggtgttcaaggttctattcaacttgattcattctatacaagtttcccagaattaagctccccacatatgtctggtactggcacttccttcaagaatccaaatgctcaaacggagaacggtgtttcagcacagggaactgctgcagctccaaagtcaccaccatcatcttcttgtagccacagctctggttcaagcacctgttgttcaactggagctaatcaaagtaccaatactgggactacctcaaatactgtaaccactctgatggctgaaaatgctagcgcgatcttgaagagagctcgtagcgaagtgagacttcataccatgaatcaggatgaaacaaagtccctctctagaaccctgagccacaaaacattcagtgagcatcctcttttcgaaaatccacctcggttaccggagaatagtagcaggaagttgaaagctggaggggcctcaaaagtgaaagccacatttggtgaagccaaagtacggtttactttgcttcctacttggggcttcagagagttgcagcatgagattgctaggcgttttaacatagataatattgcaccctttgatcttaagtacctggatgatgacaaggaatgggttcttctgacatgtgaagcggatctcgaggaatgtatcgacatttatagatcatcacagagccgcacgatcaagataagtgttcatgaagcttctcaagtcaagctgggaggttcttttggtagcatcggtcttggtccctcgttataagctatcaggtataaggttgttacctgcaagaaaagaaaagaaaagagcaggagattcgactaatttactagtgtgttagaaaaatattactcaccattttatagcaatgggcatcgtttgtaaacatattttcagtgcccccattttgcaagcagcagtagtggactggtttcctgcatcggcttagcagattttttgtataataaggcgatgcgtaccagagaaacatgcttatatgtatgtattattattgtctgtacatcatttgtcttctggattctactaagctctgcaagtatgttaaattgatatatcttctacatcgtcacttgtatttattttcttacttaactatgcatgaaattcttaagggtgctttttggggcatcaaagcttactgtgtacaaacattacagtcaataaggagttagtattcagaaagaaacaagaaaaaacattatgccagtttgaaagtaagaaaaggctagacgttttacttatataggcaatgatagtcatataaacacagaagctatttttggcagaaaaagtagagaagaaagtgtatacttggatggtgaggacacatgatatttatagagattctcttggtttttaagcaggaatatgtgttcaagagagagaaccacctagtggagtgatcttccaagttcctaaccagagtatctctgttaaatcctcaaatcagtatttgttaaagaaacaagtaagcctgcagacaaaaggttctcgttttggtttgtttttgtttctttctgattcagtgagtgacacaaaggaagatattgatcctgaacctatcattgccacctaaacttcagagacaggagaaaacaacatggaaaacaaaaaacctatgtcaagagaatcagaccaagtgtacctgattgtaccatttggtactaaaaatcaggatgacgaaggagttgattcacgtgactatgcttcgaatctcttaacattgccaatctccgtgtttctaagacttctttcaccaaagccttgatgaaattcgagggtgcaagttatgattttgcaaataatgtagtactctgcatgatcaatgattttgcggcaattttgtaaatatctgaagtgaaaaataagcaaatgtcaaactaaattaattactgagtaaatgttgatgaagttaaatgattggggggatttgtataaatatcttaattgacgattctgaaacaaagtggtctaatcggtgattatctattgttttatggaaatatcttaatgagatgaagattttggggcgaattgtgtaaataactaaattttaacaataaacgcttttcgtccgcctccagctcccaaaagccaaagggcgaatcttcttcttctctttcgatcaaatcttttcagattcaacccaaaattgaagacaaaaatg

SEQ ID NO: 28913 - DNA, 3003 bp, Unknown; identical to SEQ ID NO: 22720
  misc_feature (1)..( 3003): 2750-1469P.txt file - cDNA_ID_2999328; gDNA_ID_1971868; Annot_ID_58447

SEQ ID NO: 28914 - DNA, 3003 bp, Unknown; identical to SEQ ID NO: 22720
  misc_feature (1)..( 3003): 2750-1469P.txt file - cDNA_ID_2999328; gDNA_ID_2926209; Annot_ID_141893

SEQ ID NO: 28915 - DNA, 3003 bp, Unknown
  misc_feature (1)..( 3003): 2750-1469P.txt file - cDNA_ID_2999332; gDNA_ID_1620674; Annot_ID_48193
tgattcatgtagattattggataagatgggcgttattttggatcatcccatccgatgttgagttaaactaatctgagcttacaaattattaaagattataaagatctctatgttcatatctatccaatgcccaatggaatcttttaaaaaatataaggaaaaacattatcttctgcatattaaacggataataacagcgaaacttgtggatggatcattacaatagaaaaataccgaggaggcacattcaaggaaggtattcaatagggcaccaaatattgtaaacgtaattctctaagtttcccatacatcatatatctgctactactctacacgcatatatatacaaaatacatgtgtgactctcttatatagaccatacttttagacattatacttacataaagccagtactagatggctgtagattctcgaattaatagtaccctaacattctttggaagaacctatgaatctttcaattataaaatagtgatgctctggtgtaggctaagtgatacagatgaagttgtaacctcctatggcaacaataagcactttcattacttgaatttgtatagaacaccctatagctatcaggaggatcaagtaaacaacatttacggattcaccttaatattttctgcaccaatacaaaatttactgaagttgattggtctcatttgcctgatcaaggctgaatccagtcatctccgctagttcagcgagttctatttctccgcttaagacctaatttataaaagaggtgaaataggtactgacatgtgatgaaatgtacaaggggttcagaggatttactcaccttatcatttattatccatgttgggaatccttcgatcgcagcatctgcacatgccttgagtatcttagttcctttcttatatccatccggaaaacattccacgtagttcagttcttttgccgcttctcttccaaacatctgtagatggatggaactataatgaacatataataaaagcataaaactgattcttggcaaacaggtgatgaatgaactaactacctctttttgctctaagcagtgagaacaccagaatgccccatacattttagctccaatggagtttagatgttttgctaaagcaatagcataagggctcgatgatgaactgatctctgttctaaaatatggcagttcaatgtcaccagagctggaaggagtgaaacaaaaaacgatcgggattaaaagagaccacctgataagactcatacatctttcggaagctatttgttcactactcgttacaaatgactaaaatttctatcgggactccccaaagaaaactatgaactttgattaccgtgaagggattggttgagcagtactgtaagaagcagtcaaggaggcaactactatgattgctaagcatatctgcaatcctacaacttgctgtatttcttgcaacttcacatcctaccacatgcatggagcacattatcataatccgaagtttagaagttatcttgagtcaacatcaggaaaaaaaaagaaatggaaataaagggatacctttacagagaggaaaaatagactaaatgataagaaagcagacaccagacaatacaggcatgatgatcctgagagttttgtgctaaggatatacaggaaatatgcactagcagatgccattgcagtcgtgatcccaaataacgcgaaacgcccattgctcttactgattccaaaaggtagattcccttccccaagctctgcacttagagcggttactacgccatacataacaaatccaatcactggaagaggaacacctggcaaaatgtaaaaaaggattttcattgagttcaacttacctgcaatgcaatgttggacaaacaacgaagacaaagcactacatagagtggagtgaagcatgctatttaactctaacaattctatgcatactaagtaccaaagctcctaaatgatatagcttcaagcaaagattcacagagactatcacatgcgagtatttaatcatgcctactataaaagagaggacaattagctacataaatcaaacgctataatcaataaagcgatggataataccgaaaacgacggcataatcgctgttgaggacatcaccgcaagtgccaccaccaatagggcaaaacgcatcggagccagtgaccttgaggtaagtcaaatacgcagtgtctaacatcccaataccgccgattccggtgtaccagttgtatgtcgaactgttactagtagatacttcacttgtagacgatgaggaggaggaagacagcgacggtgccgaatcctcaccgttttccggctcagatgaagaacatttaatcggaatcgcaggaaatctccgatcagagacctaattcagaacatctgacttcaaatgaccgatcacacactactgtcactgaagaaaacacatgacaagaatttacctcgaatcgtctaggataagaagttaccgacggaggagaaacctcacggaagccgaaatgaaactgacaagacgacacagaaacaaacctcgccatcatcgtcgtcgaagaatcgctattccaccattgttaacttcatcatcttctctcctccgctccactatctcagccacttgtttcaatattgggcctaaacgaggcccaaatacgataatttggatccataattagtttatcacaattgggccttacggtcttcttatccgtccgagtcagcaagttatcctcttcaacacgactcacgaggcaccgagttggacttatcatgattcattatctacgcattgtttacattttggaatcgactttggtacataattgaatttatccatagaaatgatagagactcgaagatcggacataaaacttgctgacgtgacacccatacctttgtgtctgtatgtattatataaacgctatagaactaagagaagaagtatctaagtagcatcaaagcattctaaaagaagtttcaaagaagaagtgaaaatg

SEQ ID NO: 28916 - DNA, 3003 bp, Unknown; identical to SEQ ID NO: 28915
  misc_feature (1)..( 3003): 2750-1469P.txt file - cDNA_ID_2999332; gDNA_ID_1620687; Annot_ID_48494

SEQ ID NO: 28917 - DNA, 3003 bp, Unknown; identical to SEQ ID NO: 28915
  misc_feature (1)..( 3003): 2750-1469P.txt file - cDNA_ID_2999332; gDNA_ID_1620687; Annot_ID_164668

SEQ ID NO: 28918 - DNA, 3003 bp, Unknown; identical to SEQ ID NO: 28915
  misc_feature (1)..( 3003): 2750-1469P.txt file - cDNA_ID_2999332; gDNA_ID_1620674; Annot_ID_164186

SEQ ID NO: 28919 - DNA, 3003 bp, Unknown; identical to SEQ ID NO: 28915
  misc_feature (1)..( 3003): 2750-1469P.txt file - cDNA_ID_2999332; gDNA_ID_2926210; Annot_ID_141924

SEQ ID NO: 28920 - DNA, 3003 bp, Unknown; identical to SEQ ID NO: 28915
  misc_feature (1)..( 3003): 2750-1469P.txt file - cDNA_ID_2999332; gDNA_ID_2926210; Annot_ID_202535

SEQ ID NO: 28921 - DNA, 3000 bp, Unknown
  misc_feature (1)..( 3000): 2750-1469P.txt file - cDNA_ID_2999334; gDNA_ID_1620618; Annot_ID_46923
tatgaagaagggtttccgtcatagcgagatggactcgggaaggatgatgagactggacttccgtggtacgaaggtgcaggacttggaaaagctgatgattgtggacttggttggattgatgaatttgtgctgaagtttgtaggagttcctgaaatatctgatgctggtggctaaacccctgtttccacaagaatcaaccattttagtgaccaagactagactaaatcaaaaccacatgatgatgcaaccgtcaaagtcaatgttttagtcaagactcaagaagcaaaagagatttccccaaaatttctcaataatcaaacttacatgatctatagaattagatgatccaaagcagaaaccatcgaattcataatcagttctaatcactacgaagaccagatttcaatccaaatagggggaaattgaaaattcaacccaatcgaacagtgaaaagtgaaatccaaatcgcaagatctcaagagtctctaacaattcgattgaattaaaacacaacaatcgcacagattcatcgattgaattatgagtaattgagagaagctcagattccgatctaaaaattgaaatccggaattttcagttttaccttgcgataagtggtgccatcgtcttcgacgatccaaccagcttcgagacagagagctttaagaacctcgttgttatcgcagtgcttaggaagcttatagttaccttgagctctaagaccagagtaaatcttagcagtgatggctcttcttcttctttctctcttcttattgttctctctctctttccacgtcggagtacgtcccgacgatgatcctcctcctcctcctcctcctccggcggccattgaagagctctgaatctctgaatctatctctaagtctttgtcagactggcgcacgagggatagagagagagagacgaagctttctttttagtttttttgtttttttttttgttttgggtgtgtgtgtgagtctgaagcggattggctgtaactttcattcattaagtataaataaattcaaatattcatttgtctccacacgtgtggtctgtttctacacgtgtgatcgatttatttctggaagtcagcttccacgtgtcctatttatgtaacgcacgagctgtggtcccttccccgttgtttccctcccgtccactgttcaatgaattcggatctttccttcttcttttttttcgtattttctttaatttaaatttgtatcttaaaaacaaaaacaaaaagcgttgtaagaattaagaatcagtataaaaactggatatactaacgattttgcattgttttttatgacgacatattgcacattttcatattgtaacgcattaatacaactcacaaaagctttacaccaaatttgatgttatttcttggagttgtcaaaacgtaattcgaaactgatctcattttcctaacataatttttaacctagtatagcatctaaagagttttaaaacggtcatattggattttagaaaatgacgaacaaattattccaaaaattacatgtttatttgattttcccaaattcattgatgtgaattaaaaaaatgtatccacataattagggaagctagctaaaacattttttagtaatattaaaaaggatggaaataagataacaaacagcaatttggctattgtggtcggagcacgtgcggttccagttaggcgtgagcaaagccaggaagcagaatcacccagctggactcatgccattattatttttttagccaactaattaatatagtactttaacaaatcctatttacatatttgttaaattttcacaaccttaaattaataaaagtaatttcataaaatgtcatttgttattattgcagacaatcaaatgaaacaaaaaaaagttcctaataattgtgtttattattttattttattaaaccacgtcttctcatttatagtcacaaatccaaaaactactaaagtttaaaatgaaaaataaaatcggtgacgccaaaaaaaatccaatctgtcagagtgactttggatcagatcattcacgtgggggaatctttaacataaattttcaatttgtacggcgtggtcacgtacatttaatcttacttagtacttacttttaatttaatttgttgattattctaattaatcgtgcggcgtccatttaagtcataatccaactattctcactattgttcaatgcatcggtcaatattggttagtattgcgttttaaaaagaaaaattatatgtgcttttgtaaacgtttcgatttgtttgctacattacattacatatttcttataatcacaatattattgtatcactagctcattctgcatgtagacattatgaaaattgtcagacagccgaagatctcggcattaatattaacgaatttgggcacttcgttattaaattgaatgaaacatgatttgtctagtatatgtgtccgaggcccatgggcccttaatttcagactcagcaatatttctgatattttcctcctggtaacatggaggagctaaagaagaagacttttctaataatgttatttctaacaataattttcagctctaaattgaaaattaccaagattaacatataacttaaattatacgttaccaatccattcacatcccaaaaatgaataaagataaatgtaatcacgttcccgacacttaccatgtaacgatccaccaaacaagctacgttacgtgcttaatgatctttttaaatccaataaatacgttaatctacataattaaatggcttaatggccacttcatgacttatccagaaagaatcatccaaagaaatatgacgtcagtaacaaaaagaatatccaacatgttactgtaattaatattaaattcggcggttgttaaatcgtacgagaaaactattcgtgtcggaactttagatccgatatttatagaaagcaaccaaactccggctccggttactcgggagttcaagttttggattttgatg

SEQ ID NO: 28922 - DNA, 3003 bp, Unknown
  misc_feature (1)..( 3003): 2750-1469P.txt file - cDNA_ID_2999334; gDNA_ID_2926212; Annot_ID_142020
aggtatgaagaagggtttccgtcatagcgagatggactcgggaaggatgatgagactggacttccgtggtacgaaggtgcaggacttggaaaagctgatgattgtggacttggttggattgatgaatttgtgctgaagtttgtaggagttcctgaaatatctgatgctggtggctaaacccctgtttccacaagaatcaaccattttagtgaccaagactagactaaatcaaaaccacatgatgatgcaaccgtcaaagtcaatgttttagtcaagactcaagaagcaaaagagatttccccaaaatttctcaataatcaaacttacatgatctatagaattagatgatccaaagcagaaaccatcgaattcataatcagttctaatcactacgaagaccagatttcaatccaaatagggggaaattgaaaattcaacccaatcgaacagtgaaaagtgaaatccaaatcgcaagatctcaagagtctctaacaattcgattgaattaaaacacaacaatcgcacagattcatcgattgaattatgagtaattgagagaagctcagattccgatctaaaaattgaaatccggaattttcagttttaccttgcgataagtggtgccatcgtcttcgacgatccaaccagcttcgagacagagagctttaagaacctcgttgttatcgcagtgcttaggaagcttatagttaccttgagctctaagaccagagtaaatcttagcagtgatggctcttcttcttctttctctcttcttattgttctctctctctttccacgtcggagtacgtcccgacgatgatcctcctcctcctcctcctcctccggcggccattgaagagctctgaatctctgaatctatctctaagtctttgtcagactggcgcacgagggatagagagagagagacgaagctttctttttagtttttttgtttttttttttgttttgggtgtgtgtgtgagtctgaagcggattggctgtaactttcattcattaagtataaataaattcaaatattcatttgtctccacacgtgtggtctgtttctacacgtgtgatcgatttatttctggaagtcagcttccacgtgtcctatttatgtaacgcacgagctgtggtcccttccccgttgtttccctcccgtccactgttcaatgaattcggatctttccttcttcttttttttcgtattttctttaatttaaatttgtatcttaaaaacaaaaacaaaaagcgttgtaagaattaagaatcagtataaaaactggatatactaacgattttgcattgttttttatgacgacatattgcacattttcatattgtaacgcattaatacaactcacaaaagctttacaccaaatttgatgttatttcttggagttgtcaaaacgtaattcgaaactgatctcattttcctaacataatttttaacctagtatagcatctaaagagttttaaaacggtcatattggattttagaaaatgacgaacaaattattccaaaaattacatgtttatttgattttcccaaattcattgatgtgaattaaaaaaatgtatccacataattagggaagctagctaaaacattttttagtaatattaaaaaggatggaaataagataacaaacagcaatttggctattgtggtcggagcacgtgcggttccagttaggcgtgagcaaagccaggaagcagaatcacccagctggactcatgccattattatttttttagccaactaattaatatagtactttaacaaatcctatttacatatttgttaaattttcacaaccttaaattaataaaagtaatttcataaaatgtcatttgttattattgcagacaatcaaatgaaacaaaaaaaagttcctaataattgtgtttattattttattttattaaaccacgtcttctcatttatagtcacaaatccaaaaactactaaagtttaaaatgaaaaataaaatcggtgacgccaaaaaaaatccaatctgtcagagtgactttggatcagatcattcacgtgggggaatctttaacataaattttcaatttgtacggcgtggtcacgtacatttaatcttacttagtacttacttttaatttaatttgttgattattctaattaatcgtgcggcgtccatttaagtcataatccaactattctcactattgttcaatgcatcggtcaatattggttagtattgcgttttaaaaagaaaaattatatgtgcttttgtaaacgtttcgatttgtttgctacattacattacatatttcttataatcacaatattattgtatcactagctcattctgcatgtagacattatgaaaattgtcagacagccgaagatctcggcattaatattaacgaatttgggcacttcgttattaaattgaatgaaacatgatttgtctagtatatgtgtccgaggcccatgggcccttaatttcagactcagcaatatttctgatattttcctcctggtaacatggaggagctaaagaagaagacttttctaataatgttatttctaacaataattttcagctctaaattgaaaattaccaagattaacatataacttaaattatacgttaccaatccattcacatcccaaaaatgaataaagataaatgtaatcacgttcccgacacttaccatgtaacgatccaccaaacaagctacgttacgtgcttaatgatctttttaaatccaataaatacgttaatctacataattaaatggcttaatggccacttcatgacttatccagaaagaatcatccaaagaaatatgacgtcagtaacaaaaagaatatccaacatgttactgtaattaatattaaattcggcggttgttaaatcgtacgagaaaactattcgtgtcggaactttagatccgatatttatagaaagcaaccaaactccggctccggttactcgggagttcaagttttggattttgatg

SEQ ID NO: 28923 - DNA, 3000 bp, Unknown; identical to SEQ ID NO: 6296
  misc_feature (1)..( 3000): 2750-1469P.txt file - cDNA_ID_2999338; gDNA_ID_1621088; Annot_ID_55442

SEQ ID NO: 28924 - DNA, 3000 bp, Unknown; identical to SEQ ID NO: 6296
  misc_feature (1)..( 3000): 2750-1469P.txt file - cDNA_ID_2999338; gDNA_ID_1621088; Annot_ID_170576

SEQ ID NO: 28925 - DNA, 3003 bp, Unknown
  misc_feature (1)..( 3003): 2750-1469P.txt file - cDNA_ID_2999338; gDNA_ID_2926212; Annot_ID_142041
aaaagaaaaggtaaatgaagctcattggtgcctaaatgtgaaatgaagccgaaatgtgttaggtgaacacatttaaatatacaaaaagaaatataatagaaacaaaactaattaacaaagtcgcaatttgtattgtataaaatatctttccgtctcccgtcatatttgaaaaaaaaaaaattacaaatctgttaattttaaaactttctagaaaaacacaagtatataattttctcttttcgtgcgtgtttgttttaaaataacattgttttgattggcgactcaacatattttagcatttacatatttctgcatatattaaatgatttataaactcaactatagattaaaatataatttgacatctaataattttaacaataatataaaatatgagatttataaattacgaatataaatattcaagggagagaaaaagtagaacataattcaaaagataagactttttagacttttttaacaatatttttgatggataaaaattattcaaaagagaagaaagtaagaagaaaagatgtttctgagaatttctagaaacagcatccgtttttataatttaattttcttacaaaggtaggaccaacatttgtgatctataaatcttcctactacgttatatagagacccttcgacataacacttaactcgtttatatatttgttttacttgttttgcacatacacacaaaaataaaaaagactttatatttatttactttttaatcacacggattagctccggcgaagtatggtcgtcgtcttcatcttcttcctccatcatcagatttttccttaaatggaagaaaccaaacgaaactccgatcttctccgttctcgtgttttcctctctggcttttattgctgggattgggaatttctcaccgctctcttgctttttagttgctgattctttttccttcgactttctatttccaatctttcttcttctctttgtgtattagattatttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacgtgagtttcactctaacgaaaactcatttactctcaatttaatgcttcatttaattcgtttggtgaattgaatcattcttttgtagttggttagccaatttcgtaattttctcataatttgggggttggtgagaaaaccttctagaagctgagaatgttcttgttctttttttttttttttttttggtttagggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaataaaacagatgttgaagttttattgttgcttaatttatgtcttcataatgtaaaaaagcatgtgaaatacttggtctaaggtcatctacttagttgaaaacttgtgaaagaggaagaaattttacttttatgtttgattgattttctttgcaagtagtagtaggtggtttccgtgtttttacgtaatccgttgaatatttttccctcgaaattgtctttataaaagtcacagaaacattttctagaactctttatcaggaaaataaaaataaagatgtcttcaaggaatcgaaaaaatacagcaatatactaaatagaaaatgctatgaaattaaataaaaatttagtaaggttccaaagacactacttaactagagagaaaaataattccaactagctctacaacaaacaaatcatttacttgtttaagaatcgaaaaatttagaaatttattcttattatttgtttgcccaattaagtcgctcttggcccaatacttgcatcacttgattgagtagaagaagatcacttaccaactctcaaaccatttaaaaattaaaaagcatagtttattttatttaaatatgtgtatgtaataattcaccacaagaaatatattacaaaccacaaaactataatcccggtaaaatagtaattaatttcttcaaaagtgtaaataaaaaagaagagacataatttagtcatagccacataaaaaatg

SEQ ID NO: 28926 - DNA, 3003 bp, Unknown; identical to SEQ ID NO: 28925
  misc_feature (1)..( 3003): 2750-1469P.txt file - cDNA_ID_2999338; gDNA_ID_2926212; Annot_ID_202704

SEQ ID NO: 28927 - DNA, 3000 bp, Unknown; identical to SEQ ID NO: 6277
  misc_feature (1)..( 3000): 2750-1469P.txt file - cDNA_ID_2999353; gDNA_ID_1621088; Annot_ID_55412

SEQ ID NO: 28928 - DNA, 3003 bp, Unknown; identical to SEQ ID NO: 23854
  misc_feature (1)..( 3003): 2750-1469P.txt file - cDNA_ID_2999353; gDNA_ID_1620678; Annot_ID_164302

SEQ ID NO: 28929 - DNA, 3003 bp, Unknown
  misc_feature (1)..( 3003): 2750-1469P.txt file - cDNA_ID_2999353; gDNA_ID_2926213; Annot_ID_142071
acttaaatctatataaaagcaaatctttaatccattcaaatagcagatatgtatctctagggattaaggtagtatacaactataacatctcaaaagaaccaaattgtgactgcacaatgcaatatcataatttgtatatcgaaaacatgatatgttcacatggttcgtccataaacagtacttatattcatatttgaccactaaatatttcacattaaaaaatcgaaattagaaataattatggatttagttctgcaaactcgattttttttaaaaaagattcgaagatgcaagattgataatgaaataaaattgagggtacatcatacatgtgggggaagtgacgtttaaaaacaaaaaggaaaaagaggaagaagatagatgccaatattgttatcatgacaactatgaagcagagttagagtccgtccgtccatacaagtattttgtgtgagtaccaccgaatttgtctgtctatgttatctcccttctttttctcatgcccacgaaccaacatgacaattatgttttgttcgttttttgaaaaattctagagttttcatttattaattatcgttgagttatgatttagtatgattttggtttaaaaattccacttcttaggactcattgtttgatctttgtgtttcttatttatttctttgcacagtactaaaaatcatgcattagttcttaccattcacaaatcttcaaaacttaattagaaaaagaaaaaaaaaaatcgatcaatacaatgaaaacgttctcctatgcactatgcagaacaagtctcgaggattcgtatggtcaaatttattccgatcaaattattcgcgaaagtgtgagaaacaaatacgtactttatttctcttacctcctcctacgtcacttctacgcattcgtgccctaccttcatcagtactcttccagtttctaaaggttaaaaccgagtcgatgatccacgaccgtagagttaaatcaagtaatcaacttaagtcattgtaataagaaagcctccgctcaaaaaaaattctacaatattagtttgacataaaacttcaaatgatagaaatatgaaatcaaatagttgtagacttgtagtctagtactttcatttggctcatttggcaattgcaaagtttacgtggtgattactaaactccttgtcggtataaatgtttttgatcatgaaaccatataccgaaaatattggtatatatagtcctgcctaactccactaacaaaaagtcaggatttttaaattaccaactacaacttgaattgtcatttggaagattgattcattggaatattgtgtatcttaagccataaacaaatcccataatttaatagtgtgccagaattttgtattcatattttaagcagtaaaaacaaaaacaaaatacatatatatattctcaatcaaactataatactttagatttaaagctattaagaaaaacatttagctagtcaaaaaaaacaattaacacttttcgaaaggtccatttccaaggaagctagagaccgtccttttttactaattcgcctgcaccatccccttgtatcgagggtctaattctacaccttattccattttatattccctaacaatttttttagtttttttttttatattactttaattctaatgaaaactcctatcttccttcctctccatcctttttcatctacctttgaatcttttgacacttgtatataaagctttacttcctcctttgttactccttttctatcaatcaccaaaacacattcattgtcttaaaccctaaacctcaagaaccgaacaaccacaccaaaaaatgagaccggttggcttgatctttacggtcatgttcttggtctcggccttttcggaatcaagaaccgcggattgcagagttctccttggtggttcgacggaggaaatcgatcaatctaaaattcatggggtcgatttacgaagtgaagacttattaggggtcgtgatacatggttataagaagctaaggtggctctcatcggccggggagaggatgcatacaatggcttcaggaccgagcaggagaggtgctggtcactaaaatacgaacccaaacaaaacattatacttcgatatttgtttagctcaggtcatagaatcatatttttcattttttatagattattatatttattcagtcgctaaagatccatgtaaagtttagaagggtgatattctttgatcatacaatagtcggtttccttctcataaacaccaatttatagtacgtgcccattaatcgatatttattttagtttaacaaatttcaattttgagatctacgttaagccatcaaccatgcaaattgtatatgagtcaataatatagattgaggagatatgttatcggccattctggtgcaacttaaatgatatacagccacatgattatctcttttcctttttggtaaggttgataccacatgattaattataaagaagacattgattagttcatgttttaccacataattggaattaaaagtggtcgcaaattataatcaaacgtggtcgcaaatcgaatttcgatgagatgcaaacgttttttcagctgtaccttttaattcttttcttatttgttcgaaatgttggcctttggggaattaaaaggacatttcaaaaataatttattgtctttccataggagccggaaatggaaaagcttcaatcttcatgcacactatgttttgagtggacccaatttcgacaatctttttttaaatgaagaagataaaagttgttttttttggtaataatgtcgagtatttatagttttataccatgtttagtgagtatattgcagtttcacgttatgaaatttgtaatgagaaaattaaaggactaaaaaggcccactaaaagcccatatacattttcttttaaacacaactaaaaaccagtgagcaaatcctttctctttttgcatgtgtgtgttgtaaagcagtggacagagacgacgatg

SEQ ID NO: 28930 - DNA, 3003 bp, Unknown
  misc_feature (1)..( 3003): 2750-1469P.txt file - cDNA_ID_2999357; gDNA_ID_1620678; Annot_ID_48295
ttgtgagttataattcttttcgcagttgattaattttccgtatttgtgaaagatgatattcttgtttatgaaggctttttaaaaaagaattcttgtttgtgaagttgataatcaatattggtattataatatatgatataatatatataatcaacgtctaaaaaaaagatggtaccaatcaagcaatatatattctttctttttttggttaacgccaatatatctttcatttatcaagatctcttcaccaaccgaataaacaaatcatggtgacttggcaatgattcaatattatatgtcgggttaactcatggatcatgtgacttctattatatctcattttccataataatacggtgattccaataatacgactaacatgatatctatattataatatatatatatggatcattgcaaagaagacatacacaacatgccatattttctccattaacaactgaacatacatcaaataaacttggctcattgttaaaatagtactttttctagctagtattctatgttatttaaattcgtaattcacaacaaaaacgaaatattaataacatgaaagcaatttgaataattaactatgaactatatatatattatgcatttaaaaaaaatatattaaaacaacccaccaccggtgagtgctcgggaagtttgtgtacaacaacggaaaaggaacaaaatgaccagaagagattagcaagatggatcaacaggatagtcggttaaaatctcccgattggtgtgttatgcataatctaactacaaagaaggattgaaagactcaaaaaaataaaaatgtcgctgaataagcgtcatggtgctttccattcttccatctcgaacacggacacgatatgtccctctgctcaatataagaacactcactcaaacaaaataaatgcttacttaaaaaagaattagttgaacaaaaaaaaaaaaaaaaaaaaaaagaattagttgaaccaatattcgaactcatctagtatacacaatttatggctgaacctgatctcttttgtcagcttgagtgagtttgtgtgaaatctcatgtttttctcgtttgatacaaaaaaacatttagaggtaataatctgatagccaacaaaaaaaaaaaaaaaaaaaaaaaaaaaaaaactgatatgatacatgtatccatgtatgggctaatccatggcttatggcgacaactgggccacatgcctaatgttgctgctagcgtcgtggttaattggacctgacgtgtaacaggcttggcaggtttttttttttttcaatttgtgtcaagcctgtgttttttttttccaatttattaacacctcgatacagcaagcatgtgaatgtgacttgttgccgcctattagcactactatcggaacttttccggttttcccacacaatatttttttaaacgaaagttccatatctaccatatctttttgttttgctaaaaaattctgatttgttttaccaaataaagaggactattaaactaaagctaataacaacgtaacgggttttcaacacccggaacaatctggaaaaaaataaagaataccaattagaaagaagtggtggaaccatatcaaccatatgttaccctaataaaaaaatcagtattcctataagttattcataattttagggtttatcaaaataaattattcataaagcttttgtcaagcttaggtttcgggaacacgtgatttacgtgttgccaggtaataatagcatacaataattcaaagattttcaaaggtaattttaatctaaaggcttgagggagtcgttgatagtgggggttagataatcctaatgaacccttagtttcgtggaggttgagacgtatctttatcctagatttcacagtacgaaaataattcagttttccagtggatatttcattgttcactcttctggttttgatatcatgttccacaagtcttccgaatactatacatcacatagtgatccaactatccaagaatgatgtattaactctgtaaattaagataacgttctttgtattttatatgtcattttaagaaagtattttatatatgatttgtattcattttaagaagtatacgaagagagtttgattttattttcctcgtgacgaaatttgtttctgataaatttgaaagatatgatttattttctgtcttggtaaggtcagttatcacattaaagactaaatagtaaattttatgtttttttgtttctgaattatttcagaatttcttgttttattcatttaatatttaataatatatgttaaatgatactattacactttagaaaaatgtgcttatttctatcgtaccaaacttctctttttttaccgaacttgttactgtttgttttgtgaacgatttttgtttataaaaacattactcgtttgtgataaatttaacacatttttgcataaaaatgtatcaatcatatacaaatgaaacattacatttttagtcatttttagtcaataagtagacgtgtgtatcatgattagttgatttaatcataattatgatatttaaaataaacatagtttaatgttattatgttggtttttaatatttttaattaacgtcaacctatttttttttatttttttttacatataactatgttgttatggaagtcactattaatttaactgataaaatatacaataaaatagaaaaaacaatagattttaataaaagaataaaaaatttgaagatacaaaaacagttcctttttcttaataaatcaaaatcaaagagatagtgtactgaagtgaagagccagccactatacgacatacgtatgtaattacgttttaataacctgatggcaaataataatatattttcgtcaaaataaaatggtcgtatctctttgctaaaaccaaaatgtcatgatgtgattactcaattttctactataaatagattaccaaatcattcgatcggagacaatcaccaaagaaagaagtacaaaatg

SEQ ID NO: 28931 - DNA, 3003 bp, Unknown; identical to SEQ ID NO: 28930
  misc_feature (1)..( 3003): 2750-1469P.txt file - cDNA_ID_2999357; gDNA_ID_2926213; Annot_ID_142081

SEQ ID NO: 28932 - DNA, 3003 bp, Unknown
  misc_feature (1)..( 3003): 2750-1469P.txt file - cDNA_ID_2999361; gDNA_ID_1620678; Annot_ID_48297
caagaggctgggttctcccacgcggcggtgtatggaaacgatacgtgcacctggatgatgtatcttgacgtagacgagtttctcttctctccggcttgggataaacaatcacaaccgtcggatcagatgattaggtctcttctaccgtcggatcagagcatgattggacaagtgtcgtttaaatcacacgagtttggaccgtctaatcagacaaagcatccacgtggaggtgtgacacaaggttacacgtgtcgacgagaagaagatcaacggcacaagtcgatcgtgcggctaagcgcggtagagcactcgctttacacggccatccaccacttcggtttgaagagagagtacgagtggcgcgtggcggacacggaggagggagtggtgaaccattacaagtaccaagcgtggcaagagttcaaggccaagtttaaacggcgtgtgtcggcttacgtggtggattggactagagtctctaatcctaagtcgagagatcgaactcctgggttgggctttaggcccgttgaaccggaaggatgggctcataagttttgtgaagtcgaggatttgagattgaagatattaaccagaaaatggtttgggtacccagttaaaaacggttataggatggcatggcagagatgatttttttttttattagatgggttcttttgttaatagcatagttgttttggtaacagttttttttctgtttttgtgaacaggtttgaagttttttgttaggtgaaagtacggaactcaaaatagtttgaaatgtgactagagttatttttgtctagtaatcccaatgtcccatttaaaatatctgaaattcggtttcaaaatataatttttcttcgtgatacaagacaaaagtaaagtataaaaaggtacattcagaggcctggctaccttatctgtaacaatcattgtattctaatcaatgaatgtattttatgagttcaaagaaagaaagaaaaaaagaagattggaaacgtacgtacgtataagtttctgtgatttggtgcgatgataatagtttacgtaattataaaccttttaaccatcttggacctcatcaataaaattcagaagacaacaacttcaaaggatatgaatagttgactaactgaaaacgtacgatgaagaaaatgcaaagcaaacaaaagaatgttatcaagagcggtggaaaagaaatgctttaatgatgtgattcaacatcagtacatcaccatactcgtgtacgcaactttaaaagttgtcaaaaaaaacagacatgtgatcaaatatgattcgcaaatgcatcgtacacatgtgacatgaacaattatatgacagaattttgtttttgttagtgacaaattttcttcttttttttttctttctgtagcggtagattccaattagtatgataagaaaccacatacatatatatacacctttttttcacgaccacaagaaaatatattattgtttccttcttctgcctccaacattgatatgctttcaaaattctctaatatgagttgtcttactgtttaggtgacttttgattcaatagaataattttcttttaaatcaatttatgaacacctcacggaaaatcatctaagcgcaatgatgtatgaatgaaacggttgaataattcttgattttatgtttaaaaacatataagcacctcgatcgcagcaagcatgggagtgtgatttgcacgtttcatatattctcctagtccaattctctaagagaaagatatcgatctatgagatgagttctatttattgttcggtgagttttaattgatcaaataaataactttctttgttaattaattaaacaccatgcgactatagtattactccatatacagagatgtatgattagtgaacacgattgtagtatcctcgatttctttttgttatcaatttcttttacaccttgatcacaatctgagtggttgttactacttattagcacgtttcatataaagtaaataattttatcaattaataatacatatatgcttcaagttgagagcaattaacgctgtcaaaacaacacaaacaaacattaacaatgaattttgggaaggtgtctctcatctatgattgattttaagatttgtttttccttctatatttgcaggaaggaatagttctatacaatcatcagctaaacttcaaattctttgtaatcgtagatgttaatagtaaactcgaatattccccaagtcatactaataaacaatgaaaattgaagaaaataaaagtcataaacaatgaagaaataaacaaattgcaatataacaatttcttacaattctcgacttttgcgcctttgagacatggtcaattaatattatgtatagtaatggtagtggacgagtggttgatatgtgaatccgaatttaatcccacatcacgaatttgaatgttttcgaatttctatattaaaaagttttaaaatggttgccaagttgtattggttcgagtatctttattccgagactagcatatggaaaagattaaagaaagaaattctagagtttgagtttagtagctttattggtggagttttgaattagattgatttatatggaaaacgtgaaaacttgcatgtgttcgaatttccatgtgaaaggttaaaaaattgttttcaagctggcatgggttaatatctttaatcttcgacgagcacatagaaacaaatttcagagtttttatttaacttaataatggagttttgagagaaatgataatcataatatggagaactcgaaatcgtagaagatgttttttgtttttttcctctggtcttttaaaacgaaaagcacaactttcaagttccactactaattgtcacgttacagatatgacatcactactttgatttgagtaaaattttctctataaataaaagaacaaacaaaccataagccaaatcctcgcacaagtagaaaaaaacacaaacatcctgaaactagaagagagagacaaaatg

SEQ ID NO: 28933 - DNA, 3003 bp, Unknown; identical to SEQ ID NO: 28932
  misc_feature (1)..( 3003): 2750-1469P.txt file - cDNA_ID_2999361; gDNA_ID_1620678; Annot_ID_164313

SEQ ID NO: 28934 - DNA, 3003 bp, Unknown; identical to SEQ ID NO: 28932
  misc_feature (1)..( 3003): 2750-1469P.txt file - cDNA_ID_2999361; gDNA_ID_2926213; Annot_ID_142083

SEQ ID NO: 28935 - DNA, 3003 bp, Unknown; identical to SEQ ID NO: 28932
  misc_feature (1)..( 3003): 2750-1469P.txt file - cDNA_ID_2999361; gDNA_ID_2926213; Annot_ID_202765

SEQ ID NO: 28936 - DNA, 3000 bp, Unknown; identical to SEQ ID NO: 3379
  misc_feature (1)..( 3000): 2750-1469P.txt file - cDNA_ID_2999369; gDNA_ID_1620643; Annot_ID_47534

SEQ ID NO: 28937 - DNA, 3000 bp, Unknown; identical to SEQ ID NO: 3374
  misc_feature (1)..( 3000): 2750-1469P.txt file - cDNA_ID_2999369; gDNA_ID_1620643; Annot_ID_163108

SEQ ID NO: 28938 - DNA, 3000 bp, Unknown; identical to SEQ ID NO: 3379
  misc_feature (1)..( 3000): 2750-1469P.txt file - cDNA_ID_2999369; gDNA_ID_2926213; Annot_ID_142101

SEQ ID NO: 28939 - DNA, 3000 bp, Unknown; identical to SEQ ID NO: 3374
  misc_feature (1)..( 3000): 2750-1469P.txt file - cDNA_ID_2999369; gDNA_ID_2926213; Annot_ID_202786

SEQ ID NO: 28940 - DNA, 3000 bp, Unknown
  misc_feature (1)..( 3000): 2750-1469P.txt file - cDNA_ID_2999373; gDNA_ID_1620720; Annot_ID_49177
taggtacaaaagagcaggatgaataattaattttaacgtaaaagaacagttctaatgttaaatacttaagcccaagccaatagtaaaatcaaagttttgaagacgacaaaatacataaatttttttttttttggtcgtcagataaatatttctttcttgttttaaaagtgacaatacaatacacacaaacaaaaataaataaaagcaatatgctaaaatacatttttgtctataagaattttgtattgtacaattgttataaaaaaatatgaaagttgctttttgagttctggtttctgcggtttcttgtggtaatagactgactggagcagtagaaaggaccctacttcacctgaccgaccaataccgtgcctctttgccttttcgtattcttctaaccaaaaacttttatatattttatatatgtaatttatgggtcatattttatctaaaatatttatatagaactgtctcaacacgtttcgctcactcttcccaattgctttttccaatgatttaatcaattatatgctcaatggatatgtccagttaaccgctgttaaacattttttctttaattgatgatactagcaaaaatgtataaacccatctgttatagatatttgaaatactttaatttgaaattcaggcacaagacacattaactttgaaatatattatgctttattttaagataaactatttaacaaaaaaaaaaagcattcaaactgaagtatcatgtgagtattaacattcaaaacaaagatgcatcatttgtaaacaaggttttttggttgaatatatgtgagtaatatatgtctctgttgggcatacaaagcccatgattgtataaaaagccgaagaaagcccatttacgaaaagtctatcattggcatattctcaatttctaaagacccaacagattcagcaattacatatataatatagtacatgcaatttcttcaatttgtacagcacatacaaaactggctaaacccacaaaaatccccaatcttgtgtaaaatactaaaatgctttaaaacttaccgtaggaaaactaaattgtttttttcagtttatttggatacatcagagtgtcgacattaagtgcagagtattgatattcacagaaattgacatctataaaaactttaagatatgtttaccaaatctactattaacgaaaaagaaaactactactagtgttttttgtttccaatatagctcaaatcatttttattgtcggccgtgttatgttactattttaatttttaaacaagtacgacaagaaaaaggtggcaaatggatgaaaaagatggatatcatattaaataaattataatgcaaaagttaaaatcattcaaagacatgacattaaatttgagtcgaatagagtcttcgttcttcttctttttttttttaatcaaaaaaacatagagctttgtttcatgaaatttatggagtctgtcaattacttatccatagttcttacttccatgtggatttgtccaatgttgtgtctccttctatattaattagacttaattcttttgataaccatcgttttcatgcaaaaaaatccagggtgtattttacattgttattacatgatagcttaacatagccaaatattgcatcaaaacggaatgtgtgagtttaaccttgccatttatatcaatagttttttgccggagtttttcaaagttgaagtatacaattggctctattaattagtaggaatctaatcaacttatatgctccatagccaaaaccgtatttttcacttagaataggattccaaattttatttttataattagaaaatattttgttctaagatcctaattatacgattggataatttttttgcacataagtaacaaatagctcaagagttgggacctgagacttgagatggtcctgtctagagcgatttagccaaccaaaaatggttgtactacaaatgtcaaatgacactagaatgcgaaattgcctcatagaatctttgttttttttaacgatgtttgctagctgggactaatattgagtgagaaatgatataaatgaagatggggataagaactattcatcgaacacgacttgtgtggtgtggataacaaaatgaaagctacatattcataaattaacatagacacatccctactctcacgcctctccacatttaacaactttcatatctttattttcatttaaaaaaaaagaaaatcatattagaaagttcatgcacaatcataaatactgcacctatactctcattgattaaagcaataatgtataatttattggaaaaggagcaaaatgccaaaatatgtaagaaaattaaaaaaaaattacaaatttatcatctcgaatgagaacaagataaactgtatatactaatgaaacctctttctatataacaaacgaatataaacatgtatttaaggaaaaattaatctaagaaacgatcgtgtggcaacaaataataaaatctaagaatctacgaaagatacgacgatcgtatcatatctgcgagacatagcagagtaatgtaatgctgacacgtgtcccagtaaaaccgcaccacgcctttcagttatgctatacactgggaaattcttatgcttcaatcattgcgaggctgagagccaagaaaatattttagcttttatcacaataataatgtgaatagttctaggagaaaaagtacacagaataaattgaattctaaaaaaaaagtgaaagaacagtaagattttggaaagaaaacaaagacatattcagtgaatttaaaaacataataataacaacaataatagaaaattggtaggtccaaaatcattgtgacaaatcgatcagtgattagctgtactgaaaatctaagctctaaatgagaccgttcctcaataattgtacatacatttgcctgcatgcatctccatataaatatgccttcgatcttctacttccaaaacaaactcatcatcataagcaacaatg

SEQ ID NO: 28941 - DNA, 3000 bp, Unknown; identical to SEQ ID NO: 28940
  misc_feature (1)..( 3000): 2750-1469P.txt file - cDNA_ID_2999373; gDNA_ID_1620720; Annot_ID_165777

SEQ ID NO: 28942 - DNA, 3000 bp, Unknown; identical to SEQ ID NO: 28940
  misc_feature (1)..( 3000): 2750-1469P.txt file - cDNA_ID_2999373; gDNA_ID_2926214; Annot_ID_142120

SEQ ID NO: 28943 - DNA, 3000 bp, Unknown; identical to SEQ ID NO: 28940
  misc_feature (1)..( 3000): 2750-1469P.txt file - cDNA_ID_2999373; gDNA_ID_2926214; Annot_ID_202835

SEQ ID NO: 28944 - DNA, 3000 bp, Unknown; identical to SEQ ID NO: 3479
  misc_feature (1)..( 3000): 2750-1469P.txt file - cDNA_ID_2999381; gDNA_ID_1620648; Annot_ID_47649

SEQ ID NO: 28945 - DNA, 3000 bp, Unknown; identical to SEQ ID NO: 3479
  misc_feature (1)..( 3000): 2750-1469P.txt file - cDNA_ID_2999381; gDNA_ID_2926214; Annot_ID_142133

SEQ ID NO: 28946 - DNA, 3000 bp, Unknown
  misc_feature (1)..( 3000): 2750-1469P.txt file - cDNA_ID_2999389; gDNA_ID_1620648; Annot_ID_47665
acgatattaaggtatctatctaattaacattaatatcttgagatgatgggaatgttaatacactggttgttatgcttagagttgtattgttgtatcacgattcaatagactagataatgaaaccatttcatttcagttctttaagcttgatgttgcgattttgtcaatgtagctggactcagacaagacatattcaatcctgctctatgggagtggtgcgatagttgctctctacttaacgtctgcaatcgtcagttcactcgaagcaatccctctggtaagtactctcaagcccccgaaacaaactctgtttgatataattgtagtaacctttcatatttgatgttacagtttcctaagctaatggaagtagttggtctcggatacacactctggttcactacccgttatctgctatttaaggtaagctaaacataggcttaatcgactgagttttaaacttaaattcacgttttttttctcaaaactatttatttatttgcagaggaacagagaagaactcaagacaaaagttagtgaaatcaaaaagcaggttcttgggtctgatagtgagtgagtagttttgcttcttttttttttgctagcagaaattattccccacaagttttgttttttccactgatttttaagttttgtttttttatgccttgtggtagttttctatggcagtgtggagaaaatgattggattttagaaatgagtaacttgaattcgatgttatatatgtgtattttccaacgttcagactatacaaatcacaaaattctataacatatggccagtatcagataacaacatatatgcacctaatgctactcaaactaaaaatgaaagtacgaaaaattacaaaataatgaagatacctgatagaaaaagacttccttctgggcaggagtaaactcaagcctgtaagaataatttattcggattagaggttcccttggatgaacaaagcaagcaagaaaacagaagtagctaactaatttgtctagatttctttgagctactctatttttccagaagctaccgatcataattgtctgtgaacgacaacatccttttcatgaatcctctcatatgcatagcatcagaagtgacagctaacgtccaacatctaatgtgcatgttttaaaaatttaaataccataagcagaagaagcccaccgcagcttaccagctgtgcagccacagaagatacttttgaaagcacatatccctcggatgaattagcatgctgcatgacatagccaaggcagaagctgcagaaagatttcgccatattacttatttttttttttttatataatccaaaacttcataataaaaacctatattttcttatatagtcatgattatctcggaaaatgatgtgaccaggaaagcagcagtattctaaaactactatattgtgaagcatgaatgctctcagttgatttgcaaagccaatcaaaaattacaaacttaacaccaagggttgcttcctgatagagcagagggtgaccaactggaagcttaagcatatatcacccaaataacataaaagaagaaaaaatacctaatcaagccgcctttatcatcggtggcaagaaagctccattccctgatagctgattttcgaatagctgcagcagcttgaaacctagcatttgccacctgagaattttctggaagtagaaaacactttcagtcaaacagatgaaacttcccaagtccacttggccggttctggattcatcagaaagacttaccaagaatatatctacacgccttatacggctgtggggattggtgaagcgacaaaatggttgcctcagcagcaactggattactattaatctgtacgaaagaaagggaaatgtcaagtacacatgaggtgagcacaaacaaagaccatgacaagccttttataagcaaagagacttcgtacttctataaactcagaaagacggtaatagtaaactagttcagtgagacatgtagtctctaacaacttagtcaacagagacgtggagataaacaaacaccataaaaaagaaaacttgataattttcaatacgctacagtgacttcaatttcaagccaaacaaattacaagaaaacataaaaaaaacaatttcataaatgcaaccacacacacacatgttcctccagtatattaggaaaccaaaacgatcaaccaggaatagagcgaaccacttgtttatgcatatatgtatgaagaaagaagaagcaacaacctgaatatacatggcaatgatacatataaacctaaaaggggattttccaaaaagttgttttttgatcctctgttttttactctatgaaaacagaatcgtttataatgatgaaacattgccagcatacaaattcacaaaatttggtgttttgacatacaattgatatcaaaataacccaaaaactctattagaatcaattgtatgtgaaaaaaaaactgaactttgatcagattcatagaagaaacaaaaaagtaaataataacaacaggagctagcaacatgtatactatttcactttttttagagtttctaagccaatcagaaggctctatttcacacccactcgcacaaagtgagcgttgagcgcgtgagagcaattctgtgggtgtacccctttccaaatcatgcctttttcaatctactcactagtctccaaaattctatttcgcgtgaaaatttgtttgttttcttctctaaaccaatgtaaaccaaaccgcaaatcaattctaatttcaataccaatgtataccgaacctaaaaatcaattttaatttcaaatgttactatcaaatgttttctaatctagtttagcaattaaattgagaagattataatatagctagctagacggcaaaaaggcaacaatcagatgtgggtgggcgtaccggtagcagcagcagtaaccaccgtcggcggccgcagaataccggtgttagtggctgcatcaggcaagaggtcgatg

SEQ ID NO: 28947 - DNA, 3000 bp, Unknown
  misc_feature (1)..( 3000): 2750-1469P.txt file - cDNA_ID_2999389; gDNA_ID_1620648; Annot_ID_163341
atggagtagttgttgcagccgaagagaaaaactcgaatagtgaagctcctcaagctgaagatgaggaaactcaagccctagagtttttgaacgatattaaggtatctatctaattaacattaatatcttgagatgatgggaatgttaatacactggttgttatgcttagagttgtattgttgtatcacgattcaatagactagataatgaaaccatttcatttcagttctttaagcttgatgttgcgattttgtcaatgtagctggactcagacaagacatattcaatcctgctctatgggagtggtgcgatagttgctctctacttaacgtctgcaatcgtcagttcactcgaagcaatccctctggtaagtactctcaagcccccgaaacaaactctgtttgatataattgtagtaacctttcatatttgatgttacagtttcctaagctaatggaagtagttggtctcggatacacactctggttcactacccgttatctgctatttaaggtaagctaaacataggcttaatcgactgagttttaaacttaaattcacgttttttttctcaaaactatttatttatttgcagaggaacagagaagaactcaagacaaaagttagtgaaatcaaaaagcaggttcttgggtctgatagtgagtgagtagttttgcttcttttttttttgctagcagaaattattccccacaagttttgttttttccactgatttttaagttttgtttttttatgccttgtggtagttttctatggcagtgtggagaaaatgattggattttagaaatgagtaacttgaattcgatgttatatatgtgtattttccaacgttcagactatacaaatcacaaaattctataacatatggccagtatcagataacaacatatatgcacctaatgctactcaaactaaaaatgaaagtacgaaaaattacaaaataatgaagatacctgatagaaaaagacttccttctgggcaggagtaaactcaagcctgtaagaataatttattcggattagaggttcccttggatgaacaaagcaagcaagaaaacagaagtagctaactaatttgtctagatttctttgagctactctatttttccagaagctaccgatcataattgtctgtgaacgacaacatccttttcatgaatcctctcatatgcatagcatcagaagtgacagctaacgtccaacatctaatgtgcatgttttaaaaatttaaataccataagcagaagaagcccaccgcagcttaccagctgtgcagccacagaagatacttttgaaagcacatatccctcggatgaattagcatgctgcatgacatagccaaggcagaagctgcagaaagatttcgccatattacttatttttttttttttatataatccaaaacttcataataaaaacctatattttcttatatagtcatgattatctcggaaaatgatgtgaccaggaaagcagcagtattctaaaactactatattgtgaagcatgaatgctctcagttgatttgcaaagccaatcaaaaattacaaacttaacaccaagggttgcttcctgatagagcagagggtgaccaactggaagcttaagcatatatcacccaaataacataaaagaagaaaaaatacctaatcaagccgcctttatcatcggtggcaagaaagctccattccctgatagctgattttcgaatagctgcagcagcttgaaacctagcatttgccacctgagaattttctggaagtagaaaacactttcagtcaaacagatgaaacttcccaagtccacttggccggttctggattcatcagaaagacttaccaagaatatatctacacgccttatacggctgtggggattggtgaagcgacaaaatggttgcctcagcagcaactggattactattaatctgtacgaaagaaagggaaatgtcaagtacacatgaggtgagcacaaacaaagaccatgacaagccttttataagcaaagagacttcgtacttctataaactcagaaagacggtaatagtaaactagttcagtgagacatgtagtctctaacaacttagtcaacagagacgtggagataaacaaacaccataaaaaagaaaacttgataattttcaatacgctacagtgacttcaatttcaagccaaacaaattacaagaaaacataaaaaaaacaatttcataaatgcaaccacacacacacatgttcctccagtatattaggaaaccaaaacgatcaaccaggaatagagcgaaccacttgtttatgcatatatgtatgaagaaagaagaagcaacaacctgaatatacatggcaatgatacatataaacctaaaaggggattttccaaaaagttgttttttgatcctctgttttttactctatgaaaacagaatcgtttataatgatgaaacattgccagcatacaaattcacaaaatttggtgttttgacatacaattgatatcaaaataacccaaaaactctattagaatcaattgtatgtgaaaaaaaaactgaactttgatcagattcatagaagaaacaaaaaagtaaataataacaacaggagctagcaacatgtatactatttcactttttttagagtttctaagccaatcagaaggctctatttcacacccactcgcacaaagtgagcgttgagcgcgtgagagcaattctgtgggtgtacccctttccaaatcatgcctttttcaatctactcactagtctccaaaattctatttcgcgtgaaaatttgtttgttttcttctctaaaccaatgtaaaccaaaccgcaaatcaattctaatttcaataccaatgtataccgaacctaaaaatcaattttaatttcaaatgttactatcaaatgttttctaatctagtttagcaattaaattgagaagattataatatagctagctagacggcaaaaaggcaacaatcagatg

SEQ ID NO: 28948 - DNA, 3000 bp, Unknown; identical to SEQ ID NO: 28946
  misc_feature (1)..( 3000): 2750-1469P.txt file - cDNA_ID_2999389; gDNA_ID_2926214; Annot_ID_142149

SEQ ID NO: 28949 - DNA, 3000 bp, Unknown; identical to SEQ ID NO: 28947
  misc_feature (1)..( 3000): 2750-1469P.txt file - cDNA_ID_2999389; gDNA_ID_2926214; Annot_ID_202866

SEQ ID NO: 28950 - DNA, 3003 bp, Unknown
  misc_feature (1)..( 3003): 2750-1469P.txt file - cDNA_ID_2999395; gDNA_ID_1620652; Annot_ID_47759
agaaaatgtttgataaagattcatggaagttcagtttaccaaaagaaaggaaagccaagaataactggttatgaacaagttcaaaggttataaatctgtgggtaaaaggactcttacggatttgtttgaaggtcgttgattggttaagatattcagaaacgaattgcagatctctagagaattgcaggttttcgaaactaagttgcagatcctagaataagttgcaggattctgaattattatgttttttagggctgagtaagctaagaagaggttattggagtgattcagtgggattcttagaagaagaaaatggaagagacaagtgcaagtgctgcatgaactgtctcaaggctactcacttcaataatgtgaaagtgtcatgtatctagtttgataaacgacacatctcaatgctggtggcagtggctgaaaagaagctctagaaggaagcaaatgcaagaaatttaaactgcatttagaagacagtaactaaggagtttgagttagctgtctgcatcatgagaagattacataagtaactactcaagggaaattcactcgcaggttagtcaagtgaacggtttttcaaagtatcagagaatcataaagaagacaaaggctctagtaccaatttttctgttatccacctgttttatatatagatttgaagagatgagatttttaaattgctacaaaagagagagtctacaatttcacaagcttgtaccaatttcagcaaaatgattggacaaacttgtaccaatatatttaacatgtttagaaaatattcaactcacttagtttgatttcttcagctgcgattctttgaatcaagttttcagttataagcttcaacctgtaaaaatggctgcagaacaaaatgatgaggaaattttttagtatcacaaagtccagattcaagttttttttcaattgtatctaaaacacacacaactttcagattgaataaaatctgaatttcattctcagcaggggctaatataaaaatgacaaaaggagaggaggaggataggagctatatgtctactatttttagttttttagccaatgagagagctccacttcataccccacttttaccgatcgtgccatttcacagtcactctcacccatgtcgcgttgagcgcgtgtctacgatttctaaagggggttaatccacaaaaatcattcatttttcgatccacgcacctcattctcaaaaacccgtcgcgtgtcttatttttttttgttttcttctctaaaccaaagtaaaccgaaccaagatcaatttgaatttcaaaaccaatgtaaacccataaaacccatcgctgtttcactttcactatccaattccaacgaaccagattgataattttgattcgattccacacagagatcataatctaaaccaatgcgattaataagagagccaaatcttacagtatagcttaaaatcttagctaaatcccaaaaacacgagattctaggcgaaaagagaagaaaaaaaaattgccagaatgcataaacagcagaggccagaggcctccattttcaccggagtgacaaattccgggattacttcctggtcggaggtgaagagtcggagtgaaacggcgacgtttatacgtgggccataaatgggctttgacggaactcaaattatattaaaagtatatttagcattcaagtaattaatttagaaattcatttgtttctgtaaaatatatatatttgctgtaaacaacgattgtgattctggtttctggatacttataaagcttttagaaggaaaaaaaattcaaataaattgtaaaaaaaatatatgtaaatgatatttatccttttaatatttttgagcattatggctcagatttatatggaaataattagttagagagaactttaattagtggaaattctcaaacgattatattctatacataaatcgtgtgcattaataacctgacttcaaagttcaaagtcttaacacttgccataaatgtttcgatagtaatatcaattttatattaggagaaaaactaaaaactatgttaaatctgtgtcagaattataataatccctttatcttaccatacatttagttgactcacatttttacttcatcacccaactgttctcagagttttactgaaatttctcatcatctctaatcactgcattgtagattctcagtcacatgacatcatctccgatgggaaaacacggcgggtcaaagactagaaccaccgtttgtttatcagatggtgttatctttctcgccggagctttcatgtctcttaccctcgtctggtcttacttctctatcttttcaccttctttcactttcaccttcaccggtttacgtcacggctgcgaatcggttcaatgttccggtttaaacatgcaattagaccctcccgagcccggtttttacgacgatccggatctaagctactcgatcgagaaatcaatcacaaactgggacgagaaacggcacgaatggtttaaatcacacccttcattcaaacccggttcagaaaaccggatcttaatggtaaccggttcacaatcctcgccgtgtaaaaacccaatcggagaccatttgttactcctccgatgtttcaaaaacaaagtcgattacgctagaatccatggtcacgacatcttctacagcaattctcttcttcatccgaagatgaattcgtattgggcgaaacttccggtggttaaagctgcgatgcttgctcacccatttatggattgaagctttaggtaattttctcaaacacatttatggattgaagctttaggtaatgaatgagctgaatttgcatataaaaaatcgatactttcattttccagaacaaaccaagatttagcataaatgttcaaaattgaaactttgattcctaacttcttggaatgattcatattgagctagatttagatctgtatgattgatatgatgggtttggtttgtttatgagtagagagaaaatg

SEQ ID NO: 28951 - DNA, 3003 bp, Unknown; identical to SEQ ID NO: 28950
  misc_feature (1)..( 3003): 2750-1469P.txt file - cDNA_ID_2999395; gDNA_ID_1620648; Annot_ID_163366

SEQ ID NO: 28952 - DNA, 3003 bp, Unknown; identical to SEQ ID NO: 28950
  misc_feature (1)..( 3003): 2750-1469P.txt file - cDNA_ID_2999395; gDNA_ID_1620652; Annot_ID_163488

SEQ ID NO: 28953 - DNA, 3003 bp, Unknown; identical to SEQ ID NO: 28950
  misc_feature (1)..( 3003): 2750-1469P.txt file - cDNA_ID_2999395; gDNA_ID_2926215; Annot_ID_142172

SEQ ID NO: 28954 - DNA, 3003 bp, Unknown; identical to SEQ ID NO: 28950
  misc_feature (1)..( 3003): 2750-1469P.txt file - cDNA_ID_2999395; gDNA_ID_2926215; Annot_ID_202909

SEQ ID NO: 28955 - DNA, 3003 bp, Unknown
  misc_feature (1)..( 3003): 2750-1469P.txt file - cDNA_ID_2999403; gDNA_ID_2926195; Annot_ID_141241
atgctcttttaatggttggtacgttatttcgaaaaatagaaagacttatctatttaaatcctgcaaatgaccacaaactgttttccattttttttgtctccatccatatcgtattgaaaactactttctagcatatcaatcctctttaaacagctcaactcaagttataagaaatagtagagcaattggtatttcgaaatacagagaaatttatttcgttgtcaataccattgtgtttgttgtgtttttgttttatagtgaatgcttggaaatctaaaaattttgttgtttagctagatcaagtaaagtaatttattgcaagagtataagctttcctctcaataattgcattgaaaaacatttggattcaatgcagctacatatattaaataaaattgttcaatggagacacaaatgcatttgtgcaattccatgtgatgcagtaaaaaaaaaatcacactcccaaaatatctctctctacaacacaagtcaacaacacaatattcacagtcacaagctatatgccttttcttatttatagcttcatctagattctgttcaattttttttccatttattattgcattcttgattacttctgtctaaaagattcacaatcaattagaacttgtttagtaggtggaacttaaaaaccattattagttaacttatcaagaacggaatcaaactagtgcatccattcaaatgacaaatgtaacaatttgtcaaaacatgtgattcaatattttacactaaaatgcattgaaataacaaagtggaacaaaaggaaaaagaagaaaaacccgtgatatgattcatgcaatcataagttgaacataaacagtaaaacttaacaatacaaaggcaaatgtgacataactacacaaggaacaaataagaactctttttgataatcttgtcccctctctcatatcatcaatgcttcttcaaccacatccactctgtttttcataatctcacactctctctctctctctctctctctctcacacacacacactcacacaaaactcattaatccactgaaacaatcactattcattctctttccttaagtgtcaaactcttgaaaaaactactttgaaggaaaaaatgtctaagaagaagaaaggcagcaacaactttaagcttctctgtttcttcctgtttttgggtggtttggttcagacagatgcttcttttggagtaggaggcggcgttggagtaggaatcggcggcggcggcggtggcggtggcggtggtgtttgggttggcggtggatacaacaacggtggaaatcgtaatgctgttccaggatcatcagctccaaacagggtagcttacaatgctcttcaagtttggaaatcagccatgagagaggatccatcaaatgttctcaaaacatgggttggatcagatgtttgttcttacaaaggtgtgttctgttctggtcaatctataacctctatagatcttaaccatgcaaatctcaaaggcacacttgtcaaagacctagctttactctcagacctcaatattctccatctcaacagtaacagattctcagggcaaatcccagattctttcaaatctttagcttctcttcaagaacttgatctaagcaacaataaactctcaggtcctttccctttagtcacactctacataccaaatctggtttacctcgatctccggtttaatagtttaaccggtttcatccctgaagagcttttcaacaaacggttagacgcgattctcctcaataacaatcaattcgtcggagaaatcccaagaaacctcggaaattctccggcttcggttattaatctcgcgaataacagattttccggcgaaattccgacgagttttggtctgacgggatcgagggttaaggaagttttgcttttgaataaccagttaaccggttgtataccggaatctgttggtatgttctctgaaattgaagtctttgacgttagctacaatgcattgatgggtcatgttccagatacgatctcttgcttgtcggcgattgaaattttgaatcttgctcacaataaattctctggggaggttcctgatttggtttgttcgttgaggaatcttattaatctcactgttgcgttcaatttcttctctgggtttagctctgaatgttcttccagggttagtttcgggtttgatttcgttgggaattgtattcccgggaggaattcgcagcggccgcagccggattgttccggttattccggcggagctatgagctgttttaggattccgacgcagcctttggcttgtgctgcgataagtgttggattgagagagagtaataatcaatactacacttcatctcctccatgaaagtttctaaagttagaagcttttttttattaatggttgatgctgaatgatctatcttttttgtaacttattaattagttgattagtgaccaaattaaacgttaattcctcttctgtgtaatccaatcgttgctaatgttgttttgtaagcagaagaattttgtaaaaatctaacgtaagaataaggtgcccagtaaatgtaattaaagcaaagacttggcttagtgaatttcaccggaaaatatcttgttttgaatcaattagatgaatgagtgatcaagcaatgtatgtagtacaccgcatttgggactttgaaagaacaatcacccacggcaaaaccttgcaagtcactccattgatcaccggtggatatagtatagatggctaaattagttatatatatatatatactatactaccaatttatgtttaggggttttcatgaacccgaccataacagaaacatgttttacgggaccatgataattctacattcccttaggggagggttgtttagttcatgggaaaagtatgtgttgaaatatgtaaatacacaccaacaaacgcacatatcatatatatatggtatacaagctcacatcaaaagtggattctaaccaaagaataatacaacgaaaaatg

SEQ ID NO: 28956 - DNA, 3003 bp, Unknown
  misc_feature (1)..( 3003): 2750-1469P.txt file - cDNA_ID_2999417; gDNA_ID_2926195; Annot_ID_141249
actaggtccgatttattcagaatcagttttgatatggatattggtcggattcgttcaacccactgattccaatttggttttgaaaaacaatgttcggccatttgcatccagagttatttaaatcacgaaaaatatagtttgctatttatcatatacatacggaatttgcatgttaacactattgatcaactagatttttctaatgttatattttttttggtggggaagtattgaacttaccttaccactctttttcgattcaaatactaagaatcacatttatcagttgtgagtttagctaaatatgtgggtggttttaaatttgtgagtattaaatttgtcatttctatcacaaaacaatgggagaaaaaaacgaaaaactagtttcccgacattaaacatgcgaattactgaaacatggataggtccaccatttttgccatttgacaagctcggtctcttgttttccttgttcataaatgattttagtttgtttgcttttttaaacgcatctttctatcacttttttcttttggttgcaaatatgtcgttttctctcctccctccttttccgggatttaacttatcacaatgtaatgaaatttgcatgttcctctctcgccattggcaagttccattgcgatgtctctatcgataggtcaaacaatccaaaagaaccaaaaccttttttcttttcttttccactcacatttaatctagggaccctttaatcttattcattttctcaacgataatgtaaaaaagtatagttagtaaactgttaactgtgtagattatacatgttttttaatcaatcatataattagaaggggtatttagccgtccaaaagctgttttcgcgtgactatgcatgaaacccacttacgtagcctccaacgtaacgaccaataaaaagctctaacttaggaacattacaacgaactaatatttaataagttatataaggtcatgaaatgaaatcttataacgtatctaacaactcacatgatctataccatgtcacattttttatcaaacatatgttaaccacctaagcactaacactactctttgatcaaacttatatttcgcatatactccaaaagaaaccaagtggcatattggcatatctcgtaatgtggtgccaaaaatgcttatcaacttaattatagttcagatattgtctccgtatcgtatcttaatatttgtattcaacaataggtattatgttgtattagctaggtgtgatttgtaacgagaagagatatctcgttctattgtgaggtaaaaataaaataaagcagtacaagaacataacggtataaacggtttttactgttaaaaaacttgtaattgtttatgtaccaaccctattgattgtgtttaagaaattatttttaaatcttgagattcttattcaaatataaacattgaagatcgatattgctcaatatcacaataatctttctaagttatgaaaagaacgtctactactatttgtttaaaactacataggacaacatcaaatcagttttgaaattcattgtaaaattcttttaatactaaaattgtttacagttaatgagaaattacaatattatttttagcagattataattagaaaatacattattattattgatcaatttaccttgcagttccacgcaaaaccaacaaaataacaaataacaaagcattgtgtggaatgacgtaaggatgagtcagcagacaaggagtgagatcgaatcgggtcaagattatctggttgggacccgtcacatgcacatggaccctctcccgtacctaatccaggttaaataatcttgattttctgtttaattaccttaaaaacacattattattgaaactaataataaatctcggatctttggttccgaccatacttgcgaaagatcattgctttaatgctaatgtttctctaattttgatattccttgagattagattccctttgcattgtcttttcttgttaatttgttagggttcatattcttacattattttttttggcaaagaaaaaaacatttataaacatatctaattcgagcctgatctattaatgggtcaaataaaagcctctttggcccaattcaataaactggccaactggggatcatcatagagacagactactagagagtagagacgcatcagaaagaagagaaattgatcccacaagtttaaacacgattacaaattaaaacgtgccacgtattcaagacggtgaattaacacgacgtggcaaggtatgattggataacttacgcagctgcctaacaaaaacaagtgatttgagttttcagatgattagaaggaaaaaaaattctggaactttcgagcttctgttttgcggtgctctcaaagcttatatcggatctcgaatcttgaatcggactcagaacctcggatcttcgaaaatcgacgaacatgtcttctcctggcgagtgagttccgttcccctctattgaaactttgcttcgattcgattttgatcgagagattcttagcttggtcttcgtacccaggattttgagtccttaggttaataattttcatgattcgtttagcttgtataggggtttttgaagcattcaactgttgattcttctcaattcgagcgtaattttgcaacaccaagcgagttctgtgaacttgagctaacgctatttttagtatatagttatcaatttgcattgtcatcatttgatattttggtgatttgagatgtaaagaaacatcttttatgccatggaagttagtacaagtcaactggtagttagttcttgaaatatggaatctcatagtgtcttgaagcaaaactgttctcgtttgctgtatcatagttacaaggctactttgattctcctagctacgatagtctaaaatatctctgcgtaggcttgtctcttgtggtaaagttttatgctttagctgatcttgatgacatttcctgattagaaatttatagatggatggaatatg

SEQ ID NO: 28957 - DNA, 3003 bp, Unknown
  misc_feature (1)..( 3003): 2750-1469P.txt file - cDNA_ID_2999421; gDNA_ID_2926195; Annot_ID_141251
tgtttttgtttttgtctagcaatcatctccttactaaattgaattcgataaactatagccactatgaatataatcaaatgaaatttgtgacataagaatttggacgtaacgagtttgaatatctatctagataagttattaaattcgtgaccaaagagtttggtcgtaacaagtttgaattttttaggacataatattattattggctaacaagattacgactaacgagtaaataatcattccttcggtccttcctctaaaatgccgttggtgatcgtttataaataggggaaataggaaaagggaagaaagtagacgtggcaaatagcgaaacaatgattgagctataacaaaggcgaaacttgagcggcactaattgaaaatcactccttgtttttttgaagaaaaagtaagatgtagggctgagaattcgtctatgtgatccaacggttttaaaatgatccttgttccttcctctcctatttatctgaaggacgaagtccccacgctgcacataaccggggcacttaacgtatagatcataaacaaagaagaagaaaaaaaataagaaaagaagaagaagatgtcgtggcaaacttacgttgatgagcatttgatgtgtgatgttggcgatggtcaaggacaccaccttactgctgccgctatcgttggtcatgacggtagcgtttgggctcagagcgccaacttccctcaggtatttgatttcattgcgtctgatctcaatgtgatttagatcctgatagtgttgctatccgatatgatatgtgtttttacaatgtgatttagatcatgcatcatgttttgattagattctatcaatgtttgtcatgggatatatatatagtgtattttgtgtgtgtgtgtttctttttatatgttttgcatagatttgaaaacaaatgatgcatgttgtctcatggtaatcgactaatcgtgatttggtctttcatatagttcaagggacaggagttcagtgatattatgaaagatttcgacgaaccgggtcacttggcacccacgggattattcatggcaggagcaaagtacatggtgatccaaggtgagcccggggctgtaatccgtggcaagaaggtaacctaatcagtagcttcatgatcagatatgcaaataccatgttgaagagggttctaattcaatatatgcttctttcaattagggagcaggaggcataacgataaagaaaacaggacagtcatgtgtgtttgggatctatgaagagccagtgacaccaggacagtgcaacatggtcgtcgagaggttgggtgattacctcctcgaacagggtctctagaatcttcttacaatgttccaccacctacatttttttataaggccattgtttctcctatttttttcctttgggtgatttgcatctctttctctaattgatattataagttttgggctaatggaccttcctggtttctccccatagcaaacttttaagaaagctgaagcctaaaaggcttttactctctttgccttggtttcttatttatatgcatgttttagttgttttctctttgcttttttgtcaattgcattctgtctactacactaaatattaacgtattgattgagaaaattgcattatcataatctatagaaaattgtatgtagtgtagtagagacattaatctcacaatactaaaaacactttcaaaatttacacgagcatttaacacatacatcaacactcattatttacaacagaagaaaaaactgatacgcaacgcaatctttcctagtgatttcattcgtaagaaagaaaaaatgaacatgagaaagaaaaatggcaacaggcagaattcattcatcaactttaatctttaataggaaagtaataatagtacaattatgtcggaaaatcattcccatcccatctgtctttattatgtgctaatctaacagctcatcgagaaatcgaatctcagtcttttttccctattattacattatcacttagatataaggaaatttttgttatctcacaatattcactttgaatcaatacgatgcacatataacaaattaacaatagcaagtgattgtttctcttcaataactcaaaaacattttttttttttttggaatagaaaaaggtttattaaccatctttctaaattttgggtaattaagaaacatttattgacaatgacattaggaaaagagaacattaattgtaaagggtggacctaaataattggaatattttggtgtatggcacacaatgcaagagcatatccaccctgtaaacaaattatggccatacttcgatctcttttctttgattttggaaattaaattctctagtattgttttttttagaaaagaaaaaaaaacttttgtattgtttatttatgtaaacttcatttgttccaataaaatctaaaacgttttcacatttggtttgacaattttatttacacaaattttcaatatacttttagcgttagatcaaattataccatgcaagaattatatgcattttctatatgatcttgtttaaaaataaaaactgtagaaataatgtaaaacccgagaaatgaaattgttaatagattaaaaaaatcatttcttttaaccggatgcaaattttaatcattttaaaaatattttcttttgattatcattttaaaattatttatcgactttcacacaaaacattttgaatttcatttgtatctactttttttttttttttggtatttcttttagctgtctttatcaaattcagtaaataaataaaatatgtattttaatggaattttttgcagtagaaattaaaaaagagtttttttttattggaaggctaaatcgtgttattaataatttaagctcaaaggttgtccaagtctacaaaccaaaagcacgctacagaagaagaggaagaagaagaagaagcagagacaacaagaagaagaagaaacagtctcatctcgccggagaagaagaaagatg

SEQ ID NO: 28958 - DNA, 3000 bp, Unknown
  misc_feature (1)..( 3000): 2750-1469P.txt file - cDNA_ID_2999424; gDNA_ID_2926196; Annot_ID_141258
gagactcctacaggtcttaagtttggacctctagccagtggacttgagaatgaaacgactctcccatcttatggatcgagtccgccaagagacaagacgtcgtctaaatctataaaagagtatcttccaacagaggttgatccgtcaaggtcttcttctctgcagacagcttcttctagcagtattaggaatgaactttacactcagaaagcaagtaactcagacaaaagaccaagctctatacctccagattcatcttctagtgatgatgaatcagatatggaacttccaaagagagtttctttcagatatcaagagaaaagaactgagtcaagaacccggcccacacatctacattcgggtgtcagccataaggacttggaggaagaaatcccgactcgagcttctaccagaagtcaagataggaggacccacaagaccacccctgcctctgcttctgcttcatattttcacacaatgtccagtgacgatgaagatgagaaagaagtccatagagatactgcacacattcaaaccaggccttatatttccatctcaagaagaacaaagggccaagagagaagaccatccctcgttactgcaaaaattgacaaagtttcttttgatgaagaatctccaccaaagctaagtcctgaggccaagccactgactaagcaacaaggatcagcttcctctttaagctatcttcccaaaactgagaaagtttctcacgatcaagaatctcatccaaagctaggtcttggggccaaaccactgattaagcaacaaggatcagcttcttctttaagctttcttccaaaaaccaacaaagcttctcccgatcaagattctcctccaaagctagttccaaaggaaaaaccagcagctaagcaacgaggatcagcttcttctttaagctttcttccaaaaactgacaaagcttctcccgatcaagattctcctccaaagctacttccaaaggaaaagccagcagctaagcaacaaggatcagcaacttcttcaagctctcttccaaaaactgaaaaaatctctcactatagagaatctccttcaaagctaactccagaggctaagtcaatggctaagcaagaaggattagcttcttcttcaagctcgcttcccaaaactgtgacatcacctgacccagaaactccggcaaaggagaaagctagccatgtacatcccaaactcccagattacgatgacatatttgccaagctcggggctcttcgtcgctgaattcttcccgtttgtttatatatacatacatacatattcattgttcaattagccctcaattcttttctttgattggtttgcttgtagatttgaacttgaatttcgcatcctgagcataacttttttgccgtgagatatctcatctgttttgtattacatgtttggctttcttgtcatatatacagtcagatttgtaatgattgaggatacgattgacaaatcgagagaagaaaatatcttgattgatgtactattttggtggacgaaacaggaatgttatgtttaccatgataataagaaaactgttaacccgtctgtgtatagaagaaatatagattattcagatagctatggaagaacaaatttctcgtccaaaatataaactaacaacaagatctttgaatttagcaacaaatgtgttatctaataattgccaatctgttcaaagacaatgcaagttacaaaaaacaaaaagcaacaggagaaggaccgaaacttcaatcttttgttgaatcctttgacactagaaggttcttgccatgtgctagctcaagctattcagtaaaagaagccaagaacctgaccacccacattccgtttgattgcttcttcatggtccaaaatcccatccggagttgtgattacaacataaccccactacatggaacaaatcaaaaaggctaagctatttagctgcatttctggatatggagagagagagacaatgaacaaacctgacgtgttggaagtgtgcgttcagtgtatttctcaatctcttttgccctaacgtcttgcctgtaggtaagagctttgcagtcattaaccctcccttgcagatcaactgttattctcccaactctatgtggatcatacacttgaaagttcttgatataacctacatttaacattaccattttgtaaagttaaaacacactaaggaaaagctgattccatcaaacaatctgtaacatgtaaagctacttacaactataataaccatttgaaatcgctatctagcaacattacccaaaaaaaaatccatttagcagaagaattatctaaccatccttaatatgaatcaacaggtatatatatacataagtagaacaaagcaactcagaccactgatagcatcataaaagcaaaaacataaacttggaagcaaaaaacattaaactttgtttcaagtttcaaactttcaaatgttgtagcttcacaagtaagtaagcccaacaatctcacgaactaattgcagcttctaaaatactactaaatctagtgtccatgagaattgatgagcttccgatcccaaaaatgataaatgggtaagcatcaagaaccaattagaaaacaaaagggagaaaaatttcacctttctccttcatgattctcaagaacgaagacataacggtggagattggtttgagctccaccgaagcttttcctcgtctctcagcattcacaatcgtcctcaacgcatcgttcaaaatcctcctccccatttctccggtcaaaaaatcccgacgatactacacaaatcggagaaatctagaaaacaataagggtttttcttcactctatgacacgtttgttattttccagaattcataagggtagtttagtcgtttacaattttaacacgtgcgggattttaaccacacgtacctccaaatttctataactccttctctccttcgtcttcttcctttccttcaatttcccaaatcaagaaacaccatg

SEQ ID NO: 28959 - DNA, 3000 bp, Unknown; identical to SEQ ID NO: 3790
  misc_feature (1)..( 3000): 2750-1469P.txt file - cDNA_ID_2999432; gDNA_ID_2926196; Annot_ID_141304

SEQ ID NO: 28960 - DNA, 3003 bp, Unknown
  misc_feature (1)..( 3003): 2750-1469P.txt file - cDNA_ID_2999446; gDNA_ID_2926197; Annot_ID_141345
caacgtcaagtaacttatttatgaatcaaagaatcaatcatttagctgcactctggaggaacacctcgaggaaacctttttttatcggagcaatagttgtaaaccatgtatttactctgtacccctttcattcttgtctggccattcgaatcgagtttttgagtgaaccattgggaatttgcgggacaaactgactttccattaacccatacacatccctcgacattgtagtttctgtaataagcggtgaaaggagcttttgaccaatctgttttctctaatcctccccttgtagcccaatgctctgcttcccatagactcgcatatagcctcattggttgctttgttgggaatgggactccacgtgactcggcattcataaactctctaattggaatcccatcaacggtaaaactggagagaataaaagattcttggttcatgagtttatatcctcaaacataaatattatgtatggtacaaaggaaggagtttcgacacttacataattctttgtggattccatgtgatgcaataagtgtgaaagttagcggttgggtcaaaccatagatgaaattgttgttctttgtctcctgagccttttgtgtaaacattagtatggagagtatatggatgaccacttatgttccccaaaaactcgaaatcaatctcatcccatgtagttcccggagatttaagctacacaaattagaacatcatataagcaagtggtacgaacattttatgaaatagcaaaacatgacaagaacgttacatgttacttacatagaatgttgtgacggttccagcagagttaccagggacaagtttcatttgaacttcggctttaccatagagaaactcttgattagattggaaacctgaaccagaggatttgtcaagcgagagagatagaagtttcccttgattatcgtgaatctttccacgaccatcaccccaatgtatcttaacgtctttgtggaagctgcctgcatagacgctgatagattgtgctgcaaagagaaagagaatcaagaacgtaaaagacttcatttttattagatctctctaggagttttgatatctcagatgtatattgttgatggaatattgaggtaagtgacattagtttatataggggaaaaagagagatggaagtttcatgggtttgatcatttatggtgcatgtgcttttgtctactcggaggcacattcacagcttctaatataattatgtatatagattatttgattcgttgttggctgttgccaagtgaatccaataaaaaactctttctttatttgtttattgttatcaaaccgaaataatgtttggacatttgtacaaaattgaatggtcccaatgttttgatatgtcaacacggcttcgactttcgagcgcaccgcctaactaatgagaagctcaagatgtctgagaacactccgaatgaggaagcatattcgacaatcgacatcatccgatgccttgtgtcagacaaaacagcaaaaacgacagtgtttcaaccaaagaaaagattgtgttgggcttaagtgattcagacccaaaccaaaagaagcccatgacattacaacggtcattcattctcaactaaagacaaaaacagatgaatgcgagttcttcttctacgcaatcggtttgagattctcatgtgtgaagaaaaaaactagtctaatatatgggaacgattgaaacaaaccgaattcaaacaccataatatattctcaaaaattaaactccagatggatctaataaaattcaagagatcttataatagattgaaggggctaggaaagatcaaaacgtgagtttctcactacttcaggttttctccggtgaaagattctctcaatgtcatctctctcttaatcatccaagtagtaataacatcccgcaagcttctggtcactatccttcatcgaatcgagtttattgattcttggtctgaaattcgtaggatctcgtctgaaagtgatgttcaaacgagacaagaacaaattcattccactacgtagagactgaggagaagatgccgtgcaatccacggaaggttctccttcatacacaataactttatctgccaaatacgtagccattatgaaatcgtgcaaaagccgccttcttcatctgaagaatgaatctctttatgactttggaagctataattctctgctccgaatcaagaaacgcgctcggttcatcgatcaagtagatatccgcagatttaccaaggcataaagctaaagcaaccctttgtttctctccacctgatagtttgttgaagcttttatccatgagctcctcgatcttgagcggtttcataacgtctgacacgaattggtgttctgcatatgcgttagggatcttcctgtgtatcaaatctctaacagtaatctcaaatttacggtttgacatatgttgattcttgtaagaaacagagaactgtggtatctcatgtacttgagatccttcttcatcaatatcaagcttcgaacccgcaagcattttgataaacgttgtcttccccgttccattctctcccaacataactataatctgagaatccgtgaattctccttggttcaatctcagcttgaagtcccctcgagttatagtcattgcagggtaattgtaccttgcataagaagctacttcttaggcttgcaacagtctgcgttgacgacagggattcgagtcatacgatctgccatctctttttcccgatgaatcgagtaagaagactcaacttggagaattattttttaggtcaaagaacggacttgtagggttttattagtcataaaacaggggaaaaaacggagcacgtggaccgtggttcgaccgatccaaattagctaaatccggctctctactaaccaagaacaatccggttatgatgtataaaggaaaggaaagtagataaaggaaggtgagccactaaagtcatcgtcacctccgtagcttccgccgttgccgttcagatg

SEQ ID NO: 28961 - DNA, 3000 bp, Unknown
  misc_feature (1)..( 3000): 2750-1469P.txt file - cDNA_ID_2999450; gDNA_ID_2926197; Annot_ID_141347
gcgaagcatcgacgactaatttcgtggcggcgagaccgtcggcgaagaccgatgatgcagtgacgatgagaggttgtggttttgctaatcttgccttggttggtatagacaaagaagagcttcgagggagactagcgatgcctgagtatcttcgtatagctatgagagattgtatcaagaggaaagattcaacagagatttctgatcatttgttacttcctggaggcgccgccgctgatatggctcctcacgcgccaatggttgtgtttattaacccgaaaagtggtggtcgtcatggtcctgttcttaaagagaggcttcaacaattgatgactgaagaacaggtctgttttttaaaaaacaaaaactttttttttgtttgcaacttatgaaatgagctcactttacttaacttttgaaatgaacttgagatcatatttttgtttgaagaagattttaaatcttgatttgggagtttactttctttttgacttcactagatttgtggttagattgtgaatggaaacactctgttttggtttaatgagtataactatgagcctatggcattcttattgttctgacatcatcaaatgttctgttttttttttctctgtaattttgtttagaagaagttataaactgttttgtcttaaaaagactgtgattcctccttagttagtgagctcatgttaatatttgcaatgacaggtatttgatctcacagaagtgaagcctcatgaatttgtacggtacggtttggggtgcttggacacattggctgctaaaggagatgaatgtgcaagagaatgcagagaaaagatacggatcatggtgagtatctatttccaaagtattagttagcaattggaattagatttgctaagttagcggcgatgattgatgataggtagcaggcggtgatggtaccgttggttgggttcttggatgtctcggtgagcttcataaagatggtaaatcacatattcctcctgttggagttatacctcttggtacaggaaatgacctctccaggagttttagttggggtggttcattcccttttgcttggagatctgctatgaaaagaacattacatcgagcaactttaggttccattgctcgattagatagctggaagattgtagtgtcgatgccatctggagaagtcgttgatcctccttattctttgaagcctacaatagaggaaactgcacttgatcaggctttggatgctgatggagatgtacctcctaaagcaaagtcttatgaaggagtgttctacaactacttcagcataggtttggaatttggatacatgaagtaactttatctttcattgttcttaataaatttctacaaagttaaaccttttgaagtaatttggtattttcttgtgttgtttaggtatggatgctcaagttgcatatgggttccaccatcttcgcaatgagaaaccgtatctagctcaaggccctgttacaaataaggttgctatatatcagaatcttcattcttgtctaagtttcattaattagctgtttttttggtttgtaatgagattatgaatcacactcgtttcggttttgcagattatctattcgagttacagttgtactcaaggttggttttgcacgccttgtgtcaacaatccagctttaaggttagcattttctgtgaagagagtaaaccaaaagccttttctttactcaattcctgtctcttgttgtgttgacatgttgtggtaagatgaatttgcaggggactaagaaacattatgaaaatccatattaaaaaggcaaattgttccgagtgggaagagatccatgttcctaagaggttcatataaaactaatcttatctttgattaaaactaaaaaaatggcttcacttataatctctctggttttgttttggtgtagcgtaagatctattgtggtgttgaatctttataactatggaagtggaagacatccatggggtaatctcagaccaaaatatttagagaaggtaataatgttttattcagtacactaatcttaggttttattgctttctctacaagctttaacagaacgtgttcgggttttataacagagaggatttgtggaggcgcattgtgatgacggactgatagagatcttcggtttaaagcaaggttggcatgcgtcatttgtaatggctgaaattatctcagctaagcacattgctcaggtacaacaaaatacatccaaagtttctttataagaatcggtttaacctcggtttgatattaaaccgtttatcgttttaggcggctgcgattagatttgaactaagaggaggtgattggaaaaatgcattcttgcaaatggatggtgaaccatggaaacaaccgatgaagagtgattattcgacttttgtagagataaaaaaggttccttttcaatcgttaatgatcaatggcgaatgatcgaggaaactcttttcaagaagttgtaaaaggattaaaaaagcatgattctttatgtatttctgttccatcaattagtcaaaatagtgatctatgttgagcttttgctacggctgttgttgtgctagtgaagcatttaactttgtgtattttatcaaaaaaagatggttatttattcaatagtcattaatatacaattaagatataagcaatcatcttcaggtagaccttgaaatcttgtaaacatgattttgctgtctttaaactctgtttcttaagtcgtttttcagtgttttggagatagtagtaatgggtctaaaaagttaaataatgtttttgtggggagaaaaatgaaaatagcagattttcgaggatgggaagagtaaaacatatatttgagaagtcgaaaagtgtgaaatatttgttctgtctcgcgaggaagagagaaaaatcgaattagaaattgcaagttttagggttttagaaaatctatcttcttcactgagttttccagctccgaagaacacttgcaacttcaggcaattatg

SEQ ID NO: 28962 - DNA, 3000 bp, Unknown; identical to SEQ ID NO: 28961
  misc_feature (1)..( 3000): 2750-1469P.txt file - cDNA_ID_2999450; gDNA_ID_2926197; Annot_ID_201563

SEQ ID NO: 28963 - DNA, 3000 bp, Unknown; identical to SEQ ID NO: 24278
  misc_feature (1)..( 3000): 2750-1469P.txt file - cDNA_ID_2999453; gDNA_ID_2926197; Annot_ID_141348

SEQ ID NO: 28964 - DNA, 3000 bp, Unknown
  misc_feature (1)..( 3000): 2750-1469P.txt file - cDNA_ID_2999465; gDNA_ID_1621125; Annot_ID_172254
tgaaattgaggagatgatcagagagatggaaacaacagaagagagattagtggtgtacgatgtagatgtgttggattatcaaagcatacttgtctctctcaagacatgtaacgttgtcttctgttgcttagacagccctgaagggtacgatgtgagtgactaattcatcttgaagtgttttgtgttgattcgttctgagtttggattgaaatttgaaactgagattgatgatttgtgtgaatttatcatcaatcataggagaaggaggtggatttggaagtgagaggagcgatcaatgtggtggaagcgtgtggaagaacagagagtatagagaagattgtgttttcttcttcattaacagcttcaatttggagagacaacattggaactcaaaaggatgttgatgagaagtgttggagtgaccaagacttctgtcgcagcaagaaggtttctaatttttctttatttatttattttggttattaaatattaatcctcattagtttaagtgaaatttaaaattttggggaataaattggacccacaatttaaatattataagctggattggaataactaattatttcctgacatcttatttaatgtagctagctcatattattatttattatacatataaaaaaggaagccagttctataaattttgaattttgaaacactatataaggaattattttgtggtatttttttaatagtcaaatgttggtcttcatcaaatgtatcatcacattatctcgaatcattttattggacgacatagaaaattcgtaaggggtcaggttaattgaatatattcatttccatgactcttaaatacattgtacaactcttgattcggttatagttgccttttggaaatttaaagggcatatattttaaatttttttccttcatgttttgaataattagatacagatgatttagtagtagtgtcttttatgactatcacttagattagacggtgacatgttttttttttgatataattatgattgtcattactggacttagctaactttatgcaacaaattattcggagacaatattaacgtgtatagctgtctgtcatcaaacggaacagtcaacaaaacgaaatcgaagactattcctttacttttttgttgctgcaatttttaggaatttcattaccctctctttttgtttgttactactatttactgtagtagtattagtacaagctcaaactcacgtgctaacaaactgtatgtggatgcagttgtggcatgcactggcaaagatgttgtcggagaaagcagcttgggcattagccatggaccgtaggctcaacatggtctctatcaaccctggtcttgtcgtcggaccatctgtcgcacaacacaacgctaggcccaccatgtcataccttaaaggtacacacacatagagaaatttcataaacctcacaaaagagtttatgagcatttaatcaaagttccggaattagttgcgaaggttttgtgaatgttttaagaaggcttttttaatagcataactggaatttgtttttaaacaatcatagtgttgaagaacgagacatactaattcatattcatcaattgtgatttgaatttgatgaaatagtgtttttggtaacaggagctgcacaaatgtatgagaatggtgtgttagcttatgtagacgttaagtttctagcggacgttcatattagagcattcgaggatgtttcagcttgcggtcgatacttctgcttcaaccaaatcgtcaacacagaagaagaagctctcaagctagtggagagtttgtctcctttgattcctatgccaccgaggtacagtttcttgtttaattctatcttgtgatttattgtttaatgcaacttatagtctaatactatatatgtcaattaggtatgagaatgagatgcacggaagtgaagtttacgaagaaagattaaggaacaacaaattaagcaagctggtagaagctggctctgcttgttaaagaaagatttcacaatttaaattgaaagagacgagattatacaaaaaaaagttgtaatttgtatattgatcttctcatagatgcatgtgttgcttgtgaactattaaaaagaaagaaaaaaaacacatttcatctcattttataactaatagtatatgagtagttttttttttttggctgggggcacaatatgaatgttttctaatttttgttaaacatattaaatcttggtgggagagttgtcgtatacgaaccttttaaagcgatgtttcctataattgtgcaataataatatgaatgcattacgtgaaagattgtgcttgtattggtatatgaacacatactattatactaaaaaatttgataaagagttttttttgttttgattttatatgtagaaattataatattttcaaattatggttgaaaacaaagatgattttcttagcaagccataagcttttcttatatgcaaatgataaagtacttcacataatatgtttccctagattacgagttaagatcatatcgttgaatatagaattttgtgacgatactaacttgttttactatgaaatcatgcacaattttgtgacagaattcatgattttgctacggaatcatcaacgtgttatgattttttttttaaatgatatgttcttacctgagaataatgtgaattggatttatactaaaaacaccaaattataagaacagtacttttgcgaacaaagatcttattcacaaaaccatatgatatacttaatgggccaataccaggcctgagattgcctaacgtcgttagtaaaacccgtttaaccagctaaagtataacgtcgtcgtttaaacaaggcatcttgacccttcttcttctctatcgagtgctctggattctgatttgatttgtgaggaaagctagatcgacgatcgaataagtctcgcgctgaaatctatctttgtgcaagcaaactctcgaagaaccttagattgaagatg

SEQ ID NO: 28965 - DNA, 3003 bp, Unknown
  misc_feature (1)..( 3003): 2750-1469P.txt file - cDNA_ID_2999465; gDNA_ID_2926198; Annot_ID_141362
gagtgaaattgaggagatgatcagagagatggaaacaacagaagagagattagtggtgtacgatgtagatgtgttggattatcaaagcatacttgtctctctcaagacatgtaacgttgtcttctgttgcttagacagccctgaagggtacgatgtgagtgactaattcatcttgaagtgttttgtgttgattcgttctgagtttggattgaaatttgaaactgagattgatgatttgtgtgaatttatcatcaatcataggagaaggaggtggatttggaagtgagaggagcgatcaatgtggtggaagcgtgtggaagaacagagagtatagagaagattgtgttttcttcttcattaacagcttcaatttggagagacaacattggaactcaaaaggatgttgatgagaagtgttggagtgaccaagacttctgtcgcagcaagaaggtttctaatttttctttatttatttattttggttattaaatattaatcctcattagtttaagtgaaatttaaaattttggggaataaattggacccacaatttaaatattataagctggattggaataactaattatttcctgacatcttatttaatgtagctagctcatattattatttattatacatataaaaaaggaagccagttctataaattttgaattttgaaacactatataaggaattattttgtggtatttttttaatagtcaaatgttggtcttcatcaaatgtatcatcacattatctcgaatcattttattggacgacatagaaaattcgtaaggggtcaggttaattgaatatattcatttccatgactcttaaatacattgtacaactcttgattcggttatagttgccttttggaaatttaaagggcatatattttaaatttttttccttcatgttttgaataattagatacagatgatttagtagtagtgtcttttatgactatcacttagattagacggtgacatgttttttttttgatataattatgattgtcattactggacttagctaactttatgcaacaaattattcggagacaatattaacgtgtatagctgtctgtcatcaaacggaacagtcaacaaaacgaaatcgaagactattcctttacttttttgttgctgcaatttttaggaatttcattaccctctctttttgtttgttactactatttactgtagtagtattagtacaagctcaaactcacgtgctaacaaactgtatgtggatgcagttgtggcatgcactggcaaagatgttgtcggagaaagcagcttgggcattagccatggaccgtaggctcaacatggtctctatcaaccctggtcttgtcgtcggaccatctgtcgcacaacacaacgctaggcccaccatgtcataccttaaaggtacacacacatagagaaatttcataaacctcacaaaagagtttatgagcatttaatcaaagttccggaattagttgcgaaggttttgtgaatgttttaagaaggcttttttaatagcataactggaatttgtttttaaacaatcatagtgttgaagaacgagacatactaattcatattcatcaattgtgatttgaatttgatgaaatagtgtttttggtaacaggagctgcacaaatgtatgagaatggtgtgttagcttatgtagacgttaagtttctagcggacgttcatattagagcattcgaggatgtttcagcttgcggtcgatacttctgcttcaaccaaatcgtcaacacagaagaagaagctctcaagctagtggagagtttgtctcctttgattcctatgccaccgaggtacagtttcttgtttaattctatcttgtgatttattgtttaatgcaacttatagtctaatactatatatgtcaattaggtatgagaatgagatgcacggaagtgaagtttacgaagaaagattaaggaacaacaaattaagcaagctggtagaagctggctctgcttgttaaagaaagatttcacaatttaaattgaaagagacgagattatacaaaaaaaagttgtaatttgtatattgatcttctcatagatgcatgtgttgcttgtgaactattaaaaagaaagaaaaaaaacacatttcatctcattttataactaatagtatatgagtagttttttttttttggctgggggcacaatatgaatgttttctaatttttgttaaacatattaaatcttggtgggagagttgtcgtatacgaaccttttaaagcgatgtttcctataattgtgcaataataatatgaatgcattacgtgaaagattgtgcttgtattggtatatgaacacatactattatactaaaaaatttgataaagagttttttttgttttgattttatatgtagaaattataatattttcaaattatggttgaaaacaaagatgattttcttagcaagccataagcttttcttatatgcaaatgataaagtacttcacataatatgtttccctagattacgagttaagatcatatcgttgaatatagaattttgtgacgatactaacttgttttactatgaaatcatgcacaattttgtgacagaattcatgattttgctacggaatcatcaacgtgttatgattttttttttaaatgatatgttcttacctgagaataatgtgaattggatttatactaaaaacaccaaattataagaacagtacttttgcgaacaaagatcttattcacaaaaccatatgatatacttaatgggccaataccaggcctgagattgcctaacgtcgttagtaaaacccgtttaaccagctaaagtataacgtcgtcgtttaaacaaggcatcttgacccttcttcttctctatcgagtgctctggattctgatttgatttgtgaggaaagctagatcgacgatcgaataagtctcgcgctgaaatctatctttgtgcaagcaaactctcgaagaaccttagattgaagatg

SEQ ID NO: 28966 - DNA, 3003 bp, Unknown; identical to SEQ ID NO: 28965
  misc_feature (1)..( 3003): 2750-1469P.txt file - cDNA_ID_2999465; gDNA_ID_2926198; Annot_ID_201598

SEQ ID NO: 28967 - DNA, 3000 bp, Unknown; identical to SEQ ID NO: 15657
  misc_feature (1)..( 3000): 2750-1469P.txt file - cDNA_ID_2999468; gDNA_ID_2926198; Annot_ID_141363

SEQ ID NO: 28968 - DNA, 3003 bp, Unknown
  misc_feature (1)..( 3003): 2750-1469P.txt file - cDNA_ID_2999472; gDNA_ID_2926198; Annot_ID_141364
taaacagatgtccaaagagtcggtttagtattagagcatctgcaacatcagttacctataataacagaaacagtagccgaaaaaatcaagatgtgttgatccaaagatgatcactttcaagaaaataaatatatgaaatagtgtacataccatgaactcatctagacatagtaagattgcatcatgagctatctcttgggcaacaacttcaagtggatctgataaacccttgtgcttctgcaaacattatgaaccgaaatcaaacaacgtatctcaaaaggctaaagcttttcctactaaaatcaatagagaaacaatggaaactcaattatccatacttgcaagcggctatgaacactcaacatgaaatcatggaaatgtatcctctgcttcttccaagtacaaggcctaatgaaacaagagaattgtcatgaaaccgcaatgctcgaaaaaaaaggataagaatttgatcatacaaacttacagttgatcaaagaataagtccatcaacatggtttttcctgtacctacacctccataaaggtataatcctttgacgggtgagtaagaagtctgtggcatgagccgagaccaaaaccaacgacttctgtattacacaaaaacacagttgtgtgagactcaagttctcaatcctaaacagagaaggaaaggtgtcaaggctaagagaacagaacaatcaccttgaggatttatcagaagtattataccgatctaaacgacatgtatctactgaatccacaagctcatcatatagtctctgaagctctctcaatgcactaatctacaacatttcaaacacaaccttaagccgcaagtaacacgaatcacatttaatcttatagctcaaaagcttcaatgaagtaaaaaagagtggctattatttttatcatacttggcagatatcaccagtcatgagttcaccattactgattcttctctcatactcaacaagaggacctgttctattcacatctgtcatcattcaacaaatatcagcaaaccaataaacacgaactctgagattgatagaatttctttgcaaagagaaacaaaacctgagacggtgaccctagtagtagcaggatcagctgcttctactgcttctgctgataagcctctaaagatacttgaccttgaatacaaacttgaattatcagtgtttgtattcagcagagcttgattttgattgacaccgatcaaaagtttgcggcttttggagtagaaagttgaagaataacgttcttgattgttccttagagcccatctaattctactgagagatgataacctaatgattggtctcatctacgatcaatgcaaattcaattcagcagctgaaactttgagatacggaaacagagcaagaacaataacccaagaagaaaaacagaatctttgtatgagagaaatcggatccggataagaattagagcacaagaggaaaaagtgaatgagaatattgaaaagttaagtttgatgtttatatgtaatgacgatgataaatctggataagagagatagagagagacccaagaataaacggagatgtagtcaaataaggaagatagagaagaagatctttaactgttaaactcttaaaacagagagatagaggcgtgattaatgagttatttatcaactaagacacgttttttatttttttatttttatatactttcaattttttaaccaaaattgattgtgttgtacttctaattacatttgttaatgttgattgcatagttgttttccaggtcattagaggattgtatttgtcccttatttaagagagttgactatttttattcctatgaaaaaagtaatttcttgatatatctttaccctaatgatgtctacaagtcaaattacaaattttataaacaatttttaacatttgtaattatagtatagaatattggaaacggaagcttctcgatgttgcgtttgcgtacaggatactggtggacctagcgaatgtgtcccatacataggctaagcatattccaagtgggagagagatacgtgaatcagacatggtccttaaagatgatccaacggtctataatttttctagttttgttctcaatgggtaagttgaacaatggaccttaatgatgacatgttgcattgcgtatgattccacgtgtccacgtcatttcttacactgcaaacatgtctttttctgaccaacccctaacgctacttttctttgatacatctttgtttttgctataatggtgcttgttgacaaaataatactatgttgaattgacctaaaaccatactcagattgggatatccgagaaccattgtgtaagacgtgatgtttgatccaaatatgggctacactcaaatattggatataggcccacaagatatgatatcttcatttttttttgtctatagaacaacataaaacagggaaaaaaatttacactacttttgttcttgttccgttataaatatcgttttaccgattgatcatagaaatggtatactttttagtttttggaacagcggtaaaaggttttatgttgatgtcttctccgagcgccggtgattttcacacagaccttgttattggaaaactgaaataatgcagttttctgttgataggccttaagatgtcagattttatgggccttttaggttgttctggcccatttagatagaactgtttcagttttccaacaacaactgataaggatagacgaaagcccaaattaagaatctttgtcctaaacccaaggaaaagcgtaattacgacacgcagccaaacaaaacatttcctgcgtgaaaaaagtatttgagaaaagaggacgacaaaaaggtacaggtgtcaatatataattggattaaacaagcttagacacctaaaagttttctctcacaccatttgtgaagatccaaagcaaaagaagaattacagaaactgaaaaaactatcttcctcgtctctttgatcattctcttttaactcatg

SEQ ID NO: 28969 - DNA, 3000 bp, Unknown
  misc_feature (1)..( 3000): 2750-1469P.txt file - cDNA_ID_2999480; gDNA_ID_2926198; Annot_ID_141366
attttgtcataagttttatcaaaccatgtgtgcgaataacatattatgaaagttaattagggcatttatgtaatatatatgtgaaacaaagtacacagatgcatgcatgatgtaaatggatcattgatataatgtgacataaaaaaacaaggtaattggttacaaagcatctcgatgcttacctcatcttgctcaacctaattcggcattttttgccactttcaactccgtacttctttatggtttgtgacattttaatgttgtcattcactaacattttcggtgaacacaagattcattttctttataaaaagccatacaaaatttccaataacacttgttttttgtagtcaagacctttttcttttccttattgactacgagtttgagtgcaccgttacgcacgatgcaaatgggcaatgcatgattgattatttattagtaagtacattttaacaaaaacttaaattcattttctagcatatttaccgaaaactttatcaaaaaacatacattcgaaacgtgggggtcatgaatgttcttgcagtaaagtaagatgtgattgaaagggaaaaagatagaaaagtaataaaataagataaaaagacaaagatgtaattattagacccttcaattaaattaatacgaaagtaggaggaggtgggccaaaataatgacaaagaaattagaaaggcgaaaaaggaaagaaatcaaaagtatagggacttatcataaataatgtaacaacacaacctcatcagggcaagtgtgtggattcacctatttcaggcatttgttacttgttgcaagtttctcttcgtatcactatctcatgttgtttcgttttgacatatttatacaataatttctttatatgcgaatcattaaatatcattatcattaaagttcaaatttaggtagggagatatcaaatatcaaatttcatcttatggtgaaatactgttttcattaagatggatttctttagagaagaagacaaaagaggaaagaggatgaagctattttagagtgcatcagtcctctagcctgtcactggtagtcctactacattacatcaatgttctccaatttgttttataaaatataaattatttttttacacataataaaattagaaaattattgaatgtaaacccaagtcgattttggtcaattcatcgtccatgtacaatatgcagatgtttctttttaaaaatctttatatataacttctatgtaaatttttttttaccccttctgtaccatttgctcttatcatagtttagcttaccgtttaaccaatccattttaatagaaataatagatctatcatgccggtaaaaattaccaaaaaatattgggtttagttgttaactaaggccctgtttgtttgatcagttagcatttgcattctaatgatccatttacatgattcatttgaatggtttatttgaatatgtttgtttgattatttgatattttttctaaatgatgcatttaaatgaatatttttttatttgattattttgtaattcatccacattttcatttagataaaaataactaaaatactcatgctttcactttgacaaatgaaagtattttacggttttggcgggaaaaatgattctacggttttggcgggaaaacaaaattttgcggttttagcgggaaaacaaaattttgcagttttagcgggaaaacataattttgcggttttggcgggaaaacatgattttacggttttgacggaaaaacatgattttgcggttttgacgggaaaaataattttacggttttggcgggaaaacatgattttacggttttggcgggaaaacatgattttgcggttttggcggaaaaaataattttacggttttcgcgggaaaacaaaattttgcggttttggcgggaaagtatgaatttaacgttttggcgagaaaaatgattttatggtttttgcggagaaaatgaatttacaattttgacgtaaaataatagtccgcgatttcatgattcttagaatgtttttttggtttaatatgtaattaaaatttttatattaaattagaaagttatagaaaattaacattattaaaagagggtatatttgtcatttgttgtttttgagtaaaccatctccattcaaatggtcctatcaagtctatccaaatgagtttcataattttgcttaatttttaaaaatcattgagatggatcatccaactgattcatccaaatggtctcttaaattgtcaaaagcaaacatcatttttcatctccatctaaataatccatctggatgaagaaacaaacaggccctaagtatcgtaattatataccgctttttttttttttgcgttttacatctattaaattttttgtactgttttaaaacttagtctaatttagttttaaaatttatatgtaatttagtctaatttagttttatatctattaatcggacttattaagactaaattagaaaaacatatatggttccaaatatacaaaaaaattggcattaagaagaacaaaaaagacaaagaaaaagagtgagagagagactggagtagaccagcatccaccatcccgggtccgacagtccgtatcagcatcccctgattcactctctacaaatgtcactctcttgcctctctctccctctcatttaaacgtttttcggcttaaaccttttctcagcaacaaactcatctcctctgagagagactgtttgtttgagaagaagacgaacgtaaagacttgtttactaaacccgagatttctttctttcttgttttcaaaataaaaaagcagagatctcttctccttcttcttctttttgctttgtttgcttttgctttctcttctttttctatgtgtgtttgtggtcactaccccgaaaaaaaataaagtaatgctgtctctcttctcttcaaaattattgttaacctctcgtaactaaaatcttccatggtagtagtaacaaagaagaccatg

SEQ ID NO: 28970 - DNA, 3000 bp, Unknown; identical to SEQ ID NO: 7066
  misc_feature (1)..( 3000): 2750-1469P.txt file - cDNA_ID_2999484; gDNA_ID_1621125; Annot_ID_172246

SEQ ID NO: 28971 - DNA, 3003 bp, Unknown
  misc_feature (1)..( 3003): 2750-1469P.txt file - cDNA_ID_2999484; gDNA_ID_2926198; Annot_ID_141367
ttttttttgttctttattcgtttcgtctgagagaagcctcctttgtgcctgtaaaccttttttctctctctttctagttctctctaacccttaccttcttttctctttcataattttgcatgtctgtctaattaaatacgactgtaataaaatttctaatttagtaaaacaaaattatttttagtgttaagcaattaaaaattcagcagttttacaatagttaaataaataagctagttatttaatttagtctagatttgactggaaatgacgttattaatgtatttagtggttttttcatcaataaattactaatttatatatagacgctaaaaatccagcgttatcgctaatgatttgggtgaaaatttgaaagatttggtagtataccactctgtcggtgttccgacagtataattctaacatcagtagaccattgcaatcaagttctcaagtgtttttatctttatattatatgttggtttaaagccggtttgcatccacagtgcagcatgtataccggaccaatattgttatgttaattaacttccagtcactcattgctaaacttcttttgatatgcatacaaacacgttttaacttatgaaatcttgacttccgttttttattcgatttctactaaatcgagacatgatggacaattatttaaatgaagtgatatagacaattaaataattgtatcaatacaagcttgaaaatggtctgaccaaaaacatgtgctccctagtcgaggctcggttttatcgagacaaacaccactaaaccctatactcattttcatattcatattcataaatcataatacgtactatataaaaacacactgattaaaccgaaccgaaactgaaaataattggtaggtgttgattatgctgcagaagagaaagatcgaaaggcctaagagtgacacgtgtacggagatggtatgaagaagctaaaagaatagagatagagaggttgaaagcacgtaggcaatgacttgtgaggtgaaatgacagagcaaaggcaaaacaaaaacaaaagagttacgaatgagacagaatgtctcaggaaacgtcagcttcttctgttttttggctcttcatttcgtaaaaccaattttcttttggaactgtcacggaaagcccacatggtgtgggatgatatgaacctgtccattaatttgaaacttggaaggagaaacaaatcagaagcgtgaaattaggtcacttggttatcaatgattctgttttttgggaaatcttggtgtttgttctcaaattcagatatccattgaaaatagatgatcttcgcctagtaagtattgaaaattatatgattttctaaggaggttagctggttagtgatgggaagcaacttgttagtccttttagctatggactgagacccatattattgggccataatcgaagcccataggaccataatcgaagcccacaagtccacaatattgcttcaattggtgaaagatactgtggattgtagagtgtgtagtagacgtaatcaattttctacaatagtagatgtgtacgtaactggacgagtttctggactatattcgaatttcatctttgtagtttgtttatatacttggaccaaaaaagattataactaattaaaaaacagcggaattgacaaatgagaacaccctccttgaaacggcgaagaaatagtcaaatgtgcgatacttattttttgtaaaccttaaagattttgttttttctttttgataatgaccagttcccacaaaaacaggtaagttaaatcaaccatgtgcatactgcaagaagataacatctctatatagttgcgcaagaatataaaaaccggcgttatttacgagttacagttttctaacagatttggtgaataacaaggtttattaattgtagatatctatatatatatatatatatatatatatattgaagtatgtatgtgttatatattgcataaatacattcaagatagttatttatttaattaaaaacggtaaaatatagattttatcaaatgacatatttttagtttaaatatggtacaattaattttaagatttactggcacatcaaatgatcaaaatgtggttgataattgtgttgattattgttattgataaaaccattttcttttcaattaaacaggtgtggtttggacgaatcctaatcatcttagaagaataagacgattttttttttgccccagacgattaaaacatatcttatgattggcagccacacatatgcactttttagtgagatatgatattacgaaatgctagtttacgtatagtttctaaaatacaaatttcacgcactaaactacggacacctagttaagaaataattattgatatgatgtatgatagtatttaaactatataataaaatacaaaaatcaaaactattattttttaaaaaaaaagaatcacatagtgtaaatactcatgtatttttctttagtcatcacaaaatttacttctctagatttttaaaaaagttttgagctattaaaagcatttatatcgtgtagagacataaaagtatatcaataataaaaaaataatatatatttctaatttaattatgaaatacttactacttaatttcttttgacaagtgattccattatttgtttattgtttgtctacaaatgatatccatgttcaaactgtgtcaatcattcagaatagagtcaacaacggttgccgtccacggtccactccggcctctaaacttttttttttttttaagagcctctaaacttttttttctgaagtaaacaacaaaattaaaactataatatatacaaaactgttacataaaacgtggaaaattaaaaaaccagtaggtaggtcgaccaaatcaaatctcatataaatacatacatacatacgtctttattctccactgctctatttctcaatctctctcctaaatcaatcaatctttgtattttcatttagccagaacaaaaaaaatg

SEQ ID NO: 28972 - DNA, 3003 bp, Unknown; identical to SEQ ID NO: 28971
  misc_feature (1)..( 3003): 2750-1469P.txt file - cDNA_ID_2999484; gDNA_ID_2926198; Annot_ID_201605

SEQ ID NO: 28973 - DNA, 3000 bp, Unknown; identical to SEQ ID NO: 7064
  misc_feature (1)..( 3000): 2750-1469P.txt file - cDNA_ID_2999487; gDNA_ID_1621125; Annot_ID_172244

SEQ ID NO: 28974 - DNA, 1118 bp, Unknown; identical to SEQ ID NO: 141
  misc_feature (1)..( 1118): 2750-1469P.txt file - cDNA_ID_2999487; gDNA_ID_3219; Annot_ID_146163
  misc_feature (336)..(336): n is a, c, g, or t

SEQ ID NO: 28975 - DNA, 3003 bp, Unknown
  misc_feature (1)..( 3003): 2750-1469P.txt file - cDNA_ID_2999487; gDNA_ID_2926198; Annot_ID_141369
caatgcatgaccgaatattttttgtataataggtgacaattaagctattgatcattcacataaatattgtacataacactcttttagttataaatttatcatgctaatgcaacactcaatacctagactatataattaactaacagagagagatgggagaaatctgtttcatctacatttttaccgcctttccatttcccaatctattaatgtagtgataaaatgcatctttccatttttttttttttttgacgtccatcaatgatcaaatccctttacgattgcgattcacaaagaatcaatgccaaaatacacgtcgcaaattcgtaatgatatagtataatgcccaaaaaacacgtgagtaaataagattaaaccaactgtaatgtctaatcacatatcttgtaatttaaaccggtataataatactaaaccgggaaaacctaattgttgtcttgcattttccctctatggctcaaggtataattaaaatggatatcagttagatgcatactgcatacgtttttaacatttcgaatccataaattcagttgttgcgataatccaaaactaatttgctcagtacacggaccaaaccaaaaaccggttcttttagaccaaaccgaaattgtctactcctagtcctcctgcatatatgccccaacacatctctcaatcctctcatcgtcaataatatctttatatgacaatggtgaagcagataagaagatacgctctatttcaagccacgccagattctgagttcgtgaaggagatgtacggaggctacttcaacgtattcgtgtcggctttcggagacgaaggagagcaatgggatcttttccgtgtgatcgacggcgagtttcctcgcgacgaagatcttgagaagtatgagggattcgtcattagtgggagtttacatgacgctttcacagaagaggattggatcattgagctttgctctgtttgcaaaaaacttgatgtgatgaagaagaaaattcttggcatatgctttggtcaccaggtttgatattattatcatccaacgttttcttcttcttctatcatttaaaatatatcatacttgtataattttttaattacttaccactaggtaaaatctttacataaaagtgcatgttttttctttcgtaatttctctttttaaaattcgatgtacataactgttttgcctaacttcataagctatgttgtagactagcgttagactagatgaatctagttctattcaaagtaataaattttaaattataaaagcatactgcataattgaattagaatcatcatgccatattcataacatatcgcatgctatatcattttcaagttttttttttcaagttataatgcagtattgcatgctatatcattttcaaattaaattttgcgtggaatatatatatatatatatatatattgaggataataatcatcaaacatcatgttttataacttgaaaatgagatagcatgcaatatgtaatgaatatggaaaagatttaggctgtgtaatgaacatgtaaattttaattttctagtcagatattattattatagacagaaagtaattaaagaagaaaaacataattttttgttgttgttgtaaaatgatatatttgggtaaaagatattagattaagtacactgttatatactttataaattctttatatgagtacgaataaatgtacttatcaaagaaataactaatgtatgtgtgtatggattagtttcatctacacatggtggttaataatcctgaaaacaatatatatacctagcttacgtttttttttcttgttttggatttagatcatatgtagagtaagaggtgggaaagtgggaagggctcgtaaaggaccagacataggcctcggtaacataacgatcgttcaagatgtgatcaaaccgggtgattacttcgatcaaatcgagtcattgtcgatcatacaatgtcatcgagacgaagtacttgagcctccagagtcggctagagtcataggattctcagacaaatgcgacgttgagatattctcagtggaagatcacttgctttgctttcaaggtcatcccgagtataacaaagagattctccttgagatcattgatcgtgtccacaagatcaaatttgttgaggttcgttttaaacgtctatctttggttttattaatcctattatgtatagattggtcggtcttctaatgtcccaacccttgggagattattccgctacgtacccaatttaaattccgttgttcaggatatatatatatatatgtagccagggtgaggaatctctaaaacgattttttaaactaaaaaatatgtaggaggaaattttggagaaagcaaaggattcgatcaagaagtttgaaccagacacgcagcgtttgcacatgctttgcaagaattttctgaaaggacgaagaacccactaattggtttagtttccacgttcatggtctaaataaattctactacgtttgtgtaatttcataactattatatggtcatggtcatcacataatgtaacatatcttcgcttttaactaaattaccgactgctataagaaataataataataaattaccgataaacaaaaagaagaagactggtatttgtaattttaatttagtcatttataagtgggtataggttacgtgtataaatagattatttgatcttcaaaaaatacacgtaaaatcgagctacggtaaacaaataaatgtgattctaaacttagataaattattaggtggagttgtcatcttatagacagctaatctcgatgtgtgattctttttttttcaactaatttttgactattttttttctgttttctttatttaacaaaaatctcacttggcgtgtctgatcttgttccccgtcgtcgtctctaacttacacatttccattctccgaatctctatctctccttttgcttcatcggtgtgatctctgagacgaaagaagaagaagatg

SEQ ID NO: 28976 - DNA, 3003 bp, Unknown; identical to SEQ ID NO: 28975
  misc_feature (1)..( 3003): 2750-1469P.txt file - cDNA_ID_2999487; gDNA_ID_2926198; Annot_ID_201607

SEQ ID NO: 28977 - DNA, 3000 bp, Unknown
  misc_feature (1)..( 3000): 2750-1469P.txt file - cDNA_ID_2999491; gDNA_ID_2926198; Annot_ID_141375
ctcggcggcgtaagatagagagcgttctgtacaatgcctgatccgaatctctgtgagacctccttcactccgatcaacaacagatcggagaaatgaatcgactttatcctcaaactcgggagtccaccagttgatcgactcagggaacgacagaaaccgagtttcgaggtcgaagatggtgtttagtgtcgggtcatagcatgcgttcatccagttcttgctgaccagcatcggtccaatccatctttgttcctggcttagccgtgagaagatgtcaagaagacattctcgagtcaactcagaccagtcagggtagagtcccgatcccatctccacctttccttccccgccgttgacttccataggattgaagaacgcttcgtcgttttgagtacgaatagacttgaaatgttgagacttttttttatcgtcaatggaataaatgtagtcaatggaaacaaaaatgctgagactttttcagcttctataatcaagcatgctctttacctattacaaaacagagcttttttttattggtcattagtaacctttccaattttgatatccagtttatattaatgttctgtcagtttgaagttggagcaaaacggttctgctcctcgactttgattaagagaatgagtaagaacatccaacaacaaatgagattccctaattaccaaattggattaaaaggataatgtagtcacttatgacaagagttattattcaaaggttttcctatgttggacatatggaagtaatgactttctaagtcatcaaatcaaatcttatatctatatacttgtataagcatatgtgcatattgggacgacaaatcattatctcaaatcctatttcatactaaacaccctaaacacttaaagccactggatcttgccatgtaaccttcctcttcactgctctatttaactctttctccacatctccgcaaatgggtaactttctttcaacatgtagatcactgatcctgttatcaagcattgcattcttcattgcttccgcgaccatatgttcaccattcacttccggctcctcttcttctctctacaaccaaaacacaaatcaaactaataaagttctatagactctaccaaaaggaagacactaaaataacacaagttgtttggctttaccgagatctggtttaggtcaaagccagggactttgtcagtgccagaagtgtttccctctccgttaaggtcaggaagtgaaacggggaatgtcaaaacatcgcttcctctgctcctttttcgcttcttatccaagtcacaacttgcaacattattagccaatgcttccttctcattgcaaattgtattcttcagtttcaaatcaaaacatggtacagatgctctcacaccagactgcttctttctttcgccacttggtttccttgggacctctaaacccccggattctgacaatctcaacatctctggagaggtttcaagagtttgatcttgcttcaagtgctcgtatctacgtctcaagaacctatcgtttgatcatcaaaaactcaataagctaatgaatgtacaaaagcttggatcatgtaagttaatacacgctaaacacgtaaattgacaagaagatcagagatcatacctaacttctgacttgagggtcaatctcttttgtttaatcatctccaatctctttctctttatctctaattcctgagaaaacgagataaggaaacaaatttcaaaactttacttcttccctatgacttcacttagaatcaagcgaacaattccaaacccaaagtcatgacaaaacatcatgatcacccaaaccagcagatccagaggaaatcgaaacaaataagaaacccagaaatttcaaacttaaaaccctaacgaaaaagcaattaccttttccaactccagaacctgcacaaaggttaatctgatcatgggatcgccaccggaagcagaggaaacgaaattagtcttcttcatcggatccgttcagtgaatttaggaatcgcagattggaaagacagcaagcaagcgagaaagagggaggtgtgaaggagaaagaaggaagcgaaggtaaaggggatgattaggttttaatggtgagagtcttattccatgtatgaaaccctctgaccaaaagacttaagaaaccacataattgattgattttcctttgggtgcccattacaaacaaaattgatattgaaaaaattaaaaattttggattttccttttctcttctttttgtgtgtgagaagtctatgagacaagtagcagaaaactaggactagtgatcaaagatggtaaagagaggaaagaaagaaagaaaaagttttgattttttctcatttctttctttctttttcacttattatttctatgtgtgtccttttggaagttgcagaaggggtattgaaatgctgaccacttaacccaaaaaaaaggttcttccttttattgtgtttgttgatgattgggttcatgtctttgtgaggtgggtttgataaattgtaaagaatttgaattaaaaagcacatctgggttattgaagagatgaaagagttaatattgttggatatgtatgtaaagaaattggggtatagagagaaagagagcaaaaaaaaataagagtttggttgagacaaacagtgaaacaggagaagaagcaactatggagatttgacaagagagatgattggtgactggtgtgtataatgtgtgtatatatgatgtacttttatttattcttttagtcaaatacatgtttttgcataattctcaatttctcatattattattggacccaaatcctgtgaaaataatctcttctttgggctttttctcatataagcatcaattttaaaagcccattaaacccaattaagggatcctcaagcttttccacgtggcacaatcttattagtctttaagaaacatatctcgttctttctgtttatcttgtcgaagcacacttctctgtttcaggagaacaatg

SEQ ID NO: 28978 - DNA, 229 bp, Unknown; identical to SEQ ID NO: 8297
  misc_feature (1)..( 229): 2750-1469P.txt file - cDNA_ID_2999495; gDNA_ID_1971712; Annot_ID_175114

SEQ ID NO: 28979 - DNA, 3003 bp, Unknown
  misc_feature (1)..( 3003): 2750-1469P.txt file - cDNA_ID_2999495; gDNA_ID_2926199; Annot_ID_141420
ctgaaccatgtccatgaagaccgtatgcgttaatcattgagctccatgacacaagatctttctcagtaagttcataaaatacttcacgcgctgcagaaagactgccacactttgcatacatatctatgagggcgtttcccaataagatatgtgacatgaagccacatttcaggatttgagaatggactgtagatgcaaaactcaacaatgtcgaattggtacaagctgagacaattgccaatagagtaaccgagttggcttcaattccttcttttctcatttgatttaacagattcataacttcagagcaatctccagtctccgcatagccgctaatcattgaactccacattacaacatctctcacttttgatgtttcgaaaagaaccctagagagacttacattaccacatctgcagtacatggtcataaaagcagctgttaaccgctcgtcagcatggcatccatgacgaaaagaaaatccatgaatctccttcaccagacttgagccataattcaattctacacatgcaggtaaaacagacaacagtgtgacacgattgggcctcaagttttctctctgcattgctcgaaacaaatcaacgcccatttcataattctgatttgcaacacaaccggagatcatggcagtccatgagacctcattcttcacctccatctgatcaaacacatggaaagccgccgcatgatcatcaaactttaagtacatatcaaccaaagccgttgataatagaactgattcctgcatcctctcatcaacaagaacaagagcatgaaacattcttgctaccttactgctgcttcccatgcgagtgcagagagccaatagagatgcaaccagctcggacttgggaataaaaccataaaaatacatctccttaatcaacttcatcgcttcatacaacaacccatcctggcaacaactattgatgatggaacaatagctaactgtatctctgtgaagcatttcatcgaataccttacgtacagcatattttctcgagaatttcgcatacatagagatgagagaattggaaacaactgtatcacaatctgcacctgctttgagacaaaggcaatgaagctgtgcgccaagtaagaaaggctcttgttgaaaagcgcaagctttgatgacagaaggaagaatagctgtgaagccattggtccctaaagaatgaatctttagcttgtacagtctcaatgcttcatcgtagaattggtccgacaccaaacccttcagcttattgccgagctccaagtttaagcgggaagacaacgcccttgacattataacacgacggcctagtttaacccatctcatcggacgggtaataatgacgtgcccactatgactgtattatctttgagaaatagtttgtgtttgattcagtaaacaaaaagcacccatggcctaatggataaggcgcttgacttctaatcaagcgattgtgggttcgagtcccactgggtgtgtatttaataaatacaatttaatctttttcaaccttattatattcaattttttgtttgttaatattcaatttaaagcccaataaagttggaagatggtgggctagtaatgggtcgaggtttttgaatacagaagcacgtggagatcacgtgcgttgacgtcaaggtgtggctgtaccggtggatctcgaattcctcccctttggcttctcgaaggagaagaaaagtgtcggagagaaagaagaagccaatcatcatcgccagttgttcttctcttcgagatattcaaatcctccgtctctagagaatttcatatcaagagaatcaggcaagtgggcgattctctgatcccgagtcaaaccatttctggcttctcaagtctcctcaggttctgatgaatagattgtttgattttgcagtggtttctgtagtttgtggtggtggtggttggaaggtaagataggatatggcgcaggagcaggaaggagcggtcgttgagaaaggtgagccgaatgattcctccgccgctgccgtggccgcaaccgcaaccgcaaccgccgatagcgtgaagaagaagcaaaatggattcttttcgcgtttgtggaatgggatatttagggttagaggtgacgatttcgagaagagacttcaatacatctcaagggaagaagctactgttttatcaaggatgaagcgtagatcgatttcatggaggaaactcaccagaaatctcatcgtttcctctgtattattcgaggtcagcaacacaattgattgtgaaatttgaatgtttgagcttagtagattgcgatgatgtggtaaatttgttacctttttagataattgctgtgggttatgcgatcctgacaaccagaacggaagatttggattggagaatgaggagtttccggatcttgccaatgtttatcttacctgctgtttctgctcttgcttattcctcaatcgtcagcttctcaaagatgtgtgagtcttgtgtttatatgctcatttcatgttaagatgttggtgtgttctcgtagcttctctgtttctaattctgtgtaaaaatggttgtatagttgaccgcagagatcaaaagaccttggaaaagcttcgagctgaaaggttggcgaaaatcaatgaacttaaagaaaggaccaattattataccacacaacaacttattcaggtgagattactagtcttgagaacacagagaatttgtggtaattccgtttatgacaagtactgattcttccaacggttatcatttatagttactggatagtgagtgactatgttttcgaagattgttgtccatattttgggataatagcaattatgaatagaaagttggaatcttagtctgacatggcagttggaattcattgtatttaatgccaacagagacatgcatctatgcctgtatatagcaatagaaatacataaagtggttttcttaagtatgtctcgtaggcgtggcatagccatgcaacgaaagagagatcaatg

SEQ ID NO: 28980 - DNA, 3003 bp, Unknown
  misc_feature (1)..( 3003): 2750-1469P.txt file - cDNA_ID_2999499; gDNA_ID_2926199; Annot_ID_141421
ggtgagccgaatgattcctccgccgctgccgtggccgcaaccgcaaccgcaaccgccgatagcgtgaagaagaagcaaaatggattcttttcgcgtttgtggaatgggatatttagggttagaggtgacgatttcgagaagagacttcaatacatctcaagggaagaagctactgttttatcaaggatgaagcgtagatcgatttcatggaggaaactcaccagaaatctcatcgtttcctctgtattattcgaggtcagcaacacaattgattgtgaaatttgaatgtttgagcttagtagattgcgatgatgtggtaaatttgttacctttttagataattgctgtgggttatgcgatcctgacaaccagaacggaagatttggattggagaatgaggagtttccggatcttgccaatgtttatcttacctgctgtttctgctcttgcttattcctcaatcgtcagcttctcaaagatgtgtgagtcttgtgtttatatgctcatttcatgttaagatgttggtgtgttctcgtagcttctctgtttctaattctgtgtaaaaatggttgtatagttgaccgcagagatcaaaagaccttggaaaagcttcgagctgaaaggttggcgaaaatcaatgaacttaaagaaaggaccaattattataccacacaacaacttattcaggtgagattactagtcttgagaacacagagaatttgtggtaattccgtttatgacaagtactgattcttccaacggttatcatttatagttactggatagtgagtgactatgttttcgaagattgttgtccatattttgggataatagcaattatgaatagaaagttggaatcttagtctgacatggcagttggaattcattgtatttaatgccaacagagacatgcatctatgcctgtatatagcaatagaaatacataaagtggttttcttaagtatgtctcgtaggcgtggcatagccatgcaacgaaagagagatcaatgtttgccgacttgaagaggttaactactgcatgtagagctggtgctaacagaattgttttgatgcagagatatgacccggacccagctgcaaaggcagctgccgcaactgtcctggcatccaaattgggtgccgattcaggcttgaaagtatatttaggagatgaatcccaactcgatccatcctcgggcaagagcaatgacatggaggttaaccaatcacgtgggttgaggaatcgaaggcaaccaaatacaagaccccacggttctgggagcacttcaacacatcattctgatgatgagtctcaccattctggaacaagcgagagatttccaggcaccacagagcaaaaccagcagatgttggttgagcattacagccctcagggatatgctgctcatgatggcagttggatctcacgcattgcggctctacttgtgggcgaagatcccacacaatcatatgcgctcatttgtggaaactgtcgtatgcacaatggtgaatgaatgtttaagcaaatcctttacctgaatctttcaactatatacttatttctaacataattttgcaatatgctttgtaaatgcaggacttgctcggaaagaggattttgcttacattacatactattgccctcactgtaatgctctgaacaaaccgaagcattcagaggagaatgtacttcttcctgctatttccgcttcaccaatcacagactctctgccactgattgagaccagcgaagtggttaatagcagcagctcgagtagtgaacgtggaagtagccccactccagaaataaaagaggaagctgcaattactgagaccgggacaccgagctgaggaagatccagtgagctaagaagaaggcttagtcgtgttggtgctacagagaagagattttgtgtgtgcatgtgtgtttgtggatgcgagtactcattcaggtaatcttatgctatggattgctaatatatgaaggtgcttacagttttgattctggtttgtttctatacaacaagacaatagggttttggtgggtaaatatgcgattctactgtcgtaaacgacgattgttatacgttttgggggtttgaattctaattatcttttaccattacagattgtctctgtttctgttaaatgtattcactcttggatgatggatcattcccttttcgattttagcactacgagcctacacctttcttattaatcttcttcaatattcaatttattggatagcgtttttttatacctaactctgctttttcattgtttttttttttgttgtattttactagttcatgatatgaatatgacttttgcgatagtagatttttaaaattatctttagtaaattaattaccaaaattgtttgcaaaacacgtgatgatctacactttaaagactttgaaatatattttaaactggtaaaaaagatgctttccgccataaagttgatctcatcaagaaacacaaagagaggtagcaattaaaatattcaaagatgaagagcattattagcacgagcaactcttttcctctgtctccacttacaaaggaacaaaacttgatctgctttatagtaaagaacaaaactcaggaagttcaaatttgcttgggcagagaaccatgagctacaaaaatacaaataactctcacttgattctcttcaagctgttacttcttctgatcctttattctgcagatctcacagcttcaagctcatgtcgaagtgaatgtggaggatgcaaatgtggaggaattgcgatcccatacccttttggaatcggtaagggctgctatctcgagaagtcatacgaaatcgaatgtcttaatacttcaggaaagcttgtcccctttctttctgtaattagcaaagaagttgttagtatccatcttcctggtaggcaatcctttgggtcagttcgtgtcagaagtccgataacatccgcaggatgttctagtgatggaaaagactccgcaccagtaatg

SEQ ID NO: 28981 - DNA, 3003 bp, Unknown
  misc_feature (1)..( 3003): 2750-1469P.txt file - cDNA_ID_2999503; gDNA_ID_2926199; Annot_ID_141422
cataaacaaccttgtgggagttggttgcagcagcaaggtgtcgttggagcatataaagcaaaacatggtgggatgtgagttgaactgcagtacgactaacgcgtcggatagcaacagcatccctttcttcgacaaaacggggtgctctttttcttatactttcgcccaggtttgtacaggaaacaaaccggaagatatgggatgcgatggtaggggatgttgtcaagcgagtctacctagagagcctcaacaagttattggtatcagaatagagagcaatgatggaaagtcaacaacaagtggagactgtagagtcgccttcttaactgatgaattcttcagtttgtcgaagctgaccaaaccagaacagttacatgctaagagatatgctacattaagtctaggatggataatgcagacgaggaatacttccttcgtcaactccttggcctgcaaaatcagaaaagacacggacactgcttactctaatgaccagagtataaagtgtatatgcgactacaccatgagcatcatttctgatattaggtatgccaattgtgaatgcaacctaggttacaaaggtaacccatatgattcggacggatgtagaggtcagtattatgttctttccttatgccctcctctttttttgtgtgtggaagcaagcatcctttctagagaagtttctttcatcgtttgactatcgtattttcatctttcaattatagatattgatgaatgtaaagagaatcccaaatattgtaaagaaacagacacttgtgtgaatttcgagggaggctatcgctgtgtgggcgataagactaaagcaataatgataggtaggtcactgatttttgttccacaaatttagagcttttaaaaagcaagtgatgatcaacctataatattcttgtgcggtttggcaggggcgggtactggttttggggtcttagtcctagttggtggagtatggtggttgagaaagtttctagtgaagagaaggatggcaaagaggaagaagaagttcttcaaacgtaatggaggactactgttgcaacaagaattgaatacaagacaaggcgttgtcgaaaaagcaagaatcttcacctcgaaagagctagagaaagccactgaaaacttcagcgaaaacagagttcttggacatggtggtcaaggtactgtgtacaaaggtatgcttgtagatggtagaaccgttgcagtcaagaaatcaaaagttatagatgaagacaaacttcaagagttcatcaatgaggtcgtgattctctcccagataaaccatagacatgtagtcaaactcttgggatgttgtcttgagacagaagttcctattctggtttacgagtttatcatcaacggaaacctctttaagcatatccacgaagaagaagctgatgattacactatgatatggggaatgcgtctacgcattgctgtggatattgcaggagctctttcttatcttcattctgctgcatcttctccaatttatcatagagacatcaagtcaacaaatatattactagacgaaaagtaccgagccaaggtggctgattttggaacatcaaggtcagtaaccatagatcaaactcattggacaacggttatttcaggtacggttgggtatgtggatccagagtattaccggtccagccaatatactgaaaagagtgatgtttatagctttggagtcattctagcggaacttatcactggagataagcctgtcataatggtacaaaacactcaagaaataatagccttggcagagcatttcagagttgccatgaaagagagaagactttctgacatcatggatgctagaataagagatgatagcaaaccggaacaagtgatggcagtagcaaatctggcaatgaagtgtttgagttctagaggaaggaatcgtccgaatatgagagaagtttttacagagttggaaaggatttgtacgtctccggaagattcacaggtgcagaaccggattgacgaagaagaagaagaagatggagtagaagaagaagaagaagttgtgacaatagtacacagaggagattcttggagcattggtgttactgctccagcctcaagtattgtggcttcacctccatcttcagatgttgaaccattgaatcctcttctcacatggtgacactcaatcagatcttaaagtaatgatgatgaatgaatttgatgtatctcgttagaaatgttttctgtaataaatttgagtagttgttagtctgtgtttcccgcttaagaacgtttgttgtgtgtttattattcctaacgttcacctttgtgcctcaccgatcacagactctctgccattgattgaaaccagcatagtggttaatagcagctgtcgagtagtgaacgtggaaatagccccactctagaaataaacagaggaagctgcgactgctgcgaccggtactcgttcagataatctgtttttgctaacgtagtcactcttgaatttggatcattttcgattttaattctaggagcctaaagtttcctcgtgtttttctcgtgttagtttattttattcagaaatgaataaagttagttatggacggtgtttttatacccaactctgcttttcaagtttttattttttatttttttgtattatacgatttcatgatgatatgaatatgacttttgcaagaaactgcatttttgccagagtagtttttttatctttcttctgtaatcaattaccaacaatgtctttccaaaaagaattgatgatctccactttacagactttcaacaatatttaaaccagtaaaagagaagctttccgccatataattgatctgatcaagaaacacaaagagaggtatcaataaaatatccaaagatgaagaccattagcacaaggaatcttatcctctgtctccacttacaaaggccatctgctttatagttaatacaattaactcaggaagatcaactttgctctagtagagaaacatg

SEQ ID NO: 28982 - DNA, 3000 bp, Unknown; identical to SEQ ID NO: 8301
  misc_feature (1)..( 3000): 2750-1469P.txt file - cDNA_ID_2999507; gDNA_ID_2926199; Annot_ID_141423

SEQ ID NO: 28983 - DNA, 3000 bp, Unknown
  misc_feature (1)..( 3000): 2750-1469P.txt file - cDNA_ID_2999515; gDNA_ID_2926199; Annot_ID_141426
ctgaagacaaaagcagcagcaaagaataaagctgaattttttctggcttgatcctgggaacagtcgagaagttcgatagctaatttaacaacttgatgtatgacaaccaatggaagtgcacagacacgctccattataccctgagaaaaaaaaaattgaaggtaagaagaagcaggatttgtactaagtcaacgattgacggtgaaccaaaattgtgttaaagtcatgcaaatttgctgtattattacctgaagagagccaatggtgtataagcaagatgagagaccataaaaagtctcagagacccttggaacagcaagtaattttagtatgccacgccgttcaacaaacattgctgcaaacttccggtgcgcagccaaagcgcaaattaacttcatgacatcaggtaacaaaggagacactgtcgaacgatcatctaactgggatgtacgttccagcagcacaatgcatacatcaacacctttttcatggagtacaggcccgagaacctcaacatattctcccagtatctcaaggcactggatgcaatatttttcttgtaactgagccaatgattcgatatctggaagggaaacttcactaacatccgttgtctgatcagatgtgacacaagtaggatttctgccaccaaccaaatagcagagttaaagccctaaacaactcagagataaataattgataaacagcaacgataatatccacgacatcatagcatgaccaaccttgaaacctctgcggcatctatgactgtaatagctgctcgagtagcagcagacacagcagcttcttcactgccagaagacttgaattcctggataatttaaaagaaaagacaatcaatataaatatcaggtcaccctaatccaccgtttcattagggaaatgaaatcactaacagctaagcaaaaaaagaaaaacatacctccaaagcagcagttttaacaagctctgcagcagcatcgccagctgctttagctgcgtcatcaggagcatgggcagctctagcttcggtttcagcagctccaacggctctctttactagatcagttatgtttttagttcctattatgcaaccttgaaagcactcatcgttatcctctctttctatctccataataccagacttcattttcccaagacatacggtcacgtcttctgcatttctgccatctgaaatttttgatagatccctatctctgacaagtagacgacctaatctaggagatgccaagagaacttctgtatcaggtgcaccttcgtgaacccttcctctcccccttgattttgatcggttcagtctgtgtcttgaagggtcatctctaacactattgtcatctccaggtttaattttacaatcaacaacacctgaaacattaaatacatctctgccatcgatttcgaattcgccatcaggctgtacatcagtttgtcccatctctcttccggagtccgtctcaagaacatggtcaccttcaactgtatccacaatcttacgcaccctacttcgaccttcttctttggtttttaaggagacgtgcttagtctcagttgtgtgtatacggcttgtgcttggctctttaagaactcgtactcgaagataatgcataagcttagcagatagtcctgatgtcaaaacgtcttcaactatttgcccacgacttacatgagtcacacaaaaagaaaatgttacaatttcagctgtgggcgttgcaaaaatgggaagaagagacaacaagttgagaatgtttaatcaatacctcgccagagagagagcaagaagtcctgtagaataagtttttaacatttcaaaatctgaggcttccttcttggcagagtcttcaccaggaaacttgactgcctcttccataacccaatttttaaagttttccgttacagcatcgtcgaaaacatgaggatactgaaaaaaaagaaaaattgcgtcatgagtcaacaaacaagacatccaattaagggtaaagagaaagaaagtagtaaaaaatttaccatccacgtaagcgaacagttcattagcaaccttgcagaggctgcctttactgcggttgagtaagaattctcagatagaaaagtcgacgatatcaattcaaaaaactcatcgttttcctgccaaaaatcaagtaacaaaataagaagaaagaacccacacaagagaaaaaagaacaatctttttttaaataaacttactcggatgagaatacacagcttgccactgttatgactaccacgagcattggagaaatgcccattctcctctaagaacctgcgaatacaagtaagcgtcaaaactaaagacaactacaaaagaaaatcaagaagagagactgattgttgagctagaaaggaacatacagagactcctgagattcgagaagctgactaagagcgtgaaggatattaggattagggttattggcaacggaagtaatatcttccataagcttctgcgccttcgctataagctcgtcttcaacactctgttcttctccttcttcaggattaggttcgccggttgaattcgccaactctgcaatcgcctccgccgcaacaactgattggtcatcctcaaccatcgaattagggacctcggcatgctcttgcccgtccatgatgaatacctctcttttaaaagaaaaacccagaaacggcgatcaattcaaacgttgggatcacggaaaaagaaaaagaaattattgaaagggaaaacgaaaaaagagcttatagttgtagagtaagaaacgcagcagaacaaggagggtggtagatggagacgacaaagctgaaccgactcatactaaaatatgacccgacccgtttctttcactaaacaaaccctaacccatagttttttttaataatgggccttttaaaggcccatagttttactgtcaataactacgacgtcgttttcaattgttccgattaggaacttcctctccggcgactgaactttttctggaaatg

SEQ ID NO: 28984 - DNA, 3003 bp, Unknown
  misc_feature (1)..( 3003): 2750-1469P.txt file - cDNA_ID_2999519; gDNA_ID_2926199; Annot_ID_141427
tggtaacctgaatctagcacagaatgtttcgtatgcgttcaatagctattaccaggtaagtaatcagctcgacagtgcgtgtaagttcccgggtctctctatagtcagtactagggatccttctgttgggagttgcaaattcaagataatgatcaagtcagaagatgctagtgaagcaagtgccatgatgcctataacacgatcaacggcagtgctgctacttctctccatctgtctgtatattgttctgtgaatactgaagaaaatttgatgggtttgattatttctttttttccttttttcttttgcaaaacttttggtgtttatggagaaacagaaactacagtgagatttatgtattacttggtttgatctcttatttctcgagagcagtttggtgttcactgtctctcttatacctctcttgttagtaatcagaaaatgataaaaatctcatctttcactttagctgttaaagcccaacccgaagtttcaaacattacaccttatattagttaagcaggtttgctgcaaaagaggaatccatgaggcttcactgctgtgaatctgtccaccattaacagtctcttaagattgagaaacgattgtgctgtcttagagcatgagaaacgagttacagctgaaccaaaagaaataccaaacccaaagctatagaattgtttgtcgagaaccccaaaatctcccaatatacagtgcccaaacaaccaaattaccagttgcctagcctttctatttacacttgtttaaggtatgtatggaaaggaaattccaatgtatcggatataacatgattaccttggttagcttgcaatcttcaagtcagtgagataaatgaaggagataattggggcggatcttcagtgcctgaatctgtccatttaacaatctttggtaaagactttggagagtttctatgtaatgtggaatagtgttcttggttgcttgagggattaaggttcagtctggtagacaaaaaaggaagcaaagagacatgtgagccagtacgaaaaaatatgacaatggttagaaatggcggagaaaacatcagaagttacctgatccggtggtcgcactgccagttctttaaaagactcagtttgatgcttctggagatatgctcttgatctaatatctgcctgcatatagtaaactgtatacttaacgactcttacttttcacttttcacatatctacaggataactttctgtttgttggtaaatgcatcacttacctgtctaataggttctggaacacggtacttgcaggttatcttgacaacttcaacggcagagtccagtgatatgcgatggccaaccgatacatatatgggctttagagaactcagagttggcctaaatccctgttgaacgtaatatgtaaaacttgatcattaaattcactatcttacacaagattatcaaaaccacaactatggagaagtttcgttgctaaaactgataagtcactactaatataacgcggtattaccaaagagacacaacaactacagtagatgttcagtcaaagtcacttactactccccatgtaattccagagtttcctaccaaagtgatagtttgctcatgctcgtttatttggagctgaagcgactgtttaacctcagattgattcagaccatccacatgatgcagctgaaaatgttacaacatcataaattccacattaacgatcagatggaaaatgcaaggcaaaacaaaaataacatcacaaatttcagagcttgagattctgaagaccgtacattctttccgaccccaatggttggtaggtgagcaagaacacctaaatgacacgccaagccaaatcctatagaagacaattacatctaacaccataattacagagcttgaaatgcaactacaaaacaaaggtaaagttgtgtgtttatacctcgtggatgaagtattccatttccatccaccatcagtacctttgcaagagcaaagcaagagacttttagaagaaaaaaaatcaacgcaaaagcaatggtttaagagtagccaattgcaaactaaagcaacttatagataaaactgaaacctgaggatagaatggatgcttctcatctctcatcttctgcagaatctgcaaaagaaccggagcctgtaacatgaaaaatccaattttgggatctgagatactttagtgaagcaaatgaatttagcagagcattgctcggggacacgaagtagtaggagaaggaaacctcacgaaaggcaagaaatccagggacataaggaacatggaggcggagaagagagaagtcatggtggactacacggagagaaggaagctcaagaacgacgagacaagcgcatgcgacggaagaatcttctttgcaaaagctcatgtctacacctccaacatacttaagtatctccgatccctgagacagttccgttgatgaagataacttccatgtgaagtcatcgtacgcgatcagtttcttcttcagctcatcctgctctctgaaagaagtcaaacaaatcatcaaccgatttgattgtgcggaatgaaactgaaatcaaatgtgaaactactctgtccacttctcgagctgatctccagaagaagaagactcgcttgaagctccttcactatccatttccagaaaaagttcagtcgccggagaggaagttcctaatcggaacaattgaaaacgacgtcgtagttattgacagtaaaactatgggcctttaaaaggcccattattaaaaaaaactatgggttagggtttgtttagtgaaagaaacgggtcgggtcatattttagtatgagtcggttcagctttgtcgtctccatctaccaccctccttgttctgctgcgtttcttactctacaactataagctcttttttcgttttccctttcaataatttctttttctttttccgtgatcccaacgtttgaattgatcgccgtttctgggtttttcttttaaaagagaggtattcatcatg

SEQ ID NO: 28985 - DNA, 3003 bp, Unknown
  misc_feature (1)..( 3003): 2750-1469P.txt file - cDNA_ID_2999526; gDNA_ID_1971819; Annot_ID_58282
acaatacggttcggtctccatctctctctctataaatgctcttcttcccacacatcgcctcctcctcattaagatacatctcgagaagcagagcagagagaaagagattccgagagagagagagaaggagggagagaaggagcttagtggtctcattaccattaccagctccatacgaaccgaaacgacgccgttcgctcaacccttttctctgcaatctctcttcctcccacgagtttctcagcttttctcggatcatctaattaagagaggagatcttgtctcacggtgggattgatttttctcttcacgaagatcgtgttccagggtaaagttttgatttttattcatcttactcattttggttaaagtagcttctgttctcagcgattttctctgtctcgtgtttatgtttattgtagttcaggaaatgttcttactgttctgtttgattatatgattattgcaccaaatctggctagaaaaagtcaatacctttttcccttctttctagaatttgggaacactgtttactagatttttgtctttgttccaaaagtttgttcattcatgtcatttacgggttataactgcaccaccattgctatggaacgcataacctacctagaaaatcttccttgcttttcaaaataaagaaagggagaagatttgattcttttatgaactctgagctgtcctgaagagaacccaatatttgagcttatctgtttacatttaaagaggaagtgacaatagaaacgctggtccatcgtgatttgtcttacttgtttagctcttgtcttgtctttactacatggtgcctttttctggcatttaccatccacaaaatcatgatttgtgtctaaatcttagattttgtctttttttttgtgtgtgtgtatgtacagcaattaactgcagaaaatggtgatgtgggtctttggctatggctctcttgtgtggaacccaggatttcactacgatgagaaagtgttaggtttcatcaagggatataaacgtgtctttgatcttggtaacccttttctgttaagataacagttttggttctttgcgtatttgattgatttatctattcgtcccagctgttgattattgattgattgatttgtgttttgatttgacttggtagcttgcattgatcatagaggtacaccagaacaccctgcaagaacttgcaccctcgagaaagctgaagaagccatatgcgtaagtagctattcttaatatgtgtataggatcttagagtctgttcatgaggcctgcttgttactcacacattattcttttcttactaacattccaatactttcttgacagtggggtactgcattctgtgtccgtggaggaccagaaaaagaacgtctggctatggaggtatgtccttgcatctgaaaactagatcgcttgatgtatcatggtcatgcctttgtgttgatctttctatttgtacacagtacttggaacgtagagagtgtgaatatgatctcaagacaagtgtagacttttacaaggtgagtcaggactcagccgagattattgaataagcctattattccttatgctactaaaaattgacctcaaaagtttcttccttacacaggaagatgatcctctaaagccagctgtaactggagtgatagtgtaagttgtttcctatgacacggatccatcaacagctgttctcacatcgatttttattttcttctacaaatctttgtgttgtgattttgatggatgcatttctttacaatcttcagattcacttctactcctgacaaggtctccaacaagtattatctcggacctgcgccattagaagacatggcaaggtatacacttagcttccagcccaatttcttctgttcctttagtttatgtgccagattcttgtcctcacacttagctgttattttgtatattcaaagacaaatcgcgacagccaatggaccatgtggtaacaacagagattatctcttcctgctcgagaaggcaatgcacgacattggttagtccaagctccatttgaagtctttatatgaatagaacatctgcccaggctttgtagtcaaaggttctgaccttgatggttttaagagagacattgtttttgatgtgttaagccattttttatttcacacagggcatgaggaggactatgttatagagctggcaaacgaggtgaggaaggttctggccgagtcctcgactaagaaggtgacaccggtgaaggaatcaagagcaagccgtgtagctaacaagtcgaagaacaatgtccccacggctcatcagatactacctcatcatccagaagctgttgccactacaatataactcttgtagttttcttcttaattggctttagagatgagtgaaatcaggtcttttttttaataataataacaaagtaagtttgttttctgagtagagaagtgtaatctttgtgtgtttcgaactttgttgtcttgtgtgttgtcctaacgagtgcctacttgtgcaccttttgaagaagattaaagctaaaacaaagtttataaactaacgtaagatcgaacaacatacgtcacatttcaacaaaatgcaaaaccttagagaaaacttgataacattcctaattccttcaccgtgggagcaaataactgaaatgtgtatcgagcttgtatttggaagatccatggacaagtaggtattgggcttgtatttggaagggccatgaggacaaatatgtattgggcttttatttggaaggtccatgaggacaaatagatattgggctttcacgttttttatctgtcgcctaacaaaacaaaaaaaaaaagtaaaaccaaaaaaaagaaaggagagaggccgacttggggtataagccagagttcttcttctttttcaagcttcttcttctcatcagtcatcaccggaatctaatttatactcgcaaaactcagcgattcgtttcgtttctgacaagtttccaattctacagcaatg

SEQ ID NO: 28986 - DNA, 3003 bp, Unknown; identical to SEQ ID NO: 28985
  misc_feature (1)..( 3003): 2750-1469P.txt file - cDNA_ID_2999526; gDNA_ID_1971819; Annot_ID_176076

SEQ ID NO: 28987 - DNA, 3003 bp, Unknown; identical to SEQ ID NO: 28985
  misc_feature (1)..( 3003): 2750-1469P.txt file - cDNA_ID_2999526; gDNA_ID_2926199; Annot_ID_141441

SEQ ID NO: 28988 - DNA, 3003 bp, Unknown; identical to SEQ ID NO: 28985
  misc_feature (1)..( 3003): 2750-1469P.txt file - cDNA_ID_2999526; gDNA_ID_2926199; Annot_ID_201728

SEQ ID NO: 28989 - DNA, 3003 bp, Unknown; identical to SEQ ID NO: 23991
  misc_feature (1)..( 3003): 2750-1469P.txt file - cDNA_ID_2999534; gDNA_ID_1620622; Annot_ID_47067

SEQ ID NO: 28990 - DNA, 3000 bp, Unknown; identical to SEQ ID NO: 23992
  misc_feature (1)..( 3000): 2750-1469P.txt file - cDNA_ID_2999534; gDNA_ID_2926201; Annot_ID_141510

SEQ ID NO: 28991 - DNA, 3000 bp, Unknown; identical to SEQ ID NO: 23992
  misc_feature (1)..( 3000): 2750-1469P.txt file - cDNA_ID_2999534; gDNA_ID_2926201; Annot_ID_201850

SEQ ID NO: 28992 - DNA, 3000 bp, Unknown
  misc_feature (1)..( 3000): 2750-1469P.txt file - cDNA_ID_2999538; gDNA_ID_1620686; Annot_ID_48461
cagaagaaaacaaaaattatttgaaaaaaaagtttaaaactgaattaaatagagtttgttgttgtagacaacaacaacaacaaaaaaaaaaaaaaaacttgttgtagacaacaataccatcaattatttttctttctctacgacagttacaatagtgaaaacccatctttaattgcaggagatttgttttttttagaagacggactcattcgacaagtttccatacgtttgtatatataattatacacatgattttcccagtataagatatgttaaactctgttcagctatattttatatcacccttttcgcctttaattattgttgtatatatcttaaaaacttttaggctaactgctgagtcatattcaacttactccaacagatttggttaaatatcatgctgctaatcggtatatttctctaattcaaatgtatgatcaattatattgtgacagtcatcagttatattattagagagggctagagcctggctagaagagcatccgaagagtcaaaaagaaagaaatgttaatggaaagattagttataatcttactatttttaacatgtatatgttttttttttttgataaaagacaagcagttgaaattgaataatacataaacgttaatttatcaaaacttttgaaaaggatcgttctgattacagatatgttagaacacttgaccaaattaagatactacaatttcttgtattgatcaattgtgattttgacaagaaaattgaaatgatagggtctttagaagctttggggatagcaaaggaaaattataaacaaacaccacatttcgcctaggaatagcagagaattccacattatttatgtagtttttaaacatttagttcttgaatttaagagctttattcaggaagaagagtgggataagaaggaatcaatatggaatacttttttttcataaattcgtttgtctcccagcatttagactgatgggatattcccatcctaaaaataagaatctaaaacattgtatcctaaatatctatctgtagacactttattgtgtttttataaagcaacaataatcaaatcaaagttcacaatcaatctaatgtccaagcaaaaacaattaaagtgctactaaagttccatttcttaatgatctacaaagtgttgtttatctaataaattaaggcaatttgcattcatcatataaattaaatacaacttttcagtgtaatatatatggacctcactatcaaacacttatgaaatattggaatgttgtgtaaaagtgtaaaaatcaaatcttaaataaagataactactatcaatatgacaacaatttgtgacagtacaaaatttaaactaaactataatttccattttaaaaaaaaaattgagacggccaaaaagggccaattaaaaagaaggcaaacgtgatattaattagttactgaataattaactgccattgaggccaaaaccatgtgctatgaaagctgtttatcagcgaattataacattttgtgtaaaagaaagaccaagtctacacaatttttaaaacatttcagtccagtaaagttaatcatcagttcatcactccaaattttataacttatatacgcatttgcttgaataattctgccatacaatataattttatgtgatttgataaatatatatctaattaaattaacgtgagcttagcagagagagtattatgtgctaagctaaaaccggtttatactgttcaaaacatcaaatattgagacaagctcatatagtcactatacatgcccacatgcattaaccactcagtcagacgagttatatatggttgtcttttgaaacaaacaaaacaaacttttacaattcatagttgtgcgttattatcggaacacaattatttggaaaacaaaaattatgaactcatgaagctaaatgggactgaactttaggcctacttcatattttacgataaggatgatgacgacgacttcgtggctaaaaaatagcaattaggatatgggtcgtgatcaaaaatcccaccaaactaaaaatatatcaaactaaatcaagtacctactacatgcatgattatctctttaacctaaccttaattaaagttagtttagatattgacaagaaactgtttaaaatgctttgctaagaaagtgggaacacaagatttgagagtatttttgttaaagtcacaacattttaaccttaaattacacttgcaacttgagacgatacttaatcactttttaagttaatttaatcataagcagacaaaaacatgcctttcaactctcaagtagtggtgttagccggaatccaattcgtctagagtaaagaatgaagatacaattataattgtttaacttacctcatctatataacaagattatcatttctcattccagctattaaattaaaccctcttttttcacaactggtatatcaattttgtgattaatctagttaccattcatacaactagctttgcctatacataacattcacatgagtttagtggattttacaacttaaatttcccccattttttttttttaagtaggatcgaataagagttaaatgcatgtatttgtgaaacacgaaacaaaagggtcactaaaaatttgcaccagccgggaatcgaacccgggtctgtaccgtggcagggtactattctaccactagaccactggtgcttcttgtgaattattaagacaagttagtttataatctaaatacaagttatcactgggccttaaatgacgctacagctgagcgacttaaggcccaaatattactacgtgagtacgtgacctatatatgtcaaaaatacgtgaagcttagatgggccacttaaggcccaaataaatacgtgaagcagagcttatgtgattatttcctctctcaggtcaggagttgttgtagacacagcagcttggtctctttcattggcacaaagagagaaaatctgaaattgagagagacagagaaaaatg

SEQ ID NO: 28993 - DNA, 3000 bp, Unknown; identical to SEQ ID NO: 28992
  misc_feature (1)..( 3000): 2750-1469P.txt file - cDNA_ID_2999538; gDNA_ID_1620686; Annot_ID_164620

SEQ ID NO: 28994 - DNA, 3000 bp, Unknown; identical to SEQ ID NO: 28992
  misc_feature (1)..( 3000): 2750-1469P.txt file - cDNA_ID_2999538; gDNA_ID_2926202; Annot_ID_141556

SEQ ID NO: 28995 - DNA, 3000 bp, Unknown; identical to SEQ ID NO: 28992
  misc_feature (1)..( 3000): 2750-1469P.txt file - cDNA_ID_2999538; gDNA_ID_2926202; Annot_ID_201924

SEQ ID NO: 28996 - DNA, 3003 bp, Unknown
  misc_feature (1)..( 3003): 2750-1469P.txt file - cDNA_ID_2999542; gDNA_ID_2926202; Annot_ID_141573
ttgcattttgttttatgcattttgtctagagttaatatgtgaacaagttgcattttgcagatgactgcatcatctgagaaaatggaaattcctagaagtttaattgatgatgtaccagtttcagaactatctgatgaaggcattattaagaattcaagtgaaattcctgcatctctaaagaccactgaggagccagctcctaattctttggaagctttgttgtttggatcctctgttccttctgttgtccctggaacaaacaactatgaactatggaacacaagtgatatttcctctactgaaaactataccgcagttaacctcgggacccagacaatgccaggaataccagacagtgttacctcttttgccacatcaccaacaactgcacatgctcattccggttcttcaggtccagtggtacctgttgctcctgataacttaaatacaaaagagacggctacacttgcaaataaccaggttggtctctgtagcagtttttaaacacacatttacaaatattttcttgaattcaggagtttaagctgcatcaactgttagtaacagtagatgtaaccggatcatttacagactttgaaaaagaagaaaagactatagtttcaataaaacttgttctcttcatgtgctaaccctttgcaaacacatgtggcatctacatatatcatctaagggaccatcagatttctctatggaacagacaacactggctatcacagattatgctcatggagttggatctgagcatcatcaagatgatgagacacaatctagcataagaaaggcgcttcctgaggtaacgaacccttctcttataacagaaatttggatactcttttgggaatctctgatcataagaatctaaccattggcaggaccttttcactggaggcttctcatttgcccctcagcaagttcatggtcaacatcatggcatgggatatggcatgcaatattatcaatatcctgtggtatatgttccattgacataattattacagcatctggttttatgctgatatatgtcctttttcttagcaggctatgggagccttaacatatacagcaaaagcagcaaatccctttgatcttagctatgatgatacagctccaaaccaaacaccacaagtatgaatcctagagttaatttcctgatagtatatatgatgaaaatgaatatatatatatactcagttcctttctcttttctatgtcttttacagtttcctactatggcatatgtgcaaggaggaggcttacctcacgtgtcatctccaatagggtattcagattcttcaagtccagctgcagattccattggactgatgacctctcagtcaccttttcatgcaaccgctttatccccaaactctccagctcttgcatcccatctttcccctggtgagacgaaatttatgtaaaaagactgttttcagtggttggagtttatattctaagagttgaaatctggtgaacaggtgcactaatggggcagcaatcacaggtgaatatgtccccatcattcaggtacatacatactctgactcttcttaattagtgttcactgaatggttcttgactctaaattgattttggtgtgcaaaggcaagagtatagtggtcttggtacagaaggaaatacgttcaacggagtacatacatttcatcaagcaaacaatggatatccttctgcaaacccaaatgcttatgtatccagaggaaatccctttgaatgagaaacagcttaatgcagaagttttctgattacggaaatgggatagatttcgtataatccttctaaaacatgacttgcttgacgatgaaacagaggtttcaatcatctactatttgctaattgatcaaatgaacattgatgtggaaagatattactttgtaataaaaagattatagaacttatgtaatttatctacagagcttgttctattggccatttgacaatcagattttagtgtgcatgtgttaagtgtattgtaagttgtaaacaacaaaacaaatatttcttacaaagttataattaactacgcaaactagtatcacaatttcaattaatatatattttaaaagttcatatcattcttatacttattaaatatacaatttgcgcataaacttaaagatatttaatggcgttttaacaagaaaataaaattgaataaattttgtatatttttgacataacaataccaaaaaaattctagcattcgattgaaccaaacttgacgtgtgaatgagtctggtttactacagtcaaattgataactcttttttttctaagttccaactcttcaacgttttttattcatgtacccttgcattttgttgaaattttgcaatgtgaattttctgtcttctcttacggacaacaaaattttagtttttatcagtcgtctgaatcctgtgacagacaccgacgccgttaaccgtcgtcgctgtcgctgtgtctctctttctcactctgttccatagatctgagcttctatcaatattctcggatcgctatcagtcaaatcttaagaatttcgtcgctttagctcaattcgggtacgtgtttcaattttctcgatagacccttttgagattcttgccttttttgttttttctcctttagatcagatttcggtttcctgatttattagtttattaccattgatgaagttttctagattcgtctcctttgtttatggtcttgatagggtctttatgttctgaaggaataaaaaatcttgtctttggatggataattattgtcttcaattgtatttgttgtttctaagaagaagttgtgtagttactgccaccaagtctgtgtgattgatcggatcattgttagtgtgtcagtgtttttatcttcaatttctttaattgtggcatttgctgattgattacttgaatttgttgattttcgcaagactttagattgtggaggaagttttaggatttgatctccatctcgtatccaagcatg

SEQ ID NO: 28997 - DNA, 3003 bp, Unknown
  misc_feature (1)..( 3003): 2750-1469P.txt file - cDNA_ID_2999546; gDNA_ID_2926203; Annot_ID_141582
tagtgatcaattttgttggattttcttaaacagggaaaaaggttggtaggagtactgaattgttgaagctggaagatttgattgagcaacttaatgctagaacagtagctgcgtcacctttctcctatgatgttaaaagggaagacgtggaatcctttttcagtcagtatggaaaggtaatccactatcgattgaatcataagccattgttcaaaatttagattggttatacaagtttttggtatatgtatgtgtcgtccttgcaggttaatagtgtgaggatgcctcgtcatgttgcagagtcgaggatattttctggtgttgccttggttgagttccctacagaagaggatgcccagaatgttatgaagcagaatttggtctttgctggtcaggagttggagctgaaaccaaagtaatcatacttagacatgaaaacatgtcctgtttgctgactgtttctcattttacaagtctttccattgaatgtttggatgggttacttaaaaggtgatatattcttttcaggaaagagtttgataatgaaagggagaaggatgaagtaaaatttgctaattaccaacctcagaagggatctgcaaatcagaagaatggttctgatcacaaaaacaattctgcttatgagccagagtaggggtttgactgttgctatctaattacttgtcttttcatgctaataatcctcttgatctgattatggctattttatcgtattgtagttatcccaagggtttgatcatttcattcaccctcaagcgttcagctgaagagggtaccacggaacaaaaaagttctgaggagccaactgataagacaatggaagaaagtgaaacaaagccagcagatactcctgatgctgataaagaaaacactggtgaggttcaggccgagggagcagaggatgaagatgatgagaaagaagaaaagggtgctctagccacccataaagataataaggatgttgtcttacgtgaagatcttaaggctgttttcggaaaatttggtgatgtcaaggtactacttgagttttacttagctgtctgtcaacatgaatcagattcaatatctcatataactgacatcattttcactgattcctttattctttttgttgtgaagtttgttgatttcaagatgggatctgagacgggttatcttaggtttgatgaacctgaagcatcccagaaagcccgtgcagcagcagtattagccaatgaaggtggactagccgtgaagaattttattgctgtcctagaacctgttattggtaaaaacaccttttcaacttcaatcttatcttataactaaaccttgtgttctgctttagttaaatggtcacttgtttatattgctctctgtcaggcgaagctgaaaaggagtattggactctcctacgaagcaaagatcggtttgacaagggtggccgtggaggaaggtgagttcatgtttttgttctggtttctttgttatgattttgtttcaaatgaagtttttgtttggttcttcagataataatatacttggtctatgcaggggaggaagaagaggagggagattcgggagaaagaggggatcagattcaccgggtggtcgctggaacaaatctcagaaggtggaagcatgagagatttcgctcgtgactgcttctgtttttcaatatatttctagttgcaactttaaatttaatgtatcgactggtgactcgtgatgttataactagaaatagctgcttatttggcaaattttggtttagtcatatttggtattgttttgtttagctttatgtgccttcttatgcacacatctctttccttaattattttaaatcgatgtttaggaagcattctaaaagacaaactattaatattaactgctaaaagtatattcctgtaaattctacaactgtatcaattgactcactgatgatgacactattttacttgaagtagttaaaattaattttgaaaatcaaatagttttggtattcttcttggtcttctcgtttgactttgtctacattgttattaggtttttatgctgattttagaattagctgttactggcaatttcatcttcttcctttttaatgagaaaaaaactcttctttcatacaaagaatgctttgccgttgtttagaagaagaagcaacagagaatctcgaaagaaaaatgaatgaagaaacgtataaataaataaattgaacttttatgatatgagagactaaaaagcgagattcagagattgaaatcaacggctgagatcactttcctttttgttttgatctctctctctctctctctctctcacttcgaattccgtccgcctctccatgtttgagttttgaatacctctctctctctctctcattctctctctctctctctctctctctctctctctctctctctctctctcgacttcgatttcgatttgtgttcttcttcttcttcatctggattctcagcgtcttaattacttcagattaattttggaattcgttgatctgcaaggtgtgagctttactcgtatgacctcgtctccttctcttattatggtcacatttttgttagttttcacggagacttcttcctgatttttcaaaaatctactctttgaacttctcttactttttttcgtataaagtttcgattttcttcagatgatgttcgaagcttttttctcgaggtttttgttttgggttctgaaactaattcgggcttcttatcttaggtttttttggatccaatctcaatatctaaagctaccttcttcattctgtgaacttcttccttgttttgactttagtttgctcttttgctgtgaagctaatgctgattcttagtctgagtccgactgtgtttttaattttatggtttatctttgtttcaaattacagcaatgtgcttcgcttatgatgatttctaagacatatcaaagaaacggactttggggtttttcatattgctttccttgctaactatg

SEQ ID NO: 28998 - DNA, 3003 bp, Unknown
  misc_feature (1)..( 3003): 2750-1469P.txt file - cDNA_ID_2999550; gDNA_ID_2926203; Annot_ID_141590
atacatattttttgtgccaaattagtaagtcgaatacctattggtacttgtatatatctttcgctgacatctgcgaactgaaattgaaaatctgaatatatatattttttgtgcacaaaaaatctgtttattcatttttaaaaaaaatgctagacactagttgactatatcactacaaataatgaaaaataaacagtaaaaccgcttaaggtgctgagttgacatatcatatatgaacatgttttcacttagaaataaaaaaaaaagaaatggaattcaccggcattttaatgaagaagggaaataaccaataatgattgaaggaagtgattattcttaagactagagacacatatcagatgagacaaacaaatgtggcaaacatatggacccaaatcgcagttttatattacaaggaatctcttgttaattagctagttgtccacggagttttgtactatataattcataattcgaatatggaaaactaatatgatatgaagatttagatacttttcattttcccttttgaacttctttccattttcccaattgggtatatggactaggaagaagaataatagaaggccatgtactcaaaccaataacatatatgtatatacaaaagggtagaattacatagcgaccaagataaataaacgttattctcttcttttctttttgaggtaaaaaaaaaatgtatatacattaataatagagaaatattccgacatacttatgaacaatcatgaaaataccttggataatatatataaaccatttcttgttgtaatattcatattaaaaatctaaatagtactattagagatattccacattttttgcaaggatatgcgtacttgataagtatatgaattttaattagaaaagtacaatttcattaaataaacaatatggtaaaattttagttttgaaaaggttaatagtattttagatatttagtaaataattgaaatgtattagtcaaaacatttgagttttctaaatggacgatgatttgaataattgtctaatactaatgtaaagatagagaaagtatcttatgcaaaaatttataaacattaaaaaaatatttgtatgagaaacttcttgtcgaggaccattatgaaaaaaaaatgtagtaactagttattatataaaagaataataggcttaatcgcatattatttaaaataaaatttcagttgacgcaaaaaaataatagaaaaatatattaaaattaataaaaaaagttctctctatattctttaaaacatatagaataatttaaaagaaaattagttgtaaataaattctctaaaaaaactaattgagaaaataaatatatgtcagtatttctatatattgacggttatcaaaatgtaagacattttactgtcatacaaatagacagacatatatgcatgacatgtttcatacaaacattctatgattgtatttatgtttttatatgtaaacgttacgtgtagaacaacgtttaagataatggtcatatcaatcaacctttaaatagatgaatcaaaggtgcttcctttgtttgaacttctaaatccacacaaaaatacaagaaaagtcaaataatgtggtctttatcatatttgtttgctccgaaaatatagtgtcacttgaacaaaactcttgacaaactggcctatactggttttttttcttaaccaatttatccgttaattttcaatgccgtattgggttcacttcgaagcatttcctgtcagtcattataatccaccaataatgtcagtttctctctctcgcccaaaaacgaacgatcgaggtgaatataaatgaaacatgtacattaattaatatatttatatcaaagttttttccggctttgaagcttgaaaatactccatatattatatacttctttgtgctaatttgtcgacgctttggccattttcatctatcatcgaggattcacaatttttggtgcgtatcgtttacatgatcgaagaaatagatatctgtaggatattatgacaatgtaaattaaatatagtttttctttagtctgttgattatctttatgcttagtttaagaaatagtgtaaacgcttaatatactcactttgcatgacccatataaacagtgtaaacgctaaaatataactcttcatcacccatattgatttaccttaaaatcacattcaccattgcgtctgatggaagtaatatttaagtatagaatacacccatatatatgtatatttattcataatattatatcaatatatattcatatatacgcgttgacaaaacagaaattcattctaacacgtacgtttatttaactttgataatgctagagtattattgacaggtataccgtgtacatggaattaatgtttttactcgctgctaataaaatgtatcttaccaccaatttaagcgaacgtatatcgtattattttaacaatagtttcagcagctgcaggtttccaacgactaatcttttaaattttggaatagcgatcatattcatcatatatcgttaataatcatgaaccaaatatgatttggtcgccaaaatctataatatcatcgttagaacttgtcgctatttttaaacctatcattaacttaacataagacaaacaagacttggttcttggttacaaccactagtgattgtaaaacgaattatcttaactatgaaagaggtatcctacaaattaaaaccgcatcaaaacttaccgtcaaacttcttttaaataattatcgtcatttacgcgtatctaaaaaatgaatatattatatcaacttgaataagaatccatcatttgtaacaagatcccttaagcgagaccctataaatacatcacatgcgtagcaccaaacattcactaaaacttcatttactttcttgaacttgtcttgtgccctctttccaatacactgaaatccacttcaaaatatttatttaataaaaagaaaagaaaagaaaaaaactctgccaggatg

SEQ ID NO: 28999 - DNA, 3000 bp, Unknown; identical to SEQ ID NO: 8311
  misc_feature (1)..( 3000): 2750-1469P.txt file - cDNA_ID_2999554; gDNA_ID_2926203; Annot_ID_141591

SEQ ID NO: 29000 - DNA, 3003 bp, Unknown
  misc_feature (1)..( 3003): 2750-1469P.txt file - cDNA_ID_2999558; gDNA_ID_2926203; Annot_ID_141592
gtttccgatctcggccccaatgtcttgtaagcttttctaactccaaaattttcaaggcagtctcacgactcaatacatgttcacatttattagcaatatattctagaagcaagtgacccatatgatacgcaccataattttctaaattttccttcacaaaattagaaacgacggcgtgttcagaaattggatcagattcttcattgcagaaagaaccagcagactctctgtcaaaaccccttttaaggacaaatttctcaagatattgaaggatgtcactgctaggatccttactgttatcaaattctaacccttccttctcaggtttctggttccgaagccgttcaagacgagtactccgcctctcttgggggtgttcttcagaaaacacaggctctttttcttttacagaaccaccactttctctctcgatgttgcaatccttaacagacacattacttgaatctgaatccacacaatgatccttctttttcataccttgcataacagcctctgtactaagggataattcaatggttatcggtatatcagctgatatgcccacagtttcacgcgaaggatgcactatcccaattagaatatttagcagtgccacccatgaagcttcaggaagtttaaattgcactctttttcttaacttcttggaggtagcatccatgtcctgattcatgtcagacacctttcttttgccaagaaatttgagccgaacgtgctgaggttcaagtttatctatacccttgggagcaaaaggagctgaatctgtgtcttcaatacaatgtttaacatgcaaagcacgagaatgtgatggccaatgccttaaaatcagatttgcaactgaaagacaggaaacttcatcacctacggcaatgagaacttctagaagtttctccatgcagttccctgcacattagccaattcaattttcaagagggagggaagggtaaatgcaatagtccataccacatatgagtaatgtgaacccaaaaacagagagagaaagaggagaacagtgcgtacagttattggggctgcagagaagtccctgttcaaatgcccatcgtgaaatactcagtaatcccatagaacatgatagggttccaagatggttccagagcacagaatcttttgcatctaagtctatagcttgaagataacagtttagagcattctcgtagtgacttgaaccaagctcaagaaagacagtggcaagattcttcagagccaaaaatctgcaaacagaaattatttataggcgagaccacagcactaatgaactaaaaatatatgaactagacaaaatcaattagtagacatgtaaccaataactagatgaattaaaacgatggagcttgacctgagatgatggagatgattgtcgtttgcaatagtctccacctggacataatgtcaataagaaggtcattcatcatccaaagaaatcatcagagtaagtgaagaagatgattttactttggagttggttataataggatctttaaggatagattctagcagctcccgagccttgtcatagtctttagcttgcagcttgagaagaccatcatgatatgtttgtgacagatgaaactcctgaagagggcaatttaaaaaaaaaaacagttcaatatatttttcaacaatgagctaatctaacttctttataccaaattgagaagaaagaagccctgaatcagaagaaaacctgagcttctttgctaggagctaaaggttcccacttctctgtggactccgtatcattgatcgctgcaatcgaaaactgaaaaaaaaaaaagcgaaacaaatgcaaaaaaaatcaaaaactaaccgattaaaagggggatcaaaattaaatctttgcccgaaattatcattaccatcttgatactcgaagctggtaatggttggggttttcgagttcttggcgcgaaattggtcaatcttcttcttcttctaactagggttgatgatgcacgttaaacacattactagagttttagatttcacagaattcttttctttgtttggtctgttcgtcctctactgtgtttttcttttgttttggctattttgccgtctgttaaaaaattggggttttccgataatgtattgtatatgcctgaattatggaaatatcactaaaaacacttttttgcacttttgtatatattgcaattaagatttaatttttctattttgaagactttttgttaaaagagagatttgctaactcaaaattaccggagttaataagttcgttctcatcagattagcaaaacattcatctttaaagaaatctgtttatctcacgtaaaattctactaattggcagcagcacactactttaatgggcctattactatttcaatatgcactgaaaacttcattggactgtccaataacattataacattattaaaactaaactacatttgtatttgggttacaattttataaagagtaagactcaagatactaattgggctgcagacaactttaaaagccttactacaaaaatcaaaaccattcttaattaactaacaaccaggtaaaaatctcagtacaatatttacactaaaaataggtgccacccactatgcaaaagtttagggccacgaacaaaaaaacctgtaaattgttatgtcttcacaatatgtgttttaatacacatgaattttagctacggttaatgtaaattttgtagttaaattaaggctaaacaatctcaaatataaattggtcaggtccacagacaacagcctggcaagtggcaagcactaaaaattcgaccgttattttttgcccctttttttaatatttcgaaattgtatcttttagttttattttaaagctttttagcccgctcctcctccgctccacctttaattttttcaccaattggatttggatctgtcaaaaatattggcctctttctctctttctctcttgctctctttctttgttgggttgatctcttcttccatg

SEQ ID NO: 29001 - DNA, 3000 bp, Unknown
  misc_feature (1)..( 3000): 2750-1469P.txt file - cDNA_ID_2999560; gDNA_ID_2926203; Annot_ID_141593
tcaatcggtattccttgaaacttaaatttcatgaccggaacatgggcatcgggaacaggatggagctcagtcacttcttccatctcagccaatatatcatgcaagatgatgaagaaatcctcctgtaaagagtaagtgttaagaactaaagaatcaaacttctgcatcaataagtggtagcaagagtcacctcccggttaacataagatggcccaacacacaaagtatcaatgtcagccccaggaccatgcacctgcaaagtgaacaaaattgaagtcggttcagcctcagagactaagattgcatttgcatagacaaaaacagagcgatctctcgagtaatccacaaacatatagcaaaaaacatattatacgcattttagcttcaagataaaagcaaggaagcggtaaacaagtagcacttacgccaagtcggtaggatccaaaggtgaaaatgacagcatttgcatcttccaccatctgatcagtatatcctctttgctgcgttaactgtttcacccagtgctttacaatctaaaaaaaaaaggtgggagataagattgatagtttcagacaaatagcacaatgaacagcatgtgaagaaacttaaaaacagcaaagtaaatcaatggacataagaacatatgcctgaccagtctatttcatattgaactatgatctatgcttagcccaaaatcaacaaccatacacgagtaagaaccaatacaatgaaacctaaaagaccattataaacacaataattttattcttgtcgattcagacacccaattagcacaaccatcaaaagataacacttgtaaatatacagaacaaacaatcaacgagacacgctgagtcacctgatcgatgcgtcctagaacttcctctcgccgcatggtatcatccttgctctcgtagagtccctcatcaaccaagtacttgagcatataagaaaatacacatcagataagccaaatcaacgaatcctttaaacagtggaacaatttttgtataaacaaaaaaacaaagctttaccttctccagctccacattacgcttaatatccgccgaagaaggcccagcaagagagagcggcttcgtaattccatagcttttaggagaattcagcggcggcaacgaaccacctaaattttgagtacccaccatcataacacgattgataatcctaagcgatcaaagcagaagcgcagcacaaaaacataatctcgcttcacgatatgattagagggagatcggatcagacccccaggtcaagatggattcgagacgggaattgcacaaggagaggaaacaaataaaaaggagattttgaaaatcggaaaccctaaatcgatggaaggggaaagagactacggtgtcaaaaaaagtcaaagaagaaggagaatctgaaagaggttaaatcgatggactaggaacagagagaagagagaaagagagagagatgatggatcaagaagaagaaggaggtatgagggagatggagagagagagagagcaaaggttggggaagatattaggtacacggcgattcgattttataattaaattttgattagtggattaatgtgtatgattattttacggagggagccgataagtctccgttcaaaacaagaaaacattgtaatcattttgaaaacaaatctaaattagataattttgttcagatttttaatttaaagattttaatggggttagtgggattattggtaactagaaatcatgtgtcgatggaaaccaactgatttaaaatcaccatctgttaattttaattgataaagttgaaaactggtgtgttgtttattagattttgatataattttgatactatattggattttaacatattaaagtgtttttaaataaaagatacaaaagtttaggctgtatatacaaaagtttaggctgtatatacaaacatgaatttcaattagtgatgtaataatggatttccttgattaaaaattacaaagacccaattctcatggttttgtgagattgcaaatattatttttttttagtgagggagattgcaaatatttttaataacaaatagtaacaactttcctaactgtctaaaacttatcaaattcatctaaaatttattaatactcgaatcttttctttccaaatatgtaattcattatactcctaattggagaggaaactttattattttagaatccacttgtttgatatttaaatcctaaattgattcatgaagatttgtaaagtttagattgatttgttaatcaaataaaaagtttaaaccgataatttgatagtttaaaaatgattttttcggacaattgtgtattaagatcttttttttatacttaagcgttataaagatttgtaagataaattttctcctctcagaaatttgatttttaagctaaaataactattcgatctatacattagcttgacattattatttttacaaaacaaatcagtttttataaatgctatttctcaacaggatatgatatttctctctttgtcatgaacaataccatatactaagaaaaaatgattttaaaaaaaaaaaatcttaagaaattaaagaatagaaaaattgcctatatatttttgacaccaaatagagaaattactaagaatatatttcgtaaatattaagatattcttatcgtttaatttttgtcattttctttaaaggtataataaagataattaatgagattttatccatacttctgcatttatccacgaatcaattatctgaaaaccggaaattgacaaaaggaaaaaccagccgccgtttacgctggtatttcggtaatgtccgtatatcataaagtaacggtgagccaaaacgacgtcgctttctcgttccttacttctataccactctgagctctgagaattaaaactcacatacatacatacgcttcaaattcacagtcgctttacgtcaccggagagaaaaacactcagaagaataaggttttcttcgatg

SEQ ID NO: 29002 - DNA, 3003 bp, Unknown
  misc_feature (1)..( 3003): 2750-1469P.txt file - cDNA_ID_2999563; gDNA_ID_2926203; Annot_ID_141594
cacacacgatctccctgataactgtattaagcccggggcataggccaccacaagtgacaatacaggcacgcacatcagatggcttgaagtacacctaaacacaatatataatcatatatcagcagtttttacatcatcaaatacagaagctgcagagcaaaggaaactcatggagtagatgaagtaccttttggcgcgggcctgcacgtctaaaatgtgtccctctaggagaatccttgtgaacaacaatctatacatcacacgaaagggaaaatgagcaatgtgctaaacatatcacatgatcacttacgaagagaacaaatgtaagaaaggaaagcgtcagtgagtttcaccttttcctggactgtatcatcctcatcaacaaaatactgcctgaaaatcacacagaatatgaaccctattaactaaccgtcatctttcaatcaatcaagttcataagtacaacatcaacttaccttactactgaataagcagcatttgattgcaacgggtttggataagtctgttagagaaggtatcagcaaaagtgaataaagtataaaatgaaacgaagctatagcatgatttgaaatatgaaccaaaaagcttttttttttctccatggcaagactaatttacaatccaattcttccattactctacatgtataagaacctcattacattagcatcaaatttagaaaatagtaagtgattaatagatctaatcaaacattcggtgacgagtaagcatatgtgcaccaatcaatttccacgttgacattgatttaacatttcacatttgtatgcactaatacgaatataaatatttatgtaattctctccctgatagagaccaggatctcatcaacagtccgaatcaacatataggctaaaaataggcgaaaccaattatacaaacacaacttttgcatttgctatacacgaaccaccaaatcggcaacaatatcaaattcgtaaatcgtataaccaccgatccatgaaaatgtcgatttcaaagaataatcgatggaatcgtatagagatagagagaggaagtagtacggggagatcgagaatgtaatcgctcaaatgaggaacatcttcgagtacataaccagcaggtccttccaccaacttaatctgctcgtccacgccattagaagccatcgaagaaaaccttattcttctgagtgtttttctctccggtgacgtaaagcgactgtgaatttgaagcgtatgtatgtatgtgagttttaattctcagagctcagagtggtatagaagtaaggaacgagaaagcgacgtcgttttggctcaccgttactttatgatatacggacattaccgaaataccagcgtaaacggcggctggtttttccttttgtcaatttccggttttcagataattgattcgtggataaatgcagaagtatggataaaatctcattaattatctttattatacctttaaagaaaatgacaaaaattaaacgataagaatatcttaatatttacgaaatatattcttagtaatttctctatttggtgtcaaaaatatataggcaatttttctattctttaatttcttaagattttttttttttaaaatcattttttcttagtatatggtattgttcatgacaaagagagaaatatcatatcctgttgagaaatagcatttataaaaactgatttgttttgtaaaaataataatgtcaagctaatgtatagatcgaatagttattttagcttaaaaatcaaatttctgagaggagaaaatttatcttacaaatctttataacgcttaagtataaaaaaaagatcttaatacacaattgtccgaaaaaatcatttttaaactatcaaattatcggtttaaactttttatttgattaacaaatcaatctaaactttacaaatcttcatgaatcaatttaggatttaaatatcaaacaagtggattctaaaataataaagtttcctctccaattaggagtataatgaattacatatttggaaagaaaagattcgagtattaataaattttagatgaatttgataagttttagacagttaggaaagttgttactatttgttattaaaaatatttgcaatctccctcactaaaaaaaaataatatttgcaatctcacaaaaccatgagaattgggtctttgtaatttttaatcaaggaaatccattattacatcactaattgaaattcatgtttgtatatacagcctaaacttttgtatatacagcctaaacttttgtatcttttatttaaaaacactttaatatgttaaaatccaatatagtatcaaaattatatcaaaatctaataaacaacacaccagttttcaactttatcaattaaaattaacagatggtgattttaaatcagttggtttccatcgacacatgatttctagttaccaataatcccactaaccccattaaaatctttaaattaaaaatctgaacaaaattatctaatttagatttgttttcaaaatgattacaatgttttcttgttttgaacggagacttatcggctccctccgtaaaataatcatacacattaatccactaatcaaaatttaattataaaatcgaatcgccgtgtacctaatatcttccccaacctttgctctctctctctctccatctccctcatacctccttcttcttcttgatccatcatctctctctctttctctcttctctctgttcctagtccatcgatttaacctctttcagattctccttcttctttgactttttttgacaccgtagtctctttccccttccatcgatttagggtttccgattttcaaaatctcctttttatttgtttcctctccttgtgcaattcccgtctcgaatccatcttgacctgggggtctgatccgatctccctctaatcatatcgtgaagcgagattatgtttttgtgctgcgcttctgctttgatcgcttaggattatcaatcgtgttatgatg

SEQ ID NO: 29003 - DNA, 3000 bp, Unknown
  misc_feature (1)..( 3000): 2750-1469P.txt file - cDNA_ID_2999567; gDNA_ID_2926203; Annot_ID_141597
ctaagattgcatgaagagatgaaagttcttgaggtaatcaatcacatataagattttttgtaaagaaagaaaagaagaagattcatcagcttactaaaacggtaggaaatagattcacagatattatattcctcatcatcacattatagtcttgaatagatgtctctatcaaaaatatacttattaattatagtgaaaagtcgataatttaatttgttatatgataaaaacaaaagaaaaaacacttggagaaatttataagtgaggaacgctcaatattttacattattaattttcactcttttcttgcatatttattctagctttaactaataaatacatagtgtacttgaacattttgttataagatagtgaatagtagaaactatcttcaaactctgcataaaaaattaacaaacatttttttaatatattcaaacacagctgatagtagtatatttgagttttttgtttttttgtttttgtttttgtaaaacctgtttgttaatcacgacaaaactacatcacattcccacaaacgctaaaataaaaaataagacaaggtaatcgtcatatttgagctatgatatatatatatatatgtttttttttttttactttttttttttataaaggctaactatttgttttttgttttcaaatactactagcatatataagatcttaattttttgtgtgttaaatattatattttgagtttcaactgttattagatcaacagtatctatctctttttttaacacagtatctatccttacgcagaatatatcctcaaaatttggaaccagagatgtgaataatgagtaatataagaaaatcgtgcatgggcttgaatatagtgtgccttatcacaggggacaatgtcgataaattttgcatgcatgtctcatctggttctaaaaatttcattataaatatcacgactgtaacaatgatcatattatgaaaaatttctaagtttatatcaggaatgatgattgacgataatgatgataactacatgggattttatctgcgttacaagaaatcaaggacgcatgcaactttttcatcattctgtcctttcttcaactaccatttgaattttcatttattataaggtatgttctttaaattatataccttcctttgtcccgaaattaattaaaaatgggactggatatgtacttccacttcttaatttcatatgttatttttaaaaatggtcgaaaaatgtataacaatacgcatgcaaaattttctttgcgccaaagtattaaaatggcctgcaactgtacggataaaccaattttcaaatgataatatttgtatataatgtttctgtatacaggggcggacccacgttagtcttgggtggggcatgtgcccgatactcaattctataaatcttatataagtttgcattatgtaattaaaaatgtatttagtttagtggttttttacttaatggtgccccacattaacccaagtttaaaccttgctgatgtctttttattgattttttataactgtacccatataagattatttcctggattagccatctgtatattaataaatcgtttcctgtggttgtgcgatgcataaccgtccaagaaagtcgtatatttttaatacatgtgttaaaataggttttaagtgagaatttttttaacttgtggagtgtggagtgtagagtgtagatgtacattacctatatatttatccaattctgtgtaataaagatgttggggcggcgcctgctgccacatacacattggattagaagggcaaaagaagttctaataaggagcaaactaatagccatgaaaattatgaatttaccatactgaaaacaaaggaattaaggttttgaattcaatacttgttttgttatatatgatgttgatgtgacgtatttgtgcgtttctcatagtgactttgaaaggaaggctaaacgaatttgcagtaaaagtaacagaagaaacacttcaaaattgaattaaaatgaagaaaaaaaagaatgagaaaaagtgagaagtggtggttgtctggtattaagggtactcacttctctccttttcaacacagcccgacacacatgtctctttttttttttttcatacacacatttctatttattagtttcctaaaataaaaattataaaacaaaaagcacacccacccataaactaaagcttttctctctcatcccactacaaatcttatatacaagtttcgcaaatcttgactcttcacgttgtggatctatctagagagataagtaagagagaggaagagtaaggaagaaagtggttgaactgtagcagagtctgaggtttgaatcttgtagttcccattgaagcatgcttcaccgttttttccgaaggaagttactcatccactgagagagaaagagggatttggagatagagaaagaaatttctcagatgggtttgtgagaattcacagcaagagcaagaaactcctatatcttcctttgcttccagagaccagcgtgatcaaaaacaaatatttttacggtatctataagaatcctcccctctttttctttttccttaaagagaatttttttgcatctttcttaggttccaataaatatgcagaagaaagttaaaatttttgtaccgtcgttgaaccttttaaagacctaattaagagacaagatcatactaagctcataaatcactttctatttacacatatataggttattaatcttaaacaagatctatattttatctttgagatttttcaagatttcatcaagtgtcacgttcattcattgattacatttcaaatttcactaagaaagttaaaacacggatctttttgagaatatcaagaaagttctttgaaatataccaaaagaaatcagtactttcaagaatacataactttttaggttgtgttaaataatatttgcttttgtaataaaggaacaaaattaaatagagagatcggagaggatcaaagatg

SEQ ID NO: 29004 - DNA, 3000 bp, Unknown; identical to SEQ ID NO: 3983
  misc_feature (1)..( 3000): 2750-1469P.txt file - cDNA_ID_2999571; gDNA_ID_2926204; Annot_ID_141628

SEQ ID NO: 29005 - DNA, 3000 bp, Unknown; identical to SEQ ID NO: 3270
  misc_feature (1)..( 3000): 2750-1469P.txt file - cDNA_ID_2999575; gDNA_ID_1620636; Annot_ID_47360

SEQ ID NO: 29006 - DNA, 3000 bp, Unknown; identical to SEQ ID NO: 3270
  misc_feature (1)..( 3000): 2750-1469P.txt file - cDNA_ID_2999575; gDNA_ID_2926204; Annot_ID_141633

SEQ ID NO: 29007 - DNA, 3000 bp, Unknown; identical to SEQ ID NO: 4398
  misc_feature (1)..( 3000): 2750-1469P.txt file - cDNA_ID_2999579; gDNA_ID_2926204; Annot_ID_141661

SEQ ID NO: 29008 - DNA, 3003 bp, Unknown
  misc_feature (1)..( 3003): 2750-1469P.txt file - cDNA_ID_2999583; gDNA_ID_1620712; Annot_ID_49018
ctcgaagcatataacacacagtgtcgagtagtccacatcatccgacgagctaaacgacgccgtttctacatctcccttccccgttacctccaacgactcattgatcaacggcggcgtccaatcggtggtgacttcttcttctgccaccaatggtagcctctgtgtgtcatcctccatgtcacattcgctcaggaatttcaataccaaataagtaatcgtcattattgttcctgagaaacaataacaaaaacaaaaaaacaaacaaattagctctacattgaagataaatagtactccatatgttaattatataaatatgggagaaatatagtacccaaaactgtaatataaatcaccactctagctgagaaggatagccccaagtaccatcgaacgaactcatcctgcaaaatacaagttactcgcatatatatattaatccatggtttcgtcaagtttttttttttatatagaaaattgagtagagctaggagctagaggggtactcgcgttatccgatggtaacttgatggaatttagtttacggaagaacatatatagaagctgcagacattttgagatcgtggcatcgaacattttcgagagaaaagaatgatccagtgaagatagaaatgatttgttctcatctgaagttatattgaatttcttattgtttgttagagagcattaaacaaatgaatttctgattaattccaagcaattgtcatcactctgacagtatatatagattgtgtcaaaagactcgtcgtgcaatccatatttattaatttgatcagaaaaagaggcaaaatacaagttgctgacacaaacttaaaaagaaaggtacagtacaatttcctaactctgatttaataatacctatttgttaaaaaggacaattcaagtgagaaaatgaaaaggcacccaaataattcactctgtttaagtcctaaacgactgattcttttatctgaaaatacgtgatgctaaattagtcaatagttgaaataagatttaaaaaatggattatccgttaattcacaaaaattcctagaggtctctctggtacattcaatgaacactctttttaatagttgaaaataaacatttgggaagaactaagaagaaacaacattataagatgggcttgggctttttgttgtattgttttttatgttttacaattttatttaacaaacaagatgacaaaaaaaaaaaaaaggactccaaaagtccaaaacagctatggagtatatgagggtaaagtcgtcattttacaaaaagcatttttatcttcgttttgtcgtcttcgaaagttctcaaagagaaggcatctgagaaaccccaatctctaatcttcttttcaattcaatacttttttttctcaatctctcctctcaaatcaaacaactttgattgatcttcgcaatcgattccacatgaagcgcagtactaccgactctgatttggccggtgatgctcacaacgagacaaacaagaagatgaagagtacagaggaagaagaaatcggattctccaatttagacgagaatctagtgtacgaggtgttgaaacacgtcgacgcaaagaccttagctatgtcatcttgcgtgagcaagatctggcacaaaacggcacaagacgagcggctttgggagctgatctgtactcgtcactggactaacatcggctgcgggcagaaccagctcagatctgttgtgttggcgcttggtggcttccgaagactccactctctttacctctggcctctctctaaacccaatccgcgtgctaggttcggtaaggacgagcttaaactcactctttctcttctctcaattcgatactacgagaagatgagtttcactaagagacctcttccagaatccaaataattgactacaaattattagagtttggttttggagtttgtgtatttggagtttgttgattggtaagtcagatgtgatgttcaatgctggcaataaaatttgttggtatccataagccagactgttagcaacagttgtgttctgtaataatagagggtgatgagaatttttaattactgtaatcggagctgattaaaagtagatttaatatcaaatgtgattcgattttgttgtaatggttctgtcgtgaagttaagttggtccgtagttggacaatgattgtaacaaaatcgattcgtgatccagtttggtaagattaagaactgttagtgacgattctgttttattattcaatgaaaaacaatgttcaccaatttggtaataaacctaacattcaccactttaagtccaaaccggaatcaacgtcaagctatgtaatgttgcttatttctttatgtccttcgtttgtaacatttcccggtggttactactctgtcggatccagttttgccgtctagtttttacagcggtacgataaatctcaaatgttgtttgatttggttattcttgcgatggttagccttaatttcgctagatttatgtgtatttgagtgatagctacaagcctacacatcattaccatgtaccaccatctccttattcaaatcagaatcattatcgccgtaaccacttttgtcattttctttttttatatgtcggtaaagaaagaataatgaaataaagaggtgtaagtaagagtcaacaaaataatttaagagcttgtgtgaattgataaaaacactccttttctgttcttggttttatatgaaatttataaacaaactcgagtgattacaaagaacttataaaccacttatgtggcatactaaaatttaacaaaaaaaaatgttttgcgaaaaataagaagattttgttcatcttttttggtaagatgccagtttagctaaagatatttttcatatataaaaatgacaataaacacattacaaaagacaaaccccacacggctctctctagccaaattacttggccacgaccataaacacaaaacaccgcttagcttctaaaatctgaacatcgagaaaaaatg

SEQ ID NO: 29009 - DNA, 3003 bp, Unknown; identical to SEQ ID NO: 29008
  misc_feature (1)..( 3003): 2750-1469P.txt file - cDNA_ID_2999583; gDNA_ID_1620712; Annot_ID_165463

SEQ ID NO: 29010 - DNA, 3003 bp, Unknown; identical to SEQ ID NO: 29008
  misc_feature (1)..( 3003): 2750-1469P.txt file - cDNA_ID_2999583; gDNA_ID_2926185; Annot_ID_140732

SEQ ID NO: 29011 - DNA, 3003 bp, Unknown; identical to SEQ ID NO: 29008
  misc_feature (1)..( 3003): 2750-1469P.txt file - cDNA_ID_2999583; gDNA_ID_2926185; Annot_ID_200535

SEQ ID NO: 29012 - DNA, 3000 bp, Unknown; identical to SEQ ID NO: 4519
  misc_feature (1)..( 3000): 2750-1469P.txt file - cDNA_ID_2999587; gDNA_ID_1620712; Annot_ID_49029

SEQ ID NO: 29013 - DNA, 3000 bp, Unknown; identical to SEQ ID NO: 4519
  misc_feature (1)..( 3000): 2750-1469P.txt file - cDNA_ID_2999587; gDNA_ID_2926185; Annot_ID_140743

SEQ ID NO: 29014 - DNA, 3003 bp, Unknown
  misc_feature (1)..( 3003): 2750-1469P.txt file - cDNA_ID_2999590; gDNA_ID_1620712; Annot_ID_49034
atcagatggaccacactctttctcttcttccatttctcttcatcataatcatttcttccttccatgttttgcctgtttcacccacaccttcacacaaactaaaatccgccactaccatcagaaaactcaaccgcggaggaccttacatcggtctcgtgacggtcattgcgaccgaagaaaatgcttttctccgcagtgtcgatttcagacctgaccctactcatcccttcttggatctctctggtatccacttgaatcaaataactttttcaagttttctaacgtaaatagagtcttttgttttgcttaaatggaagttagtacttttgagatgaaaatattagtagtttctgatttaataaccttatgtatacagggagacgttttcgaatagggaagattcatggaaagaaggttgtgtatgttagatgtgggagaggaatggtgagtaaccacaacattaaattatccaaaacagaacaaaaaaaactacaacaaaataaagaagtttatatggctcttatttcttatctaaaagtagtatacaaaaagggaatgggcacacaccaaaatatcctgatccgtatacaataattgaaatgatgaattgatgataaaacttatattaagttttaatatagttagtaagtagtatagtatattaaagatgcatattagtaaatgtaatccatatgaaaagtagcaaacgaacacttatattaagacaaaagaattgcaggtgaatggagcagcagcaacacaacagatgatagatgtgttcaatgtgaaagggatagtgcattttgggattgctggaaatatgaacaactcaatgtccataggagatgtgagcatccctaagcaaattacgaatgctggcttgtgggattggctggtaagtataatagttacacaagtttgattgcttcttcttcttcatattgtctgatccatgcttttggttctgagtaaaacagaatccagacaaagtaaagggagttgaggatatagcgtacttagatgtcggaaactataatgttccaaaaggagatggcgacaatgagttagggagtattggatataattacgagcaactatattcagtcactggtcacatcaatgcacctcagaatgtgttttggatcaacacaactcaagagtggcttcatcttgcagctgatctagaggttgttaagagctatacaacatactgattagattatagattataaacaataacggttccattgttaacaacggtttttcgtgtggtatacggtggcagaagatggagctatcgcagtgtgtaaatgcaagtttgtgtcttccaaagaaaccaaaattggtagttggattgaaagcagccactgcttacatatttgtggataatgcagcctatagaaatttcttatacgatacttttggagtctcctcctctgatatggagagttctgcagtagccatggtaattttgaatccattaatttttacataattttgatcgttaagtgatatgtttgtgttgtggatttgaccagacatgcgcatcaaatgggtatccgataattgtgataaggggtttatcagatttagctggagaaggaggagataacactgttcataagtttggatctttggctgccactaacactgccaaagctgttttagagttcattaggaagctcccaccgtactaattcctctagtgtaacctatttatcatgaatgtttgaatctagttctctagttcatatcaacgaacccgtgacaacaaatgatttggattgttatcaaattccattttccatgatcgtaacaatgacaacacttttatctcatatatctacgaaatgcaacattcgaaaaattaacaatctcattgcaaattccaaactttcactcattctagcgacaatctttaacaagcacaaaaagggatgtatatataccttacaagagaagccaaattgttaaaattaaggtttaacatctctagttgaatcattctcatcatcgctatcgcaattctggctttgctcatcgtcagaagacggagacggatcgagacgggctgcgtctatagcccattggatcagcttatccacttcagcatcttctccgatttcatcaccatcttctccgatttcatcctgaagaagaacagaggacgaagaagacgcggaggggagagaagttttcagagccgcgaatctaagcatgagatcttctggtgtttcttcaaccacatcctttgatttcggctgcattctcggccgttgtttctgttgttgctgctgatccttcttcttttgagatttgagagcgagaaatctagagtgaagatctggatctaagtaatcggaagaagatcgagaagtgtgagaatcaacagagagctttagtatcatctcatcttgagctgcttgaagcaactgttcaacttcgtcttcttccttgcctcctctcctcatctctcgaatctgttgatctcaaaatcgattttcaaaaaccgaattgcgactttatgatctctatacaaaaccggtttagtatagggtcgattttaattggaccaacgcctaacttacgggcacacgatgtcgtttcccacgcggtttagattccaaatttccgtgagatgtttatttgatctccaccgtccaatggaaactctgattatttcgttgccgttgatctttgaccaaaaattgccaaccaatcagtttggcccaataagaaaaggaagaaaacctgaatttcacttaatctatcggcccttttttggtatttcccatgtgcgataaatttatacgatcaaatgtgaaccacgatggttcctggaagaaggaagagatttgcagcaacagagcgttataaaaaggcgaagcaagagggaagacaacagataacaaattgtgaagaatgggaagcgaaggaagatcgattgcgaggaagccaaggtttttgtgtctccatggatttcgtacgagcggagagataatg

SEQ ID NO: 29015 - DNA, 3003 bp, Unknown
  misc_feature (1)..( 3003): 2750-1469P.txt file - cDNA_ID_2999590; gDNA_ID_1620712; Annot_ID_165481
agaagaaactatcaagttggacttggatgatatatatatatatgcagctgtggatttgaatcgtaaaccaaccaaccaatcagatggaccacactctttctcttcttccatttctcttcatcataatcatttcttccttccatgttttgcctgtttcacccacaccttcacacaaactaaaatccgccactaccatcagaaaactcaaccgcggaggaccttacatcggtctcgtgacggtcattgcgaccgaagaaaatgcttttctccgcagtgtcgatttcagacctgaccctactcatcccttcttggatctctctggtatccacttgaatcaaataactttttcaagttttctaacgtaaatagagtcttttgttttgcttaaatggaagttagtacttttgagatgaaaatattagtagtttctgatttaataaccttatgtatacagggagacgttttcgaatagggaagattcatggaaagaaggttgtgtatgttagatgtgggagaggaatggtgagtaaccacaacattaaattatccaaaacagaacaaaaaaaactacaacaaaataaagaagtttatatggctcttatttcttatctaaaagtagtatacaaaaagggaatgggcacacaccaaaatatcctgatccgtatacaataattgaaatgatgaattgatgataaaacttatattaagttttaatatagttagtaagtagtatagtatattaaagatgcatattagtaaatgtaatccatatgaaaagtagcaaacgaacacttatattaagacaaaagaattgcaggtgaatggagcagcagcaacacaacagatgatagatgtgttcaatgtgaaagggatagtgcattttgggattgctggaaatatgaacaactcaatgtccataggagatgtgagcatccctaagcaaattacgaatgctggcttgtgggattggctggtaagtataatagttacacaagtttgattgcttcttcttcttcatattgtctgatccatgcttttggttctgagtaaaacagaatccagacaaagtaaagggagttgaggatatagcgtacttagatgtcggaaactataatgttccaaaaggagatggcgacaatgagttagggagtattggatataattacgagcaactatattcagtcactggtcacatcaatgcacctcagaatgtgttttggatcaacacaactcaagagtggcttcatcttgcagctgatctagaggttgttaagagctatacaacatactgattagattatagattataaacaataacggttccattgttaacaacggtttttcgtgtggtatacggtggcagaagatggagctatcgcagtgtgtaaatgcaagtttgtgtcttccaaagaaaccaaaattggtagttggattgaaagcagccactgcttacatatttgtggataatgcagcctatagaaatttcttatacgatacttttggagtctcctcctctgatatggagagttctgcagtagccatggtaattttgaatccattaatttttacataattttgatcgttaagtgatatgtttgtgttgtggatttgaccagacatgcgcatcaaatgggtatccgataattgtgataaggggtttatcagatttagctggagaaggaggagataacactgttcataagtttggatctttggctgccactaacactgccaaagctgttttagagttcattaggaagctcccaccgtactaattcctctagtgtaacctatttatcatgaatgtttgaatctagttctctagttcatatcaacgaacccgtgacaacaaatgatttggattgttatcaaattccattttccatgatcgtaacaatgacaacacttttatctcatatatctacgaaatgcaacattcgaaaaattaacaatctcattgcaaattccaaactttcactcattctagcgacaatctttaacaagcacaaaaagggatgtatatataccttacaagagaagccaaattgttaaaattaaggtttaacatctctagttgaatcattctcatcatcgctatcgcaattctggctttgctcatcgtcagaagacggagacggatcgagacgggctgcgtctatagcccattggatcagcttatccacttcagcatcttctccgatttcatcaccatcttctccgatttcatcctgaagaagaacagaggacgaagaagacgcggaggggagagaagttttcagagccgcgaatctaagcatgagatcttctggtgtttcttcaaccacatcctttgatttcggctgcattctcggccgttgtttctgttgttgctgctgatccttcttcttttgagatttgagagcgagaaatctagagtgaagatctggatctaagtaatcggaagaagatcgagaagtgtgagaatcaacagagagctttagtatcatctcatcttgagctgcttgaagcaactgttcaacttcgtcttcttccttgcctcctctcctcatctctcgaatctgttgatctcaaaatcgattttcaaaaaccgaattgcgactttatgatctctatacaaaaccggtttagtatagggtcgattttaattggaccaacgcctaacttacgggcacacgatgtcgtttcccacgcggtttagattccaaatttccgtgagatgtttatttgatctccaccgtccaatggaaactctgattatttcgttgccgttgatctttgaccaaaaattgccaaccaatcagtttggcccaataagaaaaggaagaaaacctgaatttcacttaatctatcggcccttttttggtatttcccatgtgcgataaatttatacgatcaaatgtgaaccacgatggttcctggaagaaggaagagatttgcagcaacagagcgttataaaaaggcgaagcaagagggaagacaacagataacaaattgtgaagaatg

SEQ ID NO: 29016 - DNA, 3003 bp, Unknown; identical to SEQ ID NO: 29014
  misc_feature (1)..( 3003): 2750-1469P.txt file - cDNA_ID_2999590; gDNA_ID_2926185; Annot_ID_140748

SEQ ID NO: 29017 - DNA, 3003 bp, Unknown; identical to SEQ ID NO: 29015
  misc_feature (1)..( 3003): 2750-1469P.txt file - cDNA_ID_2999590; gDNA_ID_2926185; Annot_ID_200551

SEQ ID NO: 29018 - DNA, 3000 bp, Unknown; identical to SEQ ID NO: 3597
  misc_feature (1)..( 3000): 2750-1469P.txt file - cDNA_ID_2999594; gDNA_ID_1620653; Annot_ID_47787

SEQ ID NO: 29019 - DNA, 3000 bp, Unknown; identical to SEQ ID NO: 3597
  misc_feature (1)..( 3000): 2750-1469P.txt file - cDNA_ID_2999594; gDNA_ID_1620653; Annot_ID_163546

SEQ ID NO: 29020 - DNA, 3003 bp, Unknown
  misc_feature (1)..( 3003): 2750-1469P.txt file - cDNA_ID_2999594; gDNA_ID_2926185; Annot_ID_140773
atccttcgaattccgtcgctggttagcttaggactttctgattctgtcgctttaatcttcttctctccatgacacaacgggtattccaagtctggaaaggaagcaatgtaagtccttttttcatcgaatgattgagcctggaattttattggttttttgtgtgttttctctttgttgggagatgaatattctctgaattctgttctctggtatgaatatgatttggaattcgttttttctcgagtttcacctgtgtagcataatcttagttacgcaattggtttactttggtacgtgtaaactaatgttgttgagctgaatcgttgaagtatctcttgattcactctcaaagcatgaccatgcatttttgcataaccttgtatcaagttgaatgttccttgtaatttattaacaattggaagtatcttcaatgcttgactcttcacatgttttaaattcagtatggtgataccaataaatggtccctctctcttttgcagaaattcatcctgggtgggagattgatatttggaccagatgctaggtcactgcctcttaccttgctattgatcatagttccggttgttttgttctgtgtatttgtagcaaggcaccttcgccatgagttctctccctacaatgcgggatatgctatcatggtggtagcaattcttttcactatttatgtaagtcttctccgatacccaatctgatagtcctatatatctcattgttgtaaatatttgatttctgattttatgtttgtttcctgtttgcttactgcctaatcgggtaatcaacaacatttatcagctatttcattgtttgtttcttacccggcttagaagcttaaaccctgtcctcctgttctgtcacttgttgtgtggcattcaggcgttgttattttttgcttttctgaatcacgaatttgggtttgataggtattgatcctcctcttcttcacatctgcacgagatcctggtattgttcctcgaaattcgcatccaccagaggaagacctacgttatgagacaactgtatcagctgatggaagacaaacaccgagtgttcaaattcccaggacgaaagaagtcattgttaatggcgtttctgttagagtgaaatactgtgatacatgcatgctttacaggcctcctcgctgctctcattgctccatatgcaacaactgtgttgagcgctttgatcatcattgcccatgggtgggacaatgcattggactggtaagctcaatcaaaagcatattgactttgaaaaatataaagttcgtaaatttttatctcccaaaaaagtgtgaggtttctgtttctgttatctgaaaggccaagatctgttttatctgccgattggccaatctgttgtctgccattttgtcctgtgattctgactgggaaagttctgtccattggcagagaaactataggtatttctttatgtttgtttcttcgtcaacacttctctgcatctatattttctcgatgtcggcggtatacatcaagattctgatggatcatcaacaagcaactgtgtggagggcaatgaaagaatcaccttgggctgttgtgttgatgatatattgctttattgccctgtggtttgttggagggctcacagcgtttcacttgtacctcataagtacaaaccaggtcagttggtctctattgttttaaaattctgttttctacttgttatccctgttattaccttcccgtatatacatattaatattgtatgcaaattgtaagtcaactgatagcaacaccgtgcaagtttttcagacaacctatgagaaactccggtacaggtcatcacacagcaggagcattgtctataaccgtggctgtccaaacaatttcctggaagttttttgctcaaaggtgaagccctcgaggaacaactttagagccttcatcgaagaagaacccccaagagttattactctgcctagcaccaccagggaatcaggggaagcagaagacgaaaatgtgacccggcgacagaaagtggaagacgatctagacattggagacgatctaatgaatctctcacggcgttgtaatgcagaagatgccaacaacaatcagcctcatcacacattggacatagaccatgagagagcaggctcgataaggacagaagcaagacatgaaagctggggaagaagaagtgggagctgggatgtagcagcaacagatgtgagggaaagtcgaagctacgcaacagcaaaggatggaaggggataagggtttgtggggtttctcttttaggacagaagtcggtagatgtgaattggtttcagggatttggggatcagttaatgtaatcttgagtgtactataccaagagtagtagttcttctatcttcttttcgttttctacaatgtgtattgtgctattttattaatattatgtggatattccattctgtatttgcgtccatgacatctaccttaaacattgtcatgctgtcttttagctcggccaaaatccaatttataatcttctcttacatgcaattagcagcactgcgattaaaggaaatatcaaatctaacaaaatttgtattttatgactaaaataagtttttcgtactatttaaatctaaaaactaataaatagttattttttaaagtaatccctagggcatttacttgtctaattttgctcaacacttatgagttatgatcacgagtcacgacatccattttctaaacaaagtaagacgatactggacgttgtctttgactaaatttgtacaaaccacgaattatttacattggccaaatttagaaaacataagaaaaaagttactaaagtttaacgttatttgataccagttataatatagcacattctaaagttatccagccctagatgaaaccctaagcatacatatatatccgccttgaaccaaaagccaaacaacacaaaactgaataacaaccggaaacttgagcaacaaaacttccgacgctaagagaaatg

SEQ ID NO: 29021 - DNA, 3003 bp, Unknown; identical to SEQ ID NO: 29020
  misc_feature (1)..( 3003): 2750-1469P.txt file - cDNA_ID_2999594; gDNA_ID_2926185; Annot_ID_200579

SEQ ID NO: 29022 - DNA, 3003 bp, Unknown
  misc_feature (1)..( 3003): 2750-1469P.txt file - cDNA_ID_2999597; gDNA_ID_1620653; Annot_ID_47773
acacatatgttggtttagaaaaacttcaagttgcatttcttcttttagccaatcgcactatcttccgtgaaaaggtaaataatatatagctttatgacaatttcacaaaaatggttcgttagttttgacttagcattaagatttttttccagaaatctaagtattggtaaaataattctatatctactactaggtcaaaatacaattctatattatttaaaaaattgtaactgaggtaattgatcaaattaccaaaatgatgaaagagctagttaagaatttaacaatgtacaagttttagtgaaatggtcaaaactaaatatccattcttttggcccgttagcatcattaaaccaaccactcaatggagacatggaagatcaaaattcgtcaaccctagcgctttgtttctctacaaggatcaagtatggaacaacaacaaccacaagaaatcgaaatgtgctaaggtcgcatgagttcgctaggaataagtctataacatttcgttttgtcaacaaaataagattttagtatatatattatttacaattttaccagacttccattgtcaacaaatgacattattgttgttgtcgaagaaaaaacaaaggtgacactatttgctgttttactttttatttcatgaggacggaggacccatttttttaatttagtttaaaagagcaaccgtatcagttgattacggagtccagcagagaaaagcatgctcaactgtcaaaaacaacctaacaattagggaatcccgtaaaaccggcaaatcacgagggcagcattacattacattacattacatgtcccacaaatcactttccctcccatgcttttccacttccacctatcattaccaacacctattacctaaaggactttaagccagagagttttcaaatcccgtaccgtgattggtgcactatgaagtggaaaggaatacgatgaaaaacaaactgttttctcaatacattttcaccgacaccaatcatgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaaatgaaaatg

SEQ ID NO: 29023 - DNA, 3000 bp, Unknown
  misc_feature (1)..( 3000): 2750-1469P.txt file - cDNA_ID_2999597; gDNA_ID_2926186; Annot_ID_140787
catatgttggtttagaaaaacttcaagttgcatttcttcttttagccaatcgcactatcttccgtgaaaaggtaaataatatatagctttatgacaatttcacaaaaatggttcgttagttttgacttagcattaagatttttttccagaaatctaagtattggtaaaataattctatatctactactaggtcaaaatacaattctatattatttaaaaaattgtaactgaggtaattgatcaaattaccaaaatgatgaaagagctagttaagaatttaacaatgtacaagttttagtgaaatggtcaaaactaaatatccattcttttggcccgttagcatcattaaaccaaccactcaatggagacatggaagatcaaaattcgtcaaccctagcgctttgtttctctacaaggatcaagtatggaacaacaacaaccacaagaaatcgaaatgtgctaaggtcgcatgagttcgctaggaataagtctataacatttcgttttgtcaacaaaataagattttagtatatatattatttacaattttaccagacttccattgtcaacaaatgacattattgttgttgtcgaagaaaaaacaaaggtgacactatttgctgttttactttttatttcatgaggacggaggacccatttttttaatttagtttaaaagagcaaccgtatcagttgattacggagtccagcagagaaaagcatgctcaactgtcaaaaacaacctaacaattagggaatcccgtaaaaccggcaaatcacgagggcagcattacattacattacattacatgtcccacaaatcactttccctcccatgcttttccacttccacctatcattaccaacacctattacctaaaggactttaagccagagagttttcaaatcccgtaccgtgattggtgcactatgaagtggaaaggaatacgatgaaaaacaaactgttttctcaatacattttcaccgacaccaatcatgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaaatgaaaatg

SEQ ID NO: 29024 - DNA, 3003 bp, Unknown
  misc_feature (1)..( 3003): 2750-1469P.txt file - cDNA_ID_2999601; gDNA_ID_1620627; Annot_ID_47171
cttcagcgcgctgaagaaagacgcgaagctgcagaagcaagggctaaagagcttgagaaacaggtgtttattatatccagtacatttgacttttgtagacatgtttatatacaatgttgatggttacttttaagcttggtatgacttacaacaggttgcttctctaggtgaaggagcaaattttgatgtcaagctcttgaagaggtttgattttctcgtctttattatatagcctttgttcacaaaattgggttttcacgaactttgcgctgatccctccaggaaagaagcagcattgcgtcaaagagaggtccgtaatgcattcatatctaaaggatgttgttgcatttgttcttcgcaatatacatgtcctttattcttctgctagcttgtgttggcagttgctttgacagtaaagttattgaaaaggagaaacataaatctatttgcaggcagcattaagggctgctgaacagaaaagagatggaagaaatagggaaactaatgcccttagctcagaatttcaggtacaatgctctggtaaccaatactcaagctggtactaaacagtagtttactagactttattgtataaacctttcaacttgacaagggaacaatcatctcttctgtgttgtgttatgatcagagtttaaaagatgaagcagagaaatccacggaacagctccaggaggttgaagctgaaataaagtctcttcggacaatgatacatagaacgattttgagtcaagaagaaatggtttgcttacaatctaaactagaattttgtgcattgacggtttaactccaccttctttgtttcatttaactatatgattgaccaaccttgcaggaggaagttgttctaaagagatgctggcttgctcgctactgggaattagctgttcaacatggtaagagaatttttctctcgtaaagatacaattgttttatcctctgttgggtattgacctgcaatgatggatatgatgaagtaacctgttcttctcatgatgatgccaagggttcaaatggttttgaagatctcataaattggtcctattatgattaaaacatgattagagcatatgcatgtttcccattcacgcagtgtacttgtccactaaactgtatactgacatggagaacaactatgtgatccccgctagctgatcatttgcccttatttggaaatgtttacttatgcatttcattgggtcactcttaggaatatgtgaagatatatccacatcaagatatgaacattggtcagctttagctcctcttccctctgaagttgtcctttccgctgcccaaaagtctgaagattcctggcagacaggtttgatcttcaactatcctgccaatatttcccacataatcatttagtttgagtatataaaactaattggtaaaatcacatctcgcaggtggtagcgatcgcacttggagcaaagtcatcagtaatttcagtgatttgaatggagaagggaacattgagagtatgcttgctgttgaaacgggattacgagagatagcatccttgaaggtttatgcacacattttgatctgtttattactaaaaaaaactgtttcccagaaaatacacatctcattcatatcatttcttgcacctcataggttgaggatgctgtaatgcttgcactttcccggtatagacagacaaatgtggctcgacaagccgtcactggtaaaactatatctaaaactgattggcacatataaatactgatgtgatgttatacaacagacactcatctcatcttaatatccagatcccagggtgcaaggggaacctaagttctccgaaacatttggtgagtcacatccttaaactgttttcgttactatctagacagagtatcatataagtaaacaagcctctcaacaaaacctgttttcttgttcttcttcatctatattgtatttgaatcttatgactaagcaggaagggtttattctgaattttgaatgcagagttgagtcatgatgagcaacaagatattctctttaaagaggtaagttacatctttaccgggagagtttagcttttacttagcaggatcatatacattaactcaaaaaacatatatacatggtgtgtataggcatggctgctgtatttctggaaaagagctaaaattcatggcgtggaaagtgatattgcggaagagcgtcttcagttctggatcaaccgactcgggcaacattcatcttcacatgatgcaattgatggtatatttattacttgaagctaaatcagttaaagtaaagaatctgattccttttgtgtttgctgggacagtggaaagaggaatgagggagctaaggaagcttggaatagaacaacaattgtgggaaacatctcgtaaagaactcatcgactcctcttttcttccttcttattccgtttctgactacaatgacgagtgaccacctctactctcctctttgcctccaattttctttattcacgacacacgctcacataaacatacacatacacacacaaaggtaatcaaaatcattttttcctgctcgacaaagcttagaagaaacacaaaagaattcatactacatctgttttgctttcagactgtgttccaattgttgatatatgtttggcttccatgttgttacttgtataatactcttcgttacctcacccaaataacccaaatacaggttttttgagaacaaaaagctgaatttcatatagttaggggcaaaaatataaattttatatagttgagggcaaaactagaaagtttgtgtataaaaaaggtcgaaacgttaaaatatgataaagaaactggtctgtgacataccgcattaagatgggtcccatagaaatcgaaatgtggatcgtctccttccctatcttatccaggataacgataacaacactctctctctcactgcaagagcgcgaaacagagtaaggctcactttgttttagctttctcctctacttcgataatg

SEQ ID NO: 29025 - DNA, 3003 bp, Unknown
  misc_feature (1)..( 3003): 2750-1469P.txt file - cDNA_ID_2999601; gDNA_ID_1620658; Annot_ID_163693
actgatctctcatttgaatccaactcattatcattgcagttagacatgcttcaagaagaaaacgataatataatggataaggtcagtgtgaacgctctctttatctctaatgtaggttatttgtttgtgtttgctgcctttttgtacttgatgtgtatattcttgagttacatatgcagcttcagcgcgctgaagaaagacgcgaagctgcagaagcaagggctaaagagcttgagaaacaggtgtttattatatccagtacatttgacttttgtagacatgtttatatacaatgttgatggttacttttaagcttggtatgacttacaacaggttgcttctctaggtgaaggagcaaattttgatgtcaagctcttgaagaggtttgattttctcgtctttattatatagcctttgttcacaaaattgggttttcacgaactttgcgctgatccctccaggaaagaagcagcattgcgtcaaagagaggtccgtaatgcattcatatctaaaggatgttgttgcatttgttcttcgcaatatacatgtcctttattcttctgctagcttgtgttggcagttgctttgacagtaaagttattgaaaaggagaaacataaatctatttgcaggcagcattaagggctgctgaacagaaaagagatggaagaaatagggaaactaatgcccttagctcagaatttcaggtacaatgctctggtaaccaatactcaagctggtactaaacagtagtttactagactttattgtataaacctttcaacttgacaagggaacaatcatctcttctgtgttgtgttatgatcagagtttaaaagatgaagcagagaaatccacggaacagctccaggaggttgaagctgaaataaagtctcttcggacaatgatacatagaacgattttgagtcaagaagaaatggtttgcttacaatctaaactagaattttgtgcattgacggtttaactccaccttctttgtttcatttaactatatgattgaccaaccttgcaggaggaagttgttctaaagagatgctggcttgctcgctactgggaattagctgttcaacatggtaagagaatttttctctcgtaaagatacaattgttttatcctctgttgggtattgacctgcaatgatggatatgatgaagtaacctgttcttctcatgatgatgccaagggttcaaatggttttgaagatctcataaattggtcctattatgattaaaacatgattagagcatatgcatgtttcccattcacgcagtgtacttgtccactaaactgtatactgacatggagaacaactatgtgatccccgctagctgatcatttgcccttatttggaaatgtttacttatgcatttcattgggtcactcttaggaatatgtgaagatatatccacatcaagatatgaacattggtcagctttagctcctcttccctctgaagttgtcctttccgctgcccaaaagtctgaagattcctggcagacaggtttgatcttcaactatcctgccaatatttcccacataatcatttagtttgagtatataaaactaattggtaaaatcacatctcgcaggtggtagcgatcgcacttggagcaaagtcatcagtaatttcagtgatttgaatggagaagggaacattgagagtatgcttgctgttgaaacgggattacgagagatagcatccttgaaggtttatgcacacattttgatctgtttattactaaaaaaaactgtttcccagaaaatacacatctcattcatatcatttcttgcacctcataggttgaggatgctgtaatgcttgcactttcccggtatagacagacaaatgtggctcgacaagccgtcactggtaaaactatatctaaaactgattggcacatataaatactgatgtgatgttatacaacagacactcatctcatcttaatatccagatcccagggtgcaaggggaacctaagttctccgaaacatttggtgagtcacatccttaaactgttttcgttactatctagacagagtatcatataagtaaacaagcctctcaacaaaacctgttttcttgttcttcttcatctatattgtatttgaatcttatgactaagcaggaagggtttattctgaattttgaatgcagagttgagtcatgatgagcaacaagatattctctttaaagaggtaagttacatctttaccgggagagtttagcttttacttagcaggatcatatacattaactcaaaaaacatatatacatggtgtgtataggcatggctgctgtatttctggaaaagagctaaaattcatggcgtggaaagtgatattgcggaagagcgtcttcagttctggatcaaccgactcgggcaacattcatcttcacatgatgcaattgatggtatatttattacttgaagctaaatcagttaaagtaaagaatctgattccttttgtgtttgctgggacagtggaaagaggaatgagggagctaaggaagcttggaatagaacaacaattgtgggaaacatctcgtaaagaactcatcgactcctcttttcttccttcttattccgtttctgactacaatgacgagtgaccacctctactctcctctttgcctccaattttctttattcacgacacacgctcacataaacatacacatacacacacaaaggtaatcaaaatcattttttcctgctcgacaaagcttagaagaaacacaaaagaattcatactacatctgttttgctttcagactgtgttccaattgttgatatatgtttggcttccatgttgttacttgtataatactcttcgttacctcacccaaataacccaaatacaggttttttgagaacaaaaagctgaatttcatatagttaggggcaaaaatataaattttatatagttgagggcaaaactagaaagtttgtgtataaaaaaggtcgaaacgttaaaatatg

SEQ ID NO: 29026 - DNA, 3003 bp, Unknown; identical to SEQ ID NO: 29025
  misc_feature (1)..( 3003): 2750-1469P.txt file - cDNA_ID_2999601; gDNA_ID_1620627; Annot_ID_162526

SEQ ID NO: 29027 - DNA, 3003 bp, Unknown; identical to SEQ ID NO: 29024
  misc_feature (1)..( 3003): 2750-1469P.txt file - cDNA_ID_2999601; gDNA_ID_2926186; Annot_ID_140815

SEQ ID NO: 29028 - DNA, 3003 bp, Unknown; identical to SEQ ID NO: 29024
  misc_feature (1)..( 3003): 2750-1469P.txt file - cDNA_ID_2999601; gDNA_ID_2926186; Annot_ID_200656

SEQ ID NO: 29029 - DNA, 3003 bp, Unknown
  misc_feature (1)..( 3003): 2750-1469P.txt file - cDNA_ID_2999605; gDNA_ID_1620693; Annot_ID_48624
gcatcgcattctcttcttcttttgcttttgttgagttgcgtaatgacttttacgtgtatccctcgtgcgtgtgtacgaatgcgaccctttacctttctttgtctcttgagaagttggatattcacttttacattatttaaacactatatcagtaacataaatgaagtatagaaaaacctatcaaacatattttgaatgtttttattctaatgctttgaaaaagaaaaagaaaaaatatatatatcataatacttaagtactatggaatacgtaatatacaattatttttgtatgtgaatatccaatttcatttgcgatgttaatatacattttttagattttatcatcaatcatggcaaaatatagtcttttgaatagatgagcatatccttagtagaagccactcgaagcaatcatggatgtcttccaatgaccatctaacatttaagtcattattggaaacttaaagaagttgtataacaaaatacttagatgttattatgaggatgctcttaaattagtatatgtcaagtgttgttattgagaatatagcaattacttctctctctattatgctcatgttggattgtgaatccttaagaaaaattcttaagactgatatttataagaaaaaaaaactgaacatggttcagataccgggtttcaaaacattatggtgttaagtccatacaaatgtacttgttttaaagtagaaaacatgtgtggtgttggtcaagtttttctattacatcctatcaaagcatgtacacaattttaggtagacgtaataatgttgttagtattctctttacggaagatgtgtgtgatgcgtcctatcacatattgtcattgcaaagtgtgttagctcattatgcacatggtggtttagctctttatgtagattgttaggatctggtttgaaaaaataaataatagttacttaacattcatacccaaaaaaataataaagaatagttgataatatttcatgaaaatcgatttgttttggtggacatacatcgtcgtctctactctattgtctcgatcgcaagtaatatgacaaataaagcagcagccctagcaataaaacatgtgactactaaaataggaggatttatctttacttgacgaactataaattaaatatctactcttttaccttgactttgaaaattactttttaagattgccttttacaattatgtggaatagcggcacacatttacgtaaatttaacttcaatttaaaacaatgatttattcattttcatcatacaaacttttcagcacattttctcctttttaatataattttatatattatagatagagatatagatcaaacaatgtatgactttaaacttagattgtaaattcttcttactatgctcgaaaatttcatctacgtatatagatctattgtaaacctaagtttaaaacggaaatcagttattgatagtaatctagtaagtttaatcaactatgcgttataacataatgaaatcatatatacgagcttagatatctaattcagttaatcaacaagtcaactaaacaaggcttcacttttccacacctctacagatcgaaattattatatattcgaattatgtaactaatgtaagtcttgcaacgtgtggatagatacaaaatggatatgtccataggtatacatattaaaaatataactagaaatggtatattactaacaaaattttacccccaaaggtggccatccactagtagccacatgcttatctagtagacattgaacatgataaaaagtgccaaataagtggaataatcaatgggaatcttcattcctataaacaaaaacattttcaagcctatgacatagctagctactctacaacatgtatatgccaattgggatataaatgtattaaagcataaccattaatttgacaaatagaaataaatagttcagaatgtataagttgagaaaagttataatgattggtagggagagactcaaaaagaaaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaagatg

SEQ ID NO: 29030 - DNA, 3003 bp, Unknown; identical to SEQ ID NO: 29029
  misc_feature (1)..( 3003): 2750-1469P.txt file - cDNA_ID_2999605; gDNA_ID_1620693; Annot_ID_164848

SEQ ID NO: 29031 - DNA, 3003 bp, Unknown; identical to SEQ ID NO: 29029
  misc_feature (1)..( 3003): 2750-1469P.txt file - cDNA_ID_2999605; gDNA_ID_2926187; Annot_ID_140849

SEQ ID NO: 29032 - DNA, 3003 bp, Unknown; identical to SEQ ID NO: 29029
  misc_feature (1)..( 3003): 2750-1469P.txt file - cDNA_ID_2999605; gDNA_ID_2926187; Annot_ID_200741

SEQ ID NO: 29033 - DNA, 3003 bp, Unknown
  misc_feature (1)..( 3003): 2750-1469P.txt file - cDNA_ID_2999608; gDNA_ID_1620693; Annot_ID_48627
caagcccagtcagttcaccagttacggccaggcccatttcgattttgtatcataagatacacatcgttgttagatgatgatgatactattgacaaaaacaaaaacattatcataaaacaaatatcttaccgagcagatcatttaaaccgataaatttgttcgggaggataaaatagactcagaaaatgctcatgaggccatttcttcagtaaatgaatcatctagaatgttagtaaacggtatagattcaagaattagtttctgtataactgttatgtacaacaccatgtggactgaatacatccgatgagtatatatacgaagtacaaacaccaatatacatttcaaacaacagcatggttgtagtcatggtaatggaatgtcttgtagatgaagtgtgatagccactttgaagctgcaaaacttaaaacagccgccacaagcactgcaattctagccacattcgacattgtcgtttgcttcaacaccgccatgactccgatcatagcaacggatgcgatttgtaagatcacctctagcgcattgagatatttgtgagctttcttgcagctgctgcagttctcaacatgcgaccaatacctggaacacgcaacttttatcattaggatgtttagcactacttttcattaaacctcacaagcgagataaataacctgtcgaagagctgttctcggggaggcgtaggaggaagaagaaatggatcaaactttcctctccaatcgactcgagcctcgctgtacttgttaaaccatctcctgaatgtaaccacattagcgtctgattttgttgggataaagcaagctttttgccagttttcagggcctctctccagtatcttccgctcctacacacattccattacaagatacaaatcagtctggtacattgatcagcctctactcagaacaatgtgtgtactagatagatttggaattacctctacatgaaggaggtgcaaatctgagtctagaatcgtattttgaccaatgtgaaacacccatctagggacaatcttatcaataaatacaccaaaattcctcgggaacgtccatatcagcctactacgacctggactgaccggaatacatataaagatcaaagacaatctccgctttgacaatgccgcctgtatacagaaccatactgttaggtaactaaaacatgtgactctaaacaagaaaatcttgatacaagttaaaatctatgaccttgtcagaagcagctggtgcgggatactcatgttcctgctctggtagagggtctgtggaagagcgatacacacatggtgcaataaaattagaataaccccattcttgttttgaaaagaaccctttgttgtctagttttttaacgttgatttcgagtggtttccccccttctctgtcaatcttctctgcaagaagaatctgaaggttggtaaaaggattaaaacaactatttgaaatacaaattatgtatttgccttttggtttaggaaaccgcatcagtccataatgtgcataaggaacatgagccgggtccatgaggttttccaccaagacatcgtacctgaaagatttcagatttacacaaaaacatcaacggagaattaccacacatagttgaaatgatgtaaaagccaatagatacccgtaaggaatatcacgattccccatcaacttagtgaatgatgggtcttctaactctggaatgtaaggaggcttgttggtttcaataatgtttttgtactttggatcactgtttggccaaaaccaaatgatctcatgctgcacagtactcgggtaaacagctacacaagcttgcttgaaagtgtggacctgatttgcattaccaaaataatcattgatacaaccaaagactttgactttatgttccatataaaccatatgctaaaccaatctaaaacaaacaaatcatcatcaatagctataaaaatttaccggaggaccatcaggaggagcttgaggaatgagtttacagtcaccggaaccattaaagcaccatccatgataaacacattgcaacctcccccattgatcaatccttccatcagacaaaggagcaagacgatgaggacacgtgtcatccatcactttccattgcttctcgttcctatcccaccaaacaaccaaatcaatccccataactttcttcccatgaggaaccttcttgtcaagatcgcaaattggcatcactgggtaccaattagcgtaccaatcgaacttatccgacccgggttcgaatagggcttcaggttccggtggagaattcgttgacgtagcggctgatgatgatggtggtgatgatactgcggttgtgaatcgacttgatttgcgggtgataagggaattaggagaaatgggtaggcttggattggagaaggaacatctgaaacgaggtttcgtattgagaattcggagcgatggaagagcgcatgcagcaagagcagcttccatggcgttgtgtggtggtaacaaccggagagacgaagcaaatgaaagtcttctttaccaatctcttttgacaaatttataatccaacggttcaaattaaaatatctcaggatgtatttaaaccaattgataatcatttttctggtttaatgaaaactaaaccggttaattgaaagagaaagtgtcggttgagtgtgaaaccggcgtcggcaaagtgagggtataagggtcctttccagacaccacagcatcagtttcttcaatctcccacgtctgagattgaaaagtttgggagaagataaacaaactcaaaatacctcagctttagatcaaaatctaaaaacaagagtttcgtgcagtggtttcttagagatctagtagattagagaatttggatttgttgaagaaaagtggatttggtacgattctataggtttccttcttctctgaagctactatagagagaatctgcgagctcaatttcgtagtaaattagggttcgtgtttcttggtaaagatagaatcaatg

SEQ ID NO: 29034 - DNA, 3003 bp, Unknown; identical to SEQ ID NO: 29033
  misc_feature (1)..( 3003): 2750-1469P.txt file - cDNA_ID_2999608; gDNA_ID_1620693; Annot_ID_164851

SEQ ID NO: 29035 - DNA, 3003 bp, Unknown; identical to SEQ ID NO: 29033
  misc_feature (1)..( 3003): 2750-1469P.txt file - cDNA_ID_2999608; gDNA_ID_2926187; Annot_ID_140852

SEQ ID NO: 29036 - DNA, 3003 bp, Unknown; identical to SEQ ID NO: 29033
  misc_feature (1)..( 3003): 2750-1469P.txt file - cDNA_ID_2999608; gDNA_ID_2926187; Annot_ID_200744

SEQ ID NO: 29037 - DNA, 3003 bp, Unknown
  misc_feature (1)..( 3003): 2750-1469P.txt file - cDNA_ID_2999612; gDNA_ID_1620628; Annot_ID_47192
caattaacttactcacataatcggaatccaagttagcactaatacaaagtatgtctttatgtagcaatgttgcatcgttttcaaagaagtgttattcattgcttactttcgtaatgatgattttttcccactcgtttgtcgttactatttactatcaatgatttataaatcatcgttaatgaaaatttagatctattttagtaatagatttgtttggtttagtacaagggattgtgaaaaagataaatttgatgattaaagaggacgcaaagtttggcgagtctttactctatatagagatagggtctaagcattcacatgcacttatgaaccgtccaacatcaacgttaataacgtgtgattcgtatcaaagtttacatatatttggcaaactttaatttattatcttgaaaactatatgtttcatttttgccgttttgagtaaagaatcgtacacccatcaattttcagatatatatgagccaatccataattaatctgattgattagagagaacgttataaacatctttaagatcaacagtatattattggttgaccaaaaaaaaattattttgatggtgaaagtcacataaatcaagtataagttcttgtcaaatttaaagtaatctctacgaataataatattggatacatgaatcataatttgtgatggtataatatatggtacctttcccgtgcaaaagaaattgagtcattgaagtgttaagcaatagtttgaagtttttatattgaatattacaaagtcaaaagcccttaattacatcatacacatcaagtcatgaaatacatataatatcacacatcaacttgatcattcataaagtcttacgttccatcttctctacaggacaagagtctcccaagatatatatacccactaatacccaaatccatagacacaatctccctctatatatccatttctccaaacgaaaacaaaaaaaacattaagccaagaaccgcatatacgaaccaagaacacatcatcgttagttctaattatgaagaaggatacatgcaaggaaggatcatcaatctcgagaaactcatcggtgggatactatgatgaacggatgccagagggtgttccgttcgagtgggagatgcagccagggactcccattaatactcaaccacgggaggttgttcctccattaagtcctcctccagctatgctcagcctcggcctccccaagccatccatctccatcgaagagccaaagaactttgtgtttccaacgaagctgaagctgcggaattggaaacatcttcattgcaagagatatttttctagattgactaacaaaatggttttgtcttcaatttgtttgtaccctgataaacgctacatgtggaaaaaatgaatcaaacgtatggaaatgggccggggtcgggcaagattttttttataataataacaattttttaaaaaagttgaggacttataggcctattgacaaagattttctagtaaaattttctatcataggttttaccatctaaacagctagcgtttgcttttatgttgttctaaatctgttaacagtgtttttaaaaagtaaaaaaaaaatagtttatcagttaaacaaagtgaaccaatttcaagttagctgcgaatactacttagtagtactacgattattgttaatatcagaaataattgtttatcaaataaagaatgaaagttgttaaaatctctgatcgtgtattttttgtcaacgaaatgttcgtattaactgaaacagaaatgtcaagttatacgtcgtcttcattaactctgtctctgaccaatatgtgtcgaaataatcatgttctgatttgtttgtcagaaaatcagcggatcggaacctctgtccgggggagaggctgcttggtttatttgatacttttatcatttccttaatcatacccccttcattttctgaaactattttcttacatttcttttgtttcataattgactgcaactctccaagtattagtatcaaatgtaaactttcataaaattaattttattaatcgctccagtacacaaaaacctacttttaacgtgaaacaaacatcttacttagttaccactacaatcatctaactaaccctatttactagtatttgtttttgttttattctacaagattttgaaagtttctagacatgaccaaaccggattctaacaaaaccgactaaactaaactcttaactcttaagtgaactaaaccgactaaactaaagtcttggaccattcccctaagtgcaacacaaatcggccacgatctaagcgaacgatgagatattaaatgacgaaaagatggacctaacgaccaacgcctcctccgaatcaatagttaatgcttacccaactcttttccttattttaccatctctctctgtttgcattgtttatatataatatgatcggagccaaaaggtagagaactatcacttcggctaattgtgatgaagagtgttttaaatcattagtttttgaggttttcagattcgtttcatacattgaactcactggttctttgtcaaaagaaactatcataaaaaagattcagaaatagcgtttccttcaacagcttctcaaatggtaagtggattattctctatcaaacttgtaattacaaaaaaaaacttttaacaacgtttaataactttcaaaaacttcacaaattaatgttttaattttttaaaaaacttctcaaatgtaagggtgaggcatagatagtttatacttgtaatcataatttagtttttaacaattctaagttctaactgttagagattgtacactctaattctgatttatcgtaattttgataaatcctgaattctaactgtaaaaccctaatatagcggattttagacgtgagaaatggtgattataaattgagttaggtttcaacaagaaattagatgcttagttttgacttatatattcaattatttttgttgtgtataggcagaagaagaaatg

SEQ ID NO: 29038 - DNA, 3003 bp, Unknown; identical to SEQ ID NO: 29037
  misc_feature (1)..( 3003): 2750-1469P.txt file - cDNA_ID_2999612; gDNA_ID_2926188; Annot_ID_140871

SEQ ID NO: 29039 - DNA, 3003 bp, Unknown
  misc_feature (1)..( 3003): 2750-1469P.txt file - cDNA_ID_2999616; gDNA_ID_1620647; Annot_ID_47625
aactgttttgaataatattgacaatcatttttgtagaatgctgagtggaagattagtatgtcattcatttaattacacttaaatatacatggataattaattaggataagttttcttatcaggcgttttcgtgggacaagtacataattaggttaatttcttatgggattctactctctttttttaaaaaaaaaatctagacatttccaaatgtcgatcgaaaacattataaccgaccacctgtataactttccgtcgatgtcccccgtatgtacaaaacttaacaggtcaccttatccgtgtacgtggccggatctcattgcgtttgttagatttctgtgatgacgtggtgttttcctttacactaggaaacttcaatttggcattggaatgtaacatatggctaaagtaactttatctgcttaacatatttttcaaatatctaaaactatttctagaccgaattttagatatgtgactaagaagatttcttgatttacatcaaccaaaacaagagcaccatgtgctgtttcttatatggatataacagttcgaaataagttatcgtcttcatacatccctagaaccccaacgactggactaaaaccctcaacttctaaaataagacttattgtagaataataccaaattgtgaaaaaaaaaacaaatataaattattgactatagtttgaagtaagtcgtaattttttccgcaaggtaaattcattcaaagttaaaatgtggagagtgagagaaagagagtcgcgtggctattgggtaatgagaaacgattggacccatttggtatcattcggaagtgatatgtggcagagggcaatcatacgttttcgtcatagcgttagattttcttacagtttcttagagattatttcgattgtttgtgtcaaacgagtttagtatgttactgctattgaacagtagtattttctcatgtatcgatatgaatacgtttactctttttctttttttcacacaatcagatgaatatagggatgaatatacgtagttttgtctttgtcatatactagattatattcccaccagtcattttcctatgtatttaacaagacaagacgtagaaaaatgagaattttagtacttgagttaacatatttaaagattatattcccatcagtcattgaacatatgtgtacatatatatacgaggagaatctataacttagtaaggagggaaatatgagattttatttctatagagaaaagaaaggataaaacctctctctgccaacactggccaccgtctccaaagtccatcccagttaatttttattttttggaatcttcttatgttattactctttcttttcttatgacaacatgtcaacatgtgacctgtcgtcttctactttcttttcttcagcttttctccttttaagcagaatattcaatctatcttcaaattcatatctgagttttgtactataaaagaaaagcagacattaaaaaagatttgaatataaaacaaatgtattggagtggtaaagcacatcttcatcaaacatttttaaggagcatcaatctaattggtcgatggaaatggaagtaaaggaatagaagattgtttgtgttccatgatgatgtatatatatgcctaattaatgttactgttagttacctttggataacaaagatatttaaagcggtttaatgcttattaacggttgatggatgttaccttttctttttgacatcacggtagatgttacctttcataggtgttgaatagacagattggggacgttaattagtaatgatgtaattagttagagctaaatagtgctaataaatatatgtaagaaattgttcggaaagtaactaaaaaaagttcaattcatgcaagtagacacttcaaatgtgataaatgtataagtatgatgttaagcatgtgacccttgagagtcgattagggcactgtacaagattgacccaaatagttacaaactacaagtgaactctcttccattacatatctacgtgtattgaggggaccattatcgtacgtatacacgtatatatgttttgccctaaattcccaattttaattcagcatgggggacggactcattcaatagcatcgtctttcactttccttcttcggtttaaaatctcattttagtttctgatccaaaaaaaaatgtttgatcaaagatcaaaaacttagatagaaacaaactgtttttttttcttaaatcaagaaagtctaaaaaactaagatacaaaaagggactcgcagcggcagagagataagtatcttacgggccagcagataatttctatgttacgtccctttcatccccattgcatattgcatatgaagacaacggatattaactaaaatcttccaaaattacggtataatgaataataatacacttctgtctcatatagtattctattatattgttcgaaaatgttcttatttacatatctatttatattgttaattgattgcggctattactgtggatattcatcgtaactattttaatcaatacaaatcatgcaaaatagtgaatgacttagaaaagttgaaaccacatatgattgagtttagggggaaaagtataaaagaaagcatgactagtatgttactatgtagtaagcttcaaacatatatttaagaaaatactatatatagatacatatgatataacataacattaaaatatatggtgaaacattttttcttaatatcctaagcttcaaacatatacccaagtagagaagagttggagtattcattctttggttaaacatagacctaatacatagctcatatggacaatttttcgacaaaacaaaaatgatagcaaatgggctaaaatggtttcatatcgaaaagcccaaaccattaagccaaaacgacgtcgtacgatatgacagcggcgattcctataaccaccaccagaggttaaaaagtctctctctttagctatcttttttgtgttaccggttcaaatg

SEQ ID NO: 29040 - DNA, 3003 bp, Unknown; identical to SEQ ID NO: 29039
  misc_feature (1)..( 3003): 2750-1469P.txt file - cDNA_ID_2999616; gDNA_ID_2926188; Annot_ID_140886

SEQ ID NO: 29041 - DNA, 3003 bp, Unknown
  misc_feature (1)..( 3003): 2750-1469P.txt file - cDNA_ID_2999634; gDNA_ID_1620666; Annot_ID_48054
cgaggaagaaatggaacagtgaagagacgtctcccaaggcaacggctaaagtcttcaggaagcttcttatgttcggaaggaaaaagtaaaaccgacgttggaattcttcttctccggcatcatcgaacctttgttttgagacgacgtcatgttgagttcagttaaaaagcctctcttattctttaaatttttccttgtgtgatattaaatactgtttttcattttattgttgttatcagtttgatttgtctgtttatattacatttgttgatgtgttgtttatagcattgaaagtgggcatttgagtgtgtataaaaaattggtttggtgagttgaataatgtaagaatcttttgtatttttctaattaaactgtttatgatcattaggagaacaatatatggggatgtgttggaatcatgaatcgtaggttaaatcctacaagaggaaaagcttcaggagacagagaagatgaagagaagagaagaaaggaagaagaagaagaagtcgtgacaaagaaagtcagctaatagacatatctccgctatttaaagtcgagtctaagcctttatacacttaaaggttgagggttcgaacccttgttatgtctttttgccctaaaagaaaaaaactttctcatgaaattccgtgagatgattcttccattctaagcatttggttctgttagattgataaagaagtctcctacagtaccaaggcaatgtgccatccatctacaatttgtataactatatcttttggtaacatgttcccatcaagtgggaatctaattcccctgttattcttttcacgttctaagcatttttcaagctgtttaccattttgaaacttagtaacgatcaaaaagaataagggatttcgtcacgtaaattaaatagaatctgtatacaggtcatttaaaaaaatattttagtaagatacacaggcacagctcaacgtctgatcttggtttgtcataaacagcagagaattctaccacaaggaagctctggtactatctttctcattaagcatccgcgactacaatattccccaatttattaaataaacttttccatgatgcaaaagtaccttttattaaacactacgaataaataaataaaggtgaaacacccatttcaaagaaatggtaacgtgtctttttcattaggcgagactagccaatctaagcaaacagagtcgtctttatatctaaacgaacattttgtgaaagaaagagagactaaggtgaatccatggcgtccaagattgtctcagccatagtatttgtgtttaacctcattgcctttggtttagccgttgctgctgaacaaagaagaagcactgtgagtcacatctccacagcgatatctaatttgaacaagatgataattatgtgatctatcttaatattttggagttaaatattttttggtggggcaggcaagggttgtgcaggacactgaggtgcaatataactactgtgtgtatgactcggacagagctacagggtatggagttggagcctttttgttctcagtggctagtcaaatccttatcatgctcgttagccgttgcttctgttgtggaaagcctctcaagcctggcggttcacgcgctcttgccctcattctcttcattgttagctggtttgttattataactcaattagtacatcacatatatatccctagcttaagctagcttagacatatctggcgtttttatttcgttcaaagatgattcaaaactcacaatcaaacatttacaatagatcttagtttatagaactagaattatcattaatctatcatggtatcaaaatcgcagtaaatcttattatcagcttacacattttcattctcttttcaatgcacagttaataattcaaatctaacatgcgtctcttaatccgttatgaagctaaacgtgcttattaaacaaccgacattgtgctaatatttttacaacttgaatgttgttttgttggcgaaaaaaaggatgttcttcttgatagcggagatatgtctattagctggatcggtagagaatgcataccacacaaagtacaggacaatgttcatggacaatcctcctgattgtcaaactctacgtaaaggcgtctttgcagcaggcgcctcattcgtcttcttcaacgccattgtctctcagttctactatttcttctatttctctgctgctgaggcctctctttcaccttactagaggttcttaaccaacaaataagttttattttttttctctctaaatgtgctatttgatatgctaatatcatattttgaggtgggttttctatgtacaactatgatgaaatgttacaactatgacaaaattatttgaaagtgatggtacacatgagatttgtagatttatttgtatggttattagatcgagttgaaatgttgttttaaaaagagtggatgtaatttgacgattttgtgacatatgacataatgctcttattcattgaataaggtttgagctattctcgtgaatgcgtaaattcaaattcgtataatgcatacttttgacagagtaacaattgtttattactggagaaacttatccaaacatgagaacgtccataacaactagtagcaagcaactagctctatctatctccttctcccatgccaaagggtatggaatcccatcaacaccaatcagcaatcaccatccctttattgcaactgttccatttgttaacccaaaaaaatagtttaaagacattaaaataaaatatctaaggagaaggaaatctaattctcaaattctcattggatattaaacgacgacgtggcagatacttagttcaagataatgctatccacacatcttcggtgacctctgtggggaccaatcttcctttgtccgaatatctcatttgctagtacataaacgcacatactctctttcgcaaaatatccactacgatagttttcttcagcaatcacactctctctttgttcgagtaccaacaatg

SEQ ID NO: 29042 - DNA, 3003 bp, Unknown; identical to SEQ ID NO: 29041
  misc_feature (1)..( 3003): 2750-1469P.txt file - cDNA_ID_2999634; gDNA_ID_1620666; Annot_ID_163946

SEQ ID NO: 29043 - DNA, 3003 bp, Unknown; identical to SEQ ID NO: 29041
  misc_feature (1)..( 3003): 2750-1469P.txt file - cDNA_ID_2999634; gDNA_ID_2926191; Annot_ID_141028

SEQ ID NO: 29044 - DNA, 3003 bp, Unknown; identical to SEQ ID NO: 29041
  misc_feature (1)..( 3003): 2750-1469P.txt file - cDNA_ID_2999634; gDNA_ID_2926191; Annot_ID_201030

SEQ ID NO: 29045 - DNA, 3000 bp, Unknown; identical to SEQ ID NO: 4636
  misc_feature (1)..( 3000): 2750-1469P.txt file - cDNA_ID_2999638; gDNA_ID_2926191; Annot_ID_141061

SEQ ID NO: 29046 - DNA, 3000 bp, Unknown; identical to SEQ ID NO: 4636
  misc_feature (1)..( 3000): 2750-1469P.txt file - cDNA_ID_2999638; gDNA_ID_2926191; Annot_ID_201071

SEQ ID NO: 29047 - DNA, 3000 bp, Unknown
  misc_feature (1)..( 3000): 2750-1469P.txt file - cDNA_ID_2999659; gDNA_ID_2926192; Annot_ID_141104
aaattcttcaccagaaaagatcacttacctaaaataagactacacaagacgctacaggtaatcacagcttcgattggatctggaaattcagatgcaaaggaaaaacaaacggaggaactactaaagggaagaggaagagtcgaatcaacagagtttacttccacatattcgaggcgtattcggaacaggacttgtaggagatggtttcatacgaacaccggcaaaaaggtcaacgcgagacatggaacgatgaagatggagagaagaacgcgagtccaacgccgccaacatttccatgtatttcacgcggaactcgcgagcacaaatttctctctgaggaattcgaattgaccggagaacggagaagaaacgacggagactttgttttgtacagagcggtggtttcttgttaaaagaagaaagaacgaaaatggtttaaccgaaattgaagaaaagcttgtctcctctttttactcgtggaaattaattcttgtatttaaagtattcacggaaagcatgtgtgtatcaattattaaccgttggattttagatggacggtggagatctactttttagttttatttttgtcgtctagtttctttttattattggtgtgagattcgaattttctgaaaagagataccatgtcccgctgggatggataaacttcaacattagtttattttgttaagaattaaatgagaaacttattcctcattattttatttcgactccttagctttttatatctttcgatattcaacccctaactttagttatattcttcatttgaccacacatcttgtattgattgacacaggcaaccttgtttttgttgtgtaggcctaagttcatggctacagaacataattcttgaagattaaaatgctaatggtgttcacaaggaggagtttaacattttctaatcttttttgttacctttcaaatagaaatctcatatactaggataagtatacatatttcagtaatcatataacaaatatttaccgctgaagtcatcaaacttatatatctgtgttagtgtgtgtagtagataaagctacatatttgcaacctgatcattggctgttgttgcttgctgtgagaatattggttcaagtccatctggtttagtattcgtttctggtttaaagagctaaccgagtggagctaaaactactaaactaggttacaatttgggctgaaatagattgttaggcccaaacagagaagagcccaggtgagaaattttaacggcttgtaacagaccacaacgagaaatgaagcagagtattgtcttcatttcaagtttcaaccttcgttttgattcttactataatatctatgacaagaaatctgtctcttagtaagctcaaggaaatactcattatgaagagacaggagtataggatcaatcctgataatggtgaagctcatcaacgatttgttacctctttaataactatgtgaaactaagttctactacatgatttcgtttattattttgaaatcaaagactaacgcaaaatgttgaattgtataaagtcaatatctggtgtaaattggaagaagggtagagagggtttggtgggatcaagaatgatctgattctgatgtgaacaagataagattcgaatgtttttaaaacccacctaattaattagcattcatttatttcatgtgaatcagctgtgtcattctctatggagtatacattttgactttaacaccactctttcacattctattatcgtctaattatacaacgtatacggaacaatgaaaatctaccaaaatgacgaatcgtttctgcaattttttgtagtatccaatgattgaattttttttataagatgacgatgaatgtgaaatcttgaagtgaaaaatttgcaagcactattaatttgggtgcatacaccaaacaaatcagtcatgtctatttatatatttttgtcactactctttaaataccactatgtccctctatataatcatctataataaaaccgtaattgacgctagaaaaatctcttttattttaattctttttccatggctttaagaaagcaacgttaaagaaaagtagggttgtataatacaaagtagaaagtagtagtcatgtgcattgtgataaaacaatcaaatcgtggatccacttttattaattagattcgagcctgagtgaccaatagttactatctcttgccccaccaaagttagtaataacaaaaatataaacctaatttgtcattagaaagctctaggtggttgttcgttacatcatacaaaccagcgcaaaaaccgttaacattatcatatctatgtattttttagaacgaaatgattgatgcgttgtgcacacgagattggtcactaagatttcgtttgcgtaacatatccactcctctctattcatagactatactctatacatactgataacatacaaacagttatattgaaatgcatttaaagtatttgttctcttatctataagaaaacaaactaacttgatatcaataaatgaaaaaacatatatcgtgaagaaatctgtatcggaaaaaaaaaacagaaattaaaggattgagtcaggtatctcttaacggattcctcttctctaccacagaatctgcgggaaatttcaacggtcgaatctcataaattactaaagtacccttttaggtccctctgacaatgacacgctggatcgtgcgaaatcgacgccttaactgtcggtgggtcctaatttctagtggcatttcaccgtaaataagaccaatggcaaagggactaaaccggcaaatagaactttagaaaacaaaaagagaaaccacagaaagcagtttgcttctaccttttatttttgtctatataacaacaacaacattgacatatcaattcacacataaactcactctcactctctcactgtcggcaaactaacttattcacttttccggcactgattctgctcgggaaaaacaactccggcacaaaatg

SEQ ID NO: 29048 - DNA, 3003 bp, Unknown
  misc_feature (1)..( 3003): 2750-1469P.txt file - cDNA_ID_2999662; gDNA_ID_2926192; Annot_ID_141105
atatgtcaatgttgttgttgttatatagacaaaaataaaaggtagaagcaaactgctttctgtggtttctctttttgttttctaaagttctatttgccggtttagtccctttgccattggtcttatttacggtgaaatgccactagaaattaggacccaccgacagttaaggcgtcgatttcgcacgatccagcgtgtcattgtcagagggacctaaaagggtactttagtaatttatgagattcgaccgttgaaatttcccgcagattctgtggtagagaagaggaatccgttaagagatacctgactcaatcctttaatttctgttttttttttccgatacagatttcttcacgatatatgttttttcatttattgatatcaagttagtttgttttcttatagataagagaacaaatactttaaatgcatttcaatataactgtttgtatgttatcagtatgtatagagtatagtctatgaatagagaggagtggatatgttacgcaaacgaaatcttagtgaccaatctcgtgtgcacaacgcatcaatcatttcgttctaaaaaatacatagatatgataatgttaacggtttttgcgctggtttgtatgatgtaacgaacaaccacctagagctttctaatgacaaattaggtttatatttttgttattactaactttggtggggcaagagatagtaactattggtcactcaggctcgaatctaattaataaaagtggatccacgatttgattgttttatcacaatgcacatgactactactttctactttgtattatacaaccctacttttctttaacgttgctttcttaaagccatggaaaaagaattaaaataaaagagatttttctagcgtcaattacggttttattatagatgattatatagagggacatagtggtatttaaagagtagtgacaaaaatatataaatagacatgactgatttgtttggtgtatgcacccaaattaatagtgcttgcaaatttttcacttcaagatttcacattcatcgtcatcttataaaaaaaattcaatcattggatactacaaaaaattgcagaaacgattcgtcattttggtagattttcattgttccgtatacgttgtataattagacgataatagaatgtgaaagagtggtgttaaagtcaaaatgtatactccatagagaatgacacagctgattcacatgaaataaatgaatgctaattaattaggtgggttttaaaaacattcgaatcttatcttgttcacatcagaatcagatcattcttgatcccaccaaaccctctctacccttcttccaatttacaccagatattgactttatacaattcaacattttgcgttagtctttgatttcaaaataataaacgaaatcatgtagtagaacttagtttcacatagttattaaagaggtaacaaatcgttgatgagcttcaccattatcaggattgatcctatactcctgtctcttcataatgagtatttccttgagcttactaagagacagatttcttgtcatagatattatagtaagaatcaaaacgaaggttgaaacttgaaatgaagacaatactctgcttcatttctcgttgtggtctgttacaagccgttaaaatttctcacctgggctcttctctgtttgggcctaacaatctatttcagcccaaattgtaacctagtttagtagttttagctccactcggttagctctttaaaccagaaacgaatactaaaccagatggacttgaaccaatattctcacagcaagcaacaacagccaatgatcaggttgcaaatatgtagctttatctactacacacactaacacagatatataagtttgatgacttcagcggtaaatatttgttatatgattactgaaatatgtatacttatcctagtatatgagatttctatttgaaaggtaacaaaaaagattagaaaatgttaaactcctccttgtgaacaccattagcattttaatcttcaagaattatgttctgtagccatgaacttaggcctacacaacaaaaacaaggttgcctgtgtcaatcaatacaagatgtgtggtcaaatgaagaatataactaaagttaggggttgaatatcgaaagatataaaaagctaaggagtcgaaataaaataatgaggaataagtttctcatttaattcttaacaaaataaactaatgttgaagtttatccatcccagcgggacatggtatctcttttcagaaaattcgaatctcacaccaataataaaaagaaactagacgacaaaaataaaactaaaaagtagatctccaccgtccatctaaaatccaacggttaataattgatacacacatgctttccgtgaatactttaaatacaagaattaatttccacgagtaaaaagaggagacaagcttttcttcaatttcggttaaaccattttcgttctttcttcttttaacaagaaaccaccgctctgtacaaaacaaagtctccgtcgtttcttctccgttctccggtcaattcgaattcctcagagagaaatttgtgctcgcgagttccgcgtgaaatacatggaaatgttggcggcgttggactcgcgttcttctctccatcttcatcgttccatgtctcgcgttgacctttttgccggtgttcgtatgaaaccatctcctacaagtcctgttccgaatacgcctcgaatatgtggaagtaaactctgttgattcgactcttcctcttccctttagtagttcctccgtttgtttttcctttgcatctgaatttccagatccaatcgaagctgtgattacctgtagcgtcttgtgtagtcttattttaggtaagtgatcttttctggtgaagaatttagaagattgtgtttgtactctgaaacttcttaggattgtggaattgggggttttcttttagggtttgttgagtcgtgaagttgtttgtgtctgttggatctctgaatg

SEQ ID NO: 29049 - DNA, 3003 bp, Unknown
  misc_feature (1)..( 3003): 2750-1469P.txt file - cDNA_ID_2999666; gDNA_ID_2926192; Annot_ID_141109
gaaacatgaacctcataaatcatgcctcttgtcttggtggtacactttaagccgaagttacaatagtgatgtgaaagaaagaaaaaaaacgaaacttaaaatcagtaaatctttgtagttaatcaaatggggtaaacaataagaacccttacaaatcagaacaatgcaaatgttatcggtgagcagtaacaagcgtctcgatgaatcgtaacccatcaaaccttggagcaaacttctcatctcccccatcttccgacgaacccttcttcttcctctgtttttcctttgcctcctaaccacaatcagcagctaaaaattattctttacacatccgaatccatgtaaaagttaaaaactctccaactttgtaatttgataaatttttgactatgagaaacttattgtgagtacttgaaacagaggaggaactttaaatgctaccgagaaacaaataaacaagagcttgattcttctttttttacctgacgagagagattagattccggcgaagagaatgacacggaggtgttggtagagccggcggagatcgccgtggcagaagccgcgacagagatggaggctgcgatgattccagttttcttcatgtcttgatcttaaactttcccaaattcgtggactctgtttatacttttttttgtttttctgtgttaataaaataaaatctgcaaccgtaggcagatgagagaaaaatgtgggaaaaattgaggtgttggcttcgatagtcgacggtttatatacgcaatggggacaaaagttaaattacgctagttgaccaatttatgtatcgataaagtatgttaccgttttacccttttctaaataccttaagcatgatttaattgcgttaattacagctaagatcattggtaaacgtttttgaatagaatgatttatcttctagaagaatttaattggagtaagaatgggtagcgtgaaaaataagggggttagtatggtcaaagcattagaaaaaaagaaatgtactttgagccttgaagtcagaaccacacaaagagaaacatgattggttgatctgttaaatgaaaatgggtccatcgttggttggtaagtaacccacgtgtccggacaatgttgcaactatgagttggtgttttgagaatgttaaaagtcagctttgtattggacgattatgcccctcttatttctcgtttattactgttggtattgtatgctcataagataaggttcaagaaaagaaatgttcataagataaggtcgaaacactaaatgacgggtgaacaatggcattgaacaagtggatctgattatttgtctttgagagcatatctcaaatgcaaattgatgtaaactgatttgtggataccaaacctaacaagtcccatatggttttctggtgagatttctctgcgtcaaatttaatgttgaacacatttattctttgataaagacatcacaatctcgttaagttttaatactcgtctctatatattttacgtccggtcactatttatgaaaaaaacagagtagtagaataagttattaacacatgatcgtacaaaagcatcttatggtgacgtataggatcataatgatatgattaataaagttttgattaaagatgtatggatacaaatgaaagaaaaaagtttgcggctatatctctttagggatgggttcttaataattaaaattacttttgaaggactttatcgtttgcgcaatctcataatcatgtccacatatctctactttttcaccggccaaaacttattcggtccatatccgtatcttaacgtgaattattgatcatgccgcaagaccaacaagcccacaacttattttactcttacatgtgtaaaacaattaacaaccacagtgattgtggacaggagaagatgaaacaactcaatgtaagtaacccaacacaaccggtcaatcggtcattcttgtgaactggtttcattacaagaacgtgtaccaactatctctaagcaaacatgcagaggctatgatatcatacatcatatatcaacaagttaccaaaaaaaacactcgtacagtcgtactcttgatgtaacttccaaataatttttatatataaccggttcatgtttctggtacatgctgacaactacaatatgttcttcatacaagtttagctgaccaatgtgactacagatcccaaaaactagcagcagtaagatggttggattataacacaagaccaagatcaaagcccttccaatttctcaagaactcacatatcactcactcctcaagaagaacaatttactaacttgagatccctcgtatcttaagaaaacaccttagggaagaaacaatatcagcgttgagaacctggtttcctccacaatgcatttggcacacatcggaactatggattcaaagagcaccaaaacgagtctatatctctcagttttatgccaatgccaacagagctcaaatggcacccataaaaacatcaaaacagtcttctttatagataataagaatataagatatctagcctagcaaaaagatcgaaactttgggtttcccccttcgttacctcaatcctcaataaaaaaaaattccaatgaaacgaagtgaacgaacgacgtcgttctattttttaggttgcaaataattgaaaacaaataaacgggacaaattcacaagtaatcaatatatttagggacgaaattacaaatatttaatagaaaaacaagagtttggctgtttcctccttctttcatccttatcacaagtctgaactaaaaaacctcaattgtaataaacaaattaaaaagcaaaaatataataaagagaaaacaaacgtttttttcctgcttgcttctctctttgcttgcgttttctcaaaggttcgaagaaaacgaagaaccacgcttttgcttttttcccaagacttaatctaaaaagcgagatttccttctttcgattcttttttctcaatctggttttcagtcttcggattcaatg

SEQ ID NO: 29050 - DNA, 3000 bp, Unknown
  misc_feature (1)..( 3000): 2750-1469P.txt file - cDNA_ID_2999670; gDNA_ID_2926192; Annot_ID_141111
ccagacacagaatcataagatcagatctggtgttctcaaatatggcggataaggaagaaccagagacgatgacctcgtacaagttgtttttgagagttataagcaagagaagaacatgggcctgtctgtttcttgtagtctacgcgatcctattgtcttcttcatggaattcgttgaattcaatagttaattggtacggagagaatcatcagacatcatctggtttgcctgcgatttacgcgtcggtgcttcttggtgcggtgttcggagttttatctatggcggcggcgctgttcatagccgtgcctgcgatcgtggtgatctggatatcagtggtggtgacgatggcgttcgccggaaaatctaggaagagagtggtgattgaaggaaggaaagtgacgaaagagatcgctggttttgtgtttagggttcttcttaaagaaggaaactttgtggctcttctttgtgctcttcttgcttacttcgtcttctttaactcttactcttcatcttcttgattcgtttttttgaattcttgtcattaacgaaaacattcacagctagtatattgaaatctttcctcattattatttgtactttagtttaacaagatttgatttcttgaatctgaaaatatcgatcttctttgttggattgatgtgttttctgatgatgtcagagagaatgcttccacgtcacaataccgacacgtgaagtaatttacattacttttgtttatttatttgagagaacacagattcttcttttggtctctttgtttgtcggtcattctctgtctctgtccatggaagagcttctgaaacctgaactataatatgggttagaaggcccattggggcttacgggttaccattaatggcccattttatcgtatatagtggagaactgttttagtgacaacgtattaaatacagtatctactaggccagacgataaattgtgtttgaaggaggaagtgcatgtgattaggtatggtccaagctgaagttggttagtaaaaagcttaaaagatgataagttgcaccaatttttcataatgtagcaataataacaagtgtaagaagatgctcaatccaagtcaatgcatagttcatacgataattctttttttgataaaagttcatacgataattcaaagatataattatgaatatttgacaaaatatgtacatacattcaatgctctggatccttcatgagtaaatcgatcctcaatgctcttgaatctttatccacaatgagtaattctcaaaaatctgttagtattgttactttgatttggtttgctttgtcttcaaatattatcgaatgccattggttggtggtagtaaatcatgacatggccttcaaaagaataattggtctgtttgaatgtttctcctttagatatactaatactatataataattaaatgattatggtccaaaattagcagtaaggctgcttttatctctctttttttttcctttacactaatttgattgcaaaactagatggctaatacataactttacactttgcattacaaaaaatagctagcaaaatatccaaaaaaatttaatactgtacattgttccttagtattattaaaatgactctttgggtgttaactgttaataaaagcagtcaccgacagcattcaaagtattttacttctgtcttctatttatttattattgtatttaccacacacacgcatcaagttttctaatgtcgacagagaaaatagatagtactgttaccctatattctaagaacttaacaaaacattagaaaaatacaaaagcggagacgactgtgatgaacaggttcacataatttagcattgtaatttatacaattttgactaaacaacaaggataaaaagaatcttaccacaaatgtaattgtcaagcctatctatgctcttttatcatcataaacaacgtggagaacacctcaaaagtgattttcaagagaacaaagaaataaatatgctactgaatatgttgaatttatgcagaagctaaatattttctatgtaaatgtaattatttgatttgttttgtcttctcagaattaacctttgtatgttctaaatgagttgggctcacaattcacatcacatgattgaacaatgaacattttttctcaaatatctgaagttgatgacactccaacgcatgtggccctgtttattttttttcctaagagattcaaatgtattttttttcctgtgatactcatcaaaattaaattccttcttttaaagtttccaacaacatattagtctcttttagttctaaatctaaataccaggttaattcctgtgctttttcctcttctttggtgggtcaagttctgttctttccccttcaaccatttttttatttataaatatccaatttttatgaagatattttataagtaatttcaacttacgaaatagagtgtaaaatcataccttgtgtaatttttttttttttaaaacatcacattatgccttgtcccttttgcaaggtaaaatacaaaagggctatttcaagctattttcttctttcacaaaagaaaattagaattaatagaaaaatattatttttttgtaaaaaaattaatagaaaaatatagtaatttgggtcctttaagtttcagatacagtgaaactaaataactaataaacaactaatataaatacaaagatacatagatctgtgtctgtgattattcaatttcttctgcttgttcgtatctcccttgtttgcttaaagcgttattgagcgagctattttttcaaatctttgctaattttctacaaacgattgatttttccgtctgggttttataaaaggtttgggtttcagagaaattcacggaacaaggcacagactttttcttctgggtgggcaccgactaaaaaaggagctctttctccaattctgggtttgaaatttctgtgtgtgtgtgtgtgaagcagtgaagcaggaggtggcagaagcatg

SEQ ID NO: 29051 - DNA, 3003 bp, Unknown
  misc_feature (1)..( 3003): 2750-1469P.txt file - cDNA_ID_2999678; gDNA_ID_1971713; Annot_ID_175132
tcaaatttccgacgccggaagggacctctccggtgaactcattgaagctgaggtctagcttgagaagctctgtcaagtctccgatggaatcaggggcgtttccgttgataaagttatggctaaagtctagaacttttagattcttcagacgagacgttgcgttcgccggaaacccaccggtcaagctgtttctggagagtgtaatctcctctagactcaccaaatcgccgatttgacccggaattgacccgtgaaacccgttaccggtaagaactaatcttctcagctttgtgaaattaccgatcatggctccgatctcgccgacgagagatgggttttcgatgaacaccaactcttcgagaacagagccgaaatcctccgggactgttaacggcaacgaggcacgagcgtcggtgaagcatttgtagaagaaaagcttacgaaggtgtttgaaagcagtaaagaggagaggatcaagcgtggcattagaagagcaaggagggttttgagtgtaatccgagaggtagcctaaatggaactccgtgacgtgaacagacgttgcgacgccgttttgagaagcgtagaggttatcgcaaacgacgccgtcaggtggtgaagcgcagatgtcgtcggggaagatggttcgccatgagatggctgagttgactgagtcgagaactcggtagaccgcttcttgctccgacgggtctagagcgagttgtggtgacgcattttcgtcgtcgtcgctttgttggctggtgatgagtgtagcggtgaagagaaagaggaggagaagagagaggttagtaaaagacgccatgaaagcagagagagagagcaaaaagcttgcagctttgttttttgtttggattgtttggttttgggtttgttgctaacgagcgatacgtacctttttatgggttcatgcttcgtcatgtcctctttaggtgaaaatacatattaacccctacttgataaaccgagtgatatttaatgaagcttttcattcctataaaattgaaagaaaacacaatttttgttgttgttgcaagggttaaaaatatcagcatttactaattcatgtattttttcttcactattcagtattcacagtcctgtaatttttcaataataaaaaaaaagattcgtagttaaaaacggaaggggtaagatagtaaaaaaacagaaaatggtacaaaagcttcacgttccgtgggtaaaaaacttcaaaggtgaaggaaaaagcaagttgggaccataccggacgaaaatttgcagagagaaagacgacaccatttcgatttttaatgcacattgactaaaaaccacccttttaaacatatcttcttcttttttaacttgatcggcaactttcagagataccatttccaaaaaatttcattcaataaagaaacgtctaataaatacattatgaaattcaaatgtgactactattttgcctcattgataacaatgaatgaataaatgcaacaaaaagctccacaaaatagtatcatcttttatttaatttccacttcactttttgttggggatcaaatattattctcatcaatacgttatagtcaaaataaaagaaaagacaaaagaaaaaaaaaagctgaatagtagtaacagagacagaggagaggagagggggcaaacggcggaggaatcgacaaggacgcgcagtagccgccgaagggaacagtgtctttgtcgtacgaaagcgacggcttaagaagtcttccaatatattatcgacacgtgttaatctcttaccggaaacggcacaggtctcacgcatgccatttctatttccggttcctgcccttcgatgtccctactgtgccagtgtttcagacccttcatttattttttttggtttttacttatctagttattttttagctgtcgctgtttaaattctttgtacgacaaaaaatgtacaatgccttttgcagttgttcttggtcctcgttgttttcctataagtaatcaaaccaaattaatgatttctcttatttcggaaattaaatgtaacgttcttcgaatcaaaacgttcgataaatgactaataaaataatttattcaaaaaaacaaatatgggcctaaatatatcacgcaggcccattatgataatattagaagccgacctcgtcccctctaaaaccctatttgttttgtaaatgatgtgatcgtctctatttatattccggttttgagatttgttaagttgttcctatactttcttttttcagctacgtcgacgcttaattacttgtggactctcctgagcttgttgctatggattcagatacagtctacagagacgcttcatctacccttactttccgatgaggtcgaggatgaggtttggtttcttctctctttgctttactcttattattagatgccagtttcttaaaatctagtggattctttaggttcatgagtcatgaccaaaattattgttgtatagtctttttttgtttttgggtgattcgtgaagttcatgactaaatgatgtgacaaaaaaaaaaaaaaaatcaacaagtttttctcatcaattcctcaaactaatgtcaccatttagacccaatattagtcaaaacagaaattgtttgaatagtaacgatttgctattttcctctttataaaactactctataatccatattaaaaaaatatatataaatcgaagtaaaccttttaacgttggaacataaaaagaaacaaagactttcgagagagaggtagtgaaaactcttttgaagatgtcaaattcttactcgaagacaaaaagatctactactaatctactattatcgtagtcgtacaaatattataactagtgagacccaccagcagaaacaaaacacaaggaagacttcgtgataacgagacttgtctgattcttcaataagctcacggatttctcctcaaaatcctaatccaatcatttctccaattctccaaggagtttggtaatacacaaataacatg

SEQ ID NO: 29052 - DNA, 3003 bp, Unknown; identical to SEQ ID NO: 29051
  misc_feature (1)..( 3003): 2750-1469P.txt file - cDNA_ID_2999678; gDNA_ID_2926193; Annot_ID_141135

SEQ ID NO: 29053 - DNA, 3003 bp, Unknown; identical to SEQ ID NO: 29051
  misc_feature (1)..( 3003): 2750-1469P.txt file - cDNA_ID_2999678; gDNA_ID_2926193; Annot_ID_201214

SEQ ID NO: 29054 - DNA, 3000 bp, Unknown; identical to SEQ ID NO: 8302
  misc_feature (1)..( 3000): 2750-1469P.txt file - cDNA_ID_2999686; gDNA_ID_2926193; Annot_ID_141137

SEQ ID NO: 29055 - DNA, 3000 bp, Unknown
  misc_feature (1)..( 3000): 2750-1469P.txt file - cDNA_ID_2999694; gDNA_ID_2926193; Annot_ID_141139
gagagtttctcaactccaactctgtcgcacttctctttcgtaccgtcttcgctctggttatcatcatcatcatcatcttcaccacagtttcttcaagctcatcaaacgtaactcaattcttgaatctccacctactaatgcatctcatcaatctccatccccgattactcctatggtcaacgcacgcgtcatgttcttctccacttcaacttcagctccacatccagagaaaatcaacaggacgtcgtcggagaatatccttcggatgatttcaagctatctatggatgaaagacaacccaaaactctgtttcagagtcatctctgcttttgcgtgtctcgtgggagctaagttcttgaatgttcaagttcctttcctcttcaaagtagctatagattggctctcttcatcttcattcgttgattcaaacccttacctagttgctgctttcgctactccttcctctgttctcattggttatggcattgctcgatctggttcttctgctttcaacgagcttcgtactagtgttttctccaaagtagctctccgcaccatacgaaccatctctagaaaagttctctcgcgtttacacgatctcgatcttcgttaccatctaaatagagacacaggtgctttgaacagaatcattgatcgtggaagccgcgctataaacacgattctctcagctatggttttcaacattatgcccacgatcttggagatatcaatggtctcatgtatattagcatacaaatttggagctgtttatgcattgattacttgtctttctgttggatcatatatagcattcacgttggctatgacgcagtggagaatcaagattagaaaagctatgaatgaagctgaaaacgatgctagcaccagagccattgactctctcataaactacgagactgttaagtatttcaacaacgaagattacgaagctcgaaagtacgatcagttacacgaaaattacgaagatgctgcattgcaaagtcggaaaagctttgccttattaaattttggacagagttttatatttagtacagctttgtcaacagcaatggtgttgtgttctcaggggattatgaatggtcagatgacagttggtgatttggtgatggtgaatggtctcctctttcaactgtctcttcctctttactttctcggggttgtttacagcgacaccgttcagggacttgtcgacatgaaatcgatgtttaagtttctagaggagagatctgatatcggagataaagatatagacaggaagctccctcctcttgttctgaaaggtggaagcattagttttgagaatgtacattttagttatctaccggagagaaagattttagatgggatttcatttgaggtaccggcagggaaaagtgtggcgattgtcggtagtagcggaagcggaaaatcgactattcttagaatgatattcaggttctttgatgtagattccggaaatgtaaaaattgatggtcaggatataaaggaagtgagactagagagtcttagaagctccattggagttgtccctcaagatactgtaagttgccattttcactataaattttgctagctcttacattttgttgttatgagtctaaaccggtttttagtatgttagcatatggttacagattggggtttgattattagtactgtatactcttttgtattacaatcacgtttactacataaatcatgaaggaaatgatattgacactgcaaaatgcttcttaattgtaactaaaatctttattttaatatcatggcctttttcatacgttttggtagtttaaaatgtaacatgtcacttttctacaaattgcatgacttcaaagtaacttccatatacaaatttaatatcattatcaggcatatataccaatcataaatattcgtatcattaaccttaattcacatggcaggtgctctttaacgacactatatttcacaacattcactatggaaacctttcagcaacagaggaagaggtgtacaatgcagctcgacgagcagcgattcacgatacgatcatgaaattccctgataaatattcgaccgcggtgggagaaagagggctgatgctgagtggtggagagaaacagagggtggcacttgctcgtgcatttctgaaatcaccagcaatcctattgtgtgacgaagcaacaagtgcactcgacagtaaaaccgaggcagagataatgaaaacgctgaggtcgctagcgagtaacaggacttgcattttcattgcacatagactgaccactgcaatgcaatgtgatgagatattagtaatggagaaaggaaaagtggtggaaaaagggacacacgaagtgttgttggggaaatctggcagatacgctaaattatggacacaacaaaacagtaaattggaggtgtgaattttgtaaaactatgaatcaaaaagccactttgggcctttatatagccttttaagagagtgaaagagcagaaaatatagacaccagaaaaaatttaataaataaaaacgaaaaagatcaagcccaatacacgatcccaattatccaataaacaacgtccacgtagatcccgacaagcgagtcatactcacgcgctgtttcaccgagcgtgaaaaaaacgacggctgatccctttgtttaagacagccaccacctccgaaattaacaagaaggcgaagaaaatcatcaccaccgtcaacttttctcttgcggacaagacgattctccgattatccccaagaggagaatcctcataatcattttctccgattcgattcgtcttccttggtcctggattgcttcatgaatttctaggtgagaattttcgatccttctcctttgccttttggtaatccacagagagatagagacagagaatttatatctttcgagcatagttcggattcgatttggttttgtttttccagcgaagttgatgtttggttggataatgattctctcttgcaggacaacaatg

SEQ ID NO: 29056 - DNA, 3003 bp, Unknown
  misc_feature (1)..( 3003): 2750-1469P.txt file - cDNA_ID_2999702; gDNA_ID_2926193; Annot_ID_141144
ttcgttgtaaccaagaatggcggtttcaagtgaagggagctggccgagaacgcttggtaactcgccggtgagattgtttccggataatccgagaaatctcagcttctgtagattcttgaatgaacttggaagtgacccttgaaagaaattccctcggagatcaagaacttctaaagagactaagttcccgagatcctccgtgagatttccggagagattgttccctgaagcattgaggtgaacaagcccaagtgattcattgctaaatagaaaaagactccctgagaatgaattctggctgatgtcaatagatttcaacggagggattgatttcgggagcagcgactcgaatccgttgcatgatatgttaaacgagacaaggctactcagctggctgatcgaatctgagattttgcctgtgagattcatccccgccaggtcgagcttctcaacattgccatttgagttgcaccgaacaccggtccaattacagtgatcgctggtgtctgaaagcttccagtctttgagaaagttgagaggatccacaagagttgatttcaccgacagcaaaacagagagctcgttgacattgtcgatggaagctaaaacagaggaagtagaaccaatgtaacagtagtaaaggaagagaactattatcttcatcttcatcttcaacttcttcctctgtctcaacagcttcaactgaaacttgactccttagttcattaccaagaacgagactagtgaacatgcaaggaggtggtggaggaagagagtagaataagaagaaactctgtaagtatatgcttgttctgtgtttattatgttatatatatgtgacatataaacacagagatatataaaaatgaatcttggttttatatggatgtagtgatcaaagagtatgtagggttacatgttctaagaaaaaaagaaataaacaagatcttggaagtatttgagaaatttcttaagacattgaacatgtgaagagagaatgtgttttcttcacaattacaactaatccaaaaatgtgttcggtgttttaaaattaattaagtcaactattgatttgctgtatagtgatttgtgaatgtgccatagatagcttaagcttaaactaatactaatataattactattttttatacatacacttggtgtgtggcatagaggtagcttatgcttaacttcattctaattcagcttttgtagaatgtctttatctattttcccacctttttccttttgtgtcttttaacgcttgccttctaaggaagaaaaacaaaaaatataccattagctcttagcaatattcgattacattacatattaatgatgaatcagtgattatattgtaaatctcgtatttaggatatagccaccgaggtgaacgttcgaagcatataagaatgggtgacctgcacatgtgatgaagaagaacagatgatcctattaccctatgctctgcagcatatttaaatatcagataggtccaaataaatttcattattaattaaaatcagcaataatgaagatattcccacgatcgatcttcacgtttcttcttaccccttttgaatttcgaaaagcttctttctatttggttggttaaaaaaaattaagatcgagcccactcatggccattatacgtgaaaacatatttctttagttcaatcatacttaccttgatgcgtaacaaaagtgtgaatactataatgtatgccactgcagagagtgcaggcttgttactgttctttcgtttgcatgattgattagataagaatcttcccatgttacagatttatggcagtgtaatataggtatagtataatattgttgataatataacaaataaaaattaaataaagtggttaattgtatcacttcttgaatgtatcagcaaattgtccctaattaaaatgctactttcttaaacgttcttcagatataaaattctaatttcgtaaactttctacctgatgtctaaaagactaaaagcatgtgtagacgtatacacccaaagtcagtgccaatgcctttaaggtaaagtaaaatggagacggaataaaaaaaacgtacgtcaaacgagagaatataatttttatttttttttcagactgcccaattagcatagcatagtaatttgatatcactaaaaagaatccaaacttgataaataataaccgtgacaaattcaacaccaagatgtttaaaaactcaaacagatatgtatgtatcaagaacgggtcgaggtaaactaactgatcaatttgataaaggataagataagctaaatgctaaatgatttgtgggaaaatggcagagaaatgcacacgcataatattcatcaaaacaattattgtaatactccaacaattacccactcctcttactgatttcatgtttccatccttcttattacagtactaaacacaaactgttgcttcacatgcactcatgtggacctgtcttttatacaattgttttttctttcttattatttgttgtttttagaaaacattccgatccgtagttaagttcttcatttgcttaattatcctttcgatcgttggataaaataccttaaattctacgattactcagtaagtaatttttttttatataattgatagaatacacttttcagttttgaatctttcgactgatcactgatatatacaatatcttaggaaaataaataaatttgatctacaccataaatattataataatcaattattacccaaaagaacaatggatggtttataggagattttatagactatagatcataaagaaataaacacttacaagaggtttgaaggcttaatgggatgcatgtggatcagcacctatagtgacttaatttagtattaatttctgtattatcagagagagaaacctaatcccacaaataagtacctaaactctttgcaaatggtgttttgttgggttatattattaataccatactaattaatatattaacaagtaagtatg

SEQ ID NO: 29057 - DNA, 3003 bp, Unknown; identical to SEQ ID NO: 29056
  misc_feature (1)..( 3003): 2750-1469P.txt file - cDNA_ID_2999702; gDNA_ID_2926193; Annot_ID_201224

SEQ ID NO: 29058 - DNA, 3003 bp, Unknown
  misc_feature (1)..( 3003): 2750-1469P.txt file - cDNA_ID_2999710; gDNA_ID_1620842; Annot_ID_50905
attccagaaactaattaaattcccagaacaaatcaacacaattccacacacgatttctcaaacatagcagctcaatcagaatgcaatcgaatcaggataaaaaaccaaatcgtttgatcattcaaccaaataacaaaacacggtgccgcaaactgaccggaaacgcaagaaaccgcgggaagaaaaaaagacgatcggaagagaattcgatgagagatagggattgatgaatatatatatatatatattaagagtgttgttgcagagagcgagagggcactgtgataaagagaacaagtgcgtggctacaagacgaagaaggagcccaacaaaattgatcgtgagcttttattttctttctttgggtaacacaaaagagggttggtgcttaggaaaaaaaaaatcataattactgatttgcccctgagggtattttagtcattacaatttctggtccatattgttctgatttcaacaacatgatgaacaaaagaatcgatgacaaggatggataagagagaatgctaatctgatcaacaaagaatctgttcgaaaattcaaagtaaatcattcattctcctctcatgatgatgatacatcaagacatgaagcttgttcttcgattcattgtctgtatttggaccttttctttgttgaactccgggtttatgcaaactcctcgtcgtcatcatcttcttcttcctcgtactcggaatcagattcctcctctctttcaggttgcatcaatgtattcatgtcaaaagaagatggatcagtttctacctcttctatatctattgtgtcgtagctcattctctgttcgaacttctcatctgaacagtttagcatccaagccaatgaacatttgattcccttcttgattatcttcttgtgtctcggctttaccgtggactcaagcccatacgtaaagaatgcggggaaatccacaaggtcttgaagaggtcttttcatttccttttggaagtactcaaagctgagtttcattattccgaggttcaaagccagaacctgaggacacccgattaccatttcccttgtttggtctatcgaaaatccacacttggtaaggaaatcaatgtgctttaacataggagactcgctgagactaacaaactgcggcattctctcgatcaaagagccaagatcctctggatttagatgaatggctgaacaaagtagcttcctctgtgtgtcgagcttaggtttaaggtcgattccgatgatttcaggatactgcgcaattatagaaggaagagatgtttctctgacattgaaatcttgcaggatttgcacgtttggtttcaccgtatcatccaattcaaacccgagtatgtgaggccgcttctctatcaacctagctgcagccagtctcggaataccaagaacctcgagatactccacgagaggcttaattatccgagctacccgcattcccaaaatctcagggtaccgtgttaaaatacccccaatctccctcctagctacacctataccaaccaaataagcgactgatgtgctcatagtcccttccagcttaaaccccaaaacttctggatacctctcaagcacccgaggtacatcactcggtttaatatccagtccttgaagatacttaaccaccggtgcaagatctataacaacgctagagtgaagaacctgcgggtatcttctaagaaactcagtgaaagtcgatttcctgacgcctagtttcccgagataatcaagaaccggaaccatgttcttcttcacgctacaaccaagaacaagagggtaattgttgatatcttcaatggtaagccctaacttgtgaagaaactcgacacgctctttcatcacatcagctgttacagggagttcaaggccatcaagctcatcaggaacaatcccaatcccacgcaagaactcataaaccttagcacgattagcagctttctccttattcatatctaacaaactaggacgactatacaaagacttagaatctcttcccttatccttatctctatccctatcccttcccgaagaagaagaagaacgagaagacctttctcttctcggtgaatccaaagaacgtgaagaaaatctccgatttgcaatagcgcattgaacagttagaccaattccagtcccaggtctcttcttgtggttgcataagttgccataagtggaatcagagagtgaacgagatctaacggcaaaaaaagatggtggctcaaagtgaactagcaaaaacccaggctttgtgaagccattacagaacctaatcttcattctttacctgcacaaaaacggaacaacactaaaatcgacgattatcaacgagaaaatcataccaattcggactaacccagacaattttacagtacaattagctcagaaaactccgaaaaaataccatcattcatgttcatgttaacatcaacgaaccaaaaaaccataacctaactagaagcaaaccacagaaactatggaataaggagaattggaccagcgtgtgattgaaatctcaccggagctgaggaaagatatcggagaagacgagggttttagaggagcgggtaaggttttttcctcatcacacaacaaagtcactctctttctccattgaaatgatttatccgaattattgacgttctcccccttatttcttatatttcccattattgccctatactatctgaaattatcacattaaaccaatacgtatatgattactttggatgtgatataaattaataaaaaaactatatatcatcaaaactttctcttaatatttctaaaattaattaattccctccttttatcttcaacattggattatcgaaaatgaaaaatagtattttctgactcttttttatagtatcgggtttaattcagaaatatataaagctttggggtctgtttcgaagtatctttactcttttaacagttctgagacttctaaagagaggaaaattagttcgtcgaagcatcgagaaaatg

SEQ ID NO: 29059 - DNA, 3003 bp, Unknown; identical to SEQ ID NO: 29058
  misc_feature (1)..( 3003): 2750-1469P.txt file - cDNA_ID_2999710; gDNA_ID_1620842; Annot_ID_170085

SEQ ID NO: 29060 - DNA, 3000 bp, Unknown
  misc_feature (1)..( 3000): 2750-1469P.txt file - cDNA_ID_2999710; gDNA_ID_2926194; Annot_ID_141202
ccagaaactaattaaattcccagaacaaatcaacacaattccacacacgatttctcaaacatagcagctcaatcagaatgcaatcgaatcaggataaaaaaccaaatcgtttgatcattcaaccaaataacaaaacacggtgccgcaaactgaccggaaacgcaagaaaccgcgggaagaaaaaaagacgatcggaagagaattcgatgagagatagggattgatgaatatatatatatatatattaagagtgttgttgcagagagcgagagggcactgtgataaagagaacaagtgcgtggctacaagacgaagaaggagcccaacaaaattgatcgtgagcttttattttctttctttgggtaacacaaaagagggttggtgcttaggaaaaaaaaaatcataattactgatttgcccctgagggtattttagtcattacaatttctggtccatattgttctgatttcaacaacatgatgaacaaaagaatcgatgacaaggatggataagagagaatgctaatctgatcaacaaagaatctgttcgaaaattcaaagtaaatcattcattctcctctcatgatgatgatacatcaagacatgaagcttgttcttcgattcattgtctgtatttggaccttttctttgttgaactccgggtttatgcaaactcctcgtcgtcatcatcttcttcttcctcgtactcggaatcagattcctcctctctttcaggttgcatcaatgtattcatgtcaaaagaagatggatcagtttctacctcttctatatctattgtgtcgtagctcattctctgttcgaacttctcatctgaacagtttagcatccaagccaatgaacatttgattcccttcttgattatcttcttgtgtctcggctttaccgtggactcaagcccatacgtaaagaatgcggggaaatccacaaggtcttgaagaggtcttttcatttccttttggaagtactcaaagctgagtttcattattccgaggttcaaagccagaacctgaggacacccgattaccatttcccttgtttggtctatcgaaaatccacacttggtaaggaaatcaatgtgctttaacataggagactcgctgagactaacaaactgcggcattctctcgatcaaagagccaagatcctctggatttagatgaatggctgaacaaagtagcttcctctgtgtgtcgagcttaggtttaaggtcgattccgatgatttcaggatactgcgcaattatagaaggaagagatgtttctctgacattgaaatcttgcaggatttgcacgtttggtttcaccgtatcatccaattcaaacccgagtatgtgaggccgcttctctatcaacctagctgcagccagtctcggaataccaagaacctcgagatactccacgagaggcttaattatccgagctacccgcattcccaaaatctcagggtaccgtgttaaaatacccccaatctccctcctagctacacctataccaaccaaataagcgactgatgtgctcatagtcccttccagcttaaaccccaaaacttctggatacctctcaagcacccgaggtacatcactcggtttaatatccagtccttgaagatacttaaccaccggtgcaagatctataacaacgctagagtgaagaacctgcgggtatcttctaagaaactcagtgaaagtcgatttcctgacgcctagtttcccgagataatcaagaaccggaaccatgttcttcttcacgctacaaccaagaacaagagggtaattgttgatatcttcaatggtaagccctaacttgtgaagaaactcgacacgctctttcatcacatcagctgttacagggagttcaaggccatcaagctcatcaggaacaatcccaatcccacgcaagaactcataaaccttagcacgattagcagctttctccttattcatatctaacaaactaggacgactatacaaagacttagaatctcttcccttatccttatctctatccctatcccttcccgaagaagaagaagaacgagaagacctttctcttctcggtgaatccaaagaacgtgaagaaaatctccgatttgcaatagcgcattgaacagttagaccaattccagtcccaggtctcttcttgtggttgcataagttgccataagtggaatcagagagtgaacgagatctaacggcaaaaaaagatggtggctcaaagtgaactagcaaaaacccaggctttgtgaagccattacagaacctaatcttcattctttacctgcacaaaaacggaacaacactaaaatcgacgattatcaacgagaaaatcataccaattcggactaacccagacaattttacagtacaattagctcagaaaactccgaaaaaataccatcattcatgttcatgttaacatcaacgaaccaaaaaaccataacctaactagaagcaaaccacagaaactatggaataaggagaattggaccagcgtgtgattgaaatctcaccggagctgaggaaagatatcggagaagacgagggttttagaggagcgggtaaggttttttcctcatcacacaacaaagtcactctctttctccattgaaatgatttatccgaattattgacgttctcccccttatttcttatatttcccattattgccctatactatctgaaattatcacattaaaccaatacgtatatgattactttggatgtgatataaattaataaaaaaactatatatcatcaaaactttctcttaatatttctaaaattaattaattccctccttttatcttcaacattggattatcgaaaatgaaaaatagtattttctgactcttttttatagtatcgggtttaattcagaaatatataaagctttggggtctgtttcgaagtatctttactcttttaacagttctgagacttctaaagagaggaaaattagttcgtcgaagcatcgagaaaatg

SEQ ID NO: 29061 - DNA, 3003 bp, Unknown
  misc_feature (1)..( 3003): 2750-1469P.txt file - cDNA_ID_2999714; gDNA_ID_1620660; Annot_ID_47945
agagaaactaaaatcactcccaaaaagtctcagccaaaatattcgagaccgtgtcttgcaggtaacttatgatgaactgagtcaagtgcaaaaggatgcgtttcttgacatagcttgtttcagatcccatgatttggtttatgtaaagagcttactggattcatctggtcccgccttttctaaagcgacagttacaatagacgctctcaaagacatgttcatgatttacatttctgatagtcgagtggagatgcatgatcttttgtatacgtttgccatggaacttggtccagaagccagggatgacgatggaagagggagacaccggatatggcatcatcacaaccaagataataaaggcaggctcaataggctgctaaaaagaccagtgagactacattcccaaaacacttgcacttattggtccagctagagctttcatttacttatcttcttctctttgttgacattgtggtgtatacagggaggcagcaccagtgtgagaagttttttcctcgatatgtatgtcatgaagacggacgtgaccttaggcactgattacctcaagaacatgcgaaatctccggtacctcaagttttacagttctcattgtcctcaggaatgtacgcctaaggaaaacatacacatccctggagaacttgagcttccacttgaagaggtccgatgtttgcattggctaaatttccccaaagatgaacttccacaagatttcatccccaagaatctcgtagatcttaagctcccttacagtaagattagacagatttggagagaagagaaggtgcgtatctagataaaaaacttgattgcttcgttgtttttggcccaacatagtaagttcatggcttaaactaacttaagtcgctggatcctttccatcacaggatgcaccaaaactaaggtgggtcgatctcaatcactcaagtaagttggaaaacttgtcagggctatcacaggctctaaatcttgaaagattgaaccttgaaggttgcacagcactgaaaacgttgcttctgggtccggaaaatatggcaagtcttgttttcctgaatttgaaagggtgcacgggtcttgagtctcttcccaagattaatttgagatctctgaagactctcatcctcagcaactgttcaaacttggaggagttttgggtgatttcagaaactttatatacgctatatttggatggcactgcaataaaaacacttcctcaagacatggtaaagctaacaagcctcgtcaaattatacatgaaagactgcgagatgctcgttaagcttcccgaagaatttgacaagctgaaagttctgcaagaactagtatgctctggttgtaaaagactcagtagtctcccagatgtgatgaagaacatgcaatgcttgcagattttactgcttgatggaacagcaataacaaagattcctcatatatcctcacttgagcgtctatgcttaagcagaaacgagaagatcagttgtctttcgaatgatattcgtctgctttctcaactgaaatggctggacttgaagtactgtacgaaacttgtgtctattccagagcttccaacaaatcttcagtgcttagatgcaaacggatgtgaatcattaacaacagttgcgaatccactggctactcatttgccaacggagcagattcattccacattcattttcacaaactgcgacaaattagaccgtactgcaaaggaggtaatcacaacctatgctcaaaggaaatgtcaaatgctatcagatgcactaaaacgctggaatgaggtgatctctctcactatctcctcattcatttatcgctctcaagtaaccatatgaacctttaacttttgtatgactttttctgcagggttttgttccagaggctttgttcagcacttgcttccctgggtgtgaagtaccttcatggttttgtcatgaagcagttggatccgtcttaaagctcaacctgctcccacattggaacgaaaataggtttgtcggaatagctttatgtgctgttgtgggatccttaccaaattgccaagaacaaaccaactcttgttcagtgacatgcacgtttaacatagcaagtaaagattccaagaaaggggatccttacaaaatctcctttgatcgactggttgggcgttggaacaaacatggcaacaaactagacaagaaaggcaacaaactaaagaagacggaatcagatcatgtctttatctgctataccagatgctcaaacagcataaaatgtcttcaagaccagcactcaggtacatgtactccaaccgaagctttccttgaatttggtgtgacagataaggaatctcgactcgaggtgctcaagtgtgggttaagattggtatatgcatctgatgaaccccagaagacaaactcagatatggatctttcattatcatcatctgattcaactccgacaaggaacggcagttccaacactactacatctagtggaagtgtatctaccaataccattagagaagaagattccaatatcttacatgaagcacaatctcaaaatgggagaggactttgacatccagaattaatcaactgagtcgtcgtcttttcactctcttttgtgtttggctatgtcttataaaaccctccataatgtatttctctatgtacaacacgatttagatttgcgaggacgtacgtaccttactttaatcactgcattgaacgagaccaatcgcaaatgctggggctgggagggtaatgatgacgttgacagttttgcccatgtctattgctgtaatttacgagaaaacccaacctttgttttttcaccgatatagagatgatctaagccgtcgtctttcgccgtcgagcctgacaattgagtgatctgatcctccttcttcgtcttgttaataagtccaatttgctcggatttcgcttaactttatcgcatttcctaaattgccctcgtcaccactttcacactctctctctccctatg

SEQ ID NO: 29062 - DNA, 3003 bp, Unknown; identical to SEQ ID NO: 29061
  misc_feature (1)..( 3003): 2750-1469P.txt file - cDNA_ID_2999714; gDNA_ID_1620660; Annot_ID_163787

SEQ ID NO: 29063 - DNA, 3003 bp, Unknown; identical to SEQ ID NO: 29061
  misc_feature (1)..( 3003): 2750-1469P.txt file - cDNA_ID_2999714; gDNA_ID_2926174; Annot_ID_140237

SEQ ID NO: 29064 - DNA, 3003 bp, Unknown; identical to SEQ ID NO: 29061
  misc_feature (1)..( 3003): 2750-1469P.txt file - cDNA_ID_2999714; gDNA_ID_2926174; Annot_ID_199708

SEQ ID NO: 29065 - DNA, 3003 bp, Unknown
  misc_feature (1)..( 3003): 2750-1469P.txt file - cDNA_ID_2999718; gDNA_ID_1620703; Annot_ID_48818
aaaaaccttttaaaaccattgtaaaccctaattttcgggatcaagttttccgtccaaaactacgggatcattaatatttggcaggaaaatttgttgaaaatttttggtggaaaaattattatcggatttttttttgtgggaattcgatttttttattttgttaacttaattatttttaaataaggataaaatagtcgttaaaaataagaagatgacataaataaaaattgcttagaaaaggtatattttaaaaaaaaaataccaaagaaaaggcaattataacaatttcttttgaaagtttcaattttcaatgagttttggttaattcaatgaataatacactagcctttcattctttcatgatatggacatccttgaaagttgaaacattacaatagagacaacaaagatgaattttaaaaagcagcttaaaccgaagcctatatatgtgaagcaagagaaaaataaaatcctgaaaatatgcatttcttgaagcataacgagagttgatggcctgatagtgaatctgaaagcaaaggcacccaataatcacctctatataaaaccaaaccagcaggagagataactttggtgttgccaagaagaagaagcagaggaaagcccgacagtattaagttgaaaaggtcggtccaaaccagccaatttagccctccacagtaactgaacgtcctttattctaatttgagcgggcttcaacaccgcagtatgaagtcttgaatttctttccctccataggcaatagaccacagcttgaaagattaacatgcatactgcctttaaccttttaatggaagatgcgtttctacacaagcaccaatatcaataggcaagcaagctctcaagagtagaatcagatgtcttccccgaggtctaatccatgatccatccgcacaagcttgagagaccgtagccataatttgaattcctgtaactctgggtccattcagcctcgaaatatctatcaatgggccaagtgttgtccaatctgatcatcatgccaatcattatgatgaacgagatgagttttgtggaagacatttttttagttactgtgaaacaaaacaagcaacgtttcgttgtctattatttagcaaccttttatttatacacacaaatgtaatacgaatgcaaagcagggagagaagtgacaaataatcaacttcatttacatctaaagttgaaatttctattcacttatccaaaagtactaggacaatatgactcatcggtgaaggcgtctggtgctgacaagttcaatgtcaaaaacgagagttccaagagtagaaccttctccattggcgagacgtgttgggttaaatatagtcgtgaagagtctctgtctgtcaaagaactgcaaacacaacaagaaacaaacaaaggatttttaaaccaatctttggtactatatgtttctgcaaacaatctgaataatatgactggttctctaaaactttcatatcaaacagattgatactagttcaagtccctgtggctactgaacatgacgtaactaattatgttcttatcacctaaatagtttaggcctaaaccaaaactagcttaagagtgtggtgcactaaggcactaagccaggcccaaagctaatccatgtgggactctaaaataacatatgactttcatattaagatattatatgaaaatgttaaaggagaaagaggtgtgtgtgcacacatacgtttggtgggagaggctcctgtgatgtattctggtatccctgagatggaggtataaccacccgacgaatcccgcctactttcatagacctcacagctgtttcaatccccggaattacctgcacatcaaaatgtttcagtcatcacaaaacatcatcatagagacatagaagaagtattatcaacttcaaaaacccaaaccacttagtttgttacatcactattcaatgaagaaatgtatcaaaggtcacacctttaaatcaaattcagataatttttcaagacccatgtcacaaaaacttggactttatgcaacacatgattgagatagaagcatatagagataaaggtttatactttgctagaaccaaggacgaatgtgaaaggaacagcttcaccattactatctttatgatcatatgttgaatcaaatctccatccttgcttcgcagctaatctcccatagtaatgtatttcaatctaaaattcaaaactttgcaaaattgaatcaaatggttcgttcatttgctgaaatctatacaaaaatacaaaaacacaaaacctgatctccttcaatgggaacgtcaccatcgccgattcggaggtcgagagctttaacgccgccggaattagggatttcagagaagtcggctagtgccggagacgagaagcaaaaggaggagacgacggaagacgtgacggcgataattgacagagatattgatcttctagatgctgctgcaactgtcgatgatgatgatgatgatgatgatggtgcggaagaacgagatgcgaagattctgagagatggcggagatgtgaaatggacggtggtgattaagggagcacctactagtggtgtccacgcgaagcaccgaatcatttttctttcctttttattttataaggaaagtataaaaatgaaggtacacatattctagcttttgagaggtcagaactcagaagtggatggaatttgatttggattgggttgggattacgatagttgctgccaaaacctttctagtggaaacaagaataagctacatattgtattcccttatcaaactttagttttgtgaataaagtgttacgaaagtgtaataagatagatgaaaaaaacaaaagaggaaaaagtaggagataaaacatgatagaataaattcttgatcaaacccctttacctagggctatatatgtacacatttaatagcttttctctgtcaagttgaatgtactgatcaagataacaaatttatcaaaaataaatacatcatactggtttatg

SEQ ID NO: 29066 - DNA, 3003 bp, Unknown; identical to SEQ ID NO: 29065
  misc_feature (1)..( 3003): 2750-1469P.txt file - cDNA_ID_2999718; gDNA_ID_1620703; Annot_ID_165170

SEQ ID NO: 29067 - DNA, 3003 bp, Unknown; identical to SEQ ID NO: 29065
  misc_feature (1)..( 3003): 2750-1469P.txt file - cDNA_ID_2999718; gDNA_ID_2926174; Annot_ID_140265

SEQ ID NO: 29068 - DNA, 3003 bp, Unknown; identical to SEQ ID NO: 29065
  misc_feature (1)..( 3003): 2750-1469P.txt file - cDNA_ID_2999718; gDNA_ID_2926174; Annot_ID_199743

SEQ ID NO: 29069 - DNA, 3000 bp, Unknown; identical to SEQ ID NO: 8463
  misc_feature (1)..( 3000): 2750-1469P.txt file - cDNA_ID_2999725; gDNA_ID_1971811; Annot_ID_58114

SEQ ID NO: 29070 - DNA, 3003 bp, Unknown
  misc_feature (1)..( 3003): 2750-1469P.txt file - cDNA_ID_2999729; gDNA_ID_1620701; Annot_ID_48769
ttgtctagcttcgaactgccaaccacccccaacaacaacactcccgtcaccgtctctctaccgtcaacaccgtcaccgtcaacaactaacggcgatccctaaggcccaccactgccacggacttccacaaaaaaaaaagaacccaaagtctgaatcatgttttcctctgtttcagaaactggtttgagatttgcaacagaaaactctgagaatcagacaccaagagagtgtcagaccaatagcaaagactttcccacacagcaatccaacaagaacaatcactatcaaaccaatcactttcgttagatcctcttttggtccagtctcttcttcttcttcaacctctgtacaactctctaaaaatggcggattcgaactcaaatcatccctctcagagatttcactcccgattctctcatctgaatacaagctagaaacttctgtcatagacccttcttcttcagtttcaagttcaacttcttcttcttctttttctttgttcttcatcttcttcttcttcttataactccttagcttctttggcacaatcttcttcacaatctttgatttcagcttcgcgcttttgcttttctcagtcttaaacataacatctcttatcgtctgcatttctttcttctcatccaccacaagtttcgccttctccaatgacgacgaatccgattgaggagtgactctaatctcctctctaggttcttcgatgatttcaaagtagacattgtttcttctgtcatgcgtcgatgttgattcttcttcttcttctagcttctctttatgtcgcttccctatgagcttatcgatcaaagaatctatccgaatctgcgcgtcgggacagagattcaagtacgtgaagacacgcgccaccgcaagctcgaggaagagaagggcaaaagcagagagcgtgatccccacggcgagcttcttcgtgctcaaggcaagcacagccaccataaaaaccttaaacaccaccactatcaaaacacaccctcctcctcctccaccgcgatgaccaccgtcgtcttcatggataatctccggaacagaagtttcctcgatctttctcaccaaaggagaatcctctgtaaccaaagctggatcaagcttggaaggaagagacatacgacgctgcaaagacatatgaggaggaggtggagacaaaacacgcgtttcagtctgggctttgttgttcttgttgttacgttttgaagattgttttttgagacgatcgcgattcttaacaaagagatcgattaaagaagttgggaaaccagtttcaacaacgagagatccaccatgtttaggagattgttgaaagtctgatacgaatctagagatccgactagatttagatttcttccaaggtaaaggcatgttgaaggaaagaaagaaaaaaggatttagacttttaaaatcttttttttggtgataaatcacctctccgaagaacccagaaaaaagggtttgtcgaagagatagagaagaagatctggttggaagatcaaaaccattaattagacattttggagagacaaatgcaataaatggagaagaaacctcttcctgccctctttgcgcagaaagtgaaatgagagagagagagatatgatgaggaaaccgctaaaaagacattgcaggacgacgcgtgccttaaccaattattttacttccttttttttgttacaaaaaatttgttatttatttccatttttgttaaatttgtacaactgtactatgcagtttttaagattttacactttctgctgtaccaaaatattacctatgtccatctgaccgaaattattaaattaattctaataaaaaaattctaataaagctgatcaatttatttattttagacttaaactttacaaaaactaatttattcagcttaatttccccaatatgtaaaaacattaatgactacaagtatggtataacagtagcttcaaaatcttaattcatttataccgaagcaaaagtgaatttggtaaaccggtgaaaaaaacaaaccattccgaaacagatttaagatttttgttcaattatattttgtaagcaaacaaattacatcgaactaaactaaactaaacaaccgaaatatgcatccatattatttgtgaactaaacatggtaaaccggtaatagctattttaagatccttacatttttaaaatttgtctaaagataatttgaacaatttcatctattgttaaacctatcaacgaattgtgtctatagttagatgctaaaaaaccttcctgatagatttttttttgtttgaaccgttgattcatataataaacttagaagcaagacatatagtaatattttttcacttgaaaattgatatttatgcaacagattaactattctaaaatcgtcatatttatgagttgttatttgcctgtaagccatttacttctaatttctattgtcagcttatctaattaatttggtgatttgctaaataagtaaaattgcctattattggtgtgaaaaacaacaaaggaaaatccactaatgacgcaaattcgaatcttttggtctttaatttcaatatccgaagaaaaaaggatctaatcaataatataaaaaagcgtagaaaacaatttgcctttatataactttcacgagtgattttgtaaatattttataattaattaacaaaaatatctaaggaaagatatttgtttttgattcgctgtataacagcacataaaggaaaccaaatcgaaaaactatcagggtaatatcaaaaaccaatagaagtctaaggacgaaaatgcaaattatttgagaaactagagaaaaaaggaggtaaactatatatagccgattactactctcatttgtttttatacccctcaatcataaacaataaacagagggagtcgccaaattttctcatcattttctcgagaaaatagactaaaagcgattcccgagagaaagaaagaacaaaaaaaaaacatccgagtgaaaatg

SEQ ID NO: 29071 - DNA, 3003 bp, Unknown; identical to SEQ ID NO: 29070
  misc_feature (1)..( 3003): 2750-1469P.txt file - cDNA_ID_2999729; gDNA_ID_1620701; Annot_ID_165071

SEQ ID NO: 29072 - DNA, 3003 bp, Unknown; identical to SEQ ID NO: 29070
  misc_feature (1)..( 3003): 2750-1469P.txt file - cDNA_ID_2999729; gDNA_ID_2926176; Annot_ID_140365

SEQ ID NO: 29073 - DNA, 3003 bp, Unknown; identical to SEQ ID NO: 29070
  misc_feature (1)..( 3003): 2750-1469P.txt file - cDNA_ID_2999729; gDNA_ID_2926176; Annot_ID_199901

SEQ ID NO: 29074 - DNA, 3003 bp, Unknown
  misc_feature (1)..( 3003): 2750-1469P.txt file - cDNA_ID_2999733; gDNA_ID_1620635; Annot_ID_162868
gattggtgattgatttcttgattcaaaagtcaatttagtcttccgagtgtttcttctttttgttgttgtttggaattgaaattgggatctgtaaattggattgttgattgatttcttgattcataaaccctaattatttgttggtgcactctacttcattacgattatactaaacattttggtcaagaatcgcttctttggttagattggtccagagacaacttatagttgtagttgcaagtatttaagaacatccatcttgactcgtaattgaataatgtagattgaagaatcggcaacatttatattgattacaagtaagggagattatgcagagttcttagagcttttctatcatgtaattaagaaaatggttaaattagtaggagaaagtggaagataataagttgtagtttatgaactgaaagaaatttaaagggagagagtcaaagtaacggtatcaaagatgcttctgtatccatgttgcttctatgaactattgacatatatgtatgcttaagctagttaaagggcttggtttggctgtttctgtctttctgatgaaagcttttcattctctgatctctgaatttcattcatgggcacaaaagctagctgaacttatgcttggtatgacattttttccatagcaatctgggttttttttcagctttagcatcagtgtttatcctccatgttgttgtatgacattttttccatagcactaatgtaattcctgaatctgtgtagggagagtattctgcaaaaagggatgtgatgccgatagtgactcatgggaagattgtaagcatttctttttaattctttgtaatctgtaacgaaactgttgatgaaatgatgagcggttagatttgtcctcactatggaacatcataaaaaccaagcttgtctcctacataacgaaattacatgttcatgaagagtatcttctgcttttcaggtttaagtttccaagttaatgaattggtgtaatagtagtgtactctctataggtgtaggagactgcagtgaaatttgctacaaagatcctgtgctaaaagacagaccatggactgctgttatagatcgttctcctggagatgccaaatactctgaggtaattcacacaatgaatctttttcttcaaaaaagagaaatggactgaaccgtatctaattgttgtacatgtaactctgtttttaaattcaggaatgctttcacgcatgtgtagcaggctgtggttacaaggtttgtttccttgcttcaacctcaataatttgatgcgtttggaaatacactctacttctctgaacccgtgtggctgtatttttttgtcatcatgcagtttgatgttgaagctgagatagtcaataaggtgaaaccaaagagacctccaccaccaccgccaaagccacaaccaccaccaccaccaccacgttctcaaaaaccaatgcagcctcctactgaggatgttcttgcaacttccgcttgacgtatctcaacccccatcaaaggctaacacttggaactcctcaattttttggtatctaaacatatgagggagtattacttttcagagtagccaactcaaaggattggtccataaacttttttttttctttttcttttgatagtttttgcaatagagattggagagtagatattagtgggactcgtcccgtgatgaaagttagagcatccaaaaagctcaagttcctaaattccattgaattttttgttttcttaatatgtagaattttcattcttatcaaaagaaaaacaaatgtagaatttcctttcattagatccaataatatttgaacggcacaaaatttccaaataagaaagagtgacaaagagtctagccaatcagagaatgaggagaaagttttcacaaacatccttgaccgttgtaactaattagtagtaaattacttattacccgggaaaaccgtatttaagtaaagaaagttttcaatttcacgattttacttgccataacatttgtgtacgtgtcgttatactatttgtcagatgacttatttccctttttcaattgtcgggaatattttgtagtagacttactataaatatatacaattctagcttactccacaaataaaccaataatctttgtaacgaaggaaaccaaaaaacaatcatggctgattcttcctattcttttgtcatgaagatgacagtgaagaccacaccggcgtcagatttagctttaacaaacctcgcctattgttctccgtttgatctccatcgtttcgccgttcccgaaaccgccgatctcttcctcgctaacgtcggagaagtttttgttctatcaatctcatatcctttttttattcacttacaattttgatcttattcacacttttctttattaattatcgtcgtttctaaacattttgtcccacgggtttatcacatctttttcagattccaattaagcagttataccttcttatggagatggcagctcaaagagatggcaggtctgaagagccggtttacattaggaaggaaaaactcgacatcactcatttcatggattgtcttcaggaatttacccaagagatttgaagtttcagttcattattcttagactctcatatgtaatgacatcgtagtaaggagaagattcatatattgcactaaaatcctttgaagatgtcaaagttgatatttgattattggcacttgacttgttaactatatgaaacttttatgttggttattatgtgttatacatttgtataaacttgcttagattgattagacgagagtatttacatcacttaaaaatcgaggatagttcctgacaaaatggaatgttttctccttcaaaatcaagtcacttcttagtgattaagagttggttacttattttaaaaatttccaccactaatgtattgttttctttttcttcattaaatttgttcgcctatcaacatcggtgagactccgtgatgaaaaattgaaaatcacacaatg

SEQ ID NO: 29075 - DNA, 3003 bp, Unknown; identical to SEQ ID NO: 29074
  misc_feature (1)..( 3003): 2750-1469P.txt file - cDNA_ID_2999733; gDNA_ID_2926178; Annot_ID_200021

SEQ ID NO: 29076 - DNA, 3003 bp, Unknown
  misc_feature (1)..( 3003): 2750-1469P.txt file - cDNA_ID_2999737; gDNA_ID_1620646; Annot_ID_47598
tattatttatttttcacaaaatttaattcatagttatggcaccccaaaaaaaagtacgaaattattacagttttggaggtttctgaaacctctgcctattgtggaggcttttgattcctttgaagcaatcaatgacctctctgtctctcatttgccagcaaagagagattgtttaatgttgtttatggttcacatttttatacaatatcacattttcactgaatcttcctctgcgtctctcaggtaatttaattctctcttttctctcccatcactctgtctcttctctttattgggttttagataaaatgatggaataataatttcatggattcaggaggaagaagatcattcagttgaagcacacatttaaagggttttgttgagaggcaatggaagggggagaagagtttcaagaagaagaagtgtggtcagttttgagagaaagtgaaactcaaggtcctgaaatgaaaatgtccaaaagtaacaatctcttctcagcctcttcctcatcttctgcgaggtacattcctaaaggcaacgaggtctctggaggggcaaaacagtcatctgctccaatgaatattcctgactggtccaaggtttatgggtattcaaagaagaacacaagcagccacttgcattcatgggccattgacgatgatgatgaaggctcaatggttcctccacatgagttagtagcaaaaagacttgcaagaacgcagatctcatcattctctatgtgcgaaggaatcggaagaacgctcaaaggaagagatctcagcaaaacaagaaacgctgtcttaacaagaactggtttcttggaatcgaatatcacatcttcatcaacaacatcaccaccatagttttggcatggcatggagcatggctggatgatcaatatcacattcacacaaaaccctttttagcaccataccatatcattatcatgaaaaaaaaacctaaaaccttatggtatccacatgatttttattaaatatcaatgttattgtcgttatcaccatgtagggaatcatgacactaccaatatggttgagttctctttttttttttttgttgttgttgttgttgttgttgttaggtttttggatttttttagataagtatgatgacgatgaggatgacttgtcaatcccatgcatgggcccataccatttttctcatgttatgtttgtagttctcaatggtcttttaactctttagcagtgcttagtgagcttaaattatagtttagcaaaacaaaatggcatatactttggaacctttgaatgtgagaaatttgaaagcactctcgatctcttcaccattttggcctcgaccaagagagaaaaatgtagcgaataatgttaacatttttggtccgacacaaggttaaggggctcgttccatattgctcactacctttcacttttcaatgttatatagcaactagacatggtgttactaggggaatggggtatatgtatctgttatctatttcggtgtgttgatttaattttttacttcgtgtattcttgaaccaatctgcaactgaaaaagttgtatttgaatttggattaattcgtttcgttgctaaatatccatttcaagatatacataataaatatattagttaatttactatggtaagatatattttcaagaatgaagttgtataaataaaaatacttgtttcgataattttcagttttattcacgtcggtactatctcacccgtactaaatttgaattgccgacaaacaaaaaaaatgtcaagttcggttggattttttattttgtttggatctactcaatatataaatagtaccaatcacactataaacgaaatttactcatctttccttggccctagcaacggttcatgataatcattctttctttttacaatttactttttcgaaataaaaaattgtagtaaaattacagtttcaactaaaaaaaaatcttgtacagaggtgccacaaaaatgcaattcaattttatataaaaatacaacgacaacaaatttgttactttgtcaaagcggattatttggcacgaaaaattcgtgcggaaccgctacatatcatttttgtaaataattttcttcaaaattggctcgtttgagtcataaataacacctgatgacaaaaaaaaaaaaaaaatttttttgttactttgtaaacttttgctaaccaaagcctatataaaggcccaattagcccaaaacgacacaaaaatgtgtgaagaaataaacagatggtggtgacgtaagacaagtgtaagagatttcttgtaatccaatcaacaaataataataaacgaattccaagtggtttacttattccagaaacagttccgtgtaggcaaccattaggaaaaccctaactaaattccattattaatttcttttataatccctttctcttgacattgacttctctctctcgattcttcttctccagtttcaatcaaactcaatttcttctcaacgaaccctaatttccaacaaatcggattcagtttcttcttcgggtatgtttcttctcaccaataaattcgagatcttttagggttttctgggtttgtttctcccccgatctagcagacgatcgagtttattaattatgatctttgcttgcttgaaattcgcagagactaatcgaatcgcaatggctaagagttccttcaagatctctaaccctctcggtttgtttcttcaaatccctttctcatcgaattttcaattacttgattttttgttgagtttctgaattctgttaaaacttgctttagatcgtgtatggttttgattttggaactcaattttgattggttttgggatcagatttaatctctgcatacgcttttgattcttcctttgttgttcgtttctctgtttttgtttctaagccaagctgtgagattttatagatatctctgtttaatgatgtacttgtcattaatcttgtggttatgttttgttaatcagaggcaaggatg

SEQ ID NO: 29077 - DNA, 3003 bp, Unknown
  misc_feature (1)..( 3003): 2750-1469P.txt file - cDNA_ID_2999737; gDNA_ID_1620646; Annot_ID_163232
tatatcgttggttttcaaaaaaaaaaaaaaatttgatcaagcaagattcgtaatttcttatgaaggacaataatatcacaagccttttcgagtaaattaacattgtcctcttcaaactttaacaatatctataactatagccaaaaaagattagaaagtgtaatttgaaaatggcttaggcaaaagcataatttaagataaagcaagtcttttcatatagtacatagttttttgtcttctagcatgaatcagactctatcaataattttggcaggtcttagtagaaatagtaccaaaggctaccactcctctatctaacccttttaattattatttatttttcacaaaatttaattcatagttatggcaccccaaaaaaaagtacgaaattattacagttttggaggtttctgaaacctctgcctattgtggaggcttttgattcctttgaagcaatcaatgacctctctgtctctcatttgccagcaaagagagattgtttaatgttgtttatggttcacatttttatacaatatcacattttcactgaatcttcctctgcgtctctcaggtaatttaattctctcttttctctcccatcactctgtctcttctctttattgggttttagataaaatgatggaataataatttcatggattcaggaggaagaagatcattcagttgaagcacacatttaaagggttttgttgagaggcaatggaagggggagaagagtttcaagaagaagaagtgtggtcagttttgagagaaagtgaaactcaaggtcctgaaatgaaaatgtccaaaagtaacaatctcttctcagcctcttcctcatcttctgcgaggtacattcctaaaggcaacgaggtctctggaggggcaaaacagtcatctgctccaatgaatattcctgactggtccaaggtttatgggtattcaaagaagaacacaagcagccacttgcattcatgggccattgacgatgatgatgaaggctcaatggttcctccacatgagttagtagcaaaaagacttgcaagaacgcagatctcatcattctctatgtgcgaaggaatcggaagaacgctcaaaggaagagatctcagcaaaacaagaaacgctgtcttaacaagaactggtttcttggaatcgaatatcacatcttcatcaacaacatcaccaccatagttttggcatggcatggagcatggctggatgatcaatatcacattcacacaaaaccctttttagcaccataccatatcattatcatgaaaaaaaaacctaaaaccttatggtatccacatgatttttattaaatatcaatgttattgtcgttatcaccatgtagggaatcatgacactaccaatatggttgagttctctttttttttttttgttgttgttgttgttgttgttgttaggtttttggatttttttagataagtatgatgacgatgaggatgacttgtcaatcccatgcatgggcccataccatttttctcatgttatgtttgtagttctcaatggtcttttaactctttagcagtgcttagtgagcttaaattatagtttagcaaaacaaaatggcatatactttggaacctttgaatgtgagaaatttgaaagcactctcgatctcttcaccattttggcctcgaccaagagagaaaaatgtagcgaataatgttaacatttttggtccgacacaaggttaaggggctcgttccatattgctcactacctttcacttttcaatgttatatagcaactagacatggtgttactaggggaatggggtatatgtatctgttatctatttcggtgtgttgatttaattttttacttcgtgtattcttgaaccaatctgcaactgaaaaagttgtatttgaatttggattaattcgtttcgttgctaaatatccatttcaagatatacataataaatatattagttaatttactatggtaagatatattttcaagaatgaagttgtataaataaaaatacttgtttcgataattttcagttttattcacgtcggtactatctcacccgtactaaatttgaattgccgacaaacaaaaaaaatgtcaagttcggttggattttttattttgtttggatctactcaatatataaatagtaccaatcacactataaacgaaatttactcatctttccttggccctagcaacggttcatgataatcattctttctttttacaatttactttttcgaaataaaaaattgtagtaaaattacagtttcaactaaaaaaaaatcttgtacagaggtgccacaaaaatgcaattcaattttatataaaaatacaacgacaacaaatttgttactttgtcaaagcggattatttggcacgaaaaattcgtgcggaaccgctacatatcatttttgtaaataattttcttcaaaattggctcgtttgagtcataaataacacctgatgacaaaaaaaaaaaaaaaatttttttgttactttgtaaacttttgctaaccaaagcctatataaaggcccaattagcccaaaacgacacaaaaatgtgtgaagaaataaacagatggtggtgacgtaagacaagtgtaagagatttcttgtaatccaatcaacaaataataataaacgaattccaagtggtttacttattccagaaacagttccgtgtaggcaaccattaggaaaaccctaactaaattccattattaatttcttttataatccctttctcttgacattgacttctctctctcgattcttcttctccagtttcaatcaaactcaatttcttctcaacgaaccctaatttccaacaaatcggattcagtttcttcttcgggtatgtttcttctcaccaataaattcgagatcttttagggttttctgggtttgtttctcccccgatctagcagacgatcgagtttattaattatgatctttgcttgcttgaaattcgcagagactaatcgaatcgcaatg

SEQ ID NO: 29078 - DNA, 3003 bp, Unknown; identical to SEQ ID NO: 29076
  misc_feature (1)..( 3003): 2750-1469P.txt file - cDNA_ID_2999737; gDNA_ID_2926179; Annot_ID_140469

SEQ ID NO: 29079 - DNA, 3003 bp, Unknown; identical to SEQ ID NO: 29077
  misc_feature (1)..( 3003): 2750-1469P.txt file - cDNA_ID_2999737; gDNA_ID_2926179; Annot_ID_200077

SEQ ID NO: 29080 - DNA, 3000 bp, Unknown
  misc_feature (1)..( 3000): 2750-1469P.txt file - cDNA_ID_2999756; gDNA_ID_1620689; Annot_ID_48528
taaaaaaacgcccaaaacacattacttcgataccatttcacaacacccgttttgctagccacggacaaccttgtgtaaacccctaatctttcttcttgttcttcaacggcccaagtgggatcttgctcaacaccttctcatccaacactgcatactgcttcttgagctcgatcattgctttctcacctaatgggtcgactttgtcttcatacttgtcgtaggcaagaggaaccgtgaagagcaacacaagagctgttgcagcaagataaaaatttagtcatcagggttcagtgatacaagagaaggaaaacactaaatggtatagaagtataagcaaagcattacctatgtatgccaatgtcaagaagttgaagcaaccgcccaagattgagagaacccataacccggcaatagcctattcaatccaatggtacattgttgtcagatataaggataaacatattaagtaccaagtcccaaatagtttctacttaagcacatttgaacttacaatgaggaatttcttgagatcccttcctgatgcaatttcacggagagaagagaatccacggttgatctcgattctgagcccagacgcaagctgaagaataggttcttcagggatatgaacttcaggaatctttggaggggacctgacagagaatcaattgtcaacaatgcacaagtgaataatcataagctgagacatatttacattcatcagttttaacttacttgttaatgaacatagtggcattagaccacaaaaacagcacagcgagaacaacaatcatcacgtggcaaagcagagtgagaagatggtactccatcaattcaaacacaacccaagcagctgtagcaccaccaagtacaccaccagacatcttcttgttcttccacatgaatatatcagccgctgcaaataggaagaataatcaagttgagcaaacattacaacatactgtcatctaaatcaaccacattagaaaaacatggaacttgatactgtaaggtttctatatcgagattatgtcaaaaacccatttttatgatcaaaacattcatttagaaatggaatccctaattaaaccctcacaaatgccaaaataaagaaccccaataatacaaatggacacgatggatcgattcagatcaacgagtaaaatagaaaccctaaacaagtgcagattcaaatcacacatatcaatgaaacctaatccatcaaaatgaaagaataaaccaaacaacacatataagaaaacagatcaagccacaacacacacaaatatatgaaagtaaaaccagatcggagaaaaacttacgctttccaccgccgagaaccttatgaacaggctgctctcgtccgaacaagcggtaaactttcgatttcatagaagacgaaggagaagagggcttcttagtcttcttcttctcgtcttcatcatcagaagatgaagaagacgaagaagaatcaccaccgtgatggatcttctccgatatcttatccatcaacgattctctctccacaacctcaacagctggctcaggagcgatcacagattcatcatgcttatgttcttccgccatcgtttcaaaacgcaaagatcttagcttttttcgatttcgatggaagaaacaaagaacacagtattttagctgcttcccaaagtttttaccttttgagaagaaaagatctcgaagcctaaaatagaagaaagaaatcgaaactctaatctcagccgttgaaaatatgaaactaatctgagccgttggttggttcggatacgaacttccgaagctacaggttcgtttacttaattagagccaaaccttggggaaaaaggcaaaaagccaaatgggaacacaaaatacatttcacaaaacgaatggtcgacatgtgacgccgtcagagttaacgtttcccgtcatgagggacgtatacgtggcgatgtctgagctaagtaactaggttatgatcaggtgtcacgcggctgacgcatgatgcggtacgatctaatttttttaattgcaggacacgtggaggaagattcagccattcgtacatgcgtcacgttctttctgtctgcgtcaaaaaaggacacaatcaaacaaattcttaatattataataaacgtaatattctaaaacagtatataacgtctagaaaaaaatgatagtcggcaaagaaaataacgataataggcaaagaaaaatataataataggtgtaaaacaaaacacatagaaaagtgaaaataggtgtaaaaaaaagaagagaaaaccttgtaaaaaatgtgagagtgagaaagagtggagcccaataaagcacaaataatggacatcaatctgatcaagcccagtatcagttctctcatgggcccattacaaaaagatgctcggaaacaaactgaaacctcaagttatggtccataaataatgaagtacacaaaaatgctcaaaccgatgtattgtgtttcgaataactcagacaattaccttgtacatggaagacaaagtgaaatagtagaagctccatgagagaacacaacacaaataataaaacaaatgatagggtaatggcatgatgaaaaaatattttaggtactgcaacgtctgagaaatgtaattttttttctttgtcgagagaacaagacgagctacttaaatggagtcatattttttgttcagacgacttcacccttaccataatatattccactaaagcctttgtggtatacattaagagcaaattggtcatttacaaaaacaacaaatggaatatccgttgaattaagcatctgacttttgccctttgttcaaatcaaatgcagttataatgggttgagctaagttaaagcccataacatttaaagcccattgaataatctagaaacgacgacgtcgttttattagagaaaccccatttctgtaacacagctcctaaacccatttgctcacttcgtcgtcgtctctctctctcactggtaaaaagcaaacaatg

SEQ ID NO: 29081 - DNA, 3000 bp, Unknown; identical to SEQ ID NO: 29080
  misc_feature (1)..( 3000): 2750-1469P.txt file - cDNA_ID_2999756; gDNA_ID_1620689; Annot_ID_164690

SEQ ID NO: 29082 - DNA, 3000 bp, Unknown; identical to SEQ ID NO: 29080
  misc_feature (1)..( 3000): 2750-1469P.txt file - cDNA_ID_2999756; gDNA_ID_2926182; Annot_ID_140628

SEQ ID NO: 29083 - DNA, 3000 bp, Unknown; identical to SEQ ID NO: 29080
  misc_feature (1)..( 3000): 2750-1469P.txt file - cDNA_ID_2999756; gDNA_ID_2926182; Annot_ID_200354

SEQ ID NO: 29084 - DNA, 3003 bp, Unknown
  misc_feature (1)..( 3003): 2750-1469P.txt file - cDNA_ID_2999758; gDNA_ID_1620689; Annot_ID_48529
ggcgaccttaacaatgggttcgtctttggactttataagctttaaagccggatgaaccttgaggtctcccattactagcttttgtccgatatccaattggcttagatctacttctatatatggtgggataatctctgctgggcataggaactttactgttcttttaatcgtattcagagatgctcctgccaaaagattaagaaatagtgatcaatatcaaaatctaacaggaaactagatgctgcgatctacaaaattgggtagagagtagccagagaaatgaaacttcaaaatcccaaaaatgggtagccagaggaagatacaagccattataagatgtataatgcaaacatagatttcttttaaatcgagttaaaattttgtaaaacatcaaccataacgtcacttgaagtgatgattacttgctatcgactaagcttagctcagtctgatccaagaaagggtaactgaaacccgagcagtatcacttctctacagattagaagctcaatgagctccaatgacgtcaagaatatatgtgtggccttaactacttcaggagttagaaaccgttgtattaatcctgcatttagcatatctactcaagcgtacaggactattcgttcacagcaatcagaagtcaaaaaccacatgtttgatcactatctctcttccaaatctttaaccacatttctcatctattttgttcattgcctatgattcgagaaaagaaaatgctatccagaaactcatactaagaacagtgattcctatgtaagcaccttaacaaactcatgtatatactcctctattctcaaatgcttatcaaaatgcttcctttattttctttttgattcctcactaaagatcccaattataaaaaactagcaaagggtttattacctttcttcaatccaggagaaacatcatctccaatgaacacaagagggatatcaactttcaacaaagcacctggaggcgctcttatgaatgtcacattcagtggagcatcagtcccagagtgcaaatgaatctgaaatcacatagcataacatttctaaaaactcaatacataaaccaataatccaaacacaccactaaaccaaacattgaaaaaatgcaaactttaatcaatttcatgagtgagagaaatggagactttaccgctctaggcaaggctctgactttctcaataacctcatcagaaccaatctcagctcgaacctcaacatcaaagagcctagagaggaaaaaagagtaacccaaatgattcacaagcttcctgatctgattcgtctgaactgaaataagcctcttgtttcctccgtgttgtccatcctcttgttcgaatatgatcgaaggaacccgacccgctttacgctctttcgctgatatgctcttgccggagacagaccttggaacggctaagatcgtctctgcgtgttttggatcgggtcgagggaatccagggaggtaagttaattgggtttcttggatatgatctagggatagagctgcgttcgccgccggagagaataaccggaggttttgtagggttttgggtagtgtttttgcacgacggagcaacattgtttgctttttaccagtgagagagagagacgacgacgaagtgagcaaatgggtttaggagctgtgttacagaaatggggtttctctaataaaacgacgtcgtcgtttctagattattcaatgggctttaaatgttatgggctttaacttagctcaacccattataactgcatttgatttgaacaaagggcaaaagtcagatgcttaattcaacggatattccatttgttgtttttgtaaatgaccaatttgctcttaatgtataccacaaaggctttagtggaatatattatggtaagggtgaagtcgtctgaacaaaaaatatgactccatttaagtagctcgtcttgttctctcgacaaagaaaaaaaattacatttctcagacgttgcagtacctaaaatattttttcatcatgccattaccctatcatttgttttattatttgtgttgtgttctctcatggagcttctactatttcactttgtcttccatgtacaaggtaattgtctgagttattcgaaacacaatacatcggtttgagcatttttgtgtacttcattatttatggaccataacttgaggtttcagtttgtttccgagcatctttttgtaatgggcccatgagagaactgatactgggcttgatcagattgatgtccattatttgtgctttattgggctccactctttctcactctcacattttttacaaggttttctcttcttttttttacacctattttcacttttctatgtgttttgttttacacctattattatatttttctttgcctattatcgttattttctttgccgactatcatttttttctagacgttatatactgttttagaatattacgtttattataatattaagaatttgtttgattgtgtccttttttgacgcagacagaaagaacgtgacgcatgtacgaatggctgaatcttcctccacgtgtcctgcaattaaaaaaattagatcgtaccgcatcatgcgtcagccgcgtgacacctgatcataacctagttacttagctcagacatcgccacgtatacgtccctcatgacgggaaacgttaactctgacggcgtcacatgtcgaccattcgttttgtgaaatgtattttgtgttcccatttggctttttgcctttttccccaaggtttggctctaattaagtaaacgaacctgtagcttcggaagttcgtatccgaaccaaccaacggctcagattagtttcatattttcaacggctgagattagagtttcgatttctttcttctattttaggcttcgagatcttttcttctcaaaaggtaaaaactttgggaagcagctaaaatactgtgttctttgtttcttccatcgaaatcgaaaaaagctaagatctttgcgttttgaaacgatg

SEQ ID NO: 29085 - DNA, 3003 bp, Unknown; identical to SEQ ID NO: 29084
  misc_feature (1)..( 3003): 2750-1469P.txt file - cDNA_ID_2999758; gDNA_ID_1620689; Annot_ID_164692

SEQ ID NO: 29086 - DNA, 3003 bp, Unknown; identical to SEQ ID NO: 29084
  misc_feature (1)..( 3003): 2750-1469P.txt file - cDNA_ID_2999758; gDNA_ID_2926182; Annot_ID_140629

SEQ ID NO: 29087 - DNA, 3003 bp, Unknown; identical to SEQ ID NO: 29084
  misc_feature (1)..( 3003): 2750-1469P.txt file - cDNA_ID_2999758; gDNA_ID_2926182; Annot_ID_200356

SEQ ID NO: 29088 - DNA, 3000 bp, Unknown; identical to SEQ ID NO: 4177
  misc_feature (1)..( 3000): 2750-1469P.txt file - cDNA_ID_2999762; gDNA_ID_1620689; Annot_ID_48534

SEQ ID NO: 29089 - DNA, 3000 bp, Unknown; identical to SEQ ID NO: 4177
  misc_feature (1)..( 3000): 2750-1469P.txt file - cDNA_ID_2999762; gDNA_ID_1620689; Annot_ID_164699

SEQ ID NO: 29090 - DNA, 3000 bp, Unknown; identical to SEQ ID NO: 4177
  misc_feature (1)..( 3000): 2750-1469P.txt file - cDNA_ID_2999762; gDNA_ID_2926182; Annot_ID_140634

SEQ ID NO: 29091 - DNA, 3000 bp, Unknown; identical to SEQ ID NO: 4177
  misc_feature (1)..( 3000): 2750-1469P.txt file - cDNA_ID_2999762; gDNA_ID_2926182; Annot_ID_200361

SEQ ID NO: 29092 - DNA, 3003 bp, Unknown
  misc_feature (1)..( 3003): 2750-1469P.txt file - cDNA_ID_2999777; gDNA_ID_1620751; Annot_ID_49818
tttgtatttgtgtctttaaaattgatacggttagaacgaatgtatatgtgttgtattctttataaattaataaaatgtatttataaatagaataagatttatcatttttatcttattatataaagtttggtttttaaaatgaccggaacatgtgtcaattaaaatattagatttatacaagtaaaaaataatatctgtttatatatattacatgtcaaatctaaattaaacaatatatttaaaacaaaactagaaaattgttaacattatcaaaaaatgaaaattatcaaaagacaaaattatacacaagtaaaaataatatttgtttgtatattaaaataagggagatttataaaattacactttttttactactcttttgcaacaatacccttttatgttgtccatttttaaaaataccccttctcttgaacaaaatgaccaaattaccctcatctaatagaaacatgtaattgaaaactgaacttttcccgccaattttttggcgccaaattttttttttcccgccaaaaagaaaagtttctgccaaacttttttcccgacaaaaaaaaacattcccggcaaaaatttttttcgtaacaaatttttcctcagccaaaaaaatgattttaaaaatccttgtaaatattttttggcggcaaatagatttacaaagaattttaaaagggttttaaaagatttacaagagattttaaaaaggttttaaaagatttacaaaagattttaaaagagtttgaaaagatttacaatggattttaaaagggttttaaaaaatttacaagtaattttaaaaggttttaaaatcccttgtaaatctttcaaaatacttttaaactctttaaaaatctttacaaatcctttgtaaatcttttaaagccctttaaaatccattgtaaatattgtaaaacccttttaaaatcccttgtaaatattttaaaattttttaaaacaattttaaagcctttaaaaatctttaaaagacttttgtaaatttttgaaatccctttaaaatctattgtaaattacccttttaaaatcccttgtaaatcttataaaacccctataaaatcccttgtaaatcttttaaaactcttttaaaatcccttgtaaatctatttcccgccaaaaaaaaaaaattggcgggaaaaatatgtttgaaaacaaattttggcgggaaatttattttggaatatttttggcgaaaaaatattaatttttcattttgttaacctaaaacaatttccaaataagggtaaaatggtcattaaaaatttaaagagggtagaaataaaattggataaaacaaaagggtaaagttgaaaaagggcatcatgaaaagggcattagaaaaaaaaattcttaaagggataataattaatatattaaactattaagttgattaactgattttttttgtgttaatatattatcaaaacaaaacttgtttttttttttttttttttttcatccaaaacaaaacttgttttatttattgatttttgtaaataactgtttttcttagcttttattacttcttatgttggatgttcgtgtttggtctgagaattacctccttaagcacaagttgttcctttataaatgagctccatttaggcataatgatgtgaaccctttagtttttgttggtgtagactcaaattagagagaggagtcgctgagattgataagctagcaaacagaatcttccatatcgacaagcttgggaatcaacctgaattgtgatagaagagagaaaacattttctaggaaactaaattgtctcttttgaatttgaaatactttatttggagcttgtttgcttagcgcatatctcgaatttgattatatctcgcaagataattatgtgacgtttttgaattatgtaaacatctcaataagtgatataggaaaatttaacttacaaacagaaaaataagcgattttttcaatacattctaatagttgaatacattaattagaattaggagggatacaataatagataactacaattcattcgtcatgttctaaaaatagagagcaataagtacgacggacagtaccgtcactacttggcgtcatggtagataggtagtggatctgctagatatatgagaacggaaagaaccagaagctattagaggcgggaggagatatgtggggatgatttcagtgcaattccacgacgcaccatttccactttcgtaacacctaaacgaccgcttcggccgtataaaatcgcaaatgtttggtctcagtgtatttttccaatttccaaatacatcaattcaaattatataatatctagtggcaattataagtatatcatatattttcaaaattaattaaaaagattactaaattatgtttgactacaactattataatagttaaaaacataaacaaaaacaaagaaactattttaataaaaaaatcaagtaaacattaaaacataagcaaaaaataatgttaaagaaattattaattattaatttactaataattaatacctctataaattaattgttagaggtttaacgtaatttataaggaaaactaaagaagactttaacccataaagaaaaaaacaaagactgaattgaaggcccatatttagaagaagagaaagaagacccaaatatgatataaaatccagcccatttatatatttttattttgtttctggaaggaaaataagaaaatggcaaaaacgaaataatctgaaaaagtaaggtcttttaccaaaaaggatattttttttataaacagagcataaagttttcacttttcttctgctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagtctctgtctttagctcaaaccatg

SEQ ID NO: 29093 - DNA, 3003 bp, Unknown; identical to SEQ ID NO: 29092
  misc_feature (1)..( 3003): 2750-1469P.txt file - cDNA_ID_2999777; gDNA_ID_1620751; Annot_ID_166797

SEQ ID NO: 29094 - DNA, 3000 bp, Unknown
  misc_feature (1)..( 3000): 2750-1469P.txt file - cDNA_ID_2999777; gDNA_ID_2926183; Annot_ID_140675
gtatttgtgtctttaaaattgatacggttagaacgaatgtatatgtgttgtattctttataaattaataaaatgtatttataaatagaataagatttatcatttttatcttattatataaagtttggtttttaaaatgaccggaacatgtgtcaattaaaatattagatttatacaagtaaaaaataatatctgtttatatatattacatgtcaaatctaaattaaacaatatatttaaaacaaaactagaaaattgttaacattatcaaaaaatgaaaattatcaaaagacaaaattatacacaagtaaaaataatatttgtttgtatattaaaataagggagatttataaaattacactttttttactactcttttgcaacaatacccttttatgttgtccatttttaaaaataccccttctcttgaacaaaatgaccaaattaccctcatctaatagaaacatgtaattgaaaactgaacttttcccgccaattttttggcgccaaattttttttttcccgccaaaaagaaaagtttctgccaaacttttttcccgacaaaaaaaaacattcccggcaaaaatttttttcgtaacaaatttttcctcagccaaaaaaatgattttaaaaatccttgtaaatattttttggcggcaaatagatttacaaagaattttaaaagggttttaaaagatttacaagagattttaaaaaggttttaaaagatttacaaaagattttaaaagagtttgaaaagatttacaatggattttaaaagggttttaaaaaatttacaagtaattttaaaaggttttaaaatcccttgtaaatctttcaaaatacttttaaactctttaaaaatctttacaaatcctttgtaaatcttttaaagccctttaaaatccattgtaaatattgtaaaacccttttaaaatcccttgtaaatattttaaaattttttaaaacaattttaaagcctttaaaaatctttaaaagacttttgtaaatttttgaaatccctttaaaatctattgtaaattacccttttaaaatcccttgtaaatcttataaaacccctataaaatcccttgtaaatcttttaaaactcttttaaaatcccttgtaaatctatttcccgccaaaaaaaaaaaattggcgggaaaaatatgtttgaaaacaaattttggcgggaaatttattttggaatatttttggcgaaaaaatattaatttttcattttgttaacctaaaacaatttccaaataagggtaaaatggtcattaaaaatttaaagagggtagaaataaaattggataaaacaaaagggtaaagttgaaaaagggcatcatgaaaagggcattagaaaaaaaaattcttaaagggataataattaatatattaaactattaagttgattaactgattttttttgtgttaatatattatcaaaacaaaacttgtttttttttttttttttttttcatccaaaacaaaacttgttttatttattgatttttgtaaataactgtttttcttagcttttattacttcttatgttggatgttcgtgtttggtctgagaattacctccttaagcacaagttgttcctttataaatgagctccatttaggcataatgatgtgaaccctttagtttttgttggtgtagactcaaattagagagaggagtcgctgagattgataagctagcaaacagaatcttccatatcgacaagcttgggaatcaacctgaattgtgatagaagagagaaaacattttctaggaaactaaattgtctcttttgaatttgaaatactttatttggagcttgtttgcttagcgcatatctcgaatttgattatatctcgcaagataattatgtgacgtttttgaattatgtaaacatctcaataagtgatataggaaaatttaacttacaaacagaaaaataagcgattttttcaatacattctaatagttgaatacattaattagaattaggagggatacaataatagataactacaattcattcgtcatgttctaaaaatagagagcaataagtacgacggacagtaccgtcactacttggcgtcatggtagataggtagtggatctgctagatatatgagaacggaaagaaccagaagctattagaggcgggaggagatatgtggggatgatttcagtgcaattccacgacgcaccatttccactttcgtaacacctaaacgaccgcttcggccgtataaaatcgcaaatgtttggtctcagtgtatttttccaatttccaaatacatcaattcaaattatataatatctagtggcaattataagtatatcatatattttcaaaattaattaaaaagattactaaattatgtttgactacaactattataatagttaaaaacataaacaaaaacaaagaaactattttaataaaaaaatcaagtaaacattaaaacataagcaaaaaataatgttaaagaaattattaattattaatttactaataattaatacctctataaattaattgttagaggtttaacgtaatttataaggaaaactaaagaagactttaacccataaagaaaaaaacaaagactgaattgaaggcccatatttagaagaagagaaagaagacccaaatatgatataaaatccagcccatttatatatttttattttgtttctggaaggaaaataagaaaatggcaaaaacgaaataatctgaaaaagtaaggtcttttaccaaaaaggatattttttttataaacagagcataaagttttcacttttcttctgctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagtctctgtctttagctcaaaccatg

SEQ ID NO: 29095 - DNA, 3000 bp, Unknown; identical to SEQ ID NO: 29094
  misc_feature (1)..( 3000): 2750-1469P.txt file - cDNA_ID_2999777; gDNA_ID_2926183; Annot_ID_200436

SEQ ID NO: 29096 - DNA, 3003 bp, Unknown; identical to SEQ ID NO: 24208
  misc_feature (1)..( 3003): 2750-1469P.txt file - cDNA_ID_2999785; gDNA_ID_1620724; Annot_ID_49250

SEQ ID NO: 29097 - DNA, 3003 bp, Unknown; identical to SEQ ID NO: 24208
  misc_feature (1)..( 3003): 2750-1469P.txt file - cDNA_ID_2999785; gDNA_ID_2926184; Annot_ID_140701

SEQ ID NO: 29098 - DNA, 3003 bp, Unknown
  misc_feature (1)..( 3003): 2750-1469P.txt file - cDNA_ID_2999789; gDNA_ID_1621096; Annot_ID_55665
ttctctcgagtcaagccactctatgcagtcactatctggcttggagatgtctcccttgatgtcagaccttatggttttagccatagtaaaaagcggaccgatggggttgaagttgacttgagggcagagctgggacatgtggtcaatggtatctttttcaagttcttgaaaagtttcgatgagaacagagaaaggcttgtgaagtcgcttgatctgctctaaaatggtacctcctatagaggacagcggagaggaagggtgaagaaagctagggatctcgtcatgcttcaatgttaatggcttgaaagggacgtcaacggttatttccggctcggtttcggtcggaaacttaactaactggtggtggtaatagtaataagcggcgaggcaagcacaagactggacccaaagaacagctgatgggatttgaagctcctcggctatgtcacaaacccatggaacaaaggcattatttatgagacatctcactggttgcttctcatatttcttgacaagattcttgatctctcgttttccggaaacttcaagtgatttttgtaacaaatcaaagtcttctttgtagacaaatccatcctcgaagaactcgaaccggagaaaacctagcccgaccggtttgagcacaccgtcttgaatattgttggcttgacgcatcttcttgcccaatggttcctctgtggttacaaaggtgacgattaagcctttagaggcaatgatctttccgagacgaagaagagggcttatgtgaccttgccctgggaatgatacgagcatcacatgaggtaacgacgattccatctccatatttttttttttgttggtaaaactcaaaaagaagtttttgtcttctttacaatatttccaatttagatacctcgatttatggaaggttgggtagagaggcctttccacggcgtgctatttttttatacaaatattgataataaatgtagaaaaatatcataaaatacagcatagacataggggaaaaatgtcaattaatcccccaactttcaaaaaatggccattttatacatcaacttcgtatgcggccgtttaaatcatgaatttaacgttgactaattttaaaaacgtgattattcgttgaccaggccaaagcagacatgtcgttatcagtcattaacggaacttctaacgtccgttatcatccgttaacaactttattagtcaagttttaaattgtggccattttaaacatcaagttcatatgtggccatttaaaacatgaactaaacgttgactaccatttaaaacatgaaaaattcgttgaccaaaccaaaataaacatgttgttatcattcattaaaagaacttataacattcgtaaatttataagtttttagtcaattattaaaaagataataataagacaaaacaaaattatagatacaattttagaaaaaaagcgtaaaattaagaaaaaacaaaaactagaagagaagtttttataatgattataatgatattaaagtccttgagcagatgacctacttgatttatttttcaacgattacctgctctggttataatggtattataaaccacgagattagcgacttcataatcaaccaatataagaactctcttatgatagtattaaacataatgtttaacggttgaccaaaaacaaaaattaacgagtttagaccaaaacatgtgactctattaatttgattaaattgtggaacagatcacttattatttttgtcgtaaactccatgagctatcccacaaaaattaactttccaacaaactctaagattatgcatatcgagatgatgtctccactgacttttggtttcgaataaaatgttattaaaaattagatattcgaatttggatctttatcaaattaatataaatttaaaatatgttaaattctaaattgattcttccgactactagaattatttagttcatctaatgatatctccacgtctactttaacaaaacaaaaaaaaaatctccaattgtttaatttttaaatgggagaaaagtgtttatagaagaatcgtacatgatagattgatagaggttacatatagttttgtagctaggttttgtgttaatgaatatgatcgacctagttgtgacataaaaagcttcatgaggctttttgggcgaaatgagatgatcacactaactcaaggatgtgtaggtggaaaacaaaagagtactagattgccgttctcaaataatctgcgcctcggagatggagatctagttgactgaggatgcggactcgtaacattgccaccaccataacacacttaagggaaggattctaatggattccaaaatcaccacatgcatgacagtatgactcgattagaattagatagaaaaatgagaagatccgtcttcagttaccggcgaggaatgccgaaaaccgaagtggaagatcggtaatttttttttagtgcagagaaaaattaagaaagaaaagagaaacccataaaaatagagatagtttctcaaaatattatttgcataatcatcatattaagcaaacatgaaaaaatctctaatatatgaaacaatatattattataattttactatctattttttacacaaatgaaatatattaattggctaaaaaattatttttaatcattttatcaaattatattctaacaattaaaacaaaaattactattgtaacatgactatttgttcaaggttgttctcgttaaaaatatttcgaaataatttatttttctttgaacatatttagttgattttttatcagtaaaattatttgtttttcctaatgatatataactcttataaataaattaaataatatatacatactgtagttccaacgtatatcatcaatatctatccaaagttggattttcttggttgacgttacccaaccaaaattctcaattttcccagtggattactcttacagtccaaagtttcaatttttctgagcttcaaaaatccactctaatg

SEQ ID NO: 29099 - DNA, 3003 bp, Unknown; identical to SEQ ID NO: 29098
  misc_feature (1)..( 3003): 2750-1469P.txt file - cDNA_ID_2999789; gDNA_ID_1621096; Annot_ID_171001

SEQ ID NO: 29100 - DNA, 3003 bp, Unknown; identical to SEQ ID NO: 29098
  misc_feature (1)..( 3003): 2750-1469P.txt file - cDNA_ID_2999789; gDNA_ID_2926163; Annot_ID_139808

SEQ ID NO: 29101 - DNA, 3003 bp, Unknown; identical to SEQ ID NO: 29098
  misc_feature (1)..( 3003): 2750-1469P.txt file - cDNA_ID_2999789; gDNA_ID_2926163; Annot_ID_198929

SEQ ID NO: 29102 - DNA, 3003 bp, Unknown
  misc_feature (1)..( 3003): 2750-1469P.txt file - cDNA_ID_2999793; gDNA_ID_1621096; Annot_ID_55670
aaagttcagtcatcactatcaacacacacatgagtatacatgatatctttacaaaataattagtttctttatcttgaactttgatgtaaattgcaaatgattcgagataaaatgaattcttgcctaattatcttcgtgagtttagagaaatttgtgatcaattgagctccataggtcctacaggcccgacttaacacatgtgttaggagtgctagacgatatggtccaaaaaaaaatctttatttaattcatacaaaaagttctacttttttgaaaaacaaatagctactaattatgattatatgtttctcatttttacatccctcgttgtatagcagaagcacaacatgctgattattctggtacaagttaataaagcaaagttgtgttgaaaaaaaaaaaaaaaactacttatatttaaaaaattaaaaatattcttagttatctaaaaaaacagaaccactaatcaagaaatataccttaaaattctaaatttggtttaaaaaataaatatggaaatatccaagtttcttaaaagtaacatttctataattagaaaccacacttctttaataataatcataggccaatattttttttccaataacccttaatttttttgggtccgctctagcaccgggtcttgccaatatttgagccgaacctctttccagaacacaacttctactcgtaattttcattattctttccattgtgaagatacaaatttgttgtgttggaagatgtcaatgtgaacggatataatggtaggttaatgagaatgtttttttatggtagtgttctagaatcagtagagaagtcatatgaagtagatgatgatatacatggtgagatgaagggaaaacagttaccttttggaatagggttgaacctctccaaaaagtgaagttgatcactgataatacaaggaaatgataaagaggtgacattcgagtgatcaatgaacctgtttcctcctaaatgttgttagtaacatgtttgattgtatgttgttagaatggtttatcagagtgcattcgcacaactatccaatctctcgagatcttctctattcgttttgatattttgaactttttgaaaacctctcaatctattgataagacaacttttttatgaaaaaatcaagtttgagaactaggttttgtgtttattgatctagtttacttagtcatattcactaagtcgtcaatatggtatgctttcaacaataacatagtaatttgaatgcctcgtacattttaggcgattttctattacaatgttttggtagagaatacgtatttgtatatttatgatgtatacgtgcatatacattaattgttttgtcggtttattatgatcaaacaatagtttgtctgtcagaagattcaagaaatatctttgaatctgagagtttccaaaaaacgttatgatgaaaatttggcatatacgtatttctgacaagctgataatattgtcatcttgcatttcaagcagtttcgacaaaattttatccaactgttatattcaaactaattgaaaatcgaaaaaccaccattaaaaattagttaaaaataacatatcattttgaaaatgcaatatttaaaaatttaacatatcaatttaacatgcttgttttcttaataagttttgatatattataaaatgaaccgcgtgattacaatttttctttttgtgatggaactgtcgttagttaaacacttaaacttaaactttcatgtaagttttgtttattcatatttgactcaattgaaacccaataatcaagaatgtcaaatattatatgttttgtcggatttgtaacgtgattctcgctcatttaataatgtgataatatcataaaatttaatctatgtagttgtttaatatgatattaaactttattaatgtaataagatcgataatactaagttactaacccaaatcatacacttacgagttacgacactaccgcactatcttggttatattaaatactccttttgtttctaatagtttgatgtttatatcaacattattatttactttcatttgttaccgatagaaagaggagaaaattgttgacaaaaacaaagaaaaaagtaaaattaatattattaaattaataaaaataacaaactgtaaaagctatttttaaaaatttttcttgtaaaacatctaaaaattattcttgtagaaacagaggaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggtatgtatgcgtgaatatatttatttattttcttttctttcattttctttttaaagaactttataaatgaaataaggaacaaacaatatacacatgtactaacgtatataaataatatcatcaatatctatccaaaacttggatttcatggttgacgtggcccaaccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctccaatg

SEQ ID NO: 29103 - DNA, 3003 bp, Unknown; identical to SEQ ID NO: 29102
  misc_feature (1)..( 3003): 2750-1469P.txt file - cDNA_ID_2999793; gDNA_ID_2926164; Annot_ID_139813

SEQ ID NO: 29104 - DNA, 3000 bp, Unknown; identical to SEQ ID NO: 6578
  misc_feature (1)..( 3000): 2750-1469P.txt file - cDNA_ID_2999801; gDNA_ID_1621097; Annot_ID_55744

SEQ ID NO: 29105 - DNA, 3000 bp, Unknown; identical to SEQ ID NO: 6578
  misc_feature (1)..( 3000): 2750-1469P.txt file - cDNA_ID_2999801; gDNA_ID_1621097; Annot_ID_171145

SEQ ID NO: 29106 - DNA, 3000 bp, Unknown; identical to SEQ ID NO: 6578
  misc_feature (1)..( 3000): 2750-1469P.txt file - cDNA_ID_2999801; gDNA_ID_2926165; Annot_ID_139886

SEQ ID NO: 29107 - DNA, 3000 bp, Unknown; identical to SEQ ID NO: 6578
  misc_feature (1)..( 3000): 2750-1469P.txt file - cDNA_ID_2999801; gDNA_ID_2926165; Annot_ID_199079

SEQ ID NO: 29108 - DNA, 3000 bp, Unknown
  misc_feature (1)..( 3000): 2750-1469P.txt file - cDNA_ID_2999805; gDNA_ID_1621097; Annot_ID_55747
agtctggttggcgtttaagctctgctgtcttcaatcaagtcttcccgtccactaaatactacttccagaacttatgtgcatgttttggctttcgccttgtaggccttggtggctaggaatgatggtgtgtggagcaaggatcatgtgtctgccttgcgtaagatttgcccgatggtaagtggcgagtttacaacagaggcatctgcagctgaagtcgagggttatggtgcttcaaagctaacagttgactccgccgtcaagtatttacagcttgctaataagcttttctctcaagctgagctctaccatttttgtgcaagcattttagaacttgttattccagtttacaagagcaggaaggcttatgggcagttggctaagtgtcacactttacttactaatatatacgagtccattcttgaccaagaatcaaacccaatcccatttattgatgctacatattaccgggtgggattttatggggaaaagtttgggaagttggacaggaaagaatatgtataccgagaaccacgagatgtgcggctaggggatataatggaaaaactgagccatatatatgagtcaagaatggacagcaaccatattctgcacattataccagattcgaggcaagtgaaggcagaagacttgcaggcaggagtgtgctatctgcaaattactgctgttgatgcagtgatggaagatgaggatcttgggagcagaagagagagaatattttctctttcaactggaagtgttcgagcacgagtgtttgatcgtttctaatttgacacaccatttacgaaaaatggtaaaacccaaggtggattagaagatcaatggaagagaagaacagtgctgcagactgagggttcattccctgcccttgtgaataggctgttggttaccaagtctgaatcccttgaattctcgccagtggagaatgcgattggaatgattgaaacgcggacaaccgctctgagaaatgagctagaggagcctcgtagctcggatggggatcacctaccacggcttcaaagtctgcagaggattctccaaggaagtgttgcagtgcaggtgggtttttctcccataatatctgtgttatagattgtgttgtaaaacgtagaaatgctcatcatatgcctttccatggaaatatgcaggtgaacagtggggtgttgagcgtgtgcacagctttcttatcaggagagcctgcaacgagattgcgttcacaggaactgcagcaactaatcgcggcactgcttgaattcatggcggtttgtaagcgagccattagggttcactttagattaatcggagaagaagatcaggaattccatactcagcttgtcaatggatttcagtctctcaccgcagaactctcccattacatccctgctatcttatccgaactttagtgtatctttgtcagtttttgttacgagttttgtgcttttttcttccaccatttggcttggctatatgtttatcatttctgtaattcttagtttaatgacaacaagtgagaaaaaaattataaatgacaattggttgacttctaattcagaagcttatgttatattcgatcgaggacatgagctctctcagcttcaaacacaagccgctcaactatttaggatgcctgcgacatctcagaaggcaatcaagtaatcaacagtcacagtagaagcacaagctgaagaagatgaagaggaggttggtgagaccggtgctgatgctcgtgacattgaattggtcatgactcacgctgtagtttcgggtagcagatcggttaagtcactcatgggtcacgtcttcagacattgtaagtgcaataatatggttctcactccttgaagagaaaatgaacctctctctgctttgttcattggcaaattgtttttatataactttgaagtttcataaaatcggattattgccctttctgttatctaatctcattgtatgtacttagttatgatgcatctgcattatctgacttctaatcttttttgccaacacatgtgaaattacacgaacataagtttgataaacgtaaagaagttaggatttagaaacatcatcttgtgaaaaataggcaaagttaattatacgaaagtctcaataggaacgtttaagcaaagaagtgacacataagagacgttgaaacactatgcatagattctaactcgtcaatcatcctctgtttcttttcaagactgcaggttgaattcatcgaaatttccgccctttttaaacacttaaagttctccagaatgtatcttatgagttctttttcatcttctcttcctccatatcctttccattcaaagatcgtgggatgagacgacaagcattcgggaacagaactcggttggttccataaaactggagcatgattctctgaccgttcaatcagaaatgtggagtcgaccattaaaacctctagtttaggagaattagagaggaaaaccacaagtgattcacacaagtccgggtaaaatcgatgtatgctacactctttaagtagagagtaaacggcgttacaccatgcaaccattgtatcaccacgtatagatagctcaagatactcgattgaagaaagagatctcagaagtaaacggagcatatattaattagagtgccacgtcagcggggtttttttataatgataagtctcctccgctcaatttcagatcagaatcagttcatccatggaaacagcgtcgagagtggaactgattgttaaaggcaacttaccggagttccttctcagtacaatccagccaaccggaagctcgacctaatctcccattaccacggcgatgaagcttcgatcccaaccgtcgatctctcgagctccgattccgcgagagaagccatcggtgaccttgtcgcgactggggagccttccacgtaatcaaccatggtgttccaatccatctccttgatcggatgaggtctttaggtctctctttcttccaagactctcccatg

SEQ ID NO: 29109 - DNA, 3000 bp, Unknown
  misc_feature (1)..( 3000): 2750-1469P.txt file - cDNA_ID_2999805; gDNA_ID_1621097; Annot_ID_171148
atctggtatgtgttttacatgcgcagtggatcatctcgcagtctggttggcgtttaagctctgctgtcttcaatcaagtcttcccgtccactaaatactacttccagaacttatgtgcatgttttggctttcgccttgtaggccttggtggctaggaatgatggtgtgtggagcaaggatcatgtgtctgccttgcgtaagatttgcccgatggtaagtggcgagtttacaacagaggcatctgcagctgaagtcgagggttatggtgcttcaaagctaacagttgactccgccgtcaagtatttacagcttgctaataagcttttctctcaagctgagctctaccatttttgtgcaagcattttagaacttgttattccagtttacaagagcaggaaggcttatgggcagttggctaagtgtcacactttacttactaatatatacgagtccattcttgaccaagaatcaaacccaatcccatttattgatgctacatattaccgggtgggattttatggggaaaagtttgggaagttggacaggaaagaatatgtataccgagaaccacgagatgtgcggctaggggatataatggaaaaactgagccatatatatgagtcaagaatggacagcaaccatattctgcacattataccagattcgaggcaagtgaaggcagaagacttgcaggcaggagtgtgctatctgcaaattactgctgttgatgcagtgatggaagatgaggatcttgggagcagaagagagagaatattttctctttcaactggaagtgttcgagcacgagtgtttgatcgtttctaatttgacacaccatttacgaaaaatggtaaaacccaaggtggattagaagatcaatggaagagaagaacagtgctgcagactgagggttcattccctgcccttgtgaataggctgttggttaccaagtctgaatcccttgaattctcgccagtggagaatgcgattggaatgattgaaacgcggacaaccgctctgagaaatgagctagaggagcctcgtagctcggatggggatcacctaccacggcttcaaagtctgcagaggattctccaaggaagtgttgcagtgcaggtgggtttttctcccataatatctgtgttatagattgtgttgtaaaacgtagaaatgctcatcatatgcctttccatggaaatatgcaggtgaacagtggggtgttgagcgtgtgcacagctttcttatcaggagagcctgcaacgagattgcgttcacaggaactgcagcaactaatcgcggcactgcttgaattcatggcggtttgtaagcgagccattagggttcactttagattaatcggagaagaagatcaggaattccatactcagcttgtcaatggatttcagtctctcaccgcagaactctcccattacatccctgctatcttatccgaactttagtgtatctttgtcagtttttgttacgagttttgtgcttttttcttccaccatttggcttggctatatgtttatcatttctgtaattcttagtttaatgacaacaagtgagaaaaaaattataaatgacaattggttgacttctaattcagaagcttatgttatattcgatcgaggacatgagctctctcagcttcaaacacaagccgctcaactatttaggatgcctgcgacatctcagaaggcaatcaagtaatcaacagtcacagtagaagcacaagctgaagaagatgaagaggaggttggtgagaccggtgctgatgctcgtgacattgaattggtcatgactcacgctgtagtttcgggtagcagatcggttaagtcactcatgggtcacgtcttcagacattgtaagtgcaataatatggttctcactccttgaagagaaaatgaacctctctctgctttgttcattggcaaattgtttttatataactttgaagtttcataaaatcggattattgccctttctgttatctaatctcattgtatgtacttagttatgatgcatctgcattatctgacttctaatcttttttgccaacacatgtgaaattacacgaacataagtttgataaacgtaaagaagttaggatttagaaacatcatcttgtgaaaaataggcaaagttaattatacgaaagtctcaataggaacgtttaagcaaagaagtgacacataagagacgttgaaacactatgcatagattctaactcgtcaatcatcctctgtttcttttcaagactgcaggttgaattcatcgaaatttccgccctttttaaacacttaaagttctccagaatgtatcttatgagttctttttcatcttctcttcctccatatcctttccattcaaagatcgtgggatgagacgacaagcattcgggaacagaactcggttggttccataaaactggagcatgattctctgaccgttcaatcagaaatgtggagtcgaccattaaaacctctagtttaggagaattagagaggaaaaccacaagtgattcacacaagtccgggtaaaatcgatgtatgctacactctttaagtagagagtaaacggcgttacaccatgcaaccattgtatcaccacgtatagatagctcaagatactcgattgaagaaagagatctcagaagtaaacggagcatatattaattagagtgccacgtcagcggggtttttttataatgataagtctcctccgctcaatttcagatcagaatcagttcatccatggaaacagcgtcgagagtggaactgattgttaaaggcaacttaccggagttccttctcagtacaatccagccaaccggaagctcgacctaatctcccattaccacggcgatgaagcttcgatcccaaccgtcgatctctcgagctccgattccgcgagagaagccatcggtgaccttgtcgcgactggggagccttccacgtaatcaaccatggtgttccaatccatctccttgatcggatg

SEQ ID NO: 29110 - DNA, 3000 bp, Unknown; identical to SEQ ID NO: 29108
  misc_feature (1)..( 3000): 2750-1469P.txt file - cDNA_ID_2999805; gDNA_ID_2926165; Annot_ID_139889

SEQ ID NO: 29111 - DNA, 3000 bp, Unknown; identical to SEQ ID NO: 29109
  misc_feature (1)..( 3000): 2750-1469P.txt file - cDNA_ID_2999805; gDNA_ID_2926165; Annot_ID_199082

SEQ ID NO: 29112 - DNA, 3000 bp, Unknown; identical to SEQ ID NO: 6596
  misc_feature (1)..( 3000): 2750-1469P.txt file - cDNA_ID_2999815; gDNA_ID_1621098; Annot_ID_55783

SEQ ID NO: 29113 - DNA, 3000 bp, Unknown; identical to SEQ ID NO: 6596
  misc_feature (1)..( 3000): 2750-1469P.txt file - cDNA_ID_2999815; gDNA_ID_1621098; Annot_ID_171224

SEQ ID NO: 29114 - DNA, 3000 bp, Unknown; identical to SEQ ID NO: 6596
  misc_feature (1)..( 3000): 2750-1469P.txt file - cDNA_ID_2999815; gDNA_ID_2926166; Annot_ID_139922

SEQ ID NO: 29115 - DNA, 3000 bp, Unknown; identical to SEQ ID NO: 6596
  misc_feature (1)..( 3000): 2750-1469P.txt file - cDNA_ID_2999815; gDNA_ID_2926166; Annot_ID_199154

SEQ ID NO: 29116 - DNA, 3000 bp, Unknown; identical to SEQ ID NO: 6635
  misc_feature (1)..( 3000): 2750-1469P.txt file - cDNA_ID_2999826; gDNA_ID_2926167; Annot_ID_139944

SEQ ID NO: 29117 - DNA, 3000 bp, Unknown; identical to SEQ ID NO: 6635
  misc_feature (1)..( 3000): 2750-1469P.txt file - cDNA_ID_2999826; gDNA_ID_2926167; Annot_ID_199207

SEQ ID NO: 29118 - DNA, 3000 bp, Unknown
  misc_feature (1)..( 3000): 2750-1469P.txt file - cDNA_ID_2999830; gDNA_ID_1621100; Annot_ID_55842
gaaattcgttacagctgcaaggttatattctaccattcttaagctacaaaatatatggagctggaacacacctgagaccaatcgatcaaccctccctttgttttcggaatcgcatcaatggaagtatcggtgttctcatgggagctaggaatctaaaaattgaaagtatagtttaagtgtaatgttattctttcttccatgtggagttgagaacttttaatgggttattacagaatgttgagatgtagagagctaaggtccttacaagtgtagtgacacagaactgttctcctgctccttcacaatccgaagctgtgataattgggcttgccacccagacaaatccactttcttgaaagaacttgtgtgtagcatatgccagagtattcctaactcttgccacctaaacaagatattttgcatatttaagaaatatagaacttggtgattatcacaaggcagtaagttcaccgtcaagtttcactaaagtgaagcctgaaaggtgagcagtagaagcagtgttcacataaaatagacaaacaacagtttctaacaagagacacgtttctgcgtgagataatacataatatcaccaagaagctaacaagagtcgtatacagtatggaatttcaggaaggtataaaaggaaagttaccgccccaaaagtgttggttctaggacgtaaatgagccttggttctcaagaattcccggctgacccttttcttctggatcggataggaagagtcacactctccaacctatgataaaacgagactaataagtgacaaaaattcaaagaaacatactttcaaacttaaggaactaaagttcagcatccaaagtagaagaagaaaagacataccacaatgattttctccaccttaagttccactttttgcttcgttccctggctagctacaatagtaccttgtacagatactgatgctccagtcaagatcgaaccagattctacctattatccacccaaatggaatgtggcaaacaaaacatgtctaaggattatcataaggtttacaagaattcaaagctcctaagttctaattattgttctcaagtcacagaaattacctgatcatacccttctgcatccgaagtcatcacacattgcaaattcgataagcatgaaccatcatttatcttccaacaacaacaacaaaataaaaaccaaaactttgtcagcaaatcaatcaagagattgataaaaagatgaagaaaggttgagaatttacctcaatgaatgtgacactgctctgagatcgaagtgtacgaacccaacccataatgttaaggctctgcccgacccgactcagtccttcgtccgctcctcctttcacttcagctatcctcaactttttcctgaattctccaactttactcccaaatcgtttctcgtaactctcaactttatttccatcaccggagccgagagattccgaaacagctgtgcaaaagcatctccggcgagaattggccggaaaagcatcgaagggagggagaacacggcggcgtagaggacggaagagagaataagaagggttagaaatggtgaagaatgataagaagcggagagtagagttttgagttagacggagagatgtcgccggcagaaacgtggccgccattgtaatcgaatcgttcactgttttaggattgcgcgagtcttcttcttcatattggaacatccacccgacccaagttggttaacccgaccaagattggtattaacccgccctgtaaacttttagctaaataagcccatttagagtctagaggcccatcacctacaaatgttttcaactatgaatcggcctattgaaaagaaaaatcttttgccattagaaagatagaaattcagggtagcagcaacattattgttacatttaaaagttaagtcaccaccaagcagtgtgtcttttagtaattgtcttgtgtcaaactggagcataagtgtatggatacaaaaattagtattattgcaatatgattgttgggtcacatgatctggaaaagtaaaagcagctcattatagggtactatgtattgttaagaggctttgggttttagcactcatatgcgttgacgaatgtcaacaatctttagttgacacgtggaaagtaatagagacccacatccacatggaagcagttgagatattgacccaaaaaggtacacaactaaaactctaaaaacacaaccccaaccacttggcatcggatctctcacagaccggtgcggttgctcacctgcattcacttctcattgtcctttcgttttgttattgtacacatctatctaatctatctattgttccacatgttaatgtaagtaaaagacaacacaataaaaccaaacaaattaagctctaaatatcaattatttacttacttttaggttgaagatgctacccaatagtagttgtgatatactactcataatgagagagaatttggtatatacaaaggcaggcgagacaggtgtgaccggttgttgttgatcttaattaggttaccattataattaacccgattaattatatatcctctgtaaacaagtttggttctcattttttttacctgaataactgtgattaagtcaacgagcattattgttgcatttccttgtgtaataatgagccacattattgttgcatcacacacttatgctaataaagaaaacaggttctacacactagaacaaaaaaaataacagcaaaaagatattagcaaggtaagcataatttgatcatataacaaaagagaaacgttatgatctctattagacagcttaaccaacaaagctaaccccactttcctcttcatatttaatctctctttctctcctttcttcaacaaatatctcctgctcttacatctgagtctttttctttctaaccttctgattcatgagtaatcatatgtccattatgaagttcttgaatcaaatcctctgtctctctcttatcctctccatatccatg

SEQ ID NO: 29119 - DNA, 3000 bp, Unknown; identical to SEQ ID NO: 29118
  misc_feature (1)..( 3000): 2750-1469P.txt file - cDNA_ID_2999830; gDNA_ID_2926168; Annot_ID_139981

SEQ ID NO: 29120 - DNA, 3003 bp, Unknown
  misc_feature (1)..( 3003): 2750-1469P.txt file - cDNA_ID_2999833; gDNA_ID_1621100; Annot_ID_55866
ttcgaaattccggtgatcggaggagtaatttgcggaaatagaagggaaaattggaaaaataggagagtggagcaatacctgattcataacatctgggttagattcaagtggaagccatctcttagatgaagaactctcgcttgcggtcgccatcttaggatctttctcgtcactatcgatcgaattttgcagaagaaatcaaaatccttctataagaaaacaacacttcggctccaagatacgaatccctcaacatccgataattatgcaatggttcctatctattaacgggcctggctcactttaatccttctattaacgggcctgaccctctttaatccttctattaacgggcctgacccactttaatctgtctatccccttcgtatgcaattgttattttcagttgccaacgaatccaagttgtccgattttggtagaaagtaagtcaactagtcaagcattttaaactcatttgatctcaattggttagcacttgtacaatagtcaggtggtgaaattatgccttattgcgtgttatccatgattatcactatcgacaatatgattcgattgtatggtccattgatctataaatgtggattctctaaaccatgattaccaaccgcatattataattcggaaacaagaaaagaagattcagaatgtacaaaaagagaatccgagtaagtcattgactcagaaacaagacttaggagcattgcttctcttaataacagcctcaggcactcttagagatggctgtcacattgaagttgagagaactcggattcttctcgattatcttctttatcactttcgctgcgtcctacgaggataatatcaaagctattcaagtatataccggtttgcatttcctggattctttcaccgttttgataactttaagcttaaagagtgaagggtttatactactttgataattcttaagcttatagagtgaagtgtttatagtacatgcaataaggtagctggagaggaagtaccatgtgaaactggtcctgccctatctccatcaagttcatagagctcacttgcattatatggtaatagagtgtcacagtttagtgccaacttggaagtgagtttcattttggtgttgatatgaattttttttaccatctacacaagctaaacaaatgaaatgcgtgtccacctagtctgaagcctgaagatgggtaaacataaaaaaaccaatgtaacatctaagtgaacaagtcacaaatacattagcatcaacgggaggtgagaagttaccgttgtatcaccagctataatagctaaagaatgagcatatatcttctatttgactgtcgctctcaagaaaccttgctcgctatcaaaatttccatagacacacacattagacacgaagcaaacactctaagaaagatcaaatatataggagaaacaaaagatagagaaacacctctataggagtcatattggcagtggatttgaagaatctattcaggaacgacccctcagctgaaataagaaatcaaaagtgataatcgataaggattaatatctttagattaatgaaaggaacaaatagaaagcctgaatataactcacagagtttgatctcaaaggttatattctcaatagcatgaagaaggccaatggttccacaagcattatccacattttgtttcatgaagtaaactttatcactatgcacctaccaaattcatcaacacagagtatgaacgatacttaactacaaagacaagggttcttttttcatagaacaacccagatgtttatcagagagaagctcatcctttccttgatttcttggttatatacattatatatataaaaaatatgattaattttgcttagaaataatcttcctttaagaaaaaatgaaatatttacatgaaaatcaaccaaaatgaaagaatttttatacattatataaaaaataatatttttgtttcaatgtaggtggacaacttttatcctatgtagtttaaattaactgtgtatgggggtcaaaactataaaatactaggtcattataattattcctaagaaaaaaatatagttgtttttattttattttatagaggtcaattgacccccataatactgcactgcgtatatatgtttttgcattccgaattttgttttacctccgtatcatagagactgaaatatatatcgggtcttgtttacacaaaaaatcttaaaaataaatgaggttaattattatacaatatttaaaatgaagagacgtatccagtagcatatctagaaattgttgttgtaggggtcaaaagttttctttaatatataaaataatatacattatagatattaaaaatattcttaattttgcttagaaataatcttcccataaaaaaatgaaatatttacatgaaagtcaaccaaaatgaaataatttttatacattatataagattaatatttttgtttcaatgtatgtggataatttttatcctatgtagtttaaattaactatgtatggagtcaaaacaatataaaatacttagtcatcatgattattcttaagaaaatatagttgatttttttaattttatagagatcaattgatccccataatactatactgtatatcttttttcgtaggatttagaatggaaaaccttttggaataattcaccaatttacaattcattttatgattttgccatcacaaacgacatcagagtaaatatgactaacgggcccggcccaataattcaagattagttttttttaaggatttctagggtttttactttttagtatattatcttcttctctctctaaccctcagttctgttaagtacttggcttctaacaaacgctgtctgaatcatatttcgattctgatttttcttcatggattcgtatagccaataagttttttcaatattcaaaacaaaaaccccatcaaaataatctccggaccagtttctctttcgattcagtcggaccggaaaaacaatg

SEQ ID NO: 29121 - DNA, 3003 bp, Unknown; identical to SEQ ID NO: 29120
  misc_feature (1)..( 3003): 2750-1469P.txt file - cDNA_ID_2999833; gDNA_ID_1621100; Annot_ID_171370

SEQ ID NO: 29122 - DNA, 3003 bp, Unknown; identical to SEQ ID NO: 29120
  misc_feature (1)..( 3003): 2750-1469P.txt file - cDNA_ID_2999833; gDNA_ID_2926168; Annot_ID_140004

SEQ ID NO: 29123 - DNA, 3003 bp, Unknown; identical to SEQ ID NO: 29120
  misc_feature (1)..( 3003): 2750-1469P.txt file - cDNA_ID_2999833; gDNA_ID_2926168; Annot_ID_199289

SEQ ID NO: 29124 - DNA, 3000 bp, Unknown
  misc_feature (1)..( 3000): 2750-1469P.txt file - cDNA_ID_2999836; gDNA_ID_2926168; Annot_ID_140005
taccattcctatggaggtgtctctcagacagtcaacatcctcctcatgatggttgctggtttgtttgtcaatggtccttatgcactcatcacaaccgcagtctctgcggatctgggaacgcacaagtctttacaaggcgattcaagggcgcttgcgactgttactgctatcattgacgggactggatctgccggtgcggctttaggtccgcttttgacagggtttctttctactctgggttggcaagctgtgttctatatgttggtcgttggagctctctgtgctggtttgcttttgacccgtctggttattgctgaaattagagagaaacttggatatgttgatgaagaaggtaaataaccaaatctcttgagtttccttctactaatcacagtaatctcaattgcagaaacaatgatctgactttatctttgtttgctttgcagttcctgcttctgaaccactgttaaccgatagaagatgatggagaagggagcagcgagagaggcagtgtgaacagaaaccattgtttgcgcaagagttttgttctgttatataattatgagtttgcagaggaacttacagttctttgtattctgtgttttgtctgatattgtgaaaaatttctttatctcataacaaatgaaggaattggcttacagctttcttcctctatttcttctctgttttctacgacactcaaagcaatctttgcatggtggtgtttcgtaattgtaagaggaaactaatttcagtttttcgggtgaaactttgagatcttctatgattatccttcgaagcttttcgttctcttccattacttcatcaatgagtttctgatgtttcagcacctacacaatcaatttcgtgtatacataaccatggactactaaatctgataaactgtaacagaaaaaagaaagaaactggaagtcaagaaggagacgataccatttgaagcattaagctctccgattctagttgtgtgacctatcaatgtcatgaaacaaaaggaagttcaaggatggctttctgagatcaaagcagagagggggaaacattctgtgatagaattattacctgtcgttcttccgcagttgtgtcctggtgtttcagaatagggttgtcgagaaaactgttgatcactttctcagttcgagtaccaaacgttcttgaattagtagaggaaccactgttcttcaaagatgcttttgtgtccacatgtttcttgtgaccggttacagattgagacacctggtcttcagtctcagtttgacttgaggtggtctcactcgttcttccaagtttagtcatcaagttggatgcagttccctagaaaagattcatactcatggttttatgtgaatgaaattaataaggacactctttgaaagactggtgcttaccataatagaagcttgaagtttgtgtatggcacttggtttcactgcaatgcctgtcaatgatggatatgagttaatgacaataagagagcgatagttcaaataagtaactcaagggatgcttatacaaccaacaaatccaagtaactcaactgttcagaaacaagccatgtatcaaaattgaagagcgtttagaacaaaatcgaaacaagaagttttacttagaacggaaacataccaactccgaaaccatgaccaaagccaactccacagccaacacctgcttgaatgttcctcgctccaagcttccgcaactatagatggcgcaagtacacaaccagattcagaataacataatgcaggaagatctaaaaaagagcaggaacaagtttgtctatactgtacagcgccattcacgtggtgtgtggcacccgaaaatacattggttgctcctctagctgaattcataatttcccccaccattggaatactacctgatatgtcaataacaacaacatcaataccagattagtgatctcacaatcatgatgctgtgaaagcaaaccaattagcaaagtaaatgacacacgattttcaactatgagtgatagcttaacactagtttcatttccaagaactctgattgaaacatagtcttcaacaaacaataaaacttcttaatttgaacagaccataaaatcatcagtggcagcaatacactgagaatcaaaaatcaaactttcaaaatcaggttaatttgagctgattgattacaatcaatctcaccagatttcttaattacacactccttcacacctcaaaaacggagcaaaaggaaaaagagagtatataccgagattcaaaggtgcaccactaccaataccaactccacaaccaacgccaaatccagtgaagacttgaagagccttaaaagcaaaaggattctctattttaattccccttttagaaaaccctaatccttccttcttcatcaccacaccattgctgctgatgcttccgccgccaatttcctccatctatctcactaagctgaagatacgataatgggagttacagagaaaaagctaagaatcctccattgatttggtttcccgcctgtttttctttgtcgtagttaccgaactgttgataaagcaagagatagagactcggaaaatgaaagagaagaagaagatgattcagcgttctctgttccctggtcgatgagaaaatgtttaatgggccttagtgataagttttttcattaggcccattatgtaaatacaattcttttttctttttctttttgttgtatcgtattgaaactttctcgtccacgcatcttctgggttggcgaagacacgtcagcaatgcaaccaaaaaaaagaagcatttaaaaacaatagttgtagtgtggccctttctcatttcttaaccacgtcgtcgacacaacaaaccgatcgtgttacgtctctctctctctcagtctctcatcaccgacgaagatcacggctcttttctctgtttaatcggcggaatctctcttcttattttatttttcttccggtagatcgatccagctccgagatcaatcatg

SEQ ID NO: 29125 - DNA, 3000 bp, Unknown; identical to SEQ ID NO: 29124
  misc_feature (1)..( 3000): 2750-1469P.txt file - cDNA_ID_2999836; gDNA_ID_2926168; Annot_ID_199290

SEQ ID NO: 29126 - DNA, 3003 bp, Unknown
  misc_feature (1)..( 3003): 2750-1469P.txt file - cDNA_ID_2999841; gDNA_ID_1971815; Annot_ID_58214
tttttttgaagaacaaggataacagtaaatagttcagaattactttttaccatagaattggttcatctctttcaaatctagtttttgttctgcaaataaatttgatttgaacgcaaggaaagactcacaactcacaaggcttccttttgtagggttaatcactcacaaatctggtttagcattacaaaataaattgtccgttcttattattaaactccggaaataaaagaaataaattcactaatatttctaattagcatcttcacaaaattcactacctacaacatctataaccaatacaacaacaagaaaaaaaaaatctaattgccaaaaaaaagtgtataattatttcttcttcaatttttagattgcgtttgaccagagacttcaccaaaccggcgatgatcatatcctctgtttctaataagttcagcgaacgtaacacaactctctgtctggctatgtcctctcgtgaccttaatctttacatgttctggtaatctcaatgtatacttatcttcttcctccggtttatttctcactatcgagtgtcccgtagaatgcgatctagagaatttctccggcaagttttgttcctttttgatgctactggtctgtcctgaagatggccaagtatcaatctgtgttgttgtctgctgacgatgatgatcgtcttcttcgtcgtcgcttgtttcttgaatcacatctatgatcatctcatcgacagtaggcttggtgttttccggtggcggaggaggatcaagatcccgacgacaaacagggcaagttctgtgagattcgaaccagagatcgatgcattcttggtggaacacgtggtagcatgttgtcaagagacgtagcacgtgatctccgtcgaattcgagaagacaaatggcgcattcgaggccgtatttctcttcccggagatctttaacggaggagtaaggaaaagtgggaaatgagttaatgattcgaagttcaaggccgggatttaccggtggagcttccggttgctggaggggattgtcggatacggtgtctccgccgtggtggagacgccaagcttgcaccattgtgtcgaggaaacacttgcaaaaatagagagtgaagaaaccgatgaagaagaaaacgaggaggattacggtgaggatcaccgtgagaggcggtgtaacgtaatgttgttgcggaggttgcggtgccagaggtgaaggaattattgtcgacattacggtggccggagactgaatatctccgccgtgagacttctcatataccaaaaaaaaacaagaaagcgagagacaagagaaattcacttatttcaaaggttattttaattattagagttcagttttatttggtatagtgtgtggaaaatgtgtgtttggtgtgagagaaagagtgttaggaagttttggttactaaaaataaaaagtgtgttttgggtttggttatgtttgtttggtttgtttgcttaatgctatagcattgaacgagtcgtctgtgacatttgtttaacgttaagccacttcgtccttaaaaatagttaagttttttttctttttctttggttttaatagtatataagtctcgtttctaacaagcaataattaggatttaggttcatgacacatttcggctaatggcttttctttccttatatatacacaattcatcaaggtataaggatgttttgaatatacttgtttggtatgatcggtatacttcataaatcaactgatcatcaaaaactctcgatgaacgaccatattcttcgaaatcaatggtcattgagctatctttgtatttggtatacttttgaatcaacgaacatcggatcaactagttttgcacaagctcattccacaaaggtgtccacacggacctcaattgatgttttgcacgaagagacatgcatatatcggggatgtgaatttgcaaaacaaggacatcagtcctttagagctttggttgcttaatcatttccattttttctatttgaaaattttaatattatgaagaggagacaaaaatatagacccgtcggtaatcacttatctttgttttgacaataatattataagtcaagtactagtttccatcttccacagttagtaaacaaaactgttactgtattttataagatcatctttaccattaatagtgtgaaacaaattaaaagacaaagtcacaactagataacaaccatattatatgcatttgggaaaaccttatcttatcttatcaaaaacagcaaaatatccccaattgaatcagtatagtgaatccagatcttcccaatttcatagttaaagacaagaaaatgaaatgtcattttgtgtgattgtgatattaatcattcacatattaacatcattctcatcccatcgttaatccattacattttattgtatagatttgacacacaaaacaaaacaaaatgcatgcaaagacaattagtaaaacaacttctttttttgatctaacatcatgaataacatttggcatgacaacagaaattttatagtttcgataataatacagtaatactcatagttttatgattctgactgaatcgccaattgtttttcattaaagagaaaaatactatggtaaggaactaaggatccatgtggtaatcgaagagtcgtcgatcacgtgcaatcctccacacgtgttaagtcagctcgtagttgattcttcccccttgacggtcatctcatcggacggttgagatcagccaactttaagtgtatcacacggaaaagggaaatgtagcgcgagaaagtcaaaagatccaacggtcgatatgaaacaaaagtcagataatcgtacggtagaaacgaagctatatatagcaacaattggattattcttatcatcatcactctctgagatcgaagagaaagcaaaatcaaagttgtgatgaaatctctattgatgagaaccggttcgatgccggttcttcaaaaccggttaatttcaggtggttcatcgcggaagatg

SEQ ID NO: 29127 - DNA, 3003 bp, Unknown; identical to SEQ ID NO: 29126
  misc_feature (1)..( 3003): 2750-1469P.txt file - cDNA_ID_2999841; gDNA_ID_2926169; Annot_ID_140041

SEQ ID NO: 29128 - DNA, 3003 bp, Unknown
  misc_feature (1)..( 3003): 2750-1469P.txt file - cDNA_ID_2999845; gDNA_ID_1971815; Annot_ID_58216
taaccaaagaaacaaattgaagattaaagatttgctacatcaacacattacctctcctgttttaacctcaatgacatgaggcgtgaacccaactcctcctgttcctcctgctcacacacacacacagaggacaaaacccattaagtaaaattgtaaaacagtgaatttgatttgataagagaaagagagagagagatagagatagatcctgtacctaaagcatcgagctgcttcttaccggagccaggaggacgtcctctgttccgtttagcaggtggatcggaagagttagcattagctccggcgctatcaccaccaccacctccttcatttccaccaccgtaagaattagaagcagaaggaagaggcgaagtaggagccaaaccaagagcaatgttactaccaccaccaccaccaccaccaccatcagcagcatacttcctaggtctacctcgtttcttcttaacctgttgatggtcgatcccaaatctcatcgaatgttgttgagtggcggcaacagaagaaggcgatccatcaaatccaagagattcaagagtcttctgatctatctgttgctgaggctgaggatgatgatactgatgttgttgaggctgatgcggtgacatagaaccaccaaaaggtaatctttgatgcatagcttgagatgtggaggtgttgtgacccattaaaacagcggcggcggcgttagggtttcgattgtaggaattgtggtgactcattaacatccctggcggtggttgttgctgttgttgtagatgttgctgttgttgctgctgctgctgttgttgttgttgttgttgctgttgttggtggtggatctctctggaatccattggaggtggagaaaagtatgaatctttgtgaatttagggtaattttcttggagacccacttttctgttttacgaatgccgagaaaatagacgagaaagtgcaggtttttgagttttaagcgaaagcgtgtgagctagctaacaactctctctctctctctctctctctctctctctctctctctctctctctctctctctctctctctctctctctctctttcttgagttctttcatcagacgagggacgatctagttagtgtctaatttttttattttttttttgtgtttttgaagatttttaattatataaataaaagaagaaattgaggaaacaaatctttggtttatggttttcagttttcaggagattaagttttgtttttgttttctttaatattgatgaatttaacttttaaaatataatataattagggttttgttaaaatgtgaatgaaataaagagtttgtgtctttaataatgatgatgttcagtccagttatagtttctagttgtaatctaatgtaaatggtttggtgttctctcctttaacactagttctgttttaataaatggttttcaatttttttggggtttttcacataatttccattgttgcattgaatgaaccaagtttggttattggaagagaaatcaaaccggaatgagacattgaagtttaataaaatattaggaggttattttagttcagtgtctttttagaaaatctctaaaatgcaaacaaatgcacaagaattaataagagaataatatatcaaataaattattatgtaaactaaagattttggtttgactgtgtttgggaaatgcaaaaataataaagatggggtttgtactttgatgtgtcagattttttttcttaagtatatccttcagatcttaaaaacaatcactagtttgaaaatgacagcagcttattttgactattttgtccttctattgcctatctttttaagaaaaatctatcattcagaattcagaatactgttgtatatactctctatagattccaaattaattgacaaactcaagttactaatttttaatgctactatatcacatagataaagacccactggagttggaatagaatgtagcaaccaaatatttaatatatgcaactttagaatccaaaacaaaaatctgtgtaaaggaacaaaagtgtatattttaattggttatgtactcttctcccatacttgttcacgagaaaatggaatttaccgattagatttttttttgtatcccggtttaatccaaaggataaaatatgtgatgtgtatccggttttgttggagatgataatcaatgtaaaagactaaaagtactaaactttttatgtctaggtagcgactaaagtgattgactttagtagaccaacaagcaataaaaagcaaatgttatcaacagtttacgccatgcgcgtaccttaagaaactggacacgtaaaaccagatgctgtgaaaaattagtacctgaacatagaaatatttcgagacagataacgaatgtttttcttttaaagtactttagagtttatcatatgattcaagtcacctgaaagatccataatctctattatcacttggtgctgcaaggctgcaacacataagagtgttgcattgaaaaatgaaaacacttacggaaactaatgaacttggaagcaattgaccaaaagtataattattggtcaggtgggcttttattaatgggcttaactctcactaatgtagcccactagtgaaatgtaattgtggtaaataagaatttaccgctcgttaatggagaagaagaagggttagatttggaaagtagagaaatgagcaaaagcaagaagaagaagattctctctttgatccactttcctccattgtcgtcgcagagagagtggagatattcggattcagtttatgaagtagaacttgggtctaaaggattcagtttcataaaccctaataagtatctgttgtctgattaacttataggaaagatcatttttttttttgtttctcttagtgacggattggtctagaaactagtatgcaaattgtagcttctgggagagaaagtttgtatttttagtaacggatttattttgggagagtttgatttgtaaggattaggatg

SEQ ID NO: 29129 - DNA, 3003 bp, Unknown; identical to SEQ ID NO: 29128
  misc_feature (1)..( 3003): 2750-1469P.txt file - cDNA_ID_2999845; gDNA_ID_1971815; Annot_ID_175944

SEQ ID NO: 29130 - DNA, 3003 bp, Unknown; identical to SEQ ID NO: 29128
  misc_feature (1)..( 3003): 2750-1469P.txt file - cDNA_ID_2999845; gDNA_ID_2926169; Annot_ID_140043

SEQ ID NO: 29131 - DNA, 3003 bp, Unknown; identical to SEQ ID NO: 29128
  misc_feature (1)..( 3003): 2750-1469P.txt file - cDNA_ID_2999845; gDNA_ID_2926169; Annot_ID_199375

SEQ ID NO: 29132 - DNA, 3003 bp, Unknown
  misc_feature (1)..( 3003): 2750-1469P.txt file - cDNA_ID_2999855; gDNA_ID_2926170; Annot_ID_140059
caattcttccaaaaacgacataagagactaatctggaatcaaactcaacctaatctggaatcgaatgaatattgttcatgagagaactcaggcaagctaaaatcatcattttcatgtaatatcttcatagatagagactaatgtcagatgtttaattcaaccaccatattgcatcctaaagctacaaactttaagatacagctaccaataaaaacttaaaggaacaaaacccagagattgatctactaaaatcctaaaactctgtgaaatcaaatgagaaaaagggtttaccttgacggtgattctacggtcactctggggtctgatgaacttagcagacctcttcttcacaaccttcttggtaagcaatgggaccgccatatttgcttcttcgtaagatcgatatctcaaaagcgactccgtaaaacagctgaacaaacctaaaatgtcttttataagcgtacactagggtttctgatattacattactaaatgggctcacgttgtggcccaataagatttctttcacggccttttcgttttttccttcaactaaagaaattgtatgctcttaagaaaacaatctaatttattaaactaaaaggaaaatacacttttttcttcaattaagaaaatttttcgttttttttttttcactggaagattaattttcattgatgagatattaggtgaaatacaaaaagccgacgatcaatacatgatcccggaaactaagtcgaaggatgacaaagatatcctcggaaactaagccaagaaatatggagagcaaataacaacactacaagagaaacaagtcaaaacaatgacgactaaggaagcacacaacaaaggaaatcaaaactcttaactcagaatctagcaccaaacatcttgcatattatcaatccagaaacgagaaacgcttgaattgtttctttcttcctttttctttttttgtttcttaatttctttttacaaaatatcattcatggtggtcttcttctgctcgacgattgtggatgtcgtcacgacaagtaggacatgatcgcttgcagcgtagccaggggagaatacaatctttatgaaaactgtgagaacaaagcaacttcatgatcctcctctcactacctgatgatgctaactcttctagacatattatgcactcttcttctattggtattagacaaccttgagagtcataatcattgactcttaaccaatcactatacaacgtttctagaacaacttcaacttcaaccaagaaaccatctttttcttcttcttcaaggtggcgtcttatatcaatcaggtcttcgcagattttaggaacaatactttgctgaatccacttgttgatctttgacttggacaacacgttagccacaaatatactgcatatttcttctccggtgaggaaaacaggtgggatctcggatgcgattcttactgttgcattcttctttcctagcgatttttgttgagccaaagtttcacgaccgctaggactccggataagaatccgctcaattccttggatacttattgagaaggatcctgaatttttgtgatcgacgatgtgagtcttagattcatagtttagaatccatgttgatgtgccctccataattaaaagccttgttgattaaattatgtctgttttggctctaaaacaatcgatctcttctttatttatagaggttcattggagtctccaaattcacttaggtttcaaatttacatttatttagaaaaatagaaaaaatgatgccctaaataaatggaacatgtttaatcaatgattatctaaacacaaaattaaaaaattcgggccaaactgattttttttgttttgtcaaatgttttagttgactaagtattatcaactaaaaacaattaaacagatatatttttcggattccaaaagaagtttaaatatagttgaatttaatgggaaaaaatagaaaaaggagtaaaaaatgtcgagccacttggtcctttgttactcaatcattcgccgttgttccgatcattactcttctcttctccatccaattaaagattctctcttttaataatgctttcaaaagaatatctaatttcaggaataatcaaaaacttatttaatttctctcttctttatcaatgtgtatatataatacacacatatataagaaagtgtttcttctgtattcgtgggagaaacaaacaaaaaacaatttcttctaggtaagttttttttttttgttcttcctgctaaagtttcgatttttaaactaattgatacttgtgtgttcctttggctctagcggcaatgagtttgtgttagtgatcctgctaaatacaacaaaagggtgaagtagaataaagttggtttcttttttaatcaaaaacagttggatgatcacagtttagcttcttcgatattgaaaatagggttcttgttctgtttcctttagttccctctttcctctgctgtgatcgtttctgtcttgatgatgatgatttaccccaataaggttttgattagggtttataaactcagtggaatcaaagttcagggtttatagagattgaatcattaaggatttgtttgattattattgctaatggaatttgcaatcctctgttttttaaaattgtatccatcttggtttagaaaatcatatttctctgtttcaattggagtcatctttcaatcacttgcctccatcagggtttaaaagagtccccttttcgtcgttgtagcgaagaagcagaattaatcaaagttcagagctttcactatgaatatcccaagtggaaccttctcaagatctgatcatttccatgcttcaagtgatgcttctctcttttcaagctctcttcctcttattcaacaccaaaacagtatgtacattgagttgcctaattcgtctttatatcgtcatatgttggatgatgttataatctttaactcttgcagtcaaccctcgtgacagctaccatcagtctgttgatgaaatg

SEQ ID NO: 29133 - DNA, 3000 bp, Unknown
  misc_feature (1)..( 3000): 2750-1469P.txt file - cDNA_ID_2999859; gDNA_ID_2926170; Annot_ID_140061
gctcttcttcattgtaaatagttagttgctgaaaaccagtagcaacagaagtagaaacatcttcatctgaaaataatggaaaaagcaaacattagaaaacatgacaaagaggaagaaagagataaaaagaagactcacacagagaatatggatatctcaccttgattttcctcataagaatgtctttcagctttgttattttcatcgtcacatactaaggaatctctagattcatcgtcaaccaaatttctgcttgatactgaagctagcggattgtgatccacatcaggaggagacccagttggataagtttttgtttcgcggtggatgtcatccaaaagagtctcatccaaatgttgagactcactaaattggtcggaagaaatcttagattcagcagatggtttcaagacagaggatgatagataagaaacgtcttgcttctcaattgaagggcattcatccttcaaaggggctttactgctgctctcttgagcctctgatgaacgaggcaaagcgacattcttctgcaggttaggtctacccattttcacaatttcagccatagttctttgcccagggttagcgctagcccaagctgattgatacgcaggaaaaggcaacgaagacaaagtaactgcatcactgggggtcgttggtgctttcttgactttagagcttggaagatcactgcaatgcaaaggagatactaagataacacaaaatattggacattgttacgaaaattagataccaaaagaccacatgaaggtaagaacctgtttgatggtggttggcgtctaagcaaaccaggtaggcgtccaagcaaaccagatgatgcagaagatccagccaaatgattacgtgctccgttttctcttctattcacaggtacaccttgaatttttcctgtctctgaagcaaaatccagaaacaagtttagacatttttcaagataaccaaaaccacaacgaacataagaaaaaagagaaaactatctcttgcacaatttgcatcttactaccattagatttatacttgtttctgccacctcgagaggtattgtaactgtcattaccgcttctagctccacgattcgggacattacgcgtccaggagtctgcatggtctttagtctgaacaaacagacaaataaatgaaaatcagataaaaagattttaatcatctaaagctatatggcattagtaactaaactagtagctgttttatgttatattcgacaaacctctttctttttctctcgtttactcttcgcctcatgaaaagtatctgaaaagttttaacgaaacaacattataagaaactgtaacataaaaaaagagaaaaaaactgatttatatatttatttccagaaacagataacaaaaaagattcaacaaaatccaaaataacattactatttcaagaaacttaaggaaatcaaataaagttctgacacattctcttatacaagaagttctaacagattcaacatgattgcaaaaatttcttcacaaggttaaattaaaactccttgaagttttgattttttttttgctattcaagttccattaaacaaattcgaagctaaaacccagaaactaaaaaagagataaaaagctattgaagctggaagaacgaaccttgagagagaagacgattaacagcttcatcaggattcatatcgcactcaacaagcatcgcataaatctctaactcagaacactccacaatctccttcaaatcctgaataaccttcctcgaagacgccggaacacctccattcgcgttactaacgctgccgccaccaccacccattattcctctctctctccggattaccggaaaacaacacaaatcagatttgaattcaaaaacttcttagattcacgattctttgacgagcaattctaaaacccaaaataaagattcttgatgtttgtatctctttcgttctattgacttcgagtatatcggaagaaaaagaagaaaaaaacctcttttttatttattttatttcttttgaatttgggactaaataatgagttcgggaaaaaggaaagaaattcaaatttttggaaagttatgtaaagaaaatggtatatgtgttaattatcattatttggtagcttaattactttttttattaactttatatatttttagcagattttcaattaagacatgaataggttttggataataataagcttaattttacatattttgtttaaaacagttgttgtctgagattctattaaaaaaaaggcttaaaaaataattggagattttttttgaaattttagattcgagaaaagtaaaggtcacgcgctactaaaacaacgcgcggagagaaagaatctgggagtttttaaatgattgattaatggataaggacgttggtccgagcctacgtgtaatatgggcctaagcccattatacctaacttcaaattttaaaagaattaaaaggagaagcacgtgtcaagttacaagggtgagtagctgagctggataaaactctatacgtgtcatcttattacaggttaagaacccgcccaccaaaagtttttgatcggaataaaaaaaacgtaataactaataagcttctctcattcgtggaattgtctttcagaaagaaaaaaaccagagaggaggaagaaaaaaaaaactcttgcttcttcaggtaggtcttcttcttcttcttccttagctcaatctaattcttgttgtttttctgcaattttgattgttaattatctgtgtttaacgtttcttagcaattttattttggttttatcggttgacttgtgtttgagtttgtgaaaatgatcaaaaattcctgttacagatccgtatgtttatcttactatattctgtaatttcatcaacaagctgactttgttttgcagtatctgctgctggtttgatcttgagaccatttcttttgcagcttgttgttgtatttctagagactatgccaatgccatttttgaaaatg

SEQ ID NO: 29134 - DNA, 3000 bp, Unknown; identical to SEQ ID NO: 6259
  misc_feature (1)..( 3000): 2750-1469P.txt file - cDNA_ID_2999876; gDNA_ID_1621085; Annot_ID_55369

SEQ ID NO: 29135 - DNA, 3000 bp, Unknown; identical to SEQ ID NO: 6259
  misc_feature (1)..( 3000): 2750-1469P.txt file - cDNA_ID_2999876; gDNA_ID_1621085; Annot_ID_170506

SEQ ID NO: 29136 - DNA, 3000 bp, Unknown; identical to SEQ ID NO: 6259
  misc_feature (1)..( 3000): 2750-1469P.txt file - cDNA_ID_2999876; gDNA_ID_2926172; Annot_ID_140183

SEQ ID NO: 29137 - DNA, 3000 bp, Unknown; identical to SEQ ID NO: 6259
  misc_feature (1)..( 3000): 2750-1469P.txt file - cDNA_ID_2999876; gDNA_ID_2926172; Annot_ID_199604

SEQ ID NO: 29138 - DNA, 3000 bp, Unknown; identical to SEQ ID NO: 3891
  misc_feature (1)..( 3000): 2750-1469P.txt file - cDNA_ID_2999895; gDNA_ID_2926150; Annot_ID_139253

SEQ ID NO: 29139 - DNA, 3003 bp, Unknown
  misc_feature (1)..( 3003): 2750-1469P.txt file - cDNA_ID_2999898; gDNA_ID_2926150; Annot_ID_197995
ccatgaatctgtctcccttctgcaaaaccttccttattgctacaaacttgcaaaagcttaaccattgtgctatcataagctttagcaccagaaaactgcatctctctgaaaagttccacagccttttcccaattcccactccgcaagtttaccattacgatctcgttccatgcaagatcatctcttttaggcatttcatcgaataacttgttagcaaaacccaaactcacacatcttccataaaaacccatcgacgcagaaaccactcgtgtgtctgaattatcaagccctctcttgatcaaaccaccatggatagttaaacccagaaaccgatacattagaacagcacaaattctcaaaaccatagcgagaactacttcatcaaaatttactcctttgttctgtagctgaacaaattcctctaagaccctatacttttctactccgaaattctcagccttttccaaaaaatccctccatgaaacttgattccgagggaaccccatgaagaacacagtactagcatatccaaattcttgaaattcaaggtaacgagtgatcaagctcttagcgatgaactccaattcgaatcgatcgaataacttcatcatccgagcatgagtagctttaacagaaaccagatttttgcatccatttagcttcttcaacggataaaaatcccaacttggagacgacggttccagagatattgagaatggtatagattcaaacgactcatgtttgatttccagagaagaacaagaaaatgaatggttacctagatatcttcgctgcgagtgatgaagaaacaaggagctgtaacaatggcggtaagttgaagagaagttctccattttattcacttcacagtttccggataagaggacactatccgttttattggtattttcactacgatctcagaaacgcagcgttttatatgtttgaagaagattcactagcagaagatagcaaattactcatctaaacactacaaaaagttgagaaagattcaacatcattctcaagtgttcttacaacaaaagcagcaacttacataagcttgagctattagtgttcatcttcaagaatgatacaagacaagtaaacattttttcatgaaactaatctgtgatagtttaccatttttcccttggagtaccatcagggaacacaggagtaagtactttctcttctttctttctaggactacttgattttctacttgaaggacttaatccaatcttcacgctatcttcttcttcgtcttcatcatcatcatcaaagttaggaggcacatcttcctctccttcgtcatctgtccaatcgccatcatcatcattgccaccatcttcaccttccaagtaaccatcaacatcagaccattcttcagcatcactttcttcttcttcctcctcaccatctgcatcgcttccatcgatctctacctctcttccttcttcgtctttcctgggtcctcctctccttgggaaccttggtacagaaacaagtgcacgcatcttctctttcacaagagttaaaggatctttatctatcaattcagagttcctgtaagcttctcttaagaacaccgagtctctttcacctttcaaagacacgtagaagagatcagggtgcctaataagcattcccctcagttgttgtgagaatctgaattcctcacggaaatgagtcaagtgatccaccagcgttcttttctcagtcgttaagctcaaaagctcatgaataaccccacaagcatgcttttctttctcgagtgttcccgacctcaagtgggagaaatccttgtaaggagatatatactgcatgtcacggaactgagatatcttcctcgtctcactctttgaaagattgagaccccttggaagcttaaccctgttgaacttaggtggtctatcaataatcaaattcctttcttctgactctctagtcctattatcatcctcagataactcagcagctgacactgcaagctcaggatcccagtgagtcaactctaaagccggacctctaggcgtaggaaccacacggaaatattgcgggtaacgctgacaaatcgtgtcgcggaactctaacggaagccctaaatcagtcttcaaatgggaaatcttctccaacaatatccgcttatcaatagacatcatcaccagtttcctcagcttaacaaccagtacatcttcaagctcattcctaatcctcatttcgtcaaggtacaacctttcagcctctgatgtcatcttaaatctcaaagaataagctccttcttcaactatctcaaacacaccaggatatttcctaagcagagctataaaccgacgacgtttcttcaaacccaaatctctcctgtacttacccaaacccctaagagacatcatcctatcaggttgactcacaagaatcttcctaatgttcaacactaacttaagtttcttatccctttgaacaacgctatcgaaagtaagctctttccttctcttcacagcagctctcacaggctcaacaacaacacgagttttcctagaagtactccaaaacccatacttgttccccaaaatcaaaccttcccccataaactgagacctcgcagctcgaattgtggacatgggcaaaccggatttgaccgaaagcttggttttttcattgaatggagagttacaagagacaaacaaaggtttatgtgcagaaagcagaagcttgggctccatttctgagactccaagcctgtaaattgataactcctaataagtattctccgacgaaaaattgattccaggaaataaaaaaatcttaccttatcccttcggttcaatctagtaagaggttctgcagaagaatctgtttctggtcgcgaagatttggattggggtttaacgataaaagtcataaaaccctcttcttttttccagaatgatgtgtccatctctctgatatcctcttattggtctttaacgtaatatttgaccagaagcaggggtaaatatg

SEQ ID NO: 29140 - DNA, 3003 bp, Unknown
  misc_feature (1)..( 3003): 2750-1469P.txt file - cDNA_ID_2999898; gDNA_ID_2926150; Annot_ID_139256
gctttagcaccagaaaactgcatctctctgaaaagttccacagccttttcccaattcccactccgcaagtttaccattacgatctcgttccatgcaagatcatctcttttaggcatttcatcgaataacttgttagcaaaacccaaactcacacatcttccataaaaacccatcgacgcagaaaccactcgtgtgtctgaattatcaagccctctcttgatcaaaccaccatggatagttaaacccagaaaccgatacattagaacagcacaaattctcaaaaccatagcgagaactacttcatcaaaatttactcctttgttctgtagctgaacaaattcctctaagaccctatacttttctactccgaaattctcagccttttccaaaaaatccctccatgaaacttgattccgagggaaccccatgaagaacacagtactagcatatccaaattcttgaaattcaaggtaacgagtgatcaagctcttagcgatgaactccaattcgaatcgatcgaataacttcatcatccgagcatgagtagctttaacagaaaccagatttttgcatccatttagcttcttcaacggataaaaatcccaacttggagacgacggttccagagatattgagaatggtatagattcaaacgactcatgtttgatttccagagaagaacaagaaaatgaatggttacctagatatcttcgctgcgagtgatgaagaaacaaggagctgtaacaatggcggtaagttgaagagaagttctccattttattcacttcacagtttccggataagaggacactatccgttttattggtattttcactacgatctcagaaacgcagcgttttatatgtttgaagaagattcactagcagaagatagcaaattactcatctaaacactacaaaaagttgagaaagattcaacatcattctcaagtgttcttacaacaaaagcagcaacttacataagcttgagctattagtgttcatcttcaagaatgatacaagacaagtaaacattttttcatgaaactaatctgtgatagtttaccatttttcccttggagtaccatcagggaacacaggagtaagtactttctcttctttctttctaggactacttgattttctacttgaaggacttaatccaatcttcacgctatcttcttcttcgtcttcatcatcatcatcaaagttaggaggcacatcttcctctccttcgtcatctgtccaatcgccatcatcatcattgccaccatcttcaccttccaagtaaccatcaacatcagaccattcttcagcatcactttcttcttcttcctcctcaccatctgcatcgcttccatcgatctctacctctcttccttcttcgtctttcctgggtcctcctctccttgggaaccttggtacagaaacaagtgcacgcatcttctctttcacaagagttaaaggatctttatctatcaattcagagttcctgtaagcttctcttaagaacaccgagtctctttcacctttcaaagacacgtagaagagatcagggtgcctaataagcattcccctcagttgttgtgagaatctgaattcctcacggaaatgagtcaagtgatccaccagcgttcttttctcagtcgttaagctcaaaagctcatgaataaccccacaagcatgcttttctttctcgagtgttcccgacctcaagtgggagaaatccttgtaaggagatatatactgcatgtcacggaactgagatatcttcctcgtctcactctttgaaagattgagaccccttggaagcttaaccctgttgaacttaggtggtctatcaataatcaaattcctttcttctgactctctagtcctattatcatcctcagataactcagcagctgacactgcaagctcaggatcccagtgagtcaactctaaagccggacctctaggcgtaggaaccacacggaaatattgcgggtaacgctgacaaatcgtgtcgcggaactctaacggaagccctaaatcagtcttcaaatgggaaatcttctccaacaatatccgcttatcaatagacatcatcaccagtttcctcagcttaacaaccagtacatcttcaagctcattcctaatcctcatttcgtcaaggtacaacctttcagcctctgatgtcatcttaaatctcaaagaataagctccttcttcaactatctcaaacacaccaggatatttcctaagcagagctataaaccgacgacgtttcttcaaacccaaatctctcctgtacttacccaaacccctaagagacatcatcctatcaggttgactcacaagaatcttcctaatgttcaacactaacttaagtttcttatccctttgaacaacgctatcgaaagtaagctctttccttctcttcacagcagctctcacaggctcaacaacaacacgagttttcctagaagtactccaaaacccatacttgttccccaaaatcaaaccttcccccataaactgagacctcgcagctcgaattgtggacatgggcaaaccggatttgaccgaaagcttggttttttcattgaatggagagttacaagagacaaacaaaggtttatgtgcagaaagcagaagcttgggctccatttctgagactccaagcctgtaaattgataactcctaataagtattctccgacgaaaaattgattccaggaaataaaaaaatcttaccttatcccttcggttcaatctagtaagaggttctgcagaagaatctgtttctggtcgcgaagatttggattggggtttaacgataaaagtcataaaaccctcttcttttttccagaatgatgtgtccatctctctgatatcctcttattggtctttaacgtaatatttgaccagaagcaggggtaaatatggaattaacatcattccaaaaatctcctagttctaacgatgttgtttcgttctctgtttcactggtgagaaactcgatg

SEQ ID NO: 29141 - DNA, 3003 bp, Unknown
  misc_feature (1)..( 3003): 2750-1469P.txt file - cDNA_ID_2999902; gDNA_ID_2926150; Annot_ID_139257
gtttcttatccctttgaacaacgctatcgaaagtaagctctttccttctcttcacagcagctctcacaggctcaacaacaacacgagttttcctagaagtactccaaaacccatacttgttccccaaaatcaaaccttcccccataaactgagacctcgcagctcgaattgtggacatgggcaaaccggatttgaccgaaagcttggttttttcattgaatggagagttacaagagacaaacaaaggtttatgtgcagaaagcagaagcttgggctccatttctgagactccaagcctgtaaattgataactcctaataagtattctccgacgaaaaattgattccaggaaataaaaaaatcttaccttatcccttcggttcaatctagtaagaggttctgcagaagaatctgtttctggtcgcgaagatttggattggggtttaacgataaaagtcataaaaccctcttcttttttccagaatgatgtgtccatctctctgatatcctcttattggtctttaacgtaatatttgaccagaagcaggggtaaatatggaattaacatcattccaaaaatctcctagttctaacgatgttgtttcgttctctgtttcactggtgagaaactcgatggcgaggaggcgacgttcatcggcggcggagagtttgaaacggcggaacgacggatacgagtcactgtgtcaagtcgtacaacaagattcagatcggagactcatcaccattttcgtaatcttcttcattgtgattcccgccgtttcgattgctgtgtacaaagtcaaattcgctgatcgagtcatccaaacggaatcatcaatacgtcaaaagggaatcgttaaaactgatattaatttccaagaaatcctcactgtgagttccatagttttgggtcaatgttgcaattcaaagaagaaaagctgaaaactttaggatgaattttcattaaatttggtttgaatttgtttcaggaacattccaaggcttcagagaattcaactaggcactatgattatccagtgttagcttacattactccatggttggtttctttggaacatttttagatttgagatattgaaaatatacaaattgttgtcactgagggcagtagggattggattcatatgctaaaaatgctgtgtaggaactctaaaggctatgatatggcaaagatattcaactcaaagtttacacatttatcgccggtatggtacgacctgaagaggtatattgtatacatttgttaatgagttctaagttcctgcaattatctcatggtttccacaaaatagtagtgacatttttggtttctgtttctggtagccaagggtctggattggttttggaagggagacataatgctgataagggatggattcaagagcttcggtcaagaggcaatgcactggtagtttaaccagcacacctatttttcttccttctctgaattggccagagatcggtacccggaaaatgctgatgtttaacttgtttttccttctttgattgtctggacttttttccccttttatgtagatattaccaagagttgttctagaagcaattcctggggagatgcttaacaaaaaaaaactaagagagaaagctatcagtcttattgtcacagagtgcaagtaagggtctcccaaagctctacaattcctgtatatttcatgctctgaaaaggatgaatttctttacattagagcttgtgaattttaacacttaccttgtcatcatgtttgccttgaactctagggaaatggaatacaatggtatcgtgttagagtcttggtcaaggtgggcagcttatggcgttttgcatgaccctgatttgcggaaaatggtatgccctgtaatctcttccaggccgctgcgattttttttccacataatgcatcatgtcagcaagcttttttataaatcttctaggcactgaaattcgtaaaacaacttggagacgctcttcactcaacgagctcaccaagaaacaaccagcaacatatgcagttcatgtatgtcgttggtccgcctcgttcagagaagctccaaatgtacgattttgggccagaagatcttcaattcttgaaagattcggttgatgggttctctcttatgacctatgatttctcaaatccccagaaccctggccccaatgctcctgtcaagtggatagatttaactctcaagctcctgcttgggtcatccaacaacatagactcaaacatagccaggaaggttcttcttggtatcaacttttacggcaacgattttgtaatctctggaggtatataaagcatccaagcttatataagcaacttgttctcttcccgcctttctttcaaaaccaactgacataaactgttttcttttgcgcaagattcaggaggtggaggagcaatcaccggaagggattacctcgcattactccagaaacacaagccaactttccgttgggataaagagagcggcgaacatcttttcatgtatagagatgataagaacatcaagcatgctgttttctatcctacattgatgtcaatccttctacggcttgagaatgctcgtctctggggaatcggcatttcaatctgggaaatcggacaaggtttagattatttctttgatctattgtaagttccatacattgcatcatgttatgttttcttaatgttatacttgatcctctttgttcacttaaatcaaatgctgaggaaccttttgtatctagtctagtctctgttctttgtgttctagataaaggacattttggtaaatatgcagaggcttctcttgaagcatcttcaatattctctggccacacatttgacatgcaatttcggactaagtaagtcactatgctttagtcctctacaccaaaacatgatcaagaggtatctcatccgaatattccacgtgtcaagcaagcggtggctaggattgattacacagtccacgtcagctctctagaaacggctcaatg

SEQ ID NO: 29142 - DNA, 3000 bp, Unknown
  misc_feature (1)..( 3000): 2750-1469P.txt file - cDNA_ID_2999909; gDNA_ID_2926150; Annot_ID_197999
agttgattattggaatggtgtcatcaaattgatgaagaaatggttgacttacttgttgttgttgcagccatttattgaagagtttagccatccaatgctggataactgcgctgcaggaaacacagacgtgtttgtgaatggaagagagcttcacaagagagatttcgagttacttgtgggtcgtggtctgcctagagacaagaaccgttcttacattgttgatatatcaggaagaatccttgatcaagattcaggagaagaacttcacagccttggcaaattagccccaacgtaagcagattcacacaaatgatttttattcttttgagattttgagatcacctaagattctaaagttttagtgtgttaaacttgaaacaggattgagaaagtgaagcatggatttggtatgagagttccaagatcattagcttcatgaaaactccccctagtaacaactacacaaccaaaatatgattctgcttcttgtttccatcttcatattatttatttgttaaacacaactgtaaagtgttttttacatcttgattttgatttttggtattctttttaaaatatctttggggaaatgtctgtatgttttttattgcgaccagaaccggtttaggggttatagactgtatacaaaccgggttctctcggtacaaggtttgtgctttgtattatttccatttttttatggaatgatattagtttgctcttaatgacttttttttttatctcttttattgctcttttgtaagttgtaacagaagcttcatcgataacatggtttactcctcctaattccttattatctctggtttaactaaatcgtttatttaaaccggttttggtttgtaggtttctttcatgtcagcaacaatatatgtaggtcattcgaccatactcaacaattcaattaaacaatgttctcctagctgatctttctttcttcatgattagcttctaggcttgatttgccctttcctcgagttctaggtgaattatggattgggattatctatctatcggttagttatccggtttcatctttctttccactaaaatgttcatattgtctgctaattcctctcttggctgatggactagtttttgcacgtttctgaagtgggtccttcctaaaatacaagacaacagattataacttactcatgggcccaatatcaatatcaatatcaaacaagaaagagaatctgttcttaacaggcctcgtggtccgttcgtttagttttcatgtttcaatatttcttagaaaaatacaaaattagagtaagaacaaaaagatactaactagtagcgagcatgagaaaaacgagtaagcagaagttgtccactaataataaaattgtgaggaatcaagaaattctcaatacaaaaaaattttagcaatgaagaaataaaataaaatattattagcaataattggagtcactagaatgtttcatatctctttatatactaacactagtgttagttcattcacgcaaatgttaaaaaccaattctaccattgttaaacttataccaaatatttaaactagttacctgcatcattctaataactaataagtctcatgaattcacaaacatagcaatgttttgaataacccaatatatcatcaaaaagtgtggtgcttccgtgtttgctaagttccaagattcaagagaaaggttgatattgttgtaacgaaaggctgtggagatacaagtataccacctaagttgagataaaaggtgtgaggaccaaaagcagggcatgtgcttcttcacataaattaaaagaaaaaaactcaagttattactaatatgtgattaataaacacaaggacaatgagaccatctgggctggtccaacatatttttggattcctcaagcaaagttgaaaaaaaaaaacttttctgaattttttaatcagaatttcactatcaaaagtcataattgtaaaaaacaaatcctgaaatattctttattccatttccaatatatattgctgtcacaaagaaatctacaaaaatatttgttataacttaaaagaatgcccaacaatttagcctataatcatatatgcttcttggacaaaaaaaaatcttggaacaacaatgctaattaaatttttctttttttttttcttacacagagctaattaactttttcttttttgttgactgtggttaacataattccagggtgatggtatattcaatgtcgcagtatattcaatgttgcatggtgtgtgaatagttgtactataatattccctcttttcatttttatttgatattttaggaaaaatacacatattaaaaaaaatatattaaaattgatattaaatatattatttttttgtgttttacaattttttattattttaaaccaatgattgaactattaaaatttacaatttattaataataactaataaatattgaatagaaaatttacaaaatcaatctttttaaaacaaatatttttccaaaaaaatcaaataaaaaggaacagaaaaaatataatatgacagttcgaaagtataattcaaatctgtaattgttacggttttgttattcttctttcttgtcgttgtttgtgacaaaattgtaatcaaatatattgtatatctcacaatggtgtgactttttaataccatatttttttgtaacgattgtatcactacaatttactacttgtcacaaattcatgacaatagtttttactgttacaaatatgtttctattgagacaaaatattttgtatcaataaaattactttttctgcagtaattaataaatagactgtctgaaattcacaaaattattattcctgcatttaataaaagtaaaaaagggtaacaaaacatcactttcatggtcacaaagatcctaaaagttaatctcaaacctaaccatctcattctcacgagtccaactataaaatcattgaatagcttccaccaaattcactgtgctctcttcttcaatg

SEQ ID NO: 29143 - DNA, 3003 bp, Unknown
  misc_feature (1)..( 3003): 2750-1469P.txt file - cDNA_ID_2999909; gDNA_ID_1621155; Annot_ID_57014
tcaagttgattattggaatggtgtcatcaaattgatgaagaaatggttgacttacttgttgttgttgcagccatttattgaagagtttagccatccaatgctggataactgcgctgcaggaaacacagacgtgtttgtgaatggaagagagcttcacaagagagatttcgagttacttgtgggtcgtggtctgcctagagacaagaaccgttcttacattgttgatatatcaggaagaatccttgatcaagattcaggagaagaacttcacagccttggcaaattagccccaacgtaagcagattcacacaaatgatttttattcttttgagattttgagatcacctaagattctaaagttttagtgtgttaaacttgaaacaggattgagaaagtgaagcatggatttggtatgagagttccaagatcattagcttcatgaaaactccccctagtaacaactacacaaccaaaatatgattctgcttcttgtttccatcttcatattatttatttgttaaacacaactgtaaagtgttttttacatcttgattttgatttttggtattctttttaaaatatctttggggaaatgtctgtatgttttttattgcgaccagaaccggtttaggggttatagactgtatacaaaccgggttctctcggtacaaggtttgtgctttgtattatttccatttttttatggaatgatattagtttgctcttaatgacttttttttttatctcttttattgctcttttgtaagttgtaacagaagcttcatcgataacatggtttactcctcctaattccttattatctctggtttaactaaatcgtttatttaaaccggttttggtttgtaggtttctttcatgtcagcaacaatatatgtaggtcattcgaccatactcaacaattcaattaaacaatgttctcctagctgatctttctttcttcatgattagcttctaggcttgatttgccctttcctcgagttctaggtgaattatggattgggattatctatctatcggttagttatccggtttcatctttctttccactaaaatgttcatattgtctgctaattcctctcttggctgatggactagtttttgcacgtttctgaagtgggtccttcctaaaatacaagacaacagattataacttactcatgggcccaatatcaatatcaatatcaaacaagaaagagaatctgttcttaacaggcctcgtggtccgttcgtttagttttcatgtttcaatatttcttagaaaaatacaaaattagagtaagaacaaaaagatactaactagtagcgagcatgagaaaaacgagtaagcagaagttgtccactaataataaaattgtgaggaatcaagaaattctcaatacaaaaaaattttagcaatgaagaaataaaataaaatattattagcaataattggagtcactagaatgtttcatatctctttatatactaacactagtgttagttcattcacgcaaatgttaaaaaccaattctaccattgttaaacttataccaaatatttaaactagttacctgcatcattctaataactaataagtctcatgaattcacaaacatagcaatgttttgaataacccaatatatcatcaaaaagtgtggtgcttccgtgtttgctaagttccaagattcaagagaaaggttgatattgttgtaacgaaaggctgtggagatacaagtataccacctaagttgagataaaaggtgtgaggaccaaaagcagggcatgtgcttcttcacataaattaaaagaaaaaaactcaagttattactaatatgtgattaataaacacaaggacaatgagaccatctgggctggtccaacatatttttggattcctcaagcaaagttgaaaaaaaaaaacttttctgaattttttaatcagaatttcactatcaaaagtcataattgtaaaaaacaaatcctgaaatattctttattccatttccaatatatattgctgtcacaaagaaatctacaaaaatatttgttataacttaaaagaatgcccaacaatttagcctataatcatatatgcttcttggacaaaaaaaaatcttggaacaacaatgctaattaaatttttctttttttttttcttacacagagctaattaactttttcttttttgttgactgtggttaacataattccagggtgatggtatattcaatgtcgcagtatattcaatgttgcatggtgtgtgaatagttgtactataatattccctcttttcatttttatttgatattttaggaaaaatacacatattaaaaaaaatatattaaaattgatattaaatatattatttttttgtgttttacaattttttattattttaaaccaatgattgaactattaaaatttacaatttattaataataactaataaatattgaatagaaaatttacaaaatcaatctttttaaaacaaatatttttccaaaaaaatcaaataaaaaggaacagaaaaaatataatatgacagttcgaaagtataattcaaatctgtaattgttacggttttgttattcttctttcttgtcgttgtttgtgacaaaattgtaatcaaatatattgtatatctcacaatggtgtgactttttaataccatatttttttgtaacgattgtatcactacaatttactacttgtcacaaattcatgacaatagtttttactgttacaaatatgtttctattgagacaaaatattttgtatcaataaaattactttttctgcagtaattaataaatagactgtctgaaattcacaaaattattattcctgcatttaataaaagtaaaaaagggtaacaaaacatcactttcatggtcacaaagatcctaaaagttaatctcaaacctaaccatctcattctcacgagtccaactataaaatcattgaatagcttccaccaaattcactgtgctctcttcttcaatg

SEQ ID NO: 29144 - DNA, 3003 bp, Unknown; identical to SEQ ID NO: 29143
  misc_feature (1)..( 3003): 2750-1469P.txt file - cDNA_ID_2999909; gDNA_ID_1621155; Annot_ID_173482

SEQ ID NO: 29145 - DNA, 3000 bp, Unknown; identical to SEQ ID NO: 29142
  misc_feature (1)..( 3000): 2750-1469P.txt file - cDNA_ID_2999909; gDNA_ID_2926150; Annot_ID_139260

SEQ ID NO: 29146 - DNA, 3000 bp, Unknown
  misc_feature (1)..( 3000): 2750-1469P.txt file - cDNA_ID_2999914; gDNA_ID_2926150; Annot_ID_198003
atgcatcggttagagactatagatatatatacctggtcggtccaaagaatgtgactcgtcgacattaaccttgaattgtttcatctgattcagctgaatagcgagtgagaaagggctgattccggagacaaataaagacgtgtttggcaagagaaccgtggacgctaacgtcgcaaagtttgcgccatgtcgaaaatccgatccaatagattgcaaatatgggcttaggaaaggcattccaagagatttggctaaaataatttaacactacgtttagcactatagtgataatttttgggtaataacagtaagtattatagattttgtttaaaatttcaatctaaaatcctaattattagacctggaaaaataaattgaaccgaacgtacagaaccaaatccgaagaaatgaaaaccgagtcggtaccgaaccaaaatattttgagtaaccgaaaatatccgaaatataattatcttttcaaaaatattagttattttttgactaaatagtaaaaatacttgaaaatatccaaaaaaaatcaaaaagaaccgaaatatccgaaaatattcaaagcaaaataaccgaatggatactaaatatttaaaccgaaagaaccggaaccaaacccaaatttcaaaataagcgaatagatattaaacattagacccaaacagatacgaactgaaactgaatggataactgaacgctcgaactactaagtatatcttaaatatttttaaaaaatattttaatactaaaggatacaaaaaattatactttgtagaggggatttgatactgctgtcatattatacgttttttgaaaattttgagagtatttgttagtcatttgttacctagaaaatcaatgataagacgaccgtctgaagcacgaccggctggtttcttgaaataagtcattccccatggaccagattgggcaggaaaagcagcccaaaatccgccagtgtccgaattcgagtctccgaagttgaaaattgcttcgaaatcacattttgaatcacctttatgcccataaagcatcacaataatcaagactagaagagagaacgatcttcttctgtttatatcggaagccatgtctatctctgtgtgaacaaaatgtgtgtttgtatgtgagagtgaggatgagatatttggtgctatatgattcttgtaatcatcccgtccgtgactctcactctcattgtacgtgtaattagtgtgttatagccttaatggtttttttagtccaacaattccctttaagcccaataaaagataaataaagcccaatctattatattgattccaagggttcaatatatatgagatatgtctaacaatacatcaaaagaccagtttgaataacaacacatcaatttatggattggatatgaataagatgtcatgtatgcaacaaccaaatttgacatttctcttgtaatgccttgcaataaaagttattttgttaactttttgcaaagtatgtgccaatcaagaacaggataaaaaggttgggtctaataattcaactacggcccaataataacccaataaaggagggtattaacgtaaatttatgtcttggaccgggagtctaactgcacgcgtcaagtggctcccactagaattggcatcaagaacacgtcaccttgaccttgtcggatttgtctgaaattgaattcattctttttttagtgactctcttaaattggaattagatcttcagtctaaatcttaatgattataagaaacaagattatatgcatcatttcggatttaaacaacatggattaatctcaactaatttagcattaaagataagattttgttaacccttttttattgggtggatcctacgtggcgaagattgagtcatcgtctaaaattttaaaaaagatttcaagaaaaaattaaaaaatgagctggcgtcgaatcccacgttgtccgtagggaccacaacggtattccttattcagtgggacacgtcagctttataaaaccactaacggccgacacaagtcagtagatcctacagtggggaccactctaacctttttctggttaaaaaaagatatattttaccgtagatgaaatcaatattagccgtcgattaaatggtaaaaacaaatatgcttgatttggtagtccacgtttcgtcatctgtggatctcaaatgaattatacattatagtttaattctgtattttcattatttaaaaggaataaaatcagcagcacgtcaagtctacgtagagatctcaagatgaacggtggcgattatgactacgtgtaccaatcattatttaagtcagatatttaaaatgtccagcgcagatctagggttgccagctcagcatatgcgttccctttgcaaacccttcaagatcatgacacgtgtacggtgacgtgttcatcagcctcttggcgctccgttgtgtctctcttctttttcttctcttctccttcctctctcttcttttaccgaactctggttctagagagagaaaccattctctccgactaagagagagaagcgaatttgtttttttttcttttgtgggttcaattcgaattgttttccctgagactcaaggtacgtttttggattttggttttcgttattttcttcaatgaatatctgagtgattatatatgaacgctctgttttctcgagaaagtgtgtattgagtgaagaaaattactaggaaagttaaaggtagattgaattgtgtaactctactagttggtgatagttttgaacttttgacagaggaaaaaactcgactttgaatcttttactggtagattcagtggtgctatactttatagttactcggatctctgttatatttatagtttgatgtccacaattgcgagatctaggtgtaattgaatactgttcttttagatttatgctttacagaggaactgctaaaagatctgatcatttttttgtttataaagttactgtgtcattactctgcattgagcaatg

SEQ ID NO: 29147 - DNA, 3000 bp, Unknown; identical to SEQ ID NO: 29146
  misc_feature (1)..( 3000): 2750-1469P.txt file - cDNA_ID_2999914; gDNA_ID_2926150; Annot_ID_139264

SEQ ID NO: 29148 - DNA, 3003 bp, Unknown; identical to SEQ ID NO: 22476
  misc_feature (1)..( 3003): 2750-1469P.txt file - cDNA_ID_2999918; gDNA_ID_2926150; Annot_ID_139265

SEQ ID NO: 29149 - DNA, 3000 bp, Unknown; identical to SEQ ID NO: 7648
  misc_feature (1)..( 3000): 2750-1469P.txt file - cDNA_ID_2999922; gDNA_ID_1621155; Annot_ID_57009

SEQ ID NO: 29150 - DNA, 3003 bp, Unknown; identical to SEQ ID NO: 22885
  misc_feature (1)..( 3003): 2750-1469P.txt file - cDNA_ID_2999922; gDNA_ID_2926150; Annot_ID_139267

SEQ ID NO: 29151 - DNA, 3000 bp, Unknown
  misc_feature (1)..( 3000): 2750-1469P.txt file - cDNA_ID_2999930; gDNA_ID_2926150; Annot_ID_139273
tcgtatgcgccgttagctatccttacttgccgtttctcaacaattggttgattagtgtttctagacagaagcatcaggatcaagttctcgtcatcgctgaggattacgctactctctacaaagttaacgagaaatggcctggtcacgccgttctcattcctccggcgctcgattctcagaccgctcacaaattcggttctcaggtataatacatctacacagagttttcatcttctcgatccaattttatctctagcttccagttcatgaaatctagctgaaaaatggctttgaaatctgagaatccatacttagttttgatcagtgattcacttatcttgaatgttcgttgattagcttgtttagtccctgaggtttcggttttaagctgtgttttggctgatcacatgaataacaaaagatagtgaacttgtggttaatatatatgcttaagagcttctattgcaatggaatcgattgtttaaactaacttctcgtatgcatatcttgaatgttcgttgattagcttgtttagtccctgaggtttcggttttgagctgtgtttttgtacatccatggctgatcttatgaataacaaaagatagtgaacttgtggatctagtagcagcagccatttttcccctgtttctgtatgtgatactatatatgctaagagcttgtattacaatggaatcgattgtttaaactaatttcttgtatagggattcttcaatttcacagcacggaggccgcaacatctcttggaaattttggagttaggttacaatgttatgtacaacgatgttgatatggtttggttgcaagatccgtttcagtatttagagggaaagcacgatgcttacttcatggatgatatgactgcagtatgtatatttttttctcagacatcttcttcattgatggtatttggattagtgtacttattattgtcttgattatgttgtcagattaagcctttggatcactctcatgatttaccacctccgggtaaaaaaggaaggacttatatttgtagctgtatgattttcttgcgtcccactaatggcgcaaaacttctcatgaagaaatggatcgaggagcttgaaacgcaaccttggtccagagctaagaaagcaaatgatcagcctggttttaactgggcacttaacaaaacagctaatcaggtatgttctttcttcctagttccacagtaaaacagtaacttctcttctctgtaaattggtctcaataagtagttactacacaattggtgaattcaatgaaattctagcgtaaaatctcaaaagactgaagcttttgctacgccgagagaggttccgctttatctaaccgtagctactcaagcttttaatcaactctgtaatctacttatgaatgtttagttacgataagcttttttggcacacacatggctgatcttatgaataacaaaagatagtgaacttgtggatgtagtagtagcagccatttttaccctgtttctgtatgtaataatatatatgttaagagcttgtattgcaatggaatcgattgtttaaactattttcagaggaattttatgacatcaaagtttaaaatctcaaaagactgaaccttttagtactcactcctacgaatgttgtttcaattcgagaggtaatttgatttggtttgaattcattcttcaactctttttgtattatctctgttctacaggtggatatgtacttgctttcgcaggcagctttcccaacaggaggattgtatttcaagaacaaaacatgggttaaagaaacaaagggaaaacatgcgataatccacaataactacatagtcggttttgagaagaagatcaaacgtttccgtgactttaatctatggctagtcgatgatcatgcttccgagtctcctttagggaaattagagtaaattccaatggcagaaaaagattttttgtcgctccatctttcttcttgttattggaatattcaggctgcagaaaggaagaaagatccatcgagtaaattcttttacattttttgggggtctttaaagtcatgtgaagaggtgttgttattggctaattcaatacgagttgagttgaatttggtaatgtagactactagaattggtattgggtctgaaatttcttaaataatcgaaacaaatactgacagctagcatatgaatacgagggtccacaagagtattaaacatatttattttgaattatagttgggtgttatttccacactttataacatgtgactaattttacaatctaatagaccttttggaggatgctgcttatgtaagatttaccgtaaatgataaacataaattaaatacgctctttgacgtcccattgtttggtcacacacactctagacttttcattcattcgtgtgttactcaaatctatttattcccagatctgatatatatatttattgcaattactaaatcccaatttccataaataatgatttctatgtaactcgttccataaattaaattatgcgtctaagttgtaacatataataaaaggataatatatttttcagtcacaccaaaaaaaaaattgataagaaagaaaaaaaaagagtgaaaattagaaagacagagaagcaaagattcttgctccctgcgaatccgcagctgcttcgaaacgcaaatccgatttgtagtctcctttgattcttccattgacgatacagcttctctttctctcttctctctgcttactttgctttttactaagctcacaagaatctacgcatctgtactgttattatgctgatgctctctacttaatcatcaccaccgcacgcagttcgagatttctggaattttctgtgtcggatgcgtttgagattcatcgaatctacttggttatagattggaaatttaggtggggatttgagttgcttagcttgtggtaggttacattttcttgtttgagattcagtgaatctctccagagttgcatgtatagaaatg

SEQ ID NO: 29152 - DNA, 3000 bp, Unknown
  misc_feature (1)..( 3000): 2750-1469P.txt file - cDNA_ID_2999941; gDNA_ID_2926150; Annot_ID_139281
catcaatcgatcaaaacaaacagcaacagcaaaattatctttctgcagatcgaaaccctaattggtttctccgttctccttttgttcttctagaatcggcgactcttacttttttttctttctaattatccttttctgatggattctggaatccatgtaattccccattagcgctaaaaaccctagctgtcgaagaccttagattactgcagaaatgttataatctgttttcatcttttcccgatttgaggtttttatttattttggttgggtgagagaatccgatacgagagattaaagccttgtgagtttaggatgagctagttttctttggctttgagctgtaatttctcttctctgaaatctttcactgtacatatagctagatcctgatgaagttgcgtggtggtgaatcgtggtttaagttttgctagttgagatattattggtggttactgtaatatcgaagaatcatatttcacggtatttactatagacaactactgtagagttacttgattaaggcgttaagaagagatactggtgttttttggcctcaatcagctaagatttttgtgcattgtatgatgagtatagcaaatgaacaacaatttgccatggatcaacttgtcgaaaccaatgatgattcggaaaagtatgttttttctgttttttgtaaaatccatgtctctgttttgctgcttattgtacatttctcagctgcagttgcaattgttttcaggaaaccaagaattacatacacgaggaagtttcttatatccttgagcgagaaagacgtttgcaagaagctgccaaatctgcctggtgaatttgatgaagcactgttgctgtgagactctatccgatagttttttttttagtttggatttctagaaactgtgtaaatgtgtttgatcatgttggagtgacatgtcttgatttgtacactctttatttgagtagtgacttcgaagatccttcacccgagcgagcaagaatttcaggcgatttttcgtcgcatggtttcaggcggaatgactatagttcatcgcctcccaccaggggggaattaggtactaactctcgaggcacccatggaagatgggaagggcgctctggtggatggaatgataaagatagtgattcacagtcagaccgggactcaggtagccggagcttactcgtatcctattctttacatgctgtatgatgacgttactacagtaacaaggtggactagtattctgaatagttaccttgttgttatatatgacctataaaatactcctacgaattatgtctttctgcaaaaaagtgttcattattatgatttcaactctatccatctggctgttcaatatgcgtaaatgtagatttccacctttttttaactaaagtgaatggcatgaagtctgcttgtctagtgaacatgaaaagaaggtcttttcgaaaaattctggaatttgggtgtattatagttgatttggaactgtgtattttgttaggagagcctggaaggcgttctggtatgccatctcggaggtcttggcaagcacctgagcatgatggacttcttgggaaaggttctttccctaagccttctggatttggtgcgggaacatctgcccctagacctcaatctaatgactcacatcagctgagtagaaccaatgaaccttaccatcctcctcgcccatacaaggttaagtacccaaatatctgctgtagtcatcttgaatagtctctggtaccattgattcttgaatactgctccatcacgttactgggtttcatcagctggtttgtgaggtgtatttgaatgatttaacggcatagattcataaatctctcatgtacatttgtaggcgccacctttcactagacgtgacgctagagattcattcaatgatgaaacatttggttcttctgattctactagtgaagatagagcagaagaagaaagaaaaagaagaggtacagaggatctattgactttgatctgtactaaacttagctctctgccaatttgtgcacttctttcagttaatccatgcgtttctttttgtgtcaatctttaattgacattctcaactctctgtcagcttcttttgagttgttgaggaaggaacatcaaaaagcattccaggagagacaaaaatcaaacccagacttacgcaaaaacgactttgattttactgaacttcttggggagtccaaagatgataaagggcgtccaagtagaagtgatgaagtcaatcacgctccaacaattcctggttctagtaacacctctttgccttctcaaagtaatgcacccagaccgcttgtacctcctggttttgcaagcacaattttggaaaaaaagcaaggggaaaaacctcaagtaagtcgctatctttctgagaccctcatccatacctaatatctgtgttccatgaaggtttcatttttgtttgcatattgattgttaaagtcttaaggatagcaaaatcccagaagaaatatcaaaatagaggggctttatgataatagttggaaaggggaatatgttacaagaactatgcaaatcctgatagaatgattctctgcaattcatgacagtaaagtcaaaaggaaaagcgcacgcctagttcttctgactagtgacaagctttgaacatactttttttattctatcttatagaaggcaagtcgtgccgagtaagagaatttgggaatagaggaaataaattttattgccttgaatatcaagtaaactaggaaaatataaataaagccaattccttcaataactccgtcattgggtgtaagtgatccaaggctgtggtctctttatctaccacttccattcgcttactgcagatcagtgagggttgaaatttgagtgtggtggcttttgttttaatttatcttttcttcgtaaatgttttgtttgaatgtatgctgtgtttgaatgtatctttggtggcgcctattatttactggttatcacaccatatg

SEQ ID NO: 29153 - DNA, 3003 bp, Unknown; identical to SEQ ID NO: 16250
  misc_feature (1)..( 3003): 2750-1469P.txt file - cDNA_ID_2999948; gDNA_ID_2926150; Annot_ID_139284

SEQ ID NO: 29154 - DNA, 3000 bp, Unknown
  misc_feature (1)..( 3000): 2750-1469P.txt file - cDNA_ID_2999967; gDNA_ID_2926151; Annot_ID_139304
ctatcttcggatagagcagagaagatcgcggctttatttcggacaagcaaaaaggttgtgatatggattacgactaagattgatgccacaaatgtaacttggagcaatttcttcacaatatatatatcgaaccttgagcgaaatctttcatgtaagagtttcttcacaatatatatatcgaaccttgagcgaaatctttcatgtaagagtttcttcattgacatggagaagaaagttgctatggtttttgataaagaaaaaggaaaaaaagtcgctcacaacattattaatatcattggagaggctggatgcgtgaggaaattggttcttaaagaatctggagacaaaagctgttggccacttgtgtgctcttatgttccaagtacagtgcaaatcaagcaacataatagaggcaaaaggcaaaaaaaagtgattaggaaaggcatcgacattgatatgagacatgataaacgtatcaaggttgattagtctcaatttacaaagtctatatagtttatatgtttttcacttacccgtttaacttttttcttcccatctattgttctatatggacaaaattttcatgttttaattttttaagttttacaaaaccgctgtgtgatctattaaatgactagttttgtcgtctgaaatatcacatccgtctccggcggtgtggttgatgcaagttgcaagtatagaagaatatgtgtacttgtctcttactctgcacttgatgagattgtgttgcggcttctgactacatgtatgtggtttattccttacattgtttcatgatttgaaagtaggttatggatgtgttatggtttgtacggctacactttcagacatacacaaaatattacgaattgatctcatggcacatcactccgtcttcgagtcacctctatgtgtatctagtagctttctcgttatgattgtttttcttcttggatcagttttggttgctcaatttaaccttttttctagagaacattcaactaggaatctcactatcataaaatcattaaaggttttgttagttgtagtatgttatggatattcacttgcctgtagagaacaaacattcaagttgcaaattgtgtatatgctttacttttgaaacttgcatgaaacttttgtcatggcgtgtcagtacatagagttgagtaatcatggctttgctatatttgccctgatctacgttgaagtttccatatagtatctttttttcctagtcaaaagttggtttttcactaataaaaatttatgcagatagagagaaaccaaactgcactaaacgagcttaaccatgcattagaagatagagatatatactcgatttggtatgttaaggaagcaaccaactttgaacccatatccatttttctaataaactacgtacatgagaatcctcgtagcaacatttatagaagagatacccaaaccatgtgtaacataattaattaaagtctaaagacagcattggaagagattacacacatgagtatccaaaacgaacaagctgtcactatccaaaacaaacttcaagtgagaaaagtaataaaacatgaactaaaagatagtttaagagattgttaaagcattttcttgcagagttaggttttctcctgatcccacattgtaattaatgatgttgtacatgtcctctaaaaatctgtttgctggcattcgaatctttgcagctatcttttcctacaaacaattgcctagttttctgataatgacggcagtgtgatcttaatgacacaatggacgccgtcacatttctagagtgctattagctagggaatggttattaactttctcaaactttgatcaaggaactatgttttgccttttcttttgatgtaagttgaaatgatacatattttctcacatatgggctaccaaatcttttcttatagttgtcgaacgtaactaaacatatgctgacacagttgtataaataattttacgattcacgtttctgaaaatgttagttagtattagcctatgataattaactatacttcgctttatgtaaatcaaaggccaacttttttgaatatctatatgtaagaataaattacagctattaataaatacgagatgtaacttaattcagaaatgttcacacacatatggaacaagaagatttatccctgaaatagtattcacagtttggatcttatacctttttatgtaaaagaaaagattcaaacaaaaatctttcttatacaaataagattcaatcaaacatatattcctggaagttttgaacataaaaaaatgatttacaaaaaaattctcctaatttattaaaactgaatatttaataacataaaatctcttataatttatgtatatacaaaacaaattccatgatattcatagaatctcataaggttagattcttattataaaaagtagacaatctctaataatttatgtgtcgtgatattaattagaaatctctaataactcaaataggatattaatctaaattcgttgacaaaaatagatagagaatcattgttattcaacgcccaaaaccaaagtcattagtcaatgtcactcgtgaaactatccaaagataagagtttatgggattcgctaatctattacattaaagccacgtgtcttaatcttagatgttcaatagacttgccacgtcacacattgtctctctcgtttctcaaatcgcgtttcttctggtggaggtcaaactttttgattagcaaataaaagtcacacaagccgaatccaaaaatgtaacaagaaaaacaaatcttcacaaggcaaaaaatccaaaattgagttttttttttcttcattttttacaatggtgtctcggtttcgtcttgctctagagtacttctaagtctctctgttcttacttcgatttcgatttttattctcttttttttttttttttgaagacggatttggttggtggtttttagggctgttttgggttcgagacgacgtaagaagatg

SEQ ID NO: 29155 - DNA, 3003 bp, Unknown
  misc_feature (1)..( 3003): 2750-1469P.txt file - cDNA_ID_2999974; gDNA_ID_2926151; Annot_ID_198080
tcaatcctatatggcggttaagacagatgtgagtaaggcgtatgatagagtggagtggaattttttggagacaacgatgagactatttggtttcagcgagacatggatcaaatggataatgggagcagtgaaatcagtcaactactcagttttagtgaatggcatacctcatggcacaattcaaccacaacgtggaataagacaaggagatcccttatctccatatctcttcattctatgtgctgatatactcaaccatcttattaaaaacagagtagcggaaggggatattcgaggtatccgaattggtaatggtgttcctggtgttactcatctacaatttgcggatgactctctttttttctgccaatctaatgtccgaaactgccaagctttaaaggatgtctttgatgtttatgagtactattcgggccaaaaaattaatatgtccaaatcaatgataacgtttggttcacgagtacatggcaccactcaaaatcgtctcaaaaacattcttggtatacaaagtcatggtggaggtgggaaatatcttgggctcccggagcaatttgggcggaaaaaacgagacatgttcaactatatcattgaaagagtaaagaaacgaacatccagttggagtgcgaaatatttatcaccggcaggaaaagaaattatgttaaaatcagtggcgatgtcgatgccggtgtatgcaatgtcttgcttcaaattaccattgaatatcgtttcggagattgaagctcttttaatgaatttctggtgggaaaagaatgcaaaaaaaagagaaataccatggatagcttggaagagattacaatactcgaaaaaggaaggtggtttagggtttagagatttggctaaattcaatgacgctttacttgcaaaacaagtatggcggatgattaacaacccaaattctttatttgcccgaataatgaaagcaagatactttagagaagactctattctggacgctaaaaggcagagatatcaatcttacggatggacttctatgcttgcgggtttagatgtaattaaaaaaggaagcagattcattgtcggagatggcaaaaccgtttgaatcagtcaagataattttattgcatcgcaccctccacgacctctcaacgtcgtcactcctacgttggatatcacggtggatacgttaatctcaactcagggttcgtataggtattggaacgcacatctcatttctcagcttgttagtcccgacgaccaccgttttgttatgaaccatcatctttccaggattgtgcatcaagataagctagtttggaactactcttcttctggggattatacagttaagtccgggtactggtttctctttaatgacccaacgaatatttaggttagaccagtggtgcctcatggttcagtggaaattaagaacaagctttggaaactccctattattccaaaaatcaagtacatgctttggcgtacaatctcaaaagcattaccaacacgctcgcgacttctcactcgaggaatggacatcgatccacactgccccagatgcccaactgaagaagagacgataaaccatgttttatttacgtgtccttatgctgcgtcaatttggggtctatcaaacttcccttggttaccgggtcatactttctctcaagacacagaggagaatatttctttccttatcaattctttttcaaacaatactctgaatacagagcaaaggttggccccattttggctcatatggagattatggaaagcacgcaataatcttgtgtttaataagttcagtgaaagttgctcaagggttgtgacacaaactgaagcagaagtcaatgaatggttacaaagtgtgaaccgaagagaggacgcttccgttttaacacgatcatcacacagggcaaacgtgcggtggaagaaaccggtctttcctttagtaaagtgcaacttcgatgcgggtttcacgggtaataatactcagagtacgggagggtggatcatacgtgatcatgcaggattagcgaaggcttggggatcatcaatagtctaaaatggtaccactgctttggaagctgagacaaaagcgttattaatcgcaatgcaacaagcatgggtacgagggtataagtgtgttcagttcgaaggtgattgtgagatccttatcaaggcaattaatggtgcaatttctagatgtgaaataaccagtcttctccgagatgtggatttttgggcatcaagattttctactgtggttttcactttcacaaatagactctgtaataatactgctcacctcttagcttctccactttattcgtgttacaagtttcaatcgaattctggttatcagccactttggctcaaaaactctctttgtaaagatttactcatataaataaattctgtttgttggaaaaaaagaaaaaaaaaaaacctacattctaaatactgaaaccataaaccatatggtaaaaagtggataaatgctcaactatctccatttcaatatacacatcataaaaaagatttatattcaatttattgtaaaatgaaaacttagattgcattactttttttaactctcttctctaatttaatttactatctaaatttgtgagttcataaaattttagattgagaacaattcatcagaaattctgattcagaacagtacaaatcttgtcatgcaaacttatctatcttgtaaaatctatctatcacttgtcgtcactaagtacaaaatctattttagtttgttttttttgtgtgtaagaaaagtttttttatttaataatctatcaccaatattttccaacacaacatgaccgttatctcctccaatctaaaacttaattacgaaactacccttacctctttcactgactgactcgtctccttctccacttggatctcaaaagtccgatccaaaaccaaatccgccataactctctctctctctcccacttcccacagagagacacattcatg

SEQ ID NO: 29156 - DNA, 3000 bp, Unknown
  misc_feature (1)..( 3000): 2750-1469P.txt file - cDNA_ID_2999974; gDNA_ID_1621151; Annot_ID_56891
atcctatatggcggttaagacagatgtgagtaaggcgtatgatagagtggagtggaattttttggagacaacgatgagactatttggtttcagcgagacatggatcaaatggataatgggagcagtgaaatcagtcaactactcagttttagtgaatggcatacctcatggcacaattcaaccacaacgtggaataagacaaggagatcccttatctccatatctcttcattctatgtgctgatatactcaaccatcttattaaaaacagagtagcggaaggggatattcgaggtatccgaattggtaatggtgttcctggtgttactcatctacaatttgcggatgactctctttttttctgccaatctaatgtccgaaactgccaagctttaaaggatgtctttgatgtttatgagtactattcgggccaaaaaattaatatgtccaaatcaatgataacgtttggttcacgagtacatggcaccactcaaaatcgtctcaaaaacattcttggtatacaaagtcatggtggaggtgggaaatatcttgggctcccggagcaatttgggcggaaaaaacgagacatgttcaactatatcattgaaagagtaaagaaacgaacatccagttggagtgcgaaatatttatcaccggcaggaaaagaaattatgttaaaatcagtggcgatgtcgatgccggtgtatgcaatgtcttgcttcaaattaccattgaatatcgtttcggagattgaagctcttttaatgaatttctggtgggaaaagaatgcaaaaaaaagagaaataccatggatagcttggaagagattacaatactcgaaaaaggaaggtggtttagggtttagagatttggctaaattcaatgacgctttacttgcaaaacaagtatggcggatgattaacaacccaaattctttatttgcccgaataatgaaagcaagatactttagagaagactctattctggacgctaaaaggcagagatatcaatcttacggatggacttctatgcttgcgggtttagatgtaattaaaaaaggaagcagattcattgtcggagatggcaaaaccgtttgaatcagtcaagataattttattgcatcgcaccctccacgacctctcaacgtcgtcactcctacgttggatatcacggtggatacgttaatctcaactcagggttcgtataggtattggaacgcacatctcatttctcagcttgttagtcccgacgaccaccgttttgttatgaaccatcatctttccaggattgtgcatcaagataagctagtttggaactactcttcttctggggattatacagttaagtccgggtactggtttctctttaatgacccaacgaatatttaggttagaccagtggtgcctcatggttcagtggaaattaagaacaagctttggaaactccctattattccaaaaatcaagtacatgctttggcgtacaatctcaaaagcattaccaacacgctcgcgacttctcactcgaggaatggacatcgatccacactgccccagatgcccaactgaagaagagacgataaaccatgttttatttacgtgtccttatgctgcgtcaatttggggtctatcaaacttcccttggttaccgggtcatactttctctcaagacacagaggagaatatttctttccttatcaattctttttcaaacaatactctgaatacagagcaaaggttggccccattttggctcatatggagattatggaaagcacgcaataatcttgtgtttaataagttcagtgaaagttgctcaagggttgtgacacaaactgaagcagaagtcaatgaatggttacaaagtgtgaaccgaagagaggacgcttccgttttaacacgatcatcacacagggcaaacgtgcggtggaagaaaccggtctttcctttagtaaagtgcaacttcgatgcgggtttcacgggtaataatactcagagtacgggagggtggatcatacgtgatcatgcaggattagcgaaggcttggggatcatcaatagtctaaaatggtaccactgctttggaagctgagacaaaagcgttattaatcgcaatgcaacaagcatgggtacgagggtataagtgtgttcagttcgaaggtgattgtgagatccttatcaaggcaattaatggtgcaatttctagatgtgaaataaccagtcttctccgagatgtggatttttgggcatcaagattttctactgtggttttcactttcacaaatagactctgtaataatactgctcacctcttagcttctccactttattcgtgttacaagtttcaatcgaattctggttatcagccactttggctcaaaaactctctttgtaaagatttactcatataaataaattctgtttgttggaaaaaaagaaaaaaaaaaaacctacattctaaatactgaaaccataaaccatatggtaaaaagtggataaatgctcaactatctccatttcaatatacacatcataaaaaagatttatattcaatttattgtaaaatgaaaacttagattgcattactttttttaactctcttctctaatttaatttactatctaaatttgtgagttcataaaattttagattgagaacaattcatcagaaattctgattcagaacagtacaaatcttgtcatgcaaacttatctatcttgtaaaatctatctatcacttgtcgtcactaagtacaaaatctattttagtttgttttttttgtgtgtaagaaaagtttttttatttaataatctatcaccaatattttccaacacaacatgaccgttatctcctccaatctaaaacttaattacgaaactacccttacctctttcactgactgactcgtctccttctccacttggatctcaaaagtccgatccaaaaccaaatccgccataactctctctctctctcccacttcccacagagagacacattcatg

SEQ ID NO: 29157 - DNA, 3003 bp, Unknown; identical to SEQ ID NO: 29155
  misc_feature (1)..( 3003): 2750-1469P.txt file - cDNA_ID_2999974; gDNA_ID_1620662; Annot_ID_47981

SEQ ID NO: 29158 - DNA, 3000 bp, Unknown; identical to SEQ ID NO: 29156
  misc_feature (1)..( 3000): 2750-1469P.txt file - cDNA_ID_2999974; gDNA_ID_1621151; Annot_ID_173266

SEQ ID NO: 29159 - DNA, 3003 bp, Unknown; identical to SEQ ID NO: 29155
  misc_feature (1)..( 3003): 2750-1469P.txt file - cDNA_ID_2999974; gDNA_ID_1620662; Annot_ID_163815

SEQ ID NO: 29160 - DNA, 3003 bp, Unknown; identical to SEQ ID NO: 29155
  misc_feature (1)..( 3003): 2750-1469P.txt file - cDNA_ID_2999974; gDNA_ID_2926151; Annot_ID_139315

SEQ ID NO: 29161 - DNA, 3000 bp, Unknown
  misc_feature (1)..( 3000): 2750-1469P.txt file - cDNA_ID_2999982; gDNA_ID_1971823; Annot_ID_58361
aaaagacgaagcagtagaactctcttctctagtcttttcctgcgaagaacttggcttagatgttgacaaagaggctgctcgctcgtagttcttcaaataaaatggtttcctctcttcgtctactgggaaaagcaaagaggaaactgatgtatttccatttaagacagtaccagaatgagatttctcactaatgcctgcacagaaatgatcaaacattgaatgtgaagctgccccatggagtacacgttctcgagcacctgttttcacatcccaaatgtataagacatcaattggatctgattttctcgaaagggagcgaaaaagacatgcaatgtagcctcttgtaccatcccatacaacttttgtaggatagtttgggtgcccaggaaacatcctttcgacccgcaaagtctcaagagaagaaagagcaacacatgaatcatccccaacagatagaaagcacttgctccatgggcgttttgttggagctggggatagaatgatctggcgcactggagcaacatgatgatgcatgatcatgataacatttccgctttcgagatcccaaatgcggatggtacagtccatacttccggagatcaaaacatgagaagaattacatccatttgcatccccaaacattcgatgcgctgctaagcatagaacagatcctgtatgtcccaatagacgctgtttatagacgagtggatcagtatctgatctcgggcttgaagcaggagaatcaattccatgaagaaaatcaaactttgcaatctctatctcaccactaaagaaaccatagacaacagcatatgggacatacatattctcagaaataaccatggacgatgacacacactgtccattgtcactaacaaagctttgtagatcatttttggcactgcactgacttcctgactgcgaagtaccagtttctgcactaaccgagcccttgggatctaaacaggagcttgaaatccaatcagcaaaataggagctttctccaagcactttgcgctgaagttctttttctttaccatttcctaggcacaatgaccagatcgttatatggggcctccactgagaaggttgttcaacatcacaacaactagactcaacgcgaagaagattctgcctcaactgaacaaaacaaaacgttgatttcacggaacgcttatcatcaggggcagtaacaatctcaccgaagtttttatatgtaaattcaccatctatatatgacatagtaaacagcacagcagaaccactaccatcccacagcacaaaagtttcagaaatactatcatctttatcaccttcaatagttgatgtactagagtaaagtatcattgcttctttgaacagaaaatttgaagaatgcgaatcatcaacaaaagatatctctcctattgcctcctcgcgattcaacaaccaaaagacacacctactcttcgagaaaaacgcaacaagatcccctcgagttattactgatacagcaatttccccttcactcaaccagtttctagacactagagagcctttgctcggttcagatttctctgacactgagaccaactgcaacctaccaaacgaatcagccataagcaatgattcctgctcatctaactgaaccacgcccataaaattcaaacaaccaatagataaattcccatggaaaactgtatgaacaatagtaagagtgtaagtatcaacaacaaccaccgtgcatctcgacttctgaaaatcagtatctgctaaagtctcagccccatcaacatcgatataagaacaaccaacacatacatatctaggctctgatggcaaagtagacaaaatcgatggacttccaacccaaggaggtaattttcttcgtttcctacactgaccactacttctactccatacacacaagacaccatcagtacaagcactgatcaatgcacaacagttaacaaatggatccgcattaccattatctgatgcaacaactccattacttgaaagtattgtaggatcacaaatagcaagatccactattggtgaagtatggccacacaacatagcaatcggtttaatctcatgatgagggagacgagttacagaattggattcggaagaagaagagatgctccaccagatgattgacccatcggatccaccggtatagagagtcggtggattggttagagaggctgtggcggtgacccgatgagacggaggagcacgagaccataggcaggccacagatcggcacttcatcggcttgaatcaagcggtacaagcatcgaccgagtcagtgaacgagtcggggtgagagaagaaggaagaacgaactggtaaacgacgtcgtaacagtaatcacgacaaatatatctgtacatatttagatggatttttcgaggttgcaaataaattttttaaggtaaatatttggcaaaagtttgataattgatattttaactttactagattattatcaacttaaaatacttaaatctgtgtattggacgacgggtcctaatctagtcaatatataaattataacttgttaaaatatatcatagtctaaattcacaaatcacattgtatttgctaaactatgagtaaacgattacgatataaacaaaatgagtagaaaatgattattttaaattattgtagttctctataaatatctttaccattagttttctttccttttttcagtattattcttttgtcaactaatttatttgttaaaaaatctggacttatcaagaatcaatcttatgttaaaaaataaaatcaaaaggaaattagaaaataaaataaaatctaattacctttttgtttttggttatatgacctagtagaggtattaaaacgttcttaaaagaaaaaaaaaatcccaaacacagcaaaaaaaaaaaaagcctagaggaatagaatcggtctctttctctataatctctctctctctctgacttgtttgtgttctctcaaatcctctgataagaatcaatg

SEQ ID NO: 29162 - DNA, 3000 bp, Unknown; identical to SEQ ID NO: 29161
  misc_feature (1)..( 3000): 2750-1469P.txt file - cDNA_ID_2999982; gDNA_ID_1971823; Annot_ID_176254

SEQ ID NO: 29163 - DNA, 3000 bp, Unknown; identical to SEQ ID NO: 29161
  misc_feature (1)..( 3000): 2750-1469P.txt file - cDNA_ID_2999982; gDNA_ID_2926152; Annot_ID_139357

SEQ ID NO: 29164 - DNA, 3000 bp, Unknown; identical to SEQ ID NO: 29161
  misc_feature (1)..( 3000): 2750-1469P.txt file - cDNA_ID_2999982; gDNA_ID_2926152; Annot_ID_198151

SEQ ID NO: 29165 - DNA, 3003 bp, Unknown
  misc_feature (1)..( 3003): 2750-1469P.txt file - cDNA_ID_2999986; gDNA_ID_1971823; Annot_ID_58364
ttttcctcatatttcaactagttaatctgaaaattgtaccagtcaagccatcataagaagagaccaataaattaagagtttgtctttatattaaatcacgctttgtatatttttatttaggattttggttgggtgaatattttgatctttagagataggttgttaatatttagacgttttgacaactaattttcctaacgatgaaactagtctaagttttaatgatttttaatcatgtgttctgtttattcttttaatgcttcacgtggatagattgttttcaatttctctgttagtagcatagtagccaaatgggcttagtgtttttattaattagccatgcgagattagctgtcaaatattctgttacaatgcactaattttcaaatgaagagaaacgagccttcttttctaaagggtcactgcaaaaatgcattaacattctgatgaaaaaaataaaatatagtatcagatggactttgaatccattaaaaaaccaaccctcttaaactaacactaggccaccatcatgtttagaattctatattttgaaactagtacatttacgtgttctttggtttcttgattgggatactatagtcatttttaggtttcgttcaaagttgacaatcgtataaaaataaaaactgaataagaagttttcgtgaaaagtaaattaatttagagagaaagttgtgtctgcgtaaagtatccatacaataatggattaatttttggacatatataaatttgataactaacgctaatgtcgttatgttcttgaatctatttaaaatatataagagttttatgtagaatagtgttagaaaatctcagtaacgtggacggtcttggccatggactatggcggctacaaatggtgggagtaggtctatgggtaaaatataataataccataaccagattgagttaaggattatttcttaagattttaaaattatacctaagaattatatttaattgcatgtgtatataaagtgcaaatgcacacatgactctacctagctagctagctattcgcatatagtaaaaagaaaagaaaaaaaaaagtctatgaattgataaataggtttttgaaatttgaattagattgtatatatgacccaacaaaaaataatgtcatagaacatatgatgaaattcgctatacaaattcttttacccaatgtatagtctagttttgcaccatacgtaaatgtttattctttaacgtaaaacctatatatagatttttgcgtttaatttgaactttataagccatacaatacgtaactacattcgtcaagataagttgtttttgttaattatcaacaaccatgatttaaaatatgaaaaaatggttaagggttagatatattttattttttgttaaagcaagggttagatatataatatattacaaataacttcaacttcattaaaatacgtcacatgccatgatttgtctaccaaatacaattaattaacttaccgactttctcgacgaaattaaaaaaagttatcgaaattatcatctgtgtacacctttaattccacgaggaatctatataggctaataaatagccatcgtacgtaacatcaaacaaaatatatactagctttggaatttttgttagtgtcctggcatggcaagttggataaatacaaaggaaggtaataaaaattaaaatagtaataaaattatcacaaattttaggtatatagatctccatatctataacaaacatataacatgttaagaataaataaaaaagacgaaaccaccaagcaaattctaaagatcgttggtttgaatgacattaggaaggaaatgatagtaaatatactagttctcgagaaaatgtagggatttaagcttagaacatcttaattattcaaaaataataattgaaaaccacataaaattataaatcttgcctaatagttaatattgagactaaaactcaaactttttttttttctttggttttacttttttgattatatagataaatggatgatgattaatagttttgttggagatgattttttgctaccaaatatagacacgagttatggctctattgtctctcacataaaaacgttaaacgttctactaaaggtggcatgaatcctatgcattttggaactgacaatattcagttgtctctaatagataactaagacttataactttaatctccatttttttttccgcgaatcaggatcggttatgactaaagcgttaaacagtctctattaggacaaacctaattttgttttccaataagttatttcagttaaccttgctactatcgcatatcgttacccttcggtaaggtggttgggaagctttgatcattcccatgcggacaaaccagctacagttactctagagcactcaacattccatcgaaaaacaattcaaccattaagaagatctccaaaaatctggctcgaacaaacttttaaaatatttgttaattaattttattattcaatctcagttagtatagttttatgtaaattcaactagtcttcatacttattttctatcttcattaagtaataatacattagttttggtagaattagtttttgtctggctttataagctagttagtttaatttacaatattattttcaaaatcatttgattttatctattcatgtacttatttgtttaaattttattaacatttggagagaatctatttttttcttaattatatagattatttaccataactatatcaatatttccttaagaacacattagattataataataacaataagaaaagacaaggcaatagtatctttatgatgataattgaaatcaaacaggaataaatagaacatgtttggtagcttctttcttcttgttctcttctccacattgctttatcctctcacgaccaacactatatataatccctaacttgggaactcttatcctccaaacatagttaaaccaaattttctaagtgtctcataaaaaatg

SEQ ID NO: 29166 - DNA, 3003 bp, Unknown; identical to SEQ ID NO: 29165
  misc_feature (1)..( 3003): 2750-1469P.txt file - cDNA_ID_2999986; gDNA_ID_1971823; Annot_ID_176259

SEQ ID NO: 29167 - DNA, 3003 bp, Unknown; identical to SEQ ID NO: 29165
  misc_feature (1)..( 3003): 2750-1469P.txt file - cDNA_ID_2999986; gDNA_ID_2926152; Annot_ID_139360

SEQ ID NO: 29168 - DNA, 3003 bp, Unknown; identical to SEQ ID NO: 29165
  misc_feature (1)..( 3003): 2750-1469P.txt file - cDNA_ID_2999986; gDNA_ID_2926152; Annot_ID_198155

SEQ ID NO: 29169 - DNA, 3000 bp, Unknown; identical to SEQ ID NO: 8321
  misc_feature (1)..( 3000): 2750-1469P.txt file - cDNA_ID_3000008; gDNA_ID_1971724; Annot_ID_175193

SEQ ID NO: 29170 - DNA, 3000 bp, Unknown; identical to SEQ ID NO: 8321
  misc_feature (1)..( 3000): 2750-1469P.txt file - cDNA_ID_3000008; gDNA_ID_2926153; Annot_ID_139375

SEQ ID NO: 29171 - DNA, 3000 bp, Unknown; identical to SEQ ID NO: 8321
  misc_feature (1)..( 3000): 2750-1469P.txt file - cDNA_ID_3000008; gDNA_ID_2926153; Annot_ID_198192

SEQ ID NO: 29172 - DNA, 3003 bp, Unknown
  misc_feature (1)..( 3003): 2750-1469P.txt file - cDNA_ID_3000016; gDNA_ID_2926153; Annot_ID_139377
tgtagggattgtatcatggacgtcacaagacagttaatacagacatgtcccaaccagacagcagcaattcactggtcaggtggagggaaaactgtatgtatggcacgttactataaccagccgtcttctagaccattggatttggaatcagtttctattggttataacgttggaaatctcagcacaaacttaacagattttgatagattatgggagcgattgatagctcatatggtgactaaagcttcatcagcatcaataaaatatttatcatttgataacagtagattctatgcagctgatgaaacaaacttgacaaattctcaaatggtctacgctttgatgcaatgcacgccagacgtctctccttccaactgtaacacttgtttaaaacaaagtgttgatgactatgttggttgttgtcatgggaagcaaggcggctatgtgtatcggcctagttgcattttccggtgggatctataccctttcaatggcgcctttgatcttcttacgctagcgcctccaccctcatctcagctgcaatccccacctccagtgaccaacaaaggtatgtgatttacttaaataaatgatagaaataacccttcttgtattcaactctaagaagagctaggtgatttggtcttgcacagatgaaaaaacgattcatacaggaactatcattgggattgtcattgtcgttgcaatggtcataatcatggctctgcttgctctaggggtttctgtttgcaggagtagaaaaaaatatcaagcttttgcctcagaaagtgagttcctcttgttttctttcttatcagctggtcttgctgctaatttacgaaagaatttcaccgacctgaccataaaaccacctacattttcattgtgcagctgccgatgatattacaacagttggatatctccagtttgatattaaagacattgaagctgcaacaagtaactttttggcgagtaacaagattggtcaaggtggtttcggcgaagtttacaaggcattttctccccaactactcttaagttgtatttgtgttatgtttgaagatattgagatagtgggatgattagttagattcagttgtaatatgcagggtacgttatcaaatggaactgaagttgcagtcaagaggctgtcaagaacttcagatcaaggtgaattggagttcaagaacgaggtgcttcttgtagcaaaacttcagcaccggaatctcgttaggcttctcggttttgctctgcaaggagaagaaaagatactcgtctttgagtttgttcccaacaagagcctcgattatttcctcttcggtagtactagtagtctaattttcctcttgatccaatattcttgaaatcttaagcttggatttgcaaatggatgtgcagacccaacaaaaaagggtcagctggactggacaagacggtacaacatcattggagggattacacgagggcttctctatcttcatcaagactctaggctcaccatcatacaccgtgacatcaaagcgagtaacattcttttagatgctgatatgaacccgaaaatagcggatttcgggatggctaggaatttcagagatcatcaaactgaagacagtacaggaagagtcgttggaaccttgttagtattctccttattatttacaatgggcacaattctctgatgaacggtttttgttactgactaacgtaaacattgtcatgtatatatttgcagcggttacatgcctccagaatatgttgcgcatggccaattctctaccaaatccgatgtctatagcttcggagtattgattctagagattgttagtggcaggaagaatagcagcttctatcagatggatggttctgtttgcaacttggtcacatatgtgagctgaaatctaaaatgctttttttactttctaactgtgatcatcgattctgaatacgagtttgtttgcaggtttggagactttggaacactgattcatctttagagctcgtagatccggcgattagcggaagctatgagaaagatgaagtcactagatgcatccatatcggacttttatgcgttcaagaaaatcctgtgaatcgaccagcattgtctacaatattccaaatgctcactaatagctccattactctaaatgtccctcaaccacctggatttttcttcaggaacagacctgagtcagacacattacgccgtggattggagccagaccaatataacaatgaatctgttacttgttctatcgacaatgcaacaatcactacactcctcggtaaaactcttgcttctgcactctgttgtattacctcaactctattttcaaagtcaatgtatagaaacactgaggattgaattatttttgaatattaaaagttatctcattttgattctggtttatgtattcacgttcattttttgttaagaataaatgcttggctcacctgcccaataacatctttttttgaccaaatcaaggttctcaaaatagtacggtgaatgaaatcaaactaggctatccactgttttatcctcacatgtttctgctttgtgtcttccttcacaaagatgcagggactcagtattttagacccaacggtactcattccttaatggagactaagagatttttaaaacaataggaaccgacgacttaaatacttgtgtttggtcattgcttgttgcattgtgttttggagtaagttagaacgttttggtgtcaaatagggcctagaagagctacagatcaagaattggtctacgttcactttcatcatatttacctaacgtgtttataaagtattaaattatccaaaacgttgacctaggtgacttgtgcattaatgcacgtatccactacttgacgaaaattctacacgcgaaagctgttttgaccaaatcaacgttccaaaataaacatttccttttaaagattcaagttctaagatctgcaacaagtatctgagcaaagtaaaatgtcaagagaaaaaatg

SEQ ID NO: 29173 - DNA, 3000 bp, Unknown
  misc_feature (1)..( 3000): 2750-1469P.txt file - cDNA_ID_3000036; gDNA_ID_1620726; Annot_ID_49280
accgcgatatttgttatattgtgctttattgcggccatagttttcttcataacaccgattcagattgttgtagcattggctggattcttcacgatgaggcatccgaggttccgacatcggcttccttctgttccagttaacttctttcgccggttgcctgctcgaacggatagtatgctctagcttatattggctggagtattttatgtgattgtcggatatagacttatgttactatttgtaatctggatttgttttatctacaatttttttttcatttgaaaacgttataatattttggatggtattcattagtgtttccttttcaaaaatacctctaagaaaatcagagaaaggatcagtgagtccaaaattcccaatttggtataaactagaaatgaaatttcttttagattcaattttttttttctttttgtgagcttctagattctgttagctagagaactctgaatccaaaagattcacactcacaaaaaaaaacaagaaaggaaatcactctttctttctcttaaaataaagatatcccttctctctacaaaaatctctaccgccgccgtttagggttactggttccgttggctttttcagcaccaaccgagttttctttgttttagtctctctagtttcgatttcttttgggtttgatgtgatttgaatcctgcttttcttccaacggtttcagatctaaattctcagatctagatttataaagtctaaatccttcttctaccggatttgctgcttgttttgtctccttcatctgcagtttcagttctggtcgttccaaccatgacagagacagttctttctgatccttcaatgcctcagatgcatatttctcaatattgaagctcttggtctccttcctttcttcatgagactttttcctttgaatctcgggagtgttgattgatgtctcactgccgttggtggtaaggaaagtcttagttttatttcctttggatagatctctagtcttagatctgtttttaatttaacttggatttatactttgtactttgtttttgagttcttttagtaatgagtttgagaagtttagatttagtatcaatgtttttctttatttttgagtttttttttcattttcgatatgtttttattcccgagagatattgtttgctcgccggcttaattttgggaaggattgttttccttgccgacatatgtgttaaaaataaaataaatacaaaaataccctttaaaaaaaattccagcaattttataaaagtctatcgtttaattacggcagatttattcttattccgcagacttttttaactgcgacagattttctatggcagactcttttggttgacagactttttagaagatagtgatgacagatttataaattatagctgatttaatttgattgacagatttttattttattcaaccacaaacttttatataattttatagacttatttttttgtcgttgtattttcacggtaagtgatggcagatttatgattttgttaaacaaatctgtcacattgtaacagatttgttgtcaaaaaattaattactagaatgacgtctaacgataaccaattttttttaatgttatgacagacttgttttaagttataacagatttatgtaatcttacacaatatctgtcgtttgttggcagatttattttctaaaatatgatgttttgtgttatgacagagttgttttatgttgtgacagataaatttatattaccataaatctatcgtttgatggcaggtttaataaataagaaaataaattgctgaaatgaccttaaaaatattttatgttacgacagatttgtaattaggaattcttatggtgactgatttttagttttcttgttccataattttttgtagtagaataatactaactgttgtgacagtttttttttcattttagcttgttatgactgatttactaaaattagttacaatatttaactcataaaaaatattaatatcgagatacaactagggttttggttacaaaaacttagtctccttacaaaaaatatgtggcctcctttctttcttttgtttatctttttttttcctttggaaatctcttttcagtttttggagtagtggaagcaatatattgtttcatctcttttcctcgtatgtgtgtgggttaaaaaaatatgaaacctataaactcagaattttgagcgatatttttttaaatttttccttacttatttgtttttattttatttttaatttcattttacattatttttttaatatcagatgttaaaaatttcaaaaaaaatacagaccaaggttttttggtcattatacaccaaaattgtgtcaatctaattctctaatcaaatagagagtcattctagttattattggctatatttgtgtcaatctaggtaattttgacaaaaaaaaaaaagaaaaaaaaaaaaagagaactccaaatccagattgtgaagcatatttcaatttcgcacttattcgatcataaaagaatttacataattcgttcataaaatgtatgggctaaatttaggcccagtatgagaaaaaatccaaaaggcagtagtaacgttcacattatgccgccacaaaaaacgcaactgatgacgtaagcacaccgagtgttccgacgattctccaacgtggctttctcttaaacatccacgtgtctattccattctccaaccactgaacacggatcaagaaactaaaatgatattttgactccaaccaaaataaatatctaattttgtgagaaaagaatcttcttttgcaaatgcttcgctcctcaattcgacttctctatataagaagaaccagtcctctgcttcgaagtttatcatcatcatcatcatcatcatcatcaaaacgattcgattctgcgaaaccacttttcaattctcatcggattatttctcttccaatttctacaacgggagctaaactatctagatcggagcattcaatg

SEQ ID NO: 29174 - DNA, 3000 bp, Unknown
  misc_feature (1)..( 3000): 2750-1469P.txt file - cDNA_ID_3000036; gDNA_ID_1620726; Annot_ID_165951
gaggcggtccatccagacgagcttgatgaagagtttgatacgtttccaaccactagaaaccctgacatggtgcgtttaaggtatgaccggcttagaagcgtggccgggaggattcagaccgtgatcggagatcttgcaacacaaggagaacgttttcaagcacttttaagctggagagatccacgcgctaccgcgatatttgttatattgtgctttattgcggccatagttttcttcataacaccgattcagattgttgtagcattggctggattcttcacgatgaggcatccgaggttccgacatcggcttccttctgttccagttaacttctttcgccggttgcctgctcgaacggatagtatgctctagcttatattggctggagtattttatgtgattgtcggatatagacttatgttactatttgtaatctggatttgttttatctacaatttttttttcatttgaaaacgttataatattttggatggtattcattagtgtttccttttcaaaaatacctctaagaaaatcagagaaaggatcagtgagtccaaaattcccaatttggtataaactagaaatgaaatttcttttagattcaattttttttttctttttgtgagcttctagattctgttagctagagaactctgaatccaaaagattcacactcacaaaaaaaaacaagaaaggaaatcactctttctttctcttaaaataaagatatcccttctctctacaaaaatctctaccgccgccgtttagggttactggttccgttggctttttcagcaccaaccgagttttctttgttttagtctctctagtttcgatttcttttgggtttgatgtgatttgaatcctgcttttcttccaacggtttcagatctaaattctcagatctagatttataaagtctaaatccttcttctaccggatttgctgcttgttttgtctccttcatctgcagtttcagttctggtcgttccaaccatgacagagacagttctttctgatccttcaatgcctcagatgcatatttctcaatattgaagctcttggtctccttcctttcttcatgagactttttcctttgaatctcgggagtgttgattgatgtctcactgccgttggtggtaaggaaagtcttagttttatttcctttggatagatctctagtcttagatctgtttttaatttaacttggatttatactttgtactttgtttttgagttcttttagtaatgagtttgagaagtttagatttagtatcaatgtttttctttatttttgagtttttttttcattttcgatatgtttttattcccgagagatattgtttgctcgccggcttaattttgggaaggattgttttccttgccgacatatgtgttaaaaataaaataaatacaaaaataccctttaaaaaaaattccagcaattttataaaagtctatcgtttaattacggcagatttattcttattccgcagacttttttaactgcgacagattttctatggcagactcttttggttgacagactttttagaagatagtgatgacagatttataaattatagctgatttaatttgattgacagatttttattttattcaaccacaaacttttatataattttatagacttatttttttgtcgttgtattttcacggtaagtgatggcagatttatgattttgttaaacaaatctgtcacattgtaacagatttgttgtcaaaaaattaattactagaatgacgtctaacgataaccaattttttttaatgttatgacagacttgttttaagttataacagatttatgtaatcttacacaatatctgtcgtttgttggcagatttattttctaaaatatgatgttttgtgttatgacagagttgttttatgttgtgacagataaatttatattaccataaatctatcgtttgatggcaggtttaataaataagaaaataaattgctgaaatgaccttaaaaatattttatgttacgacagatttgtaattaggaattcttatggtgactgatttttagttttcttgttccataattttttgtagtagaataatactaactgttgtgacagtttttttttcattttagcttgttatgactgatttactaaaattagttacaatatttaactcataaaaaatattaatatcgagatacaactagggttttggttacaaaaacttagtctccttacaaaaaatatgtggcctcctttctttcttttgtttatctttttttttcctttggaaatctcttttcagtttttggagtagtggaagcaatatattgtttcatctcttttcctcgtatgtgtgtgggttaaaaaaatatgaaacctataaactcagaattttgagcgatatttttttaaatttttccttacttatttgtttttattttatttttaatttcattttacattatttttttaatatcagatgttaaaaatttcaaaaaaaatacagaccaaggttttttggtcattatacaccaaaattgtgtcaatctaattctctaatcaaatagagagtcattctagttattattggctatatttgtgtcaatctaggtaattttgacaaaaaaaaaaaagaaaaaaaaaaaaagagaactccaaatccagattgtgaagcatatttcaatttcgcacttattcgatcataaaagaatttacataattcgttcataaaatgtatgggctaaatttaggcccagtatgagaaaaaatccaaaaggcagtagtaacgttcacattatgccgccacaaaaaacgcaactgatgacgtaagcacaccgagtgttccgacgattctccaacgtggctttctcttaaacatccacgtgtctattccattctccaaccactgaacacggatcaagaaactaaaatgatattttgactccaaccaaaataaatatctaattttgtgagaaaagaatcttcttttgcaaatg

SEQ ID NO: 29175 - DNA, 3000 bp, Unknown; identical to SEQ ID NO: 29173
  misc_feature (1)..( 3000): 2750-1469P.txt file - cDNA_ID_3000036; gDNA_ID_2926153; Annot_ID_139388

SEQ ID NO: 29176 - DNA, 3000 bp, Unknown; identical to SEQ ID NO: 29174
  misc_feature (1)..( 3000): 2750-1469P.txt file - cDNA_ID_3000036; gDNA_ID_2926153; Annot_ID_198205

SEQ ID NO: 29177 - DNA, 3000 bp, Unknown; identical to SEQ ID NO: 4617
  misc_feature (1)..( 3000): 2750-1469P.txt file - cDNA_ID_3000039; gDNA_ID_1620718; Annot_ID_49145

SEQ ID NO: 29178 - DNA, 3000 bp, Unknown; identical to SEQ ID NO: 4617
  misc_feature (1)..( 3000): 2750-1469P.txt file - cDNA_ID_3000039; gDNA_ID_1620718; Annot_ID_165710

SEQ ID NO: 29179 - DNA, 3000 bp, Unknown; identical to SEQ ID NO: 4617
  misc_feature (1)..( 3000): 2750-1469P.txt file - cDNA_ID_3000039; gDNA_ID_2926153; Annot_ID_139410

SEQ ID NO: 29180 - DNA, 3000 bp, Unknown; identical to SEQ ID NO: 4617
  misc_feature (1)..( 3000): 2750-1469P.txt file - cDNA_ID_3000039; gDNA_ID_2926153; Annot_ID_198228

SEQ ID NO: 29181 - DNA, 3003 bp, Unknown
  misc_feature (1)..( 3003): 2750-1469P.txt file - cDNA_ID_3000046; gDNA_ID_1971867; Annot_ID_58440
atgttatatgtttggatttctaaacaacaatgacctcctctgaacacacttctttttagtgaaataacccccaaaaacgaaaataaaaattgttagtgagttggttcactatttggtgtggtacacttggacatatgtatagatgacaaccatctgtcattatttctctactttagaagtttaattctctcacgtcacttctttattaactctttattccttctagaattttggaccattactttcaagttcccatgttttgatacacaaacgaaccattcgattcttttcttgcgtttgctagttttattttgatacttttgtttcaggaggactaagagtgaggtttagtatcgaaaacatggttacatgttattatcttgatgatcttattttgttatgatcaaaaaatttaaacctaattgagtgcatgtgcaaaattaaagacgacaaagttaatgaagcatcaaattctgattggcgatacacattagactatatcaaatggtcgaggactatatatcaagcttgcatctggttgcaacttgacttattattggctacggttccattattatgttttagggagagagtgaaccaacgttgattacgttcaggggggaaacgtaagcagacattgagacaactatctgtacgacctaagagtgatcgagtcgtataaagctcaggtgaaacaagactaaaactaaaccgataaccattggatctcattaattcacagtaaaccaaattgtacccaattaaaccggaaatagatagtaccatacggagaacattttctttttttgagagagtagtgagtgtcacaataattgacagatgacgaaaagaaaaccagagcggaatctacgagctgaaacacaagaactcactgttaagactcagtttcaagtaaaagtttctacaaagttcgaatgttttcaacatcgagtgaagtaaaccagatttcactgaaaaccttatcgtgtttctctctacttcacgagttttcttaatacagattctgcgcgctgctcaaatcgaggtagtgcccattcgtgctggattatgtctaaaccatccttctctgcacccagactctgatcaattttgcaaggcaacgataccaaatcaggtatggccacggagcgaacaaaacaacaacacttagcaatcatatattcatatatagtttgattacctttgatgcatcaaatccaaacccacccatttgcatcatacgttgtgtgtcatcaatggctgcatacgaagcaaaagtaaaagattatgaccacagtttagtttttgaggaatgtggagcaaattcgtatgtgacagctaaccattttcatctccgagaatgagactgaacaagcctcttaatccaaacaagttcaagaagtacctgaagagcgaaagaaaaactcataaaaaaaaaaaagagaaagggcaaatatccagaagcaaatatgattagcatactgaaaatctgaagaggaccggataacacaaagtcctttgtgtaatttgagtacttaccaggaacgactactcacatagctaacatcgacagtgctcaagtcaatgccattctgtaacattgatctgaacctctgagtcagtggaaatggtattttggctgcaagataaacaaagaagccttagatgctatggaattataaaaaaattagagtatcatggaaacaattaactggtttctcagatgaaagcagtgaaacagccagttataaaatcaaatacatgattgctgtttatgaagtaaccaagaaaaataattgcaaaacactttgtttaggaaataaacctgcaacaaatccagagaagaagaagttgacccatgcaaaagtgagtgtctgcaaaatggtaagtgatatcagtttcttaaatgaccagtaacgcaaaaacatagatgaaacatttcaaatacaactcacctgaggaataatcatagaaagatttttcttcatcatatccatggccatgttaggatcagaaaacatagcagcttgtggattttgagcttctcccttgggaacatgtagcaaaccattctcctacaacaaacaaaaccacatacttctcacattccatatccatcaatacactcatcagaaactattgaacagattacttcctctagcaaaacaaagagacaatataagaaagacgatcacaaatgaatgctaagtaaaaaggtcaaagatcaacaacaaactcaagctttcaatggaatccacacaatgaatctcttaaaatcagaaaaccagatcaagaccaaatgtcaaatcttagaaaactcattacctcgttgctgaagtagaatctccgagcacggaatgatttcggcgggataaaattagcaccgactttaagattccgagctctaataacaacttgcctatcaaacaaatcaaatcgaaatcgaatcagctaaacaaaaactcatagatacagacttaaaatctacgcatagagaatacaatccagagaaggaggaagaagactcacccttctttaaccatcttagcatcaggagttggagtagaacgcataagcttagagacaaagtatctcaaaataccgattagaaccatcactacggagagaggaatcagaacccaatctctgatcgccgtatcgagaactagatcctccgccattctaaaccctaattatctctctttctcgtcttcttcgtcttcgatcttctctggtgaagcaaacaaaacacgatctgagattctgagagaagagctgagaatccgataatttagtggaaattattttattttttttatttaaaaaatatctgaaaccttctgagtcagagagaggctttgatgtgttccctttataaaaccctaattcgtttgtctattaaacccaaactaaaaccctagctaccttgttctcctcaccgcttctttcttccctgaactcagaacttagaacaaagaactctcgtagacgaagaagaagatg

SEQ ID NO: 29182 - DNA, 3003 bp, Unknown; identical to SEQ ID NO: 29181
  misc_feature (1)..( 3003): 2750-1469P.txt file - cDNA_ID_3000046; gDNA_ID_1971867; Annot_ID_176506

SEQ ID NO: 29183 - DNA, 3003 bp, Unknown; identical to SEQ ID NO: 29181
  misc_feature (1)..( 3003): 2750-1469P.txt file - cDNA_ID_3000046; gDNA_ID_2926155; Annot_ID_139487

SEQ ID NO: 29184 - DNA, 3003 bp, Unknown; identical to SEQ ID NO: 29181
  misc_feature (1)..( 3003): 2750-1469P.txt file - cDNA_ID_3000046; gDNA_ID_2926155; Annot_ID_198354

SEQ ID NO: 29185 - DNA, 3003 bp, Unknown
  misc_feature (1)..( 3003): 2750-1469P.txt file - cDNA_ID_3000049; gDNA_ID_1620711; Annot_ID_48992
ttcggtaatcttcttacgtttctctgtacttactggagataaaaaaaatcgaaaattctcatcttttaagtcaattttgttactttctttcgaaagtttggtgattgttttgatgtgataacgcaggacgacgttgatgaagaaaacccgaaaactcacgagaatggtccaattggaggaaagactcaaaatttagggcaaagcaagggaggtgatagtgataatgttgtaaagactaatacttgtttcgtgtgtgatgggaaagacaattgggttttggtatgttacggagaggaatgtactatagctattcatcagagttgtgcatctgatgaacctgatttcgatgaatttggaaatttctattgtccttattgttggtataagcgtgtagttgtcaagtgtttggagttagggaagaagcttatgctgactgacaagtctaggaagggatgtagagagagtttaggaggagtagatgtgggtttaatgatggagaaagaagctggaggtgttgagaatgtagtggaggttaatgtttctggagcaagtggtatggttagtgggaagagaagggaaggtgatggattaaacaataaatggatagtgatcgagaagagtcagaaaatgcaaaaagttgctgctgaaactcattctcgggaaaattctaaggctgatgatattgattcggataagggaagaaagcagcgaggaagatttaatgagaagaattatgaaatttcatatgcgtgcatttctaatgcaggtgagggaagaaagggaagggtaagaagaggtaatgagaaaaatcatcaagcaccagaagcgcacagtattgatgttggtggggaaagaaagcgacagagaagatgcgatgatataaaccatgaaaaagcacaaccgcacagttttgctgttggtatcaaaacaaaagagaagaggagatacagtgagaagaaccagcaaaacaaaacagttgcaactactcatgaacacgacgtcttaactaatgatggaagaacagaagcccgcgattctgatttcggtgagggaagaagtgggcaaggatgtttccatgagaataaccagcaaacgaaagtgtcgtctactgaaagatgcgagcaggaaatccctaggaccaataaaagagtgtcactcggttctggattaggggaggggcgatatcgggagggaagacatattgaaaagaatcagcataccgaaactgttaaaactgaaactcatgggaaggaagtttctaaggataggaagagaaagcgggaaagaggagtggaaagagatggggatgagttctatttggcggagaatcaagacagacaatgccaagctgatatgagaaatgatgatgtggccttcaataagcaagcgactggtttcagcacagttgaacaagtagagcgaaagtctgtatcatctatttcatctccggagtctacaaacaatgttaacgaccctaatgttgcttttcaagagttagctttgatcatccaccctaaggctggtgtacaagaacaacctatcgaagcacgacctttacgctctgtctcttcgaagaaaccatcttttcaacctgaaaaatacggacacaaaagttacctggagaagaatggacctgcgtctaatgatcccgcacaaaggtttctattcatttggaacttcgtgacatttaaattgcctttagcataatggatgtttttgaggaagattcctaagcagcttgtcacgggctttaagctaacaatttttcttccatgtagtgctacaaaaaggaaaagacgattttggacgctggcagaagtagagatgcttagggtatgtaacttgcacatttctctctatcctacgtatatttcatgctgcagttatcttggtttttcgtaatttggagcttacacattcaacggctctttttaaaggtttatgcctgttttagtttatcagctttataaaaacagccagggtagctggtcttatcatctcctaagaggcggtatttcattttcagtcgtaatgcaattgttttgtagactagacttcataaataagagcttatcctccaaatcattgtgaaattatatctgagatatataacattgtttgtggctgtccaaattaaatattttgctatgtagtgcacaatggtgataaatgtggatttgtctaacttcgtcctgtcctttaggttggtgtgcagaaattccctggcgagaggaatattccatggcgcaaaatcttgcaatttggtcgggatgtgtttcatgatgaacgggctccaagcgacctcaaggacaagtggaagacgttaaacaaaattccttctgacacggggaaatgggtaagcctttcaactgaaagacaaccgaattactatgtgtctgaagttagttctgaatgacctatcggacttagcaagcattagagcttagaagagtagtagatagggctttgcagattttgtacaaccttgcttgctcctagtttgctaaatgtatatggagcaaaactgatcttaccttttaacactaaattcaaaaaaaaaaaaaaaaaattgatcttacctttctaatttgtatgtcctcggcaatgtagagaattcacaagagtgagatgatatttcatgacacttgaacacaagtttatactaaaaatcatgaaccaatgttgtacttcaatatctattaaacttttacatgtcttttgatatggatttctctgcaattgtaagacaaagaagaaaacagtaaggtcaattttacacttcgtgtaaacaaacttttttctaagtttttaatgaattaaaaaatagatgttttagacagaaaatgatgagggtagaattcccgccagtgcgtgggttcaactataaatcctttaaccgccacgtgtcctagaagagtgccacgtacagccactatcctccactttcggcttatttctgtcggtttattctctgctcactgagtggcaagaaaaaaagaaatg

SEQ ID NO: 29186 - DNA, 3003 bp, Unknown; identical to SEQ ID NO: 29185
  misc_feature (1)..( 3003): 2750-1469P.txt file - cDNA_ID_3000049; gDNA_ID_2926155; Annot_ID_139494

SEQ ID NO: 29187 - DNA, 3003 bp, Unknown
  misc_feature (1)..( 3003): 2750-1469P.txt file - cDNA_ID_3000053; gDNA_ID_1620711; Annot_ID_48996
atttaaactgtttaacagacaaagaccaagaataccaaacttcaaaacgaaaatgccgaatcaatgtgacgagacagcgtaaaaagcatgaggaagggttctgatatacacatgacccataaccaaaagtatgtacaaaagggaaagaaaaattcagccttcaaaacttagcaaatggtttttcttccaactccggagaggtaagactagacctaaacccggctctaattcttgaatttttccagatcagaacctgaaacactacaaatctcgtaatgcaaccttcttgcttctacgatatcaataatattaccactacgatcgttagctattcgatttggaagagatatcaggaatagatgcacaagacgcagccttgtgctggatgcttttcatgctcagctccatgcttctatgaaccatgtcctgcagcagtttcttagccgtttcagcagctttttctgccccgtcgacttgtactgcaatgccatagacaattttctctagtgttaatggagtcatttctttctcacgaggggtttctctcagtaggtccaagagaactctggctctatctcgggactttgatgttccatctactgttgaacttaggagacccgggattgcaccttctttcagtatgagttttcggtacttatctcggtcgctgcggcatagagaaagcagagctccaactgcgtgttctatgctgagtggagaaccatcctctacagtctctactaaagtcagaataccatcttcacagctggtgatggcatttcgcccgtcctcagagtgagacaggatcatctcaaccaaggctgtggctttttcagcaaacttggaatgttttttgcattctttaaggaggtggatgagcgggtagacagctttagcatcaagaattggagcagagtactctttgcaagctgataaattatgaagggctgtgacagcatctactttcccttgtacagttccggagctaagcatctgaatcagaagcggtggaactccagaacttataatcatcgccttgttggctggtgcagctgaaagtgttagaattgctgcagtggccaattcacgcaaactagcattgtggagcttcagaatctgtatgagaggtggaacggcaccggctttcacaatctcaatcttattcctggtcagaaatcacaacccaaaataagtaatgaccaccacaagaactgaaaatgcaaatctatttccacacagattacaaaggatctgtagaaaatactgctggagcaagtaggtaaattacatcctacatttgctatctttatccaaatagcagtaaactacaggtaaagctagacctagagcaatcagatcagtgtccaaaaagcagtatcctcttggtttcaacagatctaaagtccaaaatgtagctactctcagtacattctgatgcctgattgatagagttaaacaattgccttaacactaaaactacaaatccagaacaatgtcataaatcaagctctgagcagagattagtgaagtcactaatcctaaacactgcctaaagcctcagatcgagttaaattagacctagaagacaagacgagagaatcagtttctggtacatggcaataaaacctagaacaatccaagagagattaccgttcatttctaacggcgaggttaaggagagcgaggagagaggcgtgacgagcatcaacgttagaggagaagagcatgggaacaagcggcgggataacgccggcgtcggcgagttttgacctagcggaagacttaaccggagactttctaagcagctttcggatttccttagcggcttcaattcggaaatcgagatctccatggagaagcttcttggagagatgtagaatcagtaattcctttgtggttttccatgtgttggtggtggtttcctcctctgcttcgtcttcttccgatatatttgccgtcaccgttgagtcgccggcgatggaagccatcatctgattctggttctcttccaccaccattatctctgtctctctcgctcgcttgctcgctcttgtgtttgtttctctctagtcaaagacgaaacgacgacttatcgaatcatctacttaattaaaacgaaagttatggtattagttgaaagagcccatatttctcgaggttagttagttcacaatttaccaaccgggacatttcaatattttaactttttcaattttatgcaaggaaagaatataagaaagaattagctagaaaaattattttcaaaattaacaacaaatcccgaatatttatataactatttaaaagtataattaggttgttcgtttgatcgccgcatctatttgcgacagcagcaaccatgatgatattcgtttggtggacgcaagacgatgtggtcaaacgttaaggcaaacgcaagtagctgcggttaaaaattgttgacatcattttacttcaacaatatgcggtagagtttgctgctgccgttaggcgtaatgaaacaaatagactaacacaaagaataaacgactacaatttataatttttcatttataaaataaaataaaaattggaatatattgtgcggaattcctatatatcagaactcattgatctgctgcttcttctgaaagttcttaagtggttccacgatgtttccattttgttctgacttccgaggccaacgagatgagtccaataaacaaagggcacggaaacattctttttaaattaggtttgtttttttatttttggtttttggtttttcccggaaattgtatgaagtcttcgttacagtttctctctctcaccttctctgtataaagtcttcttgagatcgaaggataacttcaattcaattctctccaaggtacacacaggtacagttttctccttcattctctcttgtttgagatttctgaagatgggtttgttaaaaaagtgtacttttttttgttctctctcgtgtagctgatttttgtgataagaagattgattgagatg

SEQ ID NO: 29188 - DNA, 3003 bp, Unknown; identical to SEQ ID NO: 29187
  misc_feature (1)..( 3003): 2750-1469P.txt file - cDNA_ID_3000053; gDNA_ID_1620711; Annot_ID_165415

SEQ ID NO: 29189 - DNA, 3003 bp, Unknown; identical to SEQ ID NO: 29187
  misc_feature (1)..( 3003): 2750-1469P.txt file - cDNA_ID_3000053; gDNA_ID_2926155; Annot_ID_139498

SEQ ID NO: 29190 - DNA, 3003 bp, Unknown; identical to SEQ ID NO: 29187
  misc_feature (1)..( 3003): 2750-1469P.txt file - cDNA_ID_3000053; gDNA_ID_2926155; Annot_ID_198365

SEQ ID NO: 29191 - DNA, 3003 bp, Unknown
  misc_feature (1)..( 3003): 2750-1469P.txt file - cDNA_ID_3000057; gDNA_ID_1971822; Annot_ID_58341
gttagcaatgttattaaacccgacccgcataatgaaccagactactttctgggtcattaggtcatcgggttaactaattaaaattatatatatgaaagttggtcaactctttccatatgagtgacacatcatcacactagtgaatgtcatatgtcattctaaattaatattattaaaaaagaataaaacttagtgataaaaaattaaaagtttcacattgcattgaatcatccattaataatctcacacttaactatcttcatttaaaagaaaaaaatacaaaaaaatcattttaatgtatcaaacactactttcattttatttttcttattatgctatttttttaatagtcattacttgataacgactagaaattttcgtgtattacaacttagttgtttgttacttaacctttttaagtttagtaattttaacttagtcttttttttattacgctttttgtctacatgatatggttttttgtgcattacgataaattggtaacattaataattaataatgacatgcatgttttttaagtaatgatcttttgagacgttagatataccaacaagttaaatatatgatactctcgcgtgggtactcacctactttatttaataaatttaatattaatagagattttacagtttttagagttcttacaaattaaaaataatcatatcctgttgaaccggttgaaccagccgggtgtgggttttaaaatattctctttattttggaataaaatatgggattttagactttattcaatcattttagaaacaatttcagttcgtaaactcatttgatgttttagattgtgatgaagacttcacaatgtcgccttaaaaaatgaatcgaatggtgagtgagacacctgatattagttgtgtgaattcacgatgttttattagtttatttccgtcattggtgatctcctactatatttgttacggtattagacatttaattggatttaaacaatttaatcacttacggtatttacggtattagaattattattgtttgattatatatatatatatatatattttttttttggtgtaaatgattttatattttatcaaacataatctggttttatattttataaacatgatatgattattttaaatttataaaaactctaaaaactctaaaatctctattaatattaaatttattaaataaattttaattagttgacccgtgatccaacctggttgactcgattacccagtgacaaagaaagtagtccggttcattatccaggtcgggtttaaaaacattggtttttaatttttggattttggttttaggttttcgatttttgtagtttgtgatttttgttgtagattttaatttttacagaatcttaaatggaaatttatttagtttttagttctctactttaatttatagttttttattttttgtttaaaaattactaaaacaatgaaaaattgtttaaaaatcttgaatggaaattcgttaaaggtggattgtcaaagtcaatccataactgaaattagcaattttagggtaaattagcaattttctgcgagggtagtagctgtttacccaaaatcttgaatggaaatttgtttcaacgtttttaagttctctattttattatagttttttattttctgtttaaaaattactaaaacaatgataataaatattttcttaataataaaaaattaaaaagatgcagaaaaaaaataatcataggtatattgcatataaacatagattttgtaaataaaaccaatttttacgaaaaactaaaatgaaaaactcatattaatacaataatactaaaataatgatgtagaaaagaaaaaacatagcatatttaaaataataaaaaagaattaaaaaataaatatcacataaatcttctagaaatttggtttccttatgttttagaaaatctactttttattaatcataaatgagtaattattagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataaaaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcattttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcatctagagttactactatggagacaaaagtcgaataaaagagacctcacgtgaaaatgttacgagctagtaactaaagcatttacactaacggtaaaaaaagtatctataaatgtttacacaaggtagtagtcattagcactcaacttaaactcttttagtaacaatg

SEQ ID NO: 29192 - DNA, 3003 bp, Unknown; identical to SEQ ID NO: 29191
  misc_feature (1)..( 3003): 2750-1469P.txt file - cDNA_ID_3000057; gDNA_ID_1971822; Annot_ID_176210

SEQ ID NO: 29193 - DNA, 3003 bp, Unknown; identical to SEQ ID NO: 29191
  misc_feature (1)..( 3003): 2750-1469P.txt file - cDNA_ID_3000057; gDNA_ID_2926156; Annot_ID_139522

SEQ ID NO: 29194 - DNA, 3003 bp, Unknown; identical to SEQ ID NO: 29191
  misc_feature (1)..( 3003): 2750-1469P.txt file - cDNA_ID_3000057; gDNA_ID_2926156; Annot_ID_198418

SEQ ID NO: 29195 - DNA, 3003 bp, Unknown
  misc_feature (1)..( 3003): 2750-1469P.txt file - cDNA_ID_3000059; gDNA_ID_1971822; Annot_ID_58350
aattatattatattatctcccatttatagaccagccgccgaaacgaagaaagcagcatagaagaaagcgagtacataaccaagaaccatgtttgatgagaggagtctactacaaaaacatgaaatggcaagccgccattaaagtcgagaagaaacaaatccacttaggcactttctcttctcaagaagaggctgctcgcttatacgataggtaaaactctttcgggttttttttttgcaattcaagtaattcattaccattgacaattatcacctctattagggctgctttcatgtgtgggagggaaccgaactttgagctctcggaagaagttatacgagaactcaaacagcaaagctgggaagagttcttgaattgcacacgccgaacaattacgaacaaaagtaaggttttactaacaacaaactgtagtgtattttgtttgataaccttttgctggactctttggatatgcagaaccaaagagtaggatagaacatgaggatacgaagatcaatgccagcatgccacatcaaccagaagaagaagagcaagattcagacaaaatgtgataagttgtgcaaaagatacaaccagactcatatacaaagataattattattcatcaagaaaatagtaacatatataaagcatagtcgtaaaaaacaaatagcatcactcatagtaagagacaaattagagactcgccattaagaccaaatggttatgtgacaccttcttgacacaaaaaaaaaaaaggttatgtgacacctttttaatggctgaggagatggccagcagaaacggttaaactggctatcgaggaggtacggaaaaatgttttgagttttaagaatcttttaagaaatccgtaccacacttttcctaacataactagttcaatttttgagatcaaatcacttttgtgtatcatgatttaaaactctgaagttctctagaacacatggataattctttacatcatatggaaccaaattcatatatggacgcttcacgtcctctacggttctcatgtgcttgaccatctttgtgatatattcggtgcccgagcaagctacttggttagccaatggttcttttgagtcaactttttattattgtgactcatactatcttctcctgacttctgctcttaattctctatagaaaagttctctgatagataacaagtaattcaaacaaatagatatagaaccatctcgtaaaaacaaaaacattagtatatgaaaattatgttttcttattattttaaacattgaaaaatacaaaaacatatcaaatgagctatttattagaagaaaaaaaaacaatttgactaaagagttagttcttatggcttatgtaggaggtcataagcacattatgaacgccagaacgtacaggcaatgccgcacgtccatccattcgaaaatatatatgatctactctagcaatatacacacgtagttgaccacattgaatataatttggaattgtaggatagtttaaaaacttttggaacatatgcttcaacctcgttataaaacttcatgttaatctcttgcctaaaaagacatttccaaatcgatcgcttggttccgacttccgtcatccttaaatttaatgatttttgtacctttggcgtttaaatattggactcctaaattttggttctctgagcggcaatgatattggagaattctactagaaccgaaattgttcttaatcacaatctcagttttcttgcaagcatcatttaccacaaaataaatcgcactaactaatatgaaaattattagacgactcatttgtttgaatctaaagtaattgtcagagaaacaagagcatcaacatgtaatagtttttttttctgtgtgtggaaacctttttctttatttagcaaataatgtttgctgaagtgttaactatatttagagacaaacatgcatgaacatattagaaatttggtcaaaagagattttagtgtctaaatttatgtttaaccaataagattccaaccaaatgaaataacctaagttattataattgaccttgaaactcaaacaaaaaccttatcaaaaggttattggcaaaatgttgaagtatatcataaatgtgtagtaaatttgaaaactaaaattggaaaaaaaaaattatgcgataggcatgaataaaaatcagcttcacaaccaataagcaaacatcgagattttgaagaaccagttagggagagcaaatagagcttaggtggaggcaattgatctaggaagtatgtgggcttatactatgacataaaatcaaaggagctatcaaaaaaacccctcctccaattgtcttcatacttaaaaagagactcatacaaaatgagactaacatagtttctaatgagtttgtgtacatttgggtgtgtttagttttgtcgttgttgattctgttagtgtttagcgtatgatccattttagaaaagtttttttaggtaaaactcttaataaattatttaaaaaatatgctaccccgagacaactattgtttcttacaatttaattgtgtttggtgtttggatacatagatataaattaatgatattttttgtaaatatttactaaaataaaagctattatctaaaatgaaattcaaaataaataattaataaataaaataataattagtaacctcaaataattgttttgtcgtattgagtcaatctataacatggaagtcataaaggagcggcgagtgaagaggagaggtcacgtgagaaaaaccgaaacataaagctttcttattcaccacacatgcctcctttaaccctttgccaattggccaataacaatcaatggcaatctcgtaaattttccaattttcaatttccactgtcctcggtctcatcgtcgttgacaaatacgaacaccaatccttgattctctcctataaacacaaaaaccctttgattctaatataaccataacccatctctcaattttcgaaatttactcagaaatg

SEQ ID NO: 29196 - DNA, 3003 bp, Unknown; identical to SEQ ID NO: 29195
  misc_feature (1)..( 3003): 2750-1469P.txt file - cDNA_ID_3000059; gDNA_ID_1971822; Annot_ID_176225

SEQ ID NO: 29197 - DNA, 3003 bp, Unknown; identical to SEQ ID NO: 29195
  misc_feature (1)..( 3003): 2750-1469P.txt file - cDNA_ID_3000059; gDNA_ID_2926156; Annot_ID_139531

SEQ ID NO: 29198 - DNA, 3003 bp, Unknown; identical to SEQ ID NO: 29195
  misc_feature (1)..( 3003): 2750-1469P.txt file - cDNA_ID_3000059; gDNA_ID_2926156; Annot_ID_198428

SEQ ID NO: 29199 - DNA, 3000 bp, Unknown; identical to SEQ ID NO: 4847
  misc_feature (1)..( 3000): 2750-1469P.txt file - cDNA_ID_3000065; gDNA_ID_1620736; Annot_ID_49486

SEQ ID NO: 29200 - DNA, 3000 bp, Unknown; identical to SEQ ID NO: 4847
  misc_feature (1)..( 3000): 2750-1469P.txt file - cDNA_ID_3000065; gDNA_ID_2926157; Annot_ID_139560

SEQ ID NO: 29201 - DNA, 3003 bp, Unknown
  misc_feature (1)..( 3003): 2750-1469P.txt file - cDNA_ID_3000073; gDNA_ID_2926161; Annot_ID_139703
aaaacgttacgatagcaaacaaatgttatatgataattcagattgtatctcagtctacaagtattttgtagcgagaatgcaaaatctgaattctgttttaaaagtgaaattcttaaggaacttttttaggaagaacacatcaaatcaccaactaacgatgtgagcatgccaattatcacgactgtgcattcaggatcttgattgattaacgtttcttgcctttatttttaacaagtttcccttgcagaccttgttaaatgttttgtattcatattttcttttattctcgaaagcattaatcacatacatataccacaaagaaaagctacatgaaaagtaactaaaattgaattcaagatacttagggaaatgtttgtgttagggattaagcgaaaatgtgtttattcgtctagtcattctaatttttgtacttgcaccgtgtatacatgttattgaacaaaaaagctggacaaggcccacaactttatttgttgggttaatatgtaaacttatatggtctttggtataagtcgataccttcgcattaatatgtaaacttatatggtctttggtataagtcgataccttcgcattttcatcacttgaaggtgtgatttagtcataaaagcttaaccttgatttgcagaaaagtgatcacatacacttgaatctagcgacaagtaaacgaacaacttttggtcacggtcgctgatttatgtcgctatcgacatgtaaacaaacaggaccaaagtcatgacatcaccatttgtcgttaattttgtttgttcctcttttttttattattttttttttgaatatctgacagttcaagttcgaatgtcctatattttttagagatgagatctacatgaagttaaattcatgtcatttagagaaaaaatcccttccaacaggcgtcgaacccatcagctctatctcaaagatttactactggaccaataccacgttggttttgcttcttcctcttctcgtgagattcttctacttcaatgcttctgattcttctatgttcttaatctttcaacaaatacagtagtacctttaggatctgcccagaaggctgcggtatctttgatctcccttaccaggccccaatcttctcaaatcccatagcagtaaaacaattaagaatcgttggacttaggcttatctcagagattttaatgtaatgggttatagattacgaccggctttagattccgaggcatggccgacagtttagattcgtaatgatttagatatagtgcagccattgtgcttgagctacgtacatacgtccatgtcaacgatccactagctagtcttctaattaaattatttgtttttctttagtattacttttattttgttggtcactgagtcattagactattttgtattagtcacagtaatgacacacttctctttgatctttgggcaaaaccctactaagaaaattactagggttaaaactagatatggtgtatgaaagcattttttactttcaccgatttctccaaattcaggtattgttaattttagtgtagtgttcatagaaatattttttctcataagaaatgaaaccgatttagagtaaaaagtaattaagcatatcaaacaacttctaacagacgcagaatttaaaatatagcatttttgcgattcctagttccgtttttttttcactttttctaacaggttagttggatcttcacgtttgcgtgttgcaaactaaaatttgactatcctgttcaggacaaaatttgtctcttatatctagtagaatgtcacttgtaaaacttcaatatcgtcgcgagcatattagctaatagatctttgtagagttgttattttttgcccttttttgtttcgctaaaatcaatgtatgagttgttgtgcgttgtatatatatgcatgtccttgtcaatacatgacaaataaattggacattcatcatttatacttttttttccaacagattcatacgtattatatttgtgtaacttttgtatagtttggtctagttgtagacacgtcggtatcaattaactcattaaaacaacatatgaatatgaaaaagaaaaaaaaatataaacttgtcgtagtagaattttcaacctttatagatatcttttgatcacatttttaatatctctttccatgtaaaataaaagttcgacttaaaccaaacaaagaaaaaatgaagcttgacaagcaatatataacatggtattttaagatggtttacaaaaaaaaaaaaaattaacatattttagagtaaattatttggtgttctaaaaaaagagagagtaaattcttatgtaataaaataactcgtgaatgggacatatatattataatgatatataacagaatttgtctgttaaattatggtttagtttcataaattaaggcatatgaaattatggtttagtttcacaaataattaagagacactatatattgtattaagtttttatataagtttctcttttttacaaggttcatttttttcataatggcatttggttcaattttcgctttaaaatgttattttatatatatatctatatctatatatatatatatacagaaaaactttgataaaccaacttttattcaaatttatctttttttttctgatggaaagtataacttactcacctttttagtttcttatttaaactactaaatttaaatccggatttaaagattcctttgaaaatgatctaccaccagtaaattaaaatatattcgacataattttaacactagtgataaaaatttactacatatgttgatattatacttaggttaaaaaaaagaaagatatcctatgtggcaaccacctacaaactttattataaatataagtagatggcaaggcgtgtggttgccaaacacaaagaaaaacattcgacattacagaaaagaaaaaactataagaaaatcttaattaataaaataatatattcaggagggcgagagagagagagagggatg

SEQ ID NO: 29202 - DNA, 3003 bp, Unknown
  misc_feature (1)..( 3003): 2750-1469P.txt file - cDNA_ID_3000073; gDNA_ID_2926161; Annot_ID_198749
acgttacgatagcaaacaaatgttatatgataattcagattgtatctcagtctacaagtattttgtagcgagaatgcaaaatctgaattctgttttaaaagtgaaattcttaaggaacttttttaggaagaacacatcaaatcaccaactaacgatgtgagcatgccaattatcacgactgtgcattcaggatcttgattgattaacgtttcttgcctttatttttaacaagtttcccttgcagaccttgttaaatgttttgtattcatattttcttttattctcgaaagcattaatcacatacatataccacaaagaaaagctacatgaaaagtaactaaaattgaattcaagatacttagggaaatgtttgtgttagggattaagcgaaaatgtgtttattcgtctagtcattctaatttttgtacttgcaccgtgtatacatgttattgaacaaaaaagctggacaaggcccacaactttatttgttgggttaatatgtaaacttatatggtctttggtataagtcgataccttcgcattaatatgtaaacttatatggtctttggtataagtcgataccttcgcattttcatcacttgaaggtgtgatttagtcataaaagcttaaccttgatttgcagaaaagtgatcacatacacttgaatctagcgacaagtaaacgaacaacttttggtcacggtcgctgatttatgtcgctatcgacatgtaaacaaacaggaccaaagtcatgacatcaccatttgtcgttaattttgtttgttcctcttttttttattattttttttttgaatatctgacagttcaagttcgaatgtcctatattttttagagatgagatctacatgaagttaaattcatgtcatttagagaaaaaatcccttccaacaggcgtcgaacccatcagctctatctcaaagatttactactggaccaataccacgttggttttgcttcttcctcttctcgtgagattcttctacttcaatgcttctgattcttctatgttcttaatctttcaacaaatacagtagtacctttaggatctgcccagaaggctgcggtatctttgatctcccttaccaggccccaatcttctcaaatcccatagcagtaaaacaattaagaatcgttggacttaggcttatctcagagattttaatgtaatgggttatagattacgaccggctttagattccgaggcatggccgacagtttagattcgtaatgatttagatatagtgcagccattgtgcttgagctacgtacatacgtccatgtcaacgatccactagctagtcttctaattaaattatttgtttttctttagtattacttttattttgttggtcactgagtcattagactattttgtattagtcacagtaatgacacacttctctttgatctttgggcaaaaccctactaagaaaattactagggttaaaactagatatggtgtatgaaagcattttttactttcaccgatttctccaaattcaggtattgttaattttagtgtagtgttcatagaaatattttttctcataagaaatgaaaccgatttagagtaaaaagtaattaagcatatcaaacaacttctaacagacgcagaatttaaaatatagcatttttgcgattcctagttccgtttttttttcactttttctaacaggttagttggatcttcacgtttgcgtgttgcaaactaaaatttgactatcctgttcaggacaaaatttgtctcttatatctagtagaatgtcacttgtaaaacttcaatatcgtcgcgagcatattagctaatagatctttgtagagttgttattttttgcccttttttgtttcgctaaaatcaatgtatgagttgttgtgcgttgtatatatatgcatgtccttgtcaatacatgacaaataaattggacattcatcatttatacttttttttccaacagattcatacgtattatatttgtgtaacttttgtatagtttggtctagttgtagacacgtcggtatcaattaactcattaaaacaacatatgaatatgaaaaagaaaaaaaaatataaacttgtcgtagtagaattttcaacctttatagatatcttttgatcacatttttaatatctctttccatgtaaaataaaagttcgacttaaaccaaacaaagaaaaaatgaagcttgacaagcaatatataacatggtattttaagatggtttacaaaaaaaaaaaaaattaacatattttagagtaaattatttggtgttctaaaaaaagagagagtaaattcttatgtaataaaataactcgtgaatgggacatatatattataatgatatataacagaatttgtctgttaaattatggtttagtttcataaattaaggcatatgaaattatggtttagtttcacaaataattaagagacactatatattgtattaagtttttatataagtttctcttttttacaaggttcatttttttcataatggcatttggttcaattttcgctttaaaatgttattttatatatatatctatatctatatatatatatatacagaaaaactttgataaaccaacttttattcaaatttatctttttttttctgatggaaagtataacttactcacctttttagtttcttatttaaactactaaatttaaatccggatttaaagattcctttgaaaatgatctaccaccagtaaattaaaatatattcgacataattttaacactagtgataaaaatttactacatatgttgatattatacttaggttaaaaaaaagaaagatatcctatgtggcaaccacctacaaactttattataaatataagtagatggcaaggcgtgtggttgccaaacacaaagaaaaacattcgacattacagaaaagaaaaaactataagaaaatcttaattaataaaataatatattcaggagggcgagagagagagagagggatgatg

SEQ ID NO: 29203 - DNA, 3000 bp, Unknown
  misc_feature (1)..( 3000): 2750-1469P.txt file - cDNA_ID_3000085; gDNA_ID_2926161; Annot_ID_139716
aacaaggagcttgtgatgttggtaatggtgttggtttgtctgttcctggacaagctctgcttttgatacacattgtctggatgatgcttcttgggttttctattctctttgggctcttttgattttggttctaatttctctgaatcaaaacaacatatagaagattgtttaggttttcagattgcaaatgacgaatcttttttgtttatactcttctttttttctttatattgctctgtattcatattacattaaaactatgaggaaatattattattatttggtttgtttcgtacaaaagaagcttttttgaatcttgctttctccatctctttcccaagataatccaggattgtatctgttacgtggttaggtaaacaacctgcatctaacattgctttcaagtacttgtatgcttctttcaatttccctgctttactattcacttcgatcatcgtgttgtaactcacaacgtccgggtttattccattgctcttcatgtggtcaaacagttgtgtggcttcatctaaccgggttgctttccccagagcgttgatcaatgtgttgtacattacaatgtctagatatcctccttgctttgtgagtctgtcgagtaccgcgctggctaagtctgctcttcccatttttcctaatccttggattattacattgtatgttgctatgtctgctgcacaaaagttctcaaacatttggtcaagcactccacgggcggtttggaagtaaccctttttgacaaacgagctcatcatggagttgtaggtgtaactcgtgagatcggtaacacccattccattgaatatctcaaacaatttgcaggctaagctgagatcccctttggacagatatatagatagaaacgtgttcatcatgtctacgtcaaaagaatctggctttgcttcgaccctctgtcctcttgctaaaccaaacaagggcttaggttgatttctctggtgtgctaattggtccatatatggagatgatgaccaagggtcatcttccattggtgatacttcctcagcactagctccatcgtcttccgaacctaccatgctcataatatctaggaagcttcctttacttggaaacattggggtgtaatccttatctttgctctgtggacgttttagtgaagcttccactccagcgttccatctcagaacattaggcaccaagttaccttcccttatgtgcttcatcaacttctctttccaatcccacctaccttgtttatgaaatccgatcaagagtgaactaattgtgaccaaatccacagagaaacctctagtctccatctcctctaccaattttactgctccttctagcttcccttccctgcaaagctgcaacccaacaatgctaaacgtaatggcatcgacaaactgacccttcttcttcaagtcacagaacagagtaaacccagcctcagctcttccgttcctaaataacccgtcaattagaatgttgtatgtccagcaggaagctctaactccttcttgaaccatcttctcaaacaactgacaagcctcagtgacttttcttgccttgagtgtcccatctaaaagacaattatacacaatagtatcagggacaaacccgttatactgcatctcaccataaatcctcattgcatcatccatccggtaagatttacaacatccttgaatcagtatacgatatgtcgaattatcaggctcatggccagacaccttcagctcatcccatacaatcaaagcatctttagcttttccaaataaacacaacacatgaatcaggctgttatatgtgcatatatcaggaccaaaagaagacccatagaccgaacttcgctccttcatctccttgaacaaactcaatgcagcatccaagtctccccaacaaccaaatccatgaatacaaatgttataactccatgtatcaaacttgaatcttttcattccctttaacttttcaaatacccttttgaactccgacctcatatctgctctccttagaccaaccaagagctcattaacagcaacagttccaggaagataacttacaataataactctaccagtatcatcatcactatggttatcagaagcttctaaaagcttaaataatatagacagagcaagacgcaattcgtgtttcttcaccagagcaataagaacagaatcatatacactaggatttaagcaatctcctaattcctccatgtaatccaaaactcctaacgctgattcgaacttacccgaacggattagagaatctagaagtatcttcgccatcgtctggtccaagttaactccatcttccttcattgaaccaagcaaatcgggaacttctccgagaagccctgtccgacaaacagtgcgaaatatctgagagtaagctgtcgctgaatgtttgtatccaggacgaagagaataacaccatcggaagaaatctagcttcttcgatggatctatggagtttctacgaaggatctggagaaccacaggttccgaaatcggtatcgaattcgcgtcgaggcttcgtgtaccggactgagacaaggtcttggacaaagacgcgacgagaaggacattgcagagctgtggaaacggtgaattcttcgccggtgatagaccggaaattgcagctgatacggcgcttcctcttccatggcgcatcgcatagtgaccactgagaaacgaaattgatagctaacatacacggcgtcgtttaatatcgttataatgaaacgccatagtataatgtttcttcaaggcccagaattaagcccgttaatagactgatacggcgacggtttaacgaatattataaagatagataggcctatgcttaaagatgggcccaagcataggcccatttgtataggtttttcaattttgagtcgataaaccctaagttagtctccgtcgtcttcattctcagctttgccgttttcatcgattaaagagagagaggcttcgttcgccgtccgtcgtaaaaatg

SEQ ID NO: 29204 - DNA, 3000 bp, Unknown; identical to SEQ ID NO: 29203
  misc_feature (1)..( 3000): 2750-1469P.txt file - cDNA_ID_3000085; gDNA_ID_2926161; Annot_ID_198771

SEQ ID NO: 29205 - DNA, 3000 bp, Unknown; identical to SEQ ID NO: 8434
  misc_feature (1)..( 3000): 2750-1469P.txt file - cDNA_ID_3000102; gDNA_ID_1971801; Annot_ID_58091

SEQ ID NO: 29206 - DNA, 3000 bp, Unknown; identical to SEQ ID NO: 8434
  misc_feature (1)..( 3000): 2750-1469P.txt file - cDNA_ID_3000102; gDNA_ID_1971801; Annot_ID_175719

SEQ ID NO: 29207 - DNA, 3003 bp, Unknown; identical to SEQ ID NO: 27443
  misc_feature (1)..( 3003): 2750-1469P.txt file - cDNA_ID_3000117; gDNA_ID_1621182; Annot_ID_57400

SEQ ID NO: 29208 - DNA, 3000 bp, Unknown; identical to SEQ ID NO: 1977
  misc_feature (1)..( 3000): 2750-1469P.txt file - cDNA_ID_3000125; gDNA_ID_1620474; Annot_ID_158121

SEQ ID NO: 29209 - DNA, 3000 bp, Unknown; identical to SEQ ID NO: 7575
  misc_feature (1)..( 3000): 2750-1469P.txt file - cDNA_ID_3000132; gDNA_ID_1621153; Annot_ID_56918

SEQ ID NO: 29210 - DNA, 2308 bp, Unknown
  misc_feature (1)..( 2308): 2750-1469P.txt file - cDNA_ID_3011881; gDNA_ID_1620301; Annot_ID_152613
gatctttacatttgtacctttactagatgctctggttcctcaaaatatatggcttgtattgaaatttgattttgctgttgtttgttttggtttagcttgaagggatggggtttgatcgtgcgatggtcttggaagtgttctttgcgtgtaacaagaatgaagaacttgcagctaattaccttctagatcacatgcatgagtttgaagatcaataaacagagcaaatccattcctccctctaaactcagaccatctttctgtttctttttcttcttctttttaatatgataatctcttctccaatgccatttgacagtttcatgtttatgttcatgggagttgatgtgtttatgttactattaaaactatcatagtttatctggtttgaagatgctcctcttttatcatattattagcctttgaatccttcctctctttaggtctcagatgcaccaatattagctaagattaaaagtggatattttggttctatatgactcatctcgagttaggaatggtatgtcgaatctggtttaacagatctggcctaaaacgaaaccgctattcagatccaattattggcgcttacattgttttctcatagcctcaagctatgcaatatcaattattgcacatttgaattaacacaaacccatcaattaatatatcaacaaaaacccatcatcaattaacacatcaacacaaacataaagacatataagttgctcatgaagaacttataatggtggaaccagtgagcctttgagatctgtcataatcgtctctgaaattgtctcaaatcgagagagaaatgagaaatcttaaaattttaccctaaataattaaaccctagcttttaattattactgcacaaattatgtctaaataattttgcccatttactagcgagcttatatggtttgtaatccattttaaacactttaattttgggcttcaccaaaacccaaccattattatttggacgtggacatcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatg

SEQ ID NO: 29211 - DNA, 2994 bp, Unknown
  misc_feature (1)..( 2994): 2750-1469P.txt file - cDNA_ID_3011881; gDNA_ID_1620301; Annot_ID_152614
gatctttacatttgtacctttactagatgctctggttcctcaaaatatatggcttgtattgaaatttgattttgctgttgtttgttttggtttagcttgaagggatggggtttgatcgtgcgatggtcttggaagtgttctttgcgtgtaacaagaatgaagaacttgcagctaattaccttctagatcacatgcatgagtttgaagatcaataaacagagcaaatccattcctccctctaaactcagaccatctttctgtttctttttcttcttctttttaatatgataatctcttctccaatgccatttgacagtttcatgtttatgttcatgggagttgatgtgtttatgttactattaaaactatcatagtttatctggtttgaagatgctcctcttttatcatattattagcctttgaatccttcctctctttaggtctcagatgcaccaatattagctaagattaaaagtggatattttggttctatatgactcatctcgagttaggaatggtatgtcgaatctggtttaacagatctggcctaaaacgaaaccgctattcagatccaattattggcgcttacattgttttctcatagcctcaagctatgcaatatcaattattgcacatttgaattaacacaaacccatcaattaatatatcaacaaaaacccatcatcaattaacacatcaacacaaacataaagacatataagttgctcatgaagaacttataatggtggaaccagtgagcctttgagatctgtcataatcgtctctgaaattgtctcaaatcgagagagaaatgagaaatcttaaaattttaccctaaataattaaaccctagcttttaattattactgcacaaattatgtctaaataattttgcccatttactagcgagcttatatggtttgtaatccattttaaacactttaattttgggcttcaccaaaacccaaccattattatttggacgtggacatcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatggctacacacgtgtcagattcaatgcatcagtcatatcttcagcatccaacacttgtcaaccttccattggatctcttaactctacgcctcgaaaacagtttttatttatttatcattccatttctcattgtatcttcatcagtctcttcttattccattttttcaaaccacttgcaaaattcgaatcagatcttctcttcaatcgaaaaaaaagaaaggtaaatctctctctctctaatcatcgttcgtttcgtagtttcttcttctacgtgtagatctgatctttgattgtatgtttctggagatctcgatctcatcgattctctgttcttatcactgattcagtgtgtttgatatctaaatccgatttgtgtgtaggatgttaaaatttaggtttcggttttgtttctgcttttgaacgattttgctctagattcgttatccgtgaagaacatagacgagtatgtagatcttacttcggattcgcgttgaagaattttctctagattcgtcacctatgaagaagattcattgtgttcttaatctagatgattaggttattgtttcgactcatttgtttatgcctattttctctatgttcttaatcggtgaagaaatgtatcaatgtgtgtatgttttgggttctgattttgtaggatttgctctagattgttgaatcgaagatg

SEQ ID NO: 29212 - DNA, 3003 bp, Unknown
  misc_feature (1)..( 3003): 2750-1469P.txt file - cDNA_ID_3011881; gDNA_ID_1620318; Annot_ID_153250
caaacgcaaatccattaaacctgttcccccaggtagggtttttaaactggtgaaccgatttcatttgctcgttttcccttgtgaatttgttttattgacatccactcttatctgtctctatccagggcatgcccgctgcagatgctggtgctggagctggtaatcttgatttcctgcgtaacagtcaacaggtattttcaatttcttttccattcgagaacggaaatcttcatttctctcctcttatgtcatttgcaattcttttgccttttcatagttccaagccttgcgagctatggtacaagcaaacccacaaattctacaggtaaaatttttaacctcttattctttatttggtaggttatatgatattgatttcccacttatactgtttcgttttgcagcctatgcttcaggagctcggtaaacaaaacccccagcttgtgcgactaattcaagagcaccaggctgacttcctacgcttgataaacgaacctgtcgagggagaagagtgggtttaatatcatgattctcctttacgttttcattttattcttttttctcaataaagcatgtaatctgacatttcattcgatgccaccaggaatgttatggaacagttggaagcagcaatgccacaagctgttaccgttacacctgaagagcgtgaagccattgaacgggtttgttcctatgatctttacatttgtacctttactagatgctctggttcctcaaaatatatggcttgtattgaaatttgattttgctgttgtttgttttggtttagcttgaagggatggggtttgatcgtgcgatggtcttggaagtgttctttgcgtgtaacaagaatgaagaacttgcagctaattaccttctagatcacatgcatgagtttgaagatcaataaacagagcaaatccattcctccctctaaactcagaccatctttctgtttctttttcttcttctttttaatatgataatctcttctccaatgccatttgacagtttcatgtttatgttcatgggagttgatgtgtttatgttactattaaaactatcatagtttatctggtttgaagatgctcctcttttatcatattattagcctttgaatccttcctctctttaggtctcagatgcaccaatattagctaagattaaaagtggatattttggttctatatgactcatctcgagttaggaatggtatgtcgaatctggtttaacagatctggcctaaaacgaaaccgctattcagatccaattattggcgcttacattgttttctcatagcctcaagctatgcaatatcaattattgcacatttgaattaacacaaacccatcaattaatatatcaacaaaaacccatcatcaattaacacatcaacacaaacataaagacatataagttgctcatgaagaacttataatggtggaaccagtgagcctttgagatctgtcataatcgtctctgaaattgtctcaaatcgagagagaaatgagaaatcttaaaattttaccctaaataattaaaccctagcttttaattattactgcacaaattatgtctaaataattttgcccatttactagcgagcttatatggtttgtaatccattttaaacactttaattttgggcttcaccaaaacccaaccattattatttggacgtggacatcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatg

SEQ ID NO: 29213 - DNA, 3003 bp, Unknown
  misc_feature (1)..( 3003): 2750-1469P.txt file - cDNA_ID_3011881; gDNA_ID_1620318; Annot_ID_153251
tgttcctatgatctttacatttgtacctttactagatgctctggttcctcaaaatatatggcttgtattgaaatttgattttgctgttgtttgttttggtttagcttgaagggatggggtttgatcgtgcgatggtcttggaagtgttctttgcgtgtaacaagaatgaagaacttgcagctaattaccttctagatcacatgcatgagtttgaagatcaataaacagagcaaatccattcctccctctaaactcagaccatctttctgtttctttttcttcttctttttaatatgataatctcttctccaatgccatttgacagtttcatgtttatgttcatgggagttgatgtgtttatgttactattaaaactatcatagtttatctggtttgaagatgctcctcttttatcatattattagcctttgaatccttcctctctttaggtctcagatgcaccaatattagctaagattaaaagtggatattttggttctatatgactcatctcgagttaggaatggtatgtcgaatctggtttaacagatctggcctaaaacgaaaccgctattcagatccaattattggcgcttacattgttttctcatagcctcaagctatgcaatatcaattattgcacatttgaattaacacaaacccatcaattaatatatcaacaaaaacccatcatcaattaacacatcaacacaaacataaagacatataagttgctcatgaagaacttataatggtggaaccagtgagcctttgagatctgtcataatcgtctctgaaattgtctcaaatcgagagagaaatgagaaatcttaaaattttaccctaaataattaaaccctagcttttaattattactgcacaaattatgtctaaataattttgcccatttactagcgagcttatatggtttgtaatccattttaaacactttaattttgggcttcaccaaaacccaaccattattatttggacgtggacatcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatggctacacacgtgtcagattcaatgcatcagtcatatcttcagcatccaacacttgtcaaccttccattggatctcttaactctacgcctcgaaaacagtttttatttatttatcattccatttctcattgtatcttcatcagtctcttcttattccattttttcaaaccacttgcaaaattcgaatcagatcttctcttcaatcgaaaaaaaagaaaggtaaatctctctctctctaatcatcgttcgtttcgtagtttcttcttctacgtgtagatctgatctttgattgtatgtttctggagatctcgatctcatcgattctctgttcttatcactgattcagtgtgtttgatatctaaatccgatttgtgtgtaggatgttaaaatttaggtttcggttttgtttctgcttttgaacgattttgctctagattcgttatccgtgaagaacatagacgagtatgtagatcttacttcggattcgcgttgaagaattttctctagattcgtcacctatgaagaagattcattgtgttcttaatctagatgattaggttattgtttcgactcatttgtttatgcctattttctctatgttcttaatcggtgaagaaatgtatcaatgtgtgtatgttttgggttctgattttgtaggatttgctctagattgttgaatcgaagatg

SEQ ID NO: 29214 - DNA, 3003 bp, Unknown
  misc_feature (1)..( 3003): 2750-1469P.txt file - cDNA_ID_3011889; gDNA_ID_1620337; Annot_ID_153837
tatgagtagaagaacactagaagtgcattggggaaaacaccatcgaggttatgtagataatctgaataaacagttagggaaagatgatagactctatggatacaccatggaagagcttatcaaggctacatacaacaacgggaatcctttacccgagttcaacaacgctgcacaggtactttatattctaagtaacttgtacattatcacccgaggcacacactaatgttggaaggattgatgatgattatgttgttgtttaggtctataaccatgatttcttctgggagtcgatgcaacctggtggtggagacacgcctcaaaagggtgttcttgagcagattgataaggattttggttctttcacaaattttagagaaaagttcactaatgcagctcttactcagtttggttctggatgggtctggcttgtctgtgagaaacttgactagcttttcacttggtattaaactgtagaatgactttgaaaatggaaaattttgattctctttttgtttttttctggaaaatttcagtaaagagggaagagagaaggcttgaggtggtcaaaacctcaaacgccattaacccactcgtgtgggacgatattgtatgttagagttttattagttagttttcttgttgaacttaatgttacctcttgatcacatctcttttgttgttacagccaatcatctgcgtggatgtgtgggaggtacaccatctcctctcttctgtcattcttccaagaaacactttgaaacattttctaatatctttcgttttcttatcttactttgcagcactcttattatctggactacaaggtaaaaacctagcttaaattccgaccattctgtgttctttttgttcgttcaaaaggctaaatcagtgtttgtttctttctttctccggttgctagaacgacagggctaagtatataaacacatttctgaaccacttggtgtcgtggaacgctgccatgagtcggatggcccgtgcagaagcgtttgtgaatcttggtgaacccaacatcccaatcgcttaagctaaacacaactccttggaaacttgggcagtctcatttttgcaaacagaggtctcaagtcccaagtcccaaccaacaaaacaagagttgctttctgaatgtgacccatctttttgttctgtgtaatttagcgacagttttctcttcttttgccttttgagagactctctagctttaagatcatcagtgagccctgtatggtgacagtaatgttagtgacgcaattaacccttattaagttataataaaacgaaggctggctcacgtgacccgcacgtgactgagagtatccgtttcctcttctttcttttcttcttcttcttcttcttcttcgtctcctgacaatagggattgacaccatcgttcacttcaacgtaaaggtataaactttcttcctccttaacgtcaaagtttcacgcgatcgtctctgtggaactccctcagcatcgggtaattccctgattttcccaactcgctctcgcggaaactctcgatttcgattgggctcttgaggttctgttcatttcctcgtctatgaattttctacaattgattaggagtcgtgcccataactgcgtgagtaaaaagggaaaattttcttaaagataagcaatttcaagctttgtgttcgtgaaatttatccttgtatgaaacttgcaatgcgattgttgtgttggttggtgggttttctgtaaaatctcaatgttcatgtaggacctgggttttggcagattcagtgccataaagactgtagtgttagtcctcatattacatttgtatggttgctaaatggtcaaactgatactagtataactcagagattacaagatttatttggatcaagatcatatgtttccttgatgccaaaactaattcattgttaagattcataaaatcgagtatatagcgagttaacgtttacttgaatttcctcgttctttatcctttgtaggaggttatgcagttcttggatcccctgagatttgttgtcaaaaaccagcttccattactgatacactatgcctccgtctcattctcaggtctgttgtagttcttgaaacaaattatcataagctttgatcaaacaggaaagaaaacctcttataatctttcttgattgataaaaatgacagagatcttcagtgacaccagcatcagacagttatctcaaatgctactatcactaatcttcttccacatatccgaatacattctagccatcaccattcacggagcatcaaacgtaactcttagttcgcttttaatcaccaagcattacgctttagcaatgcttctgtcgcttctcgaatacctaacggagattatcctcttcccggggctgaaacaacactggtgggtcagcaactttggactcataatgatcatcgttggggaaatcatcaggaaggcagcgataataacagcgggaagatcgttcactcacctcataaagatcaactacgaagagcatcacgggcttgtgactcatggtgtgtatagactaatgaggcatccaagttactgcggttttctcatctggtcggtcgggacacaagttatgctctgtaaccccgtttcagcagttgcgttcgcggttgtcgtgtggcggttttttgctcagagaataccgtacgaggagtattttctgaatcagttttttggggtacagtatctagagtatgcagagagtgttgcctctggtgttccatttgtgaactgacacttgaattatttttgaacatatgagtttgatgtacttgacttgaggtcttaaagtcacaaaaacatacaagaccctctggctgaaagagaaggtcttgacgtggatatgaaatttaccacagcgttaattgtttatgtgacacctgtcaccggtgatgcatagctccggcgaagagtttcggagaacaagtttggtctttttaggggtttgagcagtggagtcggtaaccatg

SEQ ID NO: 29215 - DNA, 3000 bp, Unknown
  misc_feature (1)..( 3000): 2750-1469P.txt file - cDNA_ID_3011897; gDNA_ID_2926143; Annot_ID_197591
ttctatagttgtttatgtatttataaaaaaataaataattgtatttacttaactttgtttacccacataaaagactttcgtgctatggaaaagggttaagactatttacgaacgagaagagatttattagtttatacgaacggaaagagattcacctgtattaacgtacgaaaatgaggatttagttgaactcttacaggaaaagagaataaaacagttttaacgaacagaaaagaagtttatatatattttttctgttatattaggttttccttatttgtgtacaagttaaatttttggaacaaagacaatgatcaaagttcataactgtatttttttttctattataaattcagaattagaataattgcaagaaaacttattacttctaaagttgtttctatatatataaaagaaaaaaaaaagaaaaaaataattgtatttatctgactatgtttacctacgtaaaagactttcgtgccacggaaaaggtttaagactatttacgaacgagaagagatttactagtttacatgaacgaaaagagatttacctgtattaacgtacgaaaatgaggatttagttgaattttcgcgggaaaagagagttaacggttttaacgaacagaaaatgagttacttgtaaaaaatacttagcatatgtttaagtgaaatttctagttaactatgagaaactgtttcacgccctttggaatatatatggcaacttgatcaatgtatatgaccaattttagctaagttatcaattttcttacttttttacacatatcatataagttacttgtaaagtacactattttttgatatgatcaattttaaaaagaaaaatattattatttaagtaagatatctaaatattaattttaatatcttttgataaataatttactataattagttaatagacattagtgatcataaatatattaccagattatgtaatacaattattaataagtatttttaccaaatattaattgaattttagcctaaatagttaatcaacattaatatttcattaacatggtaccaaattgcctaattataatgtcaatgtgtctgaattttaaatatattaccaaattatacattaaaatattaatattttgttatagtatttatttgaataaagaaatttagtattttcttcctataaaaggatgactaggagacaaatttttagatttttaaaataaaaggctgactcttccagaactaaatatagatatattatttattaattaaaggttactaaagtgaagtctaagtgatttggtttaagaatttttgtttagaatttacaattttcagtttagttttagataattttgttaattggatattgacattttgtttgtagccagaagttgttgtttttaaaagaaaagctttatttttgctacccaataatgatgagaagagattacataaacaaattaaaatcaatacatgatacgaactaatctagctaaacgatttactcaataacttcacccaattcgtttcgaaatctaagcaatatatccctcaaaaaatcataactaacataaccaacataagtgtttccaattttgagcgaatgagaacaaacttcttccctgacacttaactcttcgtaagatgattaaaataatatatgattattgcttcttcacacacacgatctctaaagcaatttacccattaaatctttatatctatatataaaaataagtttgatacattactatgctctttgatgggcaaaagtaaaaaaaaattgctttgattttgtagacgagttttgggcatgcaatttttatttacatcttttcaacaaaaacaattaaacaaaacaaaattttgcttagacattgtccatgttaaagttcaaaaattgtacgaaaagtaagcggtagaaaattttgctctatttaggtttatcgaagtaatctttctatttgttatatgttgtataatttatagtaatatgtttatttagttacaatcttttcgtaggttaactatattacttctaacttttgtatgtttaacagattttttatttacctctatcaaaaccctgcaaaacacacaatcaaactcgcaatactctactacatcgattaactaatccacgacacttattttcttttgtacttaaaagttaaaaatatattaacacgtcctatagtaaagcggtgtatgcctcgtccacggattctaaagtttacacatgttttaagtttaacaccttaaaaccatctaaactctactttttaaaagggttttatgcaaaaaaatcctcaaactcgtctatttttacaactttattcttcagatccaaaaaatgcaaaatatcatatgaatttcaaaataatacacaatatagatttttcgttactatcaaattttaaaattttgataaataatatattaaatcggaacctcgagatgaagagttcaagtatatctttaaaagttttaaaaacaaatgtatgtaatcgtgaaaacatttacaatatatataaaattgcaaaataggctattttagatttcataagattattttgtattttttaaaacaacaaactcaagtctacataattaatatattcaactcaaaactccaaactgaaagcttaagaagcccaacaattgtaagcccaattaaaaagcccagtaagtgaacgcgtaaacaaaaaaagtaaagactctcatggaacaatcaaaaacgccgaaacaatgcttcgtctccgattattccacgaaacaccgcgtttttgtttacatttcttctctttctctctctctcttctctcatatctctctcttcgccgtcaggttttgcccaaatttctcggtcttcttcactcccgcgagttttttttctcgggaaaattttccaattccaagctccattgaagccaagtaagaggtgcgattctcttcaattttgacttggaacttgtaaatagcgtatggatttgagctggttatg

SEQ ID NO: 29216 - DNA, 3003 bp, Unknown
  misc_feature (1)..( 3003): 2750-1469P.txt file - cDNA_ID_3011897; gDNA_ID_1621164; Annot_ID_57181
tatttctatagttgtttatgtatttataaaaaaataaataattgtatttacttaactttgtttacccacataaaagactttcgtgctatggaaaagggttaagactatttacgaacgagaagagatttattagtttatacgaacggaaagagattcacctgtattaacgtacgaaaatgaggatttagttgaactcttacaggaaaagagaataaaacagttttaacgaacagaaaagaagtttatatatattttttctgttatattaggttttccttatttgtgtacaagttaaatttttggaacaaagacaatgatcaaagttcataactgtatttttttttctattataaattcagaattagaataattgcaagaaaacttattacttctaaagttgtttctatatatataaaagaaaaaaaaaagaaaaaaataattgtatttatctgactatgtttacctacgtaaaagactttcgtgccacggaaaaggtttaagactatttacgaacgagaagagatttactagtttacatgaacgaaaagagatttacctgtattaacgtacgaaaatgaggatttagttgaattttcgcgggaaaagagagttaacggttttaacgaacagaaaatgagttacttgtaaaaaatacttagcatatgtttaagtgaaatttctagttaactatgagaaactgtttcacgccctttggaatatatatggcaacttgatcaatgtatatgaccaattttagctaagttatcaattttcttacttttttacacatatcatataagttacttgtaaagtacactattttttgatatgatcaattttaaaaagaaaaatattattatttaagtaagatatctaaatattaattttaatatcttttgataaataatttactataattagttaatagacattagtgatcataaatatattaccagattatgtaatacaattattaataagtatttttaccaaatattaattgaattttagcctaaatagttaatcaacattaatatttcattaacatggtaccaaattgcctaattataatgtcaatgtgtctgaattttaaatatattaccaaattatacattaaaatattaatattttgttatagtatttatttgaataaagaaatttagtattttcttcctataaaaggatgactaggagacaaatttttagatttttaaaataaaaggctgactcttccagaactaaatatagatatattatttattaattaaaggttactaaagtgaagtctaagtgatttggtttaagaatttttgtttagaatttacaattttcagtttagttttagataattttgttaattggatattgacattttgtttgtagccagaagttgttgtttttaaaagaaaagctttatttttgctacccaataatgatgagaagagattacataaacaaattaaaatcaatacatgatacgaactaatctagctaaacgatttactcaataacttcacccaattcgtttcgaaatctaagcaatatatccctcaaaaaatcataactaacataaccaacataagtgtttccaattttgagcgaatgagaacaaacttcttccctgacacttaactcttcgtaagatgattaaaataatatatgattattgcttcttcacacacacgatctctaaagcaatttacccattaaatctttatatctatatataaaaataagtttgatacattactatgctctttgatgggcaaaagtaaaaaaaaattgctttgattttgtagacgagttttgggcatgcaatttttatttacatcttttcaacaaaaacaattaaacaaaacaaaattttgcttagacattgtccatgttaaagttcaaaaattgtacgaaaagtaagcggtagaaaattttgctctatttaggtttatcgaagtaatctttctatttgttatatgttgtataatttatagtaatatgtttatttagttacaatcttttcgtaggttaactatattacttctaacttttgtatgtttaacagattttttatttacctctatcaaaaccctgcaaaacacacaatcaaactcgcaatactctactacatcgattaactaatccacgacacttattttcttttgtacttaaaagttaaaaatatattaacacgtcctatagtaaagcggtgtatgcctcgtccacggattctaaagtttacacatgttttaagtttaacaccttaaaaccatctaaactctactttttaaaagggttttatgcaaaaaaatcctcaaactcgtctatttttacaactttattcttcagatccaaaaaatgcaaaatatcatatgaatttcaaaataatacacaatatagatttttcgttactatcaaattttaaaattttgataaataatatattaaatcggaacctcgagatgaagagttcaagtatatctttaaaagttttaaaaacaaatgtatgtaatcgtgaaaacatttacaatatatataaaattgcaaaataggctattttagatttcataagattattttgtattttttaaaacaacaaactcaagtctacataattaatatattcaactcaaaactccaaactgaaagcttaagaagcccaacaattgtaagcccaattaaaaagcccagtaagtgaacgcgtaaacaaaaaaagtaaagactctcatggaacaatcaaaaacgccgaaacaatgcttcgtctccgattattccacgaaacaccgcgtttttgtttacatttcttctctttctctctctctcttctctcatatctctctcttcgccgtcaggttttgcccaaatttctcggtcttcttcactcccgcgagttttttttctcgggaaaattttccaattccaagctccattgaagccaagtaagaggtgcgattctcttcaattttgacttggaacttgtaaatagcgtatggatttgagctggttatg

SEQ ID NO: 29217 - DNA, 3000 bp, Unknown; identical to SEQ ID NO: 29215
  misc_feature (1)..( 3000): 2750-1469P.txt file - cDNA_ID_3011897; gDNA_ID_2926143; Annot_ID_139033

SEQ ID NO: 29218 - DNA, 3003 bp, Unknown
  misc_feature (1)..( 3003): 2750-1469P.txt file - cDNA_ID_3011905; gDNA_ID_1620336; Annot_ID_153793
tatttcaaatgaagcattgtgcaaagtaatgaagcgaccagagattaagaaagaagatggaaaacatgatctgttactcaaaagttacaatgacagtaatgagaagaaagcagaagtagatacatgcatcaaaagttctcaagtttcaggtgttgagcataagaaagagatcaaagatgactcaattcttcttattgccgcagagagagtcccatgtcaagctccatcagaaaatgtaagcttactatttgttaacttcacatatataccatctgtatatgttagttctaatcggtgttggatgttcataagcagcatcatgggcgtatgttcacaaatgggatggatcaacaagctccaataccaaagtctgatggaaattcagatatattatccaagacagtatataaaggtaagaagcaaataatgaacttttggtttgtcttgttattaatctcattgcacatttttaaaaaatcactaataatcatttcgagcattatgtcaagattttgttttgataaaaatggaactaaaataagttacaattatttcagaaacaaaaggggagatagaagctggtttacccttgttggagaagcgacaagaacgccgaaaacgagaaacaacagagacattatccgaaaatgaaataaacctaaagaagatatttgtgaaaagccaattatttctagacacagcaaaggcacatttcaaactcaacattcctcaaaatgtctttcatgacaccaccagtgggagctattactatcaagaagacaagaatctaaccctcgagtgtgccttcgagctaatgaaacgaaaaaggagatttcaagagttaagtgtccatcctttcgtgaaggtacccataagttcctctaaaataaactcattggaccatcttattagacaaataagcaaagagttagagaagctgagagcctacggtagagactgccacattggatcacatgttgaagactacgtgttggaaagagatgttcactataaagacccatacttgaactcaatgtgggacatgggttggaatgattcgatgctcgcgttcatcgagaaagatgatgttatgagggatatagagagggaagtcttcagtggactcttggaagagataacaagagatcttatatgcatatagccgaaactcttctttctctccgatttaaaagtgagctcttgttttaggtgattagagtgtcttcaaacattaatccactccgttaatgttttgtctgataatggttttgcttttctttttattctactactcttttggattaactatcctgatatattgcatggttaataagaatggatgcgtatttgatgaaaaaacgtctactcattcatcataaacacaaaaagctaagtatctatttctcaaattctaacttcaaactatctaacttcttaattctattattatatacttttaaaactacctatttcactaaacttccacaacttattcttagcttttgtatgagttttatcctcagttttctatataggattttgaaaattcgttatttttattcgtgaagagaatgtacatactttgagatcaatctagctacaatagcacaaaaagataattgaacttgataatgtatatttgatggagaagttaacttgaagaggaccgatgaactttaatttcatcccaaaacaattaagtaacaaaagttatgttatagaaagaacattttggggttttaataacataaatttggggtttcacgaattaagaaccatgaatcggttaactcaaatacgataaacgactgctaccagtgaccagtcaacaatgttttggaagttacgttaatatacaaaatgattcaaacaatcgaaatttgaaatttgtggttcaaatgttaggccttttgtgcttttgttttttaataattttctcgtctttttgaggaaaaaaacaaacagtagtttaaacatgctttatcttttccttaggccacagcaaaagcgacttcttcttctttaatattattattctttttccatctttgtggtgtgtgttggaatgtctaattccttcctctcctcctccaccaccttcgatgcattgctccatttcttagtctagaaggaaaatctagttttcaaaaaagccctgaatttcttaaactagttaattacatgtttaatgctcttcattaagtgtgggaaaatccatttattataattctgtctcactttttcatgtaactaattaacgaaagatactttagggtttaattcccctttattgtctcttttaattgtcatgcaacacgtacttatacactgcaatgatgtagtattttgtatctttatctggtatatttgaaatttcaaatactcccttctaaacaaactattaaatgaatgtcagaaatatatatatatatatatatatatatatatatattttcaccaggtacgtttgaaatttgaaaatacacagctttaataaacaaactcttaaactgtatcagaaattgttgattataaaaaaaaaaaaaagaaaaaaaattcctagacatgaataatcaagagtttttttgttttcttcgttaacaatcaagagttctttgttatatatattgtttaaagtactcttgcgagcgctctttatggataatagatctagtagtcttcgtttactaattctctctcacaaatccaaacaaaaaggaactgtgtacttaaatcctgtaatgacaatttcatacatactaaacaagaactattaaatactaggataatacatacttgaagaaataacaactcttcatgtagtcgtgtctttttacaatttaaaatttgaaaaataaaagttacatttacctttacaacgtcggtcgttttccacacaatagattacccacttctactcgatagttttctctataatatagagacaaaagaagagagcatttaaattctaaagaacaaaaaaggaaaaacagagcagccatg

SEQ ID NO: 29219 - DNA, 1504 bp, Unknown; identical to SEQ ID NO: 190
  misc_feature (1)..( 1504): 2750-1469P.txt file - cDNA_ID_3012105; gDNA_ID_26053; Annot_ID_146543

SEQ ID NO: 29220 - DNA, 106 bp, Unknown; identical to SEQ ID NO: 264
  misc_feature (1)..( 106): 2750-1469P.txt file - cDNA_ID_3012143; gDNA_ID_94274; Annot_ID_147324

SEQ ID NO: 29221 - DNA, 379 bp, Unknown
  misc_feature (1)..( 379): 2750-1469P.txt file - cDNA_ID_3012233; gDNA_ID_93805; Annot_ID_147264
gcaaagttgtgttggaaaccaaataaagtaccatcatatattgcaggtttatcaacttgtgcaatgatccgcttgtagatcacgttagccccacggatagacatgctctgtttgctatagaacatcatcatctttagtatgaaacgacgaatccctacatagtctggttcatcaattctgagaggagagtctttaggcagagcaatgaacatggctttgaccaaaacatcttatccaagtttatctgtcaaacatagaacaaatccttttcatcaaagaagacacgattttccagaagcagttgactaaaagagcatgaatctaaatcacaaacatactaatgaaactccaacagaaaaaaagggatgaatcctaaatg

SEQ ID NO: 29222 - DNA, 603 bp, Unknown
  misc_feature (1)..( 603): 2750-1469P.txt file - cDNA_ID_3012251; gDNA_ID_99069; Annot_ID_147335
taggkttttttttttttttacttttcgaaaagccgatccagatttttgataattttgaagaagaagatgcaacaaaatcaagtgaagaaggttcgcttcttgctctctatctctctcaatcatgctttgattctaaatgtgggaaacagaggataaagtcttatccttttacaaatttaaagacaaaaaaaaataaaatctttcctttttcaattgcaattaggtttggttttgttgcatgagcataaataagatgtgtggataaagtttgtgttttgtctacttttgtgattcactagggcacgaaagagatggagtttttcacagagtatggtgatgcaaatcagatataggattctggaagttattggtaaaggaagctatggagttgtgtgtgcagctattgatacacatactggagagaaagttgctattaagaagattaatgatgtctttgaacatatttctgatgcgcttcgtattctccgtgaagtgaagcttcttcggcttttacggcatcctgatattgtggagatcaaaagcattatgctgcctccttctaagagagagtttaaagatatctatgttgtgtttgagctcatg

SEQ ID NO: 29223 - DNA, 450 bp, Unknown; identical to SEQ ID NO: 269
  misc_feature (1)..( 450): 2750-1469P.txt file - cDNA_ID_3012255; gDNA_ID_99073; Annot_ID_147340

SEQ ID NO: 29224 - DNA, 659 bp, Unknown; identical to SEQ ID NO: 271
  misc_feature (1)..( 659): 2750-1469P.txt file - cDNA_ID_3012301; gDNA_ID_99300; Annot_ID_147360

SEQ ID NO: 29225 - DNA, 1009 bp, Unknown
  misc_feature (1)..( 1009): 2750-1469P.txt file - cDNA_ID_3012309; gDNA_ID_78093; Annot_ID_147253
tcttggatttgtcagaacttggatcaagaacaactggtaagacttcaccatcagttcctgaggtgacttgattgatcaatatttccaaacgctctgcatcagtaacactggaaatagatttgaaagactcaactgcagaagtataattttggggtacattatcacaacttttcgctttatcctcctccttcacagcctgaacaacacacaacaacgcattggcacaaacaaaactaaaagatacaatcgaaacaaaacatagcttattgaaatgaggagagagacaaaccatctcaggaggcaagtccaaggatgtcaaatgaaccacattaccatccatatctacttcattaacaataaagtctgcgtatctacgaaacataaatacagaaaaaaagtttcaatttttctcctatatggaacaagaacgtttgtgtataagaagaagcataaaaacgtaaactgatctcacgacctttgtttgaggattccacggaagccagggagctgggagataaaacaggagatgcccacgtcagcttcatctactgttttcataccttcaaagtttgtagctatcgtcgctattttcgttgtccagctcaagctcgagtagggttttagcagagacggcaaacaagacaagacagttctacttaatttcattgccttcttcaccggaacggcgacgacattgaaatcgaatactcagtaaaacgcaccgtttcgttccccattgacctgacccggttattgatatttcaatcccaacaaaccgataaatatattctcaaccaaattgatataccaatgaatcagatgttttgttaaaacgcagcgtttcgttcgtcaatatgctctaagtttaaaccagatcggtgcgaatattaaaccgaaccggttcatgtcaatgtcttctttgtagaaagagactttcctgatcgaccttccactactaacagatccacaaatttcataaggttcagagcaaatcggagagagagagatg

SEQ ID NO: 29226 - DNA, 3003 bp, Unknown
  misc_feature (1)..( 3003): 2750-1469P.txt file - cDNA_ID_3012350; gDNA_ID_1620667; Annot_ID_48073
gaaaaataataaagacagagaggctaaaagagatgatgagttatataagaagtttgactaaataagtttgcagctttgactagcccaccttctcccaccgactgccaacccatccgtcaatatttctatcttcatttcctcacaaatatttattcaatctcttcattttcaaatatatagttttctagtactcgtagtatggtctaaagactttaaaactaaataaaatggtaggaagtaaatgcaaattacttgaatttgtaaactatattcatactttcgcaatgttagattagtctgaattcaaatgtgattaaatacgtttgtatatattacgttatcaaatataggttcaaattgtagggattgtccataactattgcgtatatatgttcaaaattatattatatgttgtatttgtataccatagacgttatgacatttgtaagttgtaatgtatcttaaattaatgttttgacaccggttttcaactattatggacgtctttaacgtaagaaaactgactttctgtgtgtttgaaaattagtctgctttacaaattaatctttgcttatataatttttaatgataataagattaaagaatttgataaaaaaaaaaatatatattaaaagtaatgtatattgtttttaccaaagataatctgaggttaaagttacaataataatcatatagaaacaagttcaatagcaaaattaacttagacatgcaatttaccgatttcttgacattagtcgaaaaacatttgaaactcggttatacaatgaggttatcgttcaggcctctggaaagaaaatcaattctataatacttcaataactttttagtaaaactaactggatcaactgatgaatcatatatcaaaaaaacaaaaaaaaaaactaacggaggtagacaatagtttagctggaatgcttgaagaaatggcaagaatatgcttcgagaagttatgatttatgaagaggttacctgcaaattttttcatttctttttgccgacggttggctgttagttaggaaaaagaatttttgttataggattttctcttccgtttcgtacaaacccaatcattattctcgtctttatacttaactttgcctctcattttcatgttatcaatcttttaaattaaatatatcgtcaatgactgttatgaataattagttcttcattctctgccttggttcgaacctcagtcacatggtgcacgttattgtgatttcccatacctcaagagttattcaagatcccttacagaaatatatttatataatcttttatctaatgtagttatttacaaacatgtattatctaccaaaataaaaagggctaaaagcttcttgagtgagaccgcttttggttcgattcattttcctacactccaatagtattacactattgtatataacaagaatcgtgggatttgtttaatccgtacaatgaaacaagaaagatatacaataacttaatatcatttttttttggggacaatcttaatatcatttctaatttctatagaaccaaaaacactcataacaacttaaactttgttttttgtgagaaaaataacaacttaattactagttactacattgacaatttaacatcttcagctaaaaccgaatgtatatgaacatttataatctagttgctattgtatatacgattggataatacgcatatcgacatttaaataattgagcctgaagataattcacaaatatgcaatgtaaatccgtccatacagccaaaagtatgtatgtcccatgcataattgaacaaaaagaaattatattaatattatttttgttgtcttctgcaaatgctaggactgctatcattatcatcattgattttaatattgatgtttccagaaaaataaataaacaaatataaagaaaaaaacaaacacaataagtaaagctacactattaggtaataattaaagctcatttttaagtctaaaattttaattataaaataaaaacattaaaaagttaagacccaaagaaacataaatgcttttttctttcatcaatgtcaaaaaagaagttttcccaccaaatggtcaaacttggatctttgacaatattgttccaatttcatcatgccctatcttttctatttatacacataccttagatataattattaaacccaaaatttgtgttaagaaaaaaaatagacccaaaatttgtgttaagaaaaaaaatagacccaaaatttggaatatatatataagtcaccgctggaaaaaaaattattgcaagtaatttcttatatgaaattggaatgataatattttgatcaagtatccattactaaaattttacaacgctagataacgagattgcttgaagtcgaacttgtgaacaaattataataatgtaaaactaacttgtattgactaatctttgattttttttacaataatgagtgatattacattcattttattaactaaatacaacgaatatgataaatattcagtcctcttataaactttatgatagtgaaaatttgagacattgacaattctagcattctaacattttatgagattacatgaaatgtcaatttagaccttaaaccaaacgaatacatgattcaaatttgaccgacaagtacatgatgccttccctttgatcacgaaatttccacaaagagtccgtgtctgcgtaattaaccagcaatttcaagggtgtttacgtaattgtagcttaacaaataaaaaacacgaaagaagatggcgaagaaaacggaaagtagtagatagataaagaaagagaaagagaagagctggattcacatggtcttgttctttctctctccttcttttctcatcttgcggcttccctttttctctctatcgccacaatgatcattaccaaccaaactgattgaaactcatttgttctctctctctcaaatccactctctctctttcttttctcttctcctctctgtgtctctatcgccatg

SEQ ID NO: 29227 - DNA, 3003 bp, Unknown; identical to SEQ ID NO: 29226
  misc_feature (1)..( 3003): 2750-1469P.txt file - cDNA_ID_3012350; gDNA_ID_1620667; Annot_ID_163987

SEQ ID NO: 29228 - DNA, 2081 bp, Unknown; identical to SEQ ID NO: 256
  misc_feature (1)..( 2081): 2750-1469P.txt file - cDNA_ID_3012350; gDNA_ID_77863; Annot_ID_147222

SEQ ID NO: 29229 - DNA, 3003 bp, Unknown; identical to SEQ ID NO: 29226
  misc_feature (1)..( 3003): 2750-1469P.txt file - cDNA_ID_3012350; gDNA_ID_2926171; Annot_ID_140118

SEQ ID NO: 29230 - DNA, 3003 bp, Unknown; identical to SEQ ID NO: 29226
  misc_feature (1)..( 3003): 2750-1469P.txt file - cDNA_ID_3012350; gDNA_ID_2926171; Annot_ID_199501

SEQ ID NO: 29231 - DNA, 6 bp, Unknown
  misc_feature (1)..( 6): 2750-1469P.txt file - cDNA_ID_3012366; gDNA_ID_77693; Annot_ID_147208
gagatg

SEQ ID NO: 29232 - DNA, 3003 bp, Unknown
  misc_feature (1)..( 3003): 2750-1469P.txt file - cDNA_ID_3012395; gDNA_ID_1620351; Annot_ID_154311
tttagctaataataatgaaattgtggaggtgattttttattttatttttctgaatagctataacaaatcaaagttacatgcgtgtgggaataaaagcaactttttctagactatctttatcaagacacagttatagagaaacaaacgaaccataaaggttataattagttaactacaaccaatcagaaaatgatgtttttaagtttcataaagattatatatcgtgttttcctttttccttttttgataatattatcgtgtccttttaatatacatagaattggattttgtcgtctaattgtgatatatattgaagctgtaaagtactgaacttttgatgatttaagctgtaaagagaagaacagtcgaatgattagcttgcttcacttgtgtcccgggccatataattagtttagcgtagttatattctggcttgtaggtaacgctatccttttggtatatcttgacaaataacatgaagaataataaatttgcaaaacaaaaaagatttcatcagtgtaacttactaataatagtggactttgaaatatgtaatgctaattatttatccattaaataataattccatttctattagactttgtcactttcatcaatatttacattctcttaatgtatgaagcatactgattcaaagtttaaacgaagagttcttccgtatctttagaatataaaacatcaaccagcatactgtaatgcgtttactaacgagttctattgaatatttttagaagtctgcttgttctaaaactctacatgttatttaaaattcttgaattgattaaagtaacgtgcgaaataatttaattgttagtgaaggatcaatcataagttctgagagcaaatcttaagttggacgattgtgtcacatgaacgactgaatgtcagtatatagatcctgaaattgaggtggtcaagttttttcatgtgtaattttgttttaaaattagttttgttttgtactgaagaaaatgttatttccatttgcacggaaaagtcgccgaaagtcagactttgattccatagtttccacttttaagattataaatataagttgtcaaagaatataactatatatgttctttaaaaaaaaagggaaaaagaaaataactatggggttgaatgataatatttgacccagacggactaatatgtttgcaaactggaccgtattatttttgcagttgataacaatttttatgaactgtttttttttttttcataataaaatttgtctgagaggaatataagttatataacgtataacggttggtaaatgattaaacgttggtttattttacaaacaaattgttacaacccttatccccattcgaatttttttaaaaacttgaacggtaatgactggcggtaaaggataatttgtttatgaagtaaaccaattatactttttaatacgaattacaatttggtgtactaagtttttttctttatgaaatcaaagcattacagatataattaaccaagaaaccaaaaatagttttgtctgtaaacggatttgtacatatggcctgctatcactattcaaagtttatggttcaatgttcttataaactaaaaaaatatattctgaccaagaataatgatccaagaaaatagttaaagtctataatttctagagataagtatttacggaataatcatgtttctacatatctagttaattattgtacattcatagagtggtgaaagattcttgaactagaaattcgatttgaaaaatacctcatccaaatacagaacaaacgaaagaatactaaacctaaagaaacttgatttggtcggtgttctttgcacctttttctttctttttatcttgtttttctttgtgtttttatttatttgttatgttctactattatgctaatgctttgttcttactttactttctttttttttctgcttactttggaaaaagtagttgaatgtgttggaaaaaggcatatgttctgttcctgcggttttcagttaatgactttataagaaaatagaaacagctactcaaaccttgtttttgaagcaagacattaacttcttttagggcttggtcaacatttgcaataagcaaatttaatcgaatcttttatctcgttgatcatatattgaacaatttggttagatgcaaacgtgaaagcgaagaggaatctcgcaacacatagtggttatactaatatatgtttatttgacgactatacttctttaggcttcacttcatgaaccttaaacaaaatgtaaatagtttacgaactgatcagggtttgccatattagtccattactgtggtatatgagacatttacacatatcgttggaaaaactgcaattaattttaatttcgatcaaactcccagttaaaaaaaaaaaaagtattattttcaatgtaaaactatcaatctatgtggcttttggaattataaacacgggaggtcaaatggtcaactgagccccataatatgaggtctaagtttcaaaagtaaaaccctttttaaatagcataaaattgcgtgaagaagttggcactctcgatgctgcttgctcgttaccaaattggagtttattaaagtaaagttttacaaattgtactactatctcctaatagatccataaaacaatttaaaaattactagtgtagtttagctaataaaaatcacttgcaatgcaagtgtttgattaaaaataatttaagtataattttttttcttttgcagaaatttcttctatatataatcatcccatctcctcataactcacaacaacattgaaacccatttcttcgcctttaaccttacttgaatttttgtgtgggtcctttttttttctttctccaagccattgtaagctccaatcttccacattctatctcttcttcctcattttcttccatacatacacacatatatatttctgttaccatttaagtgatcataaagttttcttgtgtaggaataaaaaggcagagaaaatg

SEQ ID NO: 29233 - DNA, 1716 bp, Unknown
  misc_feature (1)..( 1716): 2750-1469P.txt file - cDNA_ID_3012395; gDNA_ID_77477; Annot_ID_147181
ggtaaatgattaaacgttggtttattttacaaacaaattgttacaacccttatccccattcgattttttttaaaaacttgaacggtaatgactggcggtaaaggataatttgtttatgaagtaaaccaattgtactttttaatacgaattacaatttggtgtaataagtttttttctttatgaaaaaatcaaagcattacagatataattaaccaagaaaccaaaaatagttttgtctgtaaacggatttgtacatatggcctgctatcactattcaaagtttatggttcaatgttcttataaactaaaaaaatatattctgaccaagaataatgatccaagaaaatagttaaagtctataatttctagagataagtatttacggaataatcatgtttctacatatctagttaattgttgtacattcatagagtggtgaaagattcttgaactagaaattcgatttgaaaaatacctcatccaaatacagaacaaacgaaagaatactaaacctaaagaaacttgatttggtcggtgttctttgcacctttttctttctttttatcttgtttttctttgtgtttttatttatttgttatgttctactattatgctaatgctttgttcttactttacttatctttttttttctgcttactttggaaaaagtagttgaatgtgttggaaaaaggcatatgttctgttcctgcggttttcagttaatgactttataagaaaatagaaacagctactcaaaccttgtttttgaagcaagacattaacttcttttagggcttggtcaacatttgcaataagcaaatttaatcgaatcttttatctcgttgatcatatattgaacaatttggttagatgcaaacgtgaaagcgaagaggaatctcgcaacacatagtggttatactaatatatgtttatttgacgactatacttctttaggcttcacttcatgaaccttaaacaaaatgtaaatagtttacgaactgaacagggtttgccatattagtccattactgtggtatatgagacatttacacatatcgttggaaaaactgcaattaattttaatttcgatcaaactcccagttaaaaaaaaaaaaaagagtattattttcaatgtaaaactatcaatctatgtggcttttggaattataaacacgggaggtcaaatggtcaactgagccccataatatgaggtctaagtttcaaaagtaaaaccctttttaaatagcataaaattgcgtgaagaagttggcactctcgatgctgcttgctcgttaccaaattggagtttattaaggtaaagttttataaattgtactactatctcctaatagatccataaaacaatttaaaaactactagtgtagtttagctaataaaaatcacttgcaatgcaagtgtttgattaaaaataatttaagtataattttttttcttttgcagaaatttcttctatatataatcatcccatctcctcataactcacaacaacattgaaacccatttcttcgcctttaaccttacttgaatttttgtgtgggtcctttttttttctttctccaagccattgtaagctccaatcttccacattctatctcttcttcctcattttcttccatacatacacacatatatttctgttaccatttaagtgatcataaagttttcttgtgtaggaataaaaaggcagagaaaatg

SEQ ID NO: 29234 - DNA, 1617 bp, Unknown
  misc_feature (1)..( 1617): 2750-1469P.txt file - cDNA_ID_3012409; gDNA_ID_77263; Annot_ID_147169
aaatgcagayctttgagaagatataaaaaaagcgttttaatagagagatttttgcacatacagatttagattcgatcattagttatttgtttctaaattcctcaattcctagtaccaagagaatgacgattttctctagtaatactggcactcttcgtttttcaacatgtaaacattactttgtataattagtcttatatcaaataaatagttacaacatgaacgtaactatttatacacgagggtaaatttttaacaaatttaaaccgaaccaaaaagatttcagttaatcatagttttgttacaagcgaaatctgaaatattcaccctcaagtttgttacgtaattgtctaatctgtgtttttttgtgctagtgttataattgtttcctcgaatgttaagcaccacatagaagtatacacttttcttttattattttcgttcttcttccatttagaaacttttattaattctactgttaaatccaacgttattagtttattttctctgatgaagttctaattttttttgtttgttggaaaaagggttacttttctgatgaagttgccgatttgtttccaaccaaacctcagctaatatagttagggagacggataagaaattgcataaagggagaggctttgtaaacacgcaagtttacgtcaacttgacacatataaactcgtatataggaattgtgtaaaatgttaatcaatatatgtttatgaatatagtccttttatttccttaatctatagtcatgttatcatcatatcggcaagaaaattactattacaacatatgtttccgtgcttcgatttgtcgatcaggtaggcaaccaaaccgggccagattagtcacaaatgaaattaggctccactttggcaagttttttcacaattaaaaattagaaagtctaaccaaactaatagaaactgaaccaaacaaaaatgttcacgcaattacgtagcacttctctatgaaatactgtggataattcgatttgagctaatctatggtaagtcgtttctctcaaactgaattaagctaaaccaaaccgaaaataaaccgttgtagaacacccataataaacatatatatgttctctactcttatttggctatttttccatttgcagatacgtgtgacaacattccaaatataggcacatgatacaaattacaaagccagaaattaaaatttataaactatacataataaggtcagtagcctaattacatccatatatttagttgggcataataaggatagcctaattttggtgcatcccgccaaaaattcggacaaatggtgaatttcaaaccatgaatttctttgttatacatacattacgtgcactattacatcaaagaaaaatagtgacgtgcataaacgtattttcttcacataatctatataaaatatatacagccatgtacatttttcaacatagaaaaatcatgtatacaaatacggtaggtgcaatactgataaactgccattccccattgcattagacgctagtcaatccaaaccttataacataaaaagttatagtccatttctttcatatccaatcgagtcaaaataatattcgagcaaaaaacaaaagaaatg

SEQ ID NO: 29235 - DNA, 270 bp, Unknown; identical to SEQ ID NO: 245
  misc_feature (1)..( 270): 2750-1469P.txt file - cDNA_ID_3012455; gDNA_ID_76786; Annot_ID_147108

SEQ ID NO: 29236 - DNA, 965 bp, Unknown; identical to SEQ ID NO: 244
  misc_feature (1)..( 965): 2750-1469P.txt file - cDNA_ID_3012465; gDNA_ID_76771; Annot_ID_147088

SEQ ID NO: 29237 - DNA, 171 bp, Unknown; identical to SEQ ID NO: 241
  misc_feature (1)..( 171): 2750-1469P.txt file - cDNA_ID_3012505; gDNA_ID_76477; Annot_ID_147061

SEQ ID NO: 29238 - DNA, 3 bp, Unknown
  misc_feature (1)..( 3): 2750-1469P.txt file - cDNA_ID_3012592; gDNA_ID_75769; Annot_ID_146987
atc

SEQ ID NO: 29239 - DNA, 70 bp, Unknown
  misc_feature (1)..( 70): 2750-1469P.txt file - cDNA_ID_3012595; gDNA_ID_76057; Annot_ID_147019
tttttttttttaatctttgctttgtgtaggtggatcttgagaaattgattttagttcaaagcttctgatg

SEQ ID NO: 29240 - DNA, 848 bp, Unknown; identical to SEQ ID NO: 239
  misc_feature (1)..( 848): 2750-1469P.txt file - cDNA_ID_3012624; gDNA_ID_76074; Annot_ID_147033
  misc_feature (1)..(1): n is a, c, g, or t

SEQ ID NO: 29241 - DNA, 4 bp, Unknown
  misc_feature (1)..( 4): 2750-1469P.txt file - cDNA_ID_3012641; gDNA_ID_31582; Annot_ID_146937
gatg

SEQ ID NO: 29242 - DNA, 3 bp, Unknown
  misc_feature (1)..( 3): 2750-1469P.txt file - cDNA_ID_3012788; gDNA_ID_30094; Annot_ID_146800
ttt

SEQ ID NO: 29243 - DNA, 882 bp, Unknown; identical to SEQ ID NO: 209
  misc_feature (1)..( 882): 2750-1469P.txt file - cDNA_ID_3012824; gDNA_ID_29585; Annot_ID_146745

SEQ ID NO: 29244 - DNA, 1449 bp, Unknown; identical to SEQ ID NO: 213
  misc_feature (1)..( 1449): 2750-1469P.txt file - cDNA_ID_3012846; gDNA_ID_29783; Annot_ID_146771

SEQ ID NO: 29245 - DNA, 996 bp, Unknown
  misc_feature (1)..( 996): 2750-1469P.txt file - cDNA_ID_3012892; gDNA_ID_28580; Annot_ID_146691
catgttaatggtgtttgatgataatgaggatggttgtagtgttgtgttattgtgtgtatgtaagaattgtagactgtatatttgacggtttgggtttacaagtctaattctagggtatagcgtttaccattgacgtcgttcgttatccctcgccgtcaaagccgtgaaccaccaccaaatctttgtgctaccgtcaaagcttcacgtctaccgtcgaagctgcaaatccactatctaagccatatatctctgaatgtcaaaagaaacttaaaattgaatcagagatggggatgcattttttagaagataaacgcattcttttcacctcattctcaactccagctcatagtttaagggcaaaaatgtccgtaacaatgaaaattggagttattatatgcttttactgttgttgttttttacggcaaaataaggtcatccatttaagctaaaaacgggtcggttttcttcgagagaaaactagttcggagtagaagaacttacatgggaaaaaatagaacctcgtgctcttgccttcttatcaagacaatcagcacggacattgtttagagtgtctgttttgaaagaaatgttttcaaaatgcttgtttagaatataagctctatatagtatacctacacatgttatcgtgggtccaaatagaagagaaaaactatatttaaaaaathaaaattatatgagatatttattttcaatgaaaaggagaaaaataaaaaataaagaaggaaaaaatataaagtttcctttccctctcgttcgttggctttgccttcccgagagagaaagataagatttggttttgcattcctcttctctctcgccgctctcaatatgcttcgatttctattctcctcttcctcttgattttgtcttcttctctttgctgcggagagattaaggaacccaagggttttaagcaagagacgcggcgaggaagctatccagaactctctgaaacatccattcctttttctcatg

SEQ ID NO: 29246 - DNA, 3000 bp, Unknown; identical to SEQ ID NO: 3184
  misc_feature (1)..( 3000): 2750-1469P.txt file - cDNA_ID_3012928; gDNA_ID_1620630; Annot_ID_47232

SEQ ID NO: 29247 - DNA, 3000 bp, Unknown; identical to SEQ ID NO: 3184
  misc_feature (1)..( 3000): 2750-1469P.txt file - cDNA_ID_3012928; gDNA_ID_1620630; Annot_ID_162649

SEQ ID NO: 29248 - DNA, 3003 bp, Unknown
  misc_feature (1)..( 3003): 2750-1469P.txt file - cDNA_ID_3012928; gDNA_ID_2926193; Annot_ID_141154
aattccgacccatttgcaaatatcgatgttttcttcgatgaaagctcgaagactattgagttctccagttggatcataaggaagatcctacagaaacaaaagtccagaccgttaaacagaacacacaagacacaagcttcaactgtaaaaaaaaaaacacctcaccttctcccagtgacggtcaatcactatgaatcccactagagctgcttcgataatgattaaaagagttttgagaattgaatactaagacctatcaaggattaaacatcacaactgaatagtattaacagaaacatataggtgcagtctatatataaaaggatacgaaacacaagcaacatccattgatagcttcagctgcaatgaaaccaatgatagtgacaatgcagaccaaaatcccaatcgccatgaaacagtagataaacctacattgaatttgaaaccaaaccaaatcaattcattggaacattccttcaaacatcaaacagtgtcttagcttaacgctttgtcctttttcaacaagattagtcaaactaggcatagatttgaatcgaaaaccataaaaatggaaactttttcaataccatggagcaggaagatctaaagaacggagattgaaacccgaatctccaccaccagacccgagaacgatacccgatacgaaatcgatcggattcttcaaagaatcagaaacactgttgatctcaattattgaattagagaaggaataagaagaatccggtgatgaagctgccggaggctgagacggaggagggtcaacgggaacgtgatgattgtattgatcgagcatccaaatcgagtagattatgattgatataccgatgaaagcttggagaaaattaaggatcttgagaatcgaagcgaacgagacatggcaacaattgtgtcgcattttttctatcacgattcttgatatcgaaatcaaacttctgagcagcgatcgccgaaggaagagtctttgatgatttcggacaaaacagaaaaatgttgttttgacagataggatatattccgaagcttactaattaatcattaacgaaaatttattaattaacgaaaattttcattatcattaatgtaatagttcaaaattttgatatagttgatgaggccaaacaaactaaatgggctagaattcgaataaatgggcttagggtcaggaaagctcattgtgaagagacttcccgcttcagaagttcaagttcaagtgatggggggactcaggttagagatatttgagacttgaagtgatgcaaaaggtacagctcatgatgattgtattgtgatgatgataatggtatgaatatgatgatgagaattaagtatgcatgtgaatgttagatgactgaaaaagatagacaaccacttatataactaaccaacaacattttaggctttcctctttctctctctctgtttttatttattgatttttgggtacactaatgtttaaatctgtctctttaattggacggcctagcattcttagatctctcgatactgttttaccaataaaaccatattcagaggtgtcattttgtcatgtgtatttgttgtttttccccatgtatcacgtaaatgaatggtacatttaggggtgattacttcaaactttcatttttttctgaacaaaatgaaaaccaaggaaatcatgagttcacacccggattaataggagtattttggaatcgaattgaaattgcagttgaatttgaactttggactatatccacaaaagtaaactaggtaccactaaaccattaaaattttgttgaatttgttggttttaggcaaatgtttgagttttatgatttcagtgcaacttttataaggacataaatatctatttaattagtccataactaaaagtagcaaagttgtaagatattacagattctaaaagtcattttgtaagacataaatatatcatacctttttaatatgctgaaacatgtcagaacaaaatttataagtatcaaaatggattatcaatctttaatttataaaattaactgaataaattggaactttattagactttcaattaagttgtccttttaaaaatattttcaattaaagatgattttttttttgtcaaacaaaatccatgcatgatggataatattaaatccaaaatcttttttttgattacccacgcctaatctaaaaattcctatatcccatatatatatgtgtgtatgttacataatatccatcagagaaatcaacataaaccaaaaagtgatggataacaaaacatctttgtggaagataaggaagatcttaacagagaaaagtgatggttggttggactttgataataacaacgatatcgagaatcatattttgagaagtttgggcgaatccataattagtagagtgaaaaaagactctataaagataaagatcgacgattatgatacagggagccagcacgaggtaaccttcgggtataatcatgaatctgatacatattacattggatcattatggagattgaaggagcttgctgctggagatgaaataggattgttttacgatcctatttcaaagaatttgtgtttctctgtgttgaaacaagcaaaatcctgcttgatcaaaaaatgaaataagcaaaaccctgatgatcacaacttgtttaattatggttaattatacagcatagtaattaataagatcttgtttgaaaggacatatataagaatatgtatcgacgataatcatttctatatattaataaatatacaagttttgacatttcacttttgttcctcttaaatatgacaccttgtttctcaccattagatcgaccgacgacataagtaataacatttattacatacaccaaaaaaacaagcaaatcattaatacaattttccattagtgtatataacaaacaagagactaatcttttctttaacatttcatagtattacaaaacaacgccaaaagtcaaaaggtttcgctttctagatcatg

SEQ ID NO: 29249 - DNA, 3003 bp, Unknown; identical to SEQ ID NO: 29248
  misc_feature (1)..( 3003): 2750-1469P.txt file - cDNA_ID_3012928; gDNA_ID_2926193; Annot_ID_201240

SEQ ID NO: 29250 - DNA, 643 bp, Unknown; identical to SEQ ID NO: 197
  misc_feature (1)..( 643): 2750-1469P.txt file - cDNA_ID_3012997; gDNA_ID_27003; Annot_ID_146592

SEQ ID NO: 29251 - DNA, 186 bp, Unknown
  misc_feature (1)..( 186): 2750-1469P.txt file - cDNA_ID_3013010; gDNA_ID_26975; Annot_ID_146574
aaatcaaattagtgatgttacttgaacagttcaaaaagaactgggattattatgcattcagtttataacttaaggggttattatgttattaacaagtttactttcgtttggattttggaattagacgcgaagctgtgaaatctagaagaagaagaagaagaagaagaagaagaagaagaagcaatg

SEQ ID NO: 29252 - DNA, 373 bp, Unknown; identical to SEQ ID NO: 193
  misc_feature (1)..( 373): 2750-1469P.txt file - cDNA_ID_3013024; gDNA_ID_26737; Annot_ID_146564
  misc_feature (238)..(238): n is a, c, g, or t

SEQ ID NO: 29253 - DNA, 1626 bp, Unknown; identical to SEQ ID NO: 186
  misc_feature (1)..( 1626): 2750-1469P.txt file - cDNA_ID_3013044; gDNA_ID_26036; Annot_ID_146529
  misc_feature (1)..(1): n is a, c, g, or t

SEQ ID NO: 29254 - DNA, 520 bp, Unknown; identical to SEQ ID NO: 172
  misc_feature (1)..( 520): 2750-1469P.txt file - cDNA_ID_3013051; gDNA_ID_23898; Annot_ID_146422

SEQ ID NO: 29255 - DNA, 209 bp, Unknown; identical to SEQ ID NO: 28
  misc_feature (1)..( 209): 2750-1469P.txt file - cDNA_ID_3013115; gDNA_ID_1087; Annot_ID_144787

SEQ ID NO: 29256 - DNA, 3000 bp, Unknown; identical to SEQ ID NO: 9332
  misc_feature (1)..( 3000): 2750-1469P.txt file - cDNA_ID_3013269; gDNA_ID_1972069; Annot_ID_178539

SEQ ID NO: 29257 - DNA, 225 bp, Unknown
  misc_feature (1)..( 225): 2750-1469P.txt file - cDNA_ID_3013273; gDNA_ID_3424; Annot_ID_146291
acaaaaatatactaatctaaagtttttcagtttgttcttttgaaaaagaaaagaattatcataagttgactcaccaactctttaccatggttaagtaacttgttttgaagtctctatatatacaaatcactaacgacacatcataacatactactctcttaagccctttcataaccttgtaaaccattaagaggctttgctcaattacaagaagaagaaaaaatg

SEQ ID NO: 29258 - DNA, 3000 bp, Unknown
  misc_feature (1)..( 3000): 2750-1469P.txt file - cDNA_ID_3013289; gDNA_ID_1974091; Annot_ID_180599
taggtggggctgcccttgatgtgtttgagcaggagcctcacgtgcccgaggagctctttggccttgagaatgtagttctcctccctcacgttgggagtggcactgtggaaacacggaatgccatggccgatcttgtcgtgggtaacttggaagcgcacttttctgggaaatcacttctgactccggtcgtctgagtcatgtgacacatttgggatttggtttcacttcatttgaaaggtttttatgttaacgaactcatgaaaagggtaatttctcttccaaaagaaagttgcactgtcgtatataaggaacggatttgaacactaggcgaatcctctccgttttatgtctcttactcatctttcttttcacaaagtattggtctagtatacgagtggcgcatacggcaatacgtcaagtcattaaccatcccagaccaaaaaacgtttacaaaactactcatagatgtcagtcaagtgaagcaatatctattttgttgagaatcagctgaacctaaaaaaacgtagagaagaggatgacataaaacaaaacccaaaactttaattagggctcctttcgggccttcttggtaggttgcacgttttcaaaacactcatctttgcctttttcctttttgtgaccttctttcctgatgcacattaacaaagaatcttggagttaggttggtaaacaaccaatgaagtaccagcaaggagaacaaatgagtggtggtacaagccaaatcccaagtatgttccctacaatgaagaataaacaaggtttggtttgatgtcataccctccttccagctcagctgatgatagtcttttccacaactctctctccatctcccctgaaggccattagtacactagtcattttcaacgtttctatgattaactccatttctttggtataactaacaccatggaattgccaccttaccattaattgcttctaaggctactgagaagttattcttcacaactaaacctccaacaaactccacagctgcacgggctttcattgctgtttctgaatctgtgaaccaaacgtaacccgaatccaatccaccagagtattctatgtgctgcagtaagcacaggaaaagatgataactcaacaatcactttttaagggattggtggtttgacaaaaagtgttgcaacttacttcaacgctgccaaatctttgaaaaagatccttgagaacctcagagctgacagaattactgttgttccatgggggaaccacaagttgatcagtgttgtccttgcacaagctagcacatgagttatctccattttccttctctctatcagcaatgcctgtctccttatcttccttctctttaattttatttttcagagcgctgggtttttctgcaacccagagaagttgcttaaagagcagttcatactttttcagagattaacagtcctgagaaaagagaaaatacctttgtttgttactttttcttcactggctatccatttcaatgcaaatttgacaatttgtcctctgcggaatctgtagcaatataaatatgagcagtagaaatgagcaaagttgcatttcaatcaagaagcgttttgataagacaaaaaaacaagaaacggactcgttgtgggactctgattttccgagttgcttgatcatattctctctttgacagtcaaaatcactcctgcatatcaaacaggaatagtcaggtcatgccaatccgctatatatatatatatatatatatatatatatatatatatatcaaaacacaaagcatcccccactcccacttacttactttggtattaatactaagtcagcgcctgcatagaccaagctctgcctcaaaatatcttgagtgtcttgttcagaggagaattcaaccaacgcagtgccacaaaagcgtcgcttatcagcgatgttgggaggtagtctcacactgttcacctgaacaagtaaaatcagatgagcaaattcaaaaagctcgtttggacagtcatttgagaagaagaaccttggcatattgggagaagaaagatgagacatcctccatcttaatgctgtactcaaaaggtgaagccgcaagggttcttctgtggacttgttcaagcacctcttccggtttggagagtttagttcctctaccgatcctttgtcctggatcaacaaggttaaagtatatatctcacaccagaagaattgacaaacaaaccaaagggagggaaagcacaagtaccattattggaaactttaagaaaatcagaggtgcgcaagagattagcaacttcctccacaatcctcggagggatgtcttctctattgatgttaccgaggccaaggaggttcctcatacgagagaaggaacaaaccagaggcaaactaaccactagtttcgggcatctaaggaataacttttcaactatatctgtatgctacaacaatatatatgtatacaggatacggccatctttgctcttggtgacttccctgttgagaaatccgtctgtgggtagattactgtcactgaagtagaactcaaccttcaaccatcagcaaaagaagctacgaaaatgaaatcggggaaattagagatgagagtgaaggaagcatagataaattacagacctgggtaagcaacttcttggcggtttcttcgttgaaggaggaggccatggctctctagctgcaattgaagaagagacgacgagagtgaagaagagacgagagagagagaggggaattgaaggggttggatctcatacattaataggcccattaacagtgctggcttgacctctgtcacataggcccatctattaattgggcttaacttttatttctatcgtttgagcttagtggttgggctattcaatgtcccctatagaatagagtattcttacgtccaaacaggctcgtcttcttcgaaatcggcggcaaaatgccatcaaaccctccaaaccggaactgatttcccttactgtgacgacctcaatg

SEQ ID NO: 29259 - DNA, 531 bp, Unknown
  misc_feature (1)..( 531): 2750-1469P.txt file - cDNA_ID_3013289; gDNA_ID_3401; Annot_ID_146276
  misc_feature (1)..(1): n is a, c, g, or t
ncatctttgctcttggtgacttccctgttgagaaatccgtctgtgggtagattactgtcactgaagtagaactcaaccttcaaccatcagcaaaagaagctacgaaaatgaaatcggggaaattagagatgagagtgaaggaagcatagataaattacagacctgggtaagcaacttcttggcggtttcttcgttgaaggaggaggccatggctctctagctgcaattgaagaagagacgacgagagtgaagaagagacgagagagagagaggggaattgaaggggttggatctcatacattaataggcccattaacagtgctggcttgacctctgtcacataggcccatctattaattgggcttaacttttatttctatcgtttgagcttagtggttgggctattcaatgtcccctatagaatagagtattcttacgtccaaacaggctcgtcttcttcgaaatcggcggcaaaatgccatcaaaccctccaaaccggaactgatttcccttactgtgacgacctcaatg

SEQ ID NO: 29260 - DNA, 3000 bp, Unknown; identical to SEQ ID NO: 7203
  misc_feature (1)..( 3000): 2750-1469P.txt file - cDNA_ID_3013398; gDNA_ID_1621133; Annot_ID_56490

SEQ ID NO: 29261 - DNA, 3000 bp, Unknown; identical to SEQ ID NO: 7203
  misc_feature (1)..( 3000): 2750-1469P.txt file - cDNA_ID_3013398; gDNA_ID_1621133; Annot_ID_172541

SEQ ID NO: 29262 - DNA, 1359 bp, Unknown; identical to SEQ ID NO: 108
  misc_feature (1)..( 1359): 2750-1469P.txt file - cDNA_ID_3013398; gDNA_ID_2695; Annot_ID_145867

SEQ ID NO: 29263 - DNA, 2912 bp, Unknown
  misc_feature (1)..( 2912): 2750-1469P.txt file - cDNA_ID_3013405; gDNA_ID_2598; Annot_ID_145808
  misc_feature (26)..(26): n is a, c, g, or t
gcagcatcaagaacgtagacgtcgtngtcacactcaacctctagctcaccttctggtgtgatgaacttgaccttgtatgtagccatggctgtgacacgtccaccacgagcggtgcctgatttgagaccgaagagggattgtgtgttggctgatggaagggaacggagactgattggagctggggaacgacggatgaatgaagttccgacgatggcgcttgagagagcagtggaagccatttttttttgttttgtgttttgggagataaagttgagatttttgaggattatggcttgtggaaatggcgtggagaaagattaaaaggtgagaactttttagtgagaatcctatctaccacgtggcgtctattctgtggatcgatggattatcgtctttgtgttttatgatttgtgtgtgtgtgattgtgtttgacacactttaagaacactatcttgttgaggtgagtattacgtggtcttacttgggacagctcacacttattcggaccttgtttgtatcgtctaaataactcttcgtttgttccactaaaatcataaaagatgtggactggttgtaacatcatatctaggccgggtttaacttccaaaccgtatcaacctgaccgaatcaaaccattttaacccaattactgtaaattactccattataattatataacgtaaataattgaaccttacatagaatgtataccaaatcaacaagtgaatacataatctccaccttcacaattcagtcaacttctaatggcctttcagtacatgaataaattgtggggagaagaggtcatacttgcttgaattgggtggaagtagttttctagtgaagaccagcctcttggcataacgtcggaaagtagaaaaatcctcagaaacttaaacacaatcaacagagtagagtatgagaccatctacatcggttgattctcaaaaaagagtttctcatgaaaaaaatattgcttattttaattgaatttagataaagtattaaattttaataaaaagaataaaatcaatcatttctggaaaaacacgtggccataaacgtttttcagagtttctgaaaacagagacgattctcacttctctcttcttttcaccactttgtattattttaataataaatatctcttttaaatactgttgatggaagtgtcctgataggtttaaaactttttagttatttttaataaaaagtgactaaattttttattttagttaaagaaaagtggttgagatctcttttaaaaacaatctatctatcatatcgaaatgacaaattagataatcgtattatcaaaagctagatctaactaggaattgcaagagcatattttgcagccccagttcaatctactacatgttgcaaatagacaaatagataatcatatagataaaactcatcaaggagattgacttattgttaacgaaaccaaacccatgacataatttagtaatgatgtaagtgtttttgtacatgaaacagtttgccacaagcaacaactggacttatgccactgaaatcaacgaaattagaaaccatattaaaacctaatccatagtgccacgaacacaagaaacctacaacgcagtcgataaacacttcctagaattacgtttcttaaagttgtgcattagccttacttcatctattgggccttaaaatcataaagcccattacgagaatgcaatcgtaaatgttttttttttctttcttactcaacatctatatgatatatccgttatctgttggggtagcttaagcaaagtcacaactcacaaatctatccatcattcaatgttaacaaatctattgcttttttagttaagaagagaatttatttagtttgcatctcctattattttaacaaaactaataattttttgcaaattttaaaattatatctcaactttatacatataatcaaaatgtgatttcacatagccacattcggaaagtataaaccaaccattctacaaacaaccaacaagtcaatgtttaattacgtttttcaggttaattcagaagttgttccaaatcgaatctttccgtaaaaggcaaaaacatatctagacaatccaacaagataactaagtcatattcagattcgttatataacttatatagctttctactgaccgttagttgcaattatagtttatctaatattaaactaactttcttttttgtaactaaatactctcgggtaaaaaaagtcctaacaatctcattttttgataactggatactttaagataaaatccaaactaatctccagctcttataaagatccactagagaattatagtaaacattcttgagtacaagttgttttcgtattctcttgattctttaaaaaaagcatatccaataaacaaatgatgttctcgtagaatcggtaaattgcaaaaagatgaaaaaataagaaatagacgcaattctgtgacaactaaaatatccttttcacatatagcgacgtctcagtcactaaagaaccgatagaattggaatttgtaggtcccgcatttattaatatacctcttaaattaaccaaaaataattcaataagtaaactattacttaaataataaaaaaataagagccatcgtgacttcgagagaagaagccagcaaggaacgatggagattattacggcatcatcatcatcatcatcatcattgtaattcgtaatcatatcttcttttggaatttcttcacggataagaaaaaaggatatcgacaatttcgcttttgctttcaaaatctcattctatcactttgtgccttttttagccatcgcgaaaaacctctgaatcgcatcccttgattttctgggtttgtgactttgtgtagtggaaattaggcttgttgtttgatttcgctacgagaaaatg

SEQ ID NO: 29264 - DNA, 593 bp, Unknown; identical to SEQ ID NO: 88
  misc_feature (1)..( 593): 2750-1469P.txt file - cDNA_ID_3013435; gDNA_ID_2391; Annot_ID_145692

SEQ ID NO: 29265 - DNA, 3000 bp, Unknown; identical to SEQ ID NO: 14407
  misc_feature (1)..( 3000): 2750-1469P.txt file - cDNA_ID_3013477; gDNA_ID_2684116; Annot_ID_190808

SEQ ID NO: 29266 - DNA, 587 bp, Unknown; identical to SEQ ID NO: 293
  misc_feature (1)..( 587): 2750-1469P.txt file - cDNA_ID_3013477; gDNA_ID_1563442; Annot_ID_147685

SEQ ID NO: 29267 - DNA, 3 bp, Unknown
  misc_feature (1)..( 3): 2750-1469P.txt file - cDNA_ID_3013497; gDNA_ID_1759; Annot_ID_145348
cta

SEQ ID NO: 29268 - DNA, 791 bp, Unknown; identical to SEQ ID NO: 92
  misc_feature (1)..( 791): 2750-1469P.txt file - cDNA_ID_3013557; gDNA_ID_2413; Annot_ID_145709

SEQ ID NO: 29269 - DNA, 504 bp, Unknown; identical to SEQ ID NO: 85
  misc_feature (1)..( 504): 2750-1469P.txt file - cDNA_ID_3013567; gDNA_ID_2362; Annot_ID_145667

SEQ ID NO: 29270 - DNA, 3003 bp, Unknown; identical to SEQ ID NO: 26527
  misc_feature (1)..( 3003): 2750-1469P.txt file - cDNA_ID_3013579; gDNA_ID_2213624; Annot_ID_195779

SEQ ID NO: 29271 - DNA, 31 bp, Unknown; identical to SEQ ID NO: 46
  misc_feature (1)..( 31): 2750-1469P.txt file - cDNA_ID_3013609; gDNA_ID_1706; Annot_ID_145304

SEQ ID NO: 29272 - DNA, 16 bp, Unknown
  misc_feature (1)..( 16): 2750-1469P.txt file - cDNA_ID_3013635; gDNA_ID_3560; Annot_ID_146348
aaagctgcaacaaatg

SEQ ID NO: 29273 - DNA, 499 bp, Unknown; identical to SEQ ID NO: 80
  misc_feature (1)..( 499): 2750-1469P.txt file - cDNA_ID_3013649; gDNA_ID_2306; Annot_ID_145631

SEQ ID NO: 29274 - DNA, 3000 bp, Unknown
  misc_feature (1)..( 3000): 2750-1469P.txt file - cDNA_ID_3013660; gDNA_ID_1972133; Annot_ID_179131
ccggagaacttggtcacttataagttacttggagaaccagatggaccacattatgcacactatgatttggttggaggacgactggtatgtttgttccccagtcatttctaggtctcctcctatgttggaactttgttcaatgctgtatcatgtgcatgcttgtttcgtttgttaatcgtttctctgacaacttactgcaggcagtggagcaagtctatccttgcataactgaatttcttagccaccatgattccgcataagtgaaacatttcgggagtttctgttccttgcatgctatagcacatgtagattgtagacgtcgcactaaggtggtgtcgaagaagtgtgtttcagaagcgcctgttaaaaaggatgccatttccgtttaagacacgtacatttagtatctgggcaaactgtacatgagcttaggatgcagttttttcaagtcatacacctgtaaattaggaaaagcatcgaatgagatgctggaagctcttgtctactgtgatgatttcccttgttttgttatggcaacgagctttttatttgaacatttatctttagaagaactggtgtgttctcttgtactgctttgcttcttttggaggacttgagttatccatgagagcaattgtatagacatggatttatgtgtacattttctgtcttagatccattaatgacacagccctacttctcagataatgtgtgggatacatgatgtaatgatagatctgaattgtctagtattaaacaacagagctctctttcatgaaagatattgtctctccaccatcatgtaagaccatacctagttcttctctttctttgtccataaattaattcgttggattctctatggtacagaattctctagcacgacttacctatttcttttgtaacgtgtttgatgttgagtgattacaggttttgacttgagacaatgagttgtcaacactctctgataacattgagacacttcactagatagagatgtgcttgctgtgattagtatagtacaattctgacttcacgataatttcaggtttttgtgttggctgaccagatgtattgcagcgatcctccccatcccttgcacttagtggcatcagacaaacaacaaaaagaccacaaactgatcctttcctggaaggtaatgtgttcttgtcttttgtttgttccctgtctgcaatgatgtctcttaactctcctgacactcttagccttagctgcttgatataaatcaacatcattctcacctttctatgtatctgttatgtgctgaatatgtatttgttatagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagtgagtttctttgccgtttccattagtatttccattacctttaatttcttggtaaattttttcaactctgagacggtgtttacttatgagttatgacatgtggcaaaggatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttggtaagtttttcatgggaagcttgggattcaaagatgagtaagtactataagtagtaatgttcctagtaggcttataccggatgttcattacaatctgtagggatgcagagtgtgtcgggattgaggttgttccagatggagtctgagttctgtttggtctacagagacgaagaaggtctgtggagaaatgctggggatgttccatggaagtaagctcttgatactttctttgtagattactgaaataaagcgtttacatgtgttgtgatttgtaaatgacagtgagttcatagaaagcgtggagcggctgagaatcacaagaagaaacgatgctgtacttcccttttaatattagcttctctctttcttcactctttgttataatttccaagtcagccttgaatcggaaatgaaacaaaagagaaaaggtaaatgtaactttgaatacgattatattcgaaataaagaaagaaccacgaactacttttttcggtgaaatcctgatcactagagctccgatatgttacgtctggattctcgtcttaccatgatacgaagatattgtgaaccatccagttttaagatatagtggtgtaattacgatggtgaatttgccattttatctttcatacttttcaattcataatccgcataaacgaaaaatgagtaggatatcgaaggccttgtgaagacaagagagctcaactccggcgacaacctcgatcttttttcttacattttcattcatacggagttgttgaaagtctacgacgttatcttttacacgtaagagtgactgaaccggtggctgattaggatgacgtgatttccataattaattcaacaccctccaaatacagaaagacatgcatttatatagtataaaataaagacatatacagtatatgctctgcatgcttaatattgttacaagtcaatgagtcatccattcatatctaatcctcctaagaacctaatctgatccatatccatttattactaagaaaacgtttttttgtttaacataaccaaatcaaaagaaggaataatttggaatatccagagaagtccatctcagcatccaataggcaataggaaaggtttgaccaaaaacgtatacagataataaaaagtgtgcgtcagctttgagtggacgctgcgcctcgacgcctccattccaatctataaataaagaacgagaactaagacataaccatccaattaagaaagagaggattaagacataaacaagacaaaacaagaagaagagatttatttattacataaaaatg

SEQ ID NO: 29275 - DNA, 1034 bp, Unknown
  misc_feature (1)..( 1034): 2750-1469P.txt file - cDNA_ID_3013660; gDNA_ID_3592; Annot_ID_146376
tgtgttgtgatttgtaaatgacagtgagttcatagaaagcgtggagcggctgagaatcacaagaagaaacgatgctgtacttcccttttaatattagcttctctctttcttcactctttgttataatttccaagtcagccttgaatcggaaatgaaacaaaagagaaaaggtaaatgtaactttgaatacgattatattcgaaataaagaaagaaccacgaactacttttttcggtgaaatcctgatcactagagctccgatatgttacgtctggattctcgtcttaccatgatacgaagatattgtgaaccatccagttttaagatatagtggtgtaattacgatggtgaatttgccattttatctttcatacttttcaattcataatccgcataaacgaaaaatgagtaggatatcgaaggccttgtgaagacaagagagctcaactccggcgacaacctcgatcttttttcttacattttcattcatacggagttgttgaaagtctacgacgttatcttttacacgtaagagtgactgaaccggtggctgattaggatgacgtgatttccataattaattcaacaccctccaaatacagaaagacatgcatttatatagtataaaataaagacatatacagtatatgctctgcatgcttaatattgttacaagtcaatgagtcatccattcatatctaatcctcctaagaacctaatctgatccatatccatttattactaagaaaacgtttttttgtttaacataaccaaatcaaaagaaggaataatttggaatatccagagaagtccatctcagcatccaataggcaataggaaaggtttgaccaaaaacgtatacagataataaaaagtgtgcgtcagctttgagtggacgctgcgcctcgacgcctccattccaatctataaataaagaacgagaactaagacataaccatccaattaagaaagagaggattaagacataaacaagacaaaacaagaagaagagatttatttattacataaaaatg

SEQ ID NO: 29276 - DNA, 734 bp, Unknown; identical to SEQ ID NO: 188
  misc_feature (1)..( 734): 2750-1469P.txt file - cDNA_ID_3013704; gDNA_ID_26049; Annot_ID_146539

SEQ ID NO: 29277 - DNA, 1156 bp, Unknown
  misc_feature (1)..( 1156): 2750-1469P.txt file - cDNA_ID_3013785; gDNA_ID_836; Annot_ID_144553
  misc_feature (709)..(709): n is a, c, g, or t
  misc_feature (715)..(715): n is a, c, g, or t
agtctcaactttcctagaattcctatgtggggtttgccttatgctcatatgtatatctcataaatccgatacaggttgcagaacgagcactgttcttgtggaacaacgagcacattgtgggtctaatcgcgcaaaaccgaagcgtgatccttccaatcatatatcccacactggagaagaacatccagtctcactggaaccaagcagttcatggtctaaccacaaatatcaagaaaatgttcatggaaatggatcctgaactgtttgaagaatgtcagagacagtatgaagagaaacaagcgaaatccaaagaagtagaagaacaaccaatatacatggaagagattagcagaagcagcggcggagcgagatggaggaggaggagaagaagatcatatgatcacttcctagatcgatcaaaaagggtataattctttcactttttttttgtttgtactcattttatcaaatgagttactatattaattttcttatcaaacttaggatttgtttgttgttttgagaatcatgggttcaaaatctgattgctcagagaagtagagagagagaagtgagccattactatcagagaatatgtctttagtactaagaaatgtgtttgtgatcttctgtctaattttgttcgtggaaaggcacttataaaattttgtaaaatttttaattatatatactgtggatggatgtttgnagctgngttattagccatctcaaaatccaatttggttttcttgttttgatccattcttaccctactttttgtgttatttgtatcaaaactttgaatttgtatataggaggaaactagtcttccaactgatccaggacaatgtatttgattcctcaatttccaaaagataagaagagttttcattttaactcttaaggtaaactaaacacaatatcgtcttctttattattaaccaaattggttcagagccattggaccgaaaacatagaccgagagaatataccaagttatatacagttaactgcgccaattcaccacgagaaaacctaaattttattgaggtagcttattgcacggcggcgattagttgttttacttgttacaagaaaatcattcacggcggtggagaaaaaacaaaagagagcgagacaaagagagactacaatg

SEQ ID NO: 29278 - DNA, 214 bp, Unknown; identical to SEQ ID NO: 38
  misc_feature (1)..( 214): 2750-1469P.txt file - cDNA_ID_3013870; gDNA_ID_1466; Annot_ID_145090

SEQ ID NO: 29279 - DNA, 1663 bp, Unknown; identical to SEQ ID NO: 178
  misc_feature (1)..( 1663): 2750-1469P.txt file - cDNA_ID_3013897; gDNA_ID_24677; Annot_ID_146450

SEQ ID NO: 29280 - DNA, 593 bp, Unknown; identical to SEQ ID NO: 160
  misc_feature (1)..( 593): 2750-1469P.txt file - cDNA_ID_3013944; gDNA_ID_3448; Annot_ID_146306

SEQ ID NO: 29281 - DNA, 3003 bp, Unknown; identical to SEQ ID NO: 22263
  misc_feature (1)..( 3003): 2750-1469P.txt file - cDNA_ID_3014067; gDNA_ID_1620655; Annot_ID_47846

SEQ ID NO: 29282 - DNA, 3000 bp, Unknown
  misc_feature (1)..( 3000): 2750-1469P.txt file - cDNA_ID_3014067; gDNA_ID_2926209; Annot_ID_141874
cttttcagattcaacccaaaattgaagacaaaaatgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaataaggtttgtttgaaaggtgggcttaagactcctgttggtggtggtgttagttctcttaacgtccagcttaggaaagagcttgacctctttgcttctctggtcaactgttttaatttgcctggtttacctactcgccatgagaatgttgacatcgttgtcatcagagagaacactgaaggtgagtacgcggggcttgagcacgaggttgttcctggtgtcgttgagagtctgaaggtgagaattccgatttctgctcctcgttttggattcaatctgtatttgtggaatcatcttcgtttgcaagtggtctttgtatgttatgtgtgattgttctgatcctatttctatgcttaggtgatcacgaagttctgttcggagcgtattgcaaagtatgcttttgagtatgcctacctgaacaacaggaagaaagttacagcggtgcataaggctaacatcatgaaacttgcggatggtttgttcttggaatcttgtcgcgaggttgcgaaaaagtatcccagcatcacctacaatgaaatcattgttgataactgctgtatgcaacttgtagccaaaccagagcaattcgatgtcatggtatgtttcagagttatatacatatgaattttcatgacgttctttaagtcttcgatgttttactttgagaaaaagataccagtcatctctccctagtttggtatccctctagattgcctgttttagagtcatattatcttattggtatgagactgatgttgtgttgccatatactatagttaatcgccccatttgcatactatttaatctcgtcatttgcatatcatgctttcagggaatcttttaaattgtacttctgtgaccttgtctatgtatacttactactttgcatacactattgttcgttagagcagtaacttcactgttgctaagtattaacctttcattactgtatgtagtagcgtcttttggcttttccccccttttataacagcaatttatgaaatgttttgcaggtaacgccgaatctctatgggaatttagttgcaaacactgctgctggtattgctggaggcacaggagtcatgcctggaggtaaaaaaacatcctgtattgatattctctcgagctatacattagtggataaagaatagttctaaaatttatacatctgcgacattaaatacaaaaacaggaaatgttggggctgaccatgcggtattcgagcaaggtgcatcagcaggaaatgttgggaaagacaagatagtattggaaaacaaagcaaacccagtggcattgcttctctcatcagcgatgatgcttagacaccttcagtttccttcatttgctgaccggctcgaaacagcagtgaagaaagtcatcgctgaaggaaagtgccggacgaaagatcttggtggaacaagcacgactcaagaggtcgttgatgcggtcattgcaaaactagactgactttgacaaattacgtgttcccgctctgcataaatcatcaaattcctgatacagattttgtgttgccaaaatatggggtatgatccaagcacaacggttatctggttttgtacctcgagttttattatattctttagccgtggaatatttcgataagaaaaaaaaacatgttccaaataattcatgttgctacgtttgttggcgccttttgtcatgtcaaagtttcttaaacacttgttcgtggaatatgcaaacttttatggattcgtaatttcaagaatatgaatgaaaaattgatggtatctttgatcacctcgaatggtggtttcttaagagcatccacattggttaatttttgatggatgtttttaaatataaaactttattttaagaggtttttgagtagttaagaaactctaacgtgtcattgtgtgtgtggttgaacattgtgacaacatcatttatttatttttcttttcgcgtttttctctcttttttagtccatatgatttttaatatatatatcatatttgtttaaaattttaatatttgtattatttattaagttttataaaataaaatataaataatttttattttaataataatatatttttttaaaagacccacttaaacattagaccaaaaaaaattaatggtccaacaaaaacactttaattttttataatttaaaattttaaaaaacccttttaagggctcaaccattggggttgctcttactccaagtctttaatttaatttgtgaattaacattgactaattttaaaatcacttgaaattgtttcatcggatttgggatgtcacatttggtacccggcaagttcgaaaatgacttttaaactttgacacctcttgcctcttggtagagttttggatgaggcttgaaacttttgtattgcagcccataactgaaaatagtttattagtataatatatcttctcaacaaacattgcaaatattttgaaaatccagctaaaactatacccgatcagaattagaaaatttgagcccaagcccggcccgtaagtattattatagaaaccgatataaagtttcctttttcttaataatatttattccgtggcagcaaatgcaagccaatccaatgtcaaaacaccagctgacgtggccaaacgcacatcaactgtcgtctctctatctctctctccctcacttgtctctctctcttctcttcgacactgatg

SEQ ID NO: 29283 - DNA, 3000 bp, Unknown; identical to SEQ ID NO: 29282
  misc_feature (1)..( 3000): 2750-1469P.txt file - cDNA_ID_3014067; gDNA_ID_2926209; Annot_ID_202454

SEQ ID NO: 29284 - DNA, 999 bp, Unknown
  misc_feature (1)..( 999): 2750-1469P.txt file - cDNA_ID_3014129; gDNA_ID_2878; Annot_ID_146025
tgtaccttgcatgcaagtttcgttatcaattgctagatacttgcggtgagggtatctccattttggagatatgaaaattgctttgtgatatagcaatgtagagttgactcttgttaatcaaacaaccctagtgcctttatggcttagtatgcatcagtttcttttcttttcttctattagccacagactacagtgagtgtatttacacgtttacaacacacttaacatttcagtcaataaaatgaagaagaacaggtcagtgcctgcaggaatgttctcaggtatattggacattgaaaatagcaaaagagtttgatgcaggagaatcagattcttgtagaatgaggttcttttcttccccacacaggaaaagaaataacttttatggagttgactcttgagagaaatgttgtttattcatttttatctagaaaacaacaggagttagagcctcgtgggtgcattctgactcactcctgatatattttaaacatggatctgaattctgaaggtctgctcgagagttcttgacttctgacgaagtgaacaacgacaattcgccttcattccctcttatctctgcctctggtatgaatcttatgattctaacaacggattagtatagtgaataatcagctttggtaatcatgttgatgccatagttactctgctctcaaaaaagaaatgtttgatgtttttctggacgttctattttagtcataaagcactagcagcatctctctaaagtgactttgactttcgttaggactaggccctgtttaatatacactatttgcaaggataattccttactttaagttttaaagaaaatatctgattcctcaccaccatttcttggggtttctatttcttttattggcaactttctcctcttggccctcatgtctaattgtatatatatagacatcattacagaaacagtttcttataagatttccaacatccaatagtgtcatttttagtctgtagatatcaatg

SEQ ID NO: 29285 - DNA, 208 bp, Unknown; identical to SEQ ID NO: 117
  misc_feature (1)..( 208): 2750-1469P.txt file - cDNA_ID_3014187; gDNA_ID_2810; Annot_ID_145949
  misc_feature (16)..(16): n is a, c, g, or t
  misc_feature (57)..(57): n is a, c, g, or t

SEQ ID NO: 29286 - DNA, 188 bp, Unknown; identical to SEQ ID NO: 113
  misc_feature (1)..( 188): 2750-1469P.txt file - cDNA_ID_3014198; gDNA_ID_2756; Annot_ID_145927

SEQ ID NO: 29287 - DNA, 1919 bp, Unknown
  misc_feature (1)..( 1919): 2750-1469P.txt file - cDNA_ID_3014207; gDNA_ID_2745; Annot_ID_145915
tatggtaaagctgacgtggtatcctaagtggggtggatttgaattggagttgattccaacggtggagattcaaagattctttgattgatagtgagcgactctcgttttccaatcacgtgtaactcggctccactctaaagcacgaaatcaacacgtccacgtaacgatcatatattcatgcagtgatatagtcgtttaacagaaagatcactccgtcaatctttccaccactgtgactaaatctaaacaatttcatggcgagtctctgtctctcatcgtcccggatcgtttctcttcaccaccagaaaccattcctctctcttaaactccggtctcgtccttcagatctctccggtctaggtcgccacacgagtcctgtttgcttcaatccgcttaggtaccgtatagtgaaaacaatggatttgggattctttcgagtcatgcattttgtgtaactctttttgtttgtaatgtttctaggttatcgggtgatcgtcagcgaaccgctacggtatcaacgagggtggagaagcggcgaaagagaggatcgagtgtggtctgttatgctgctccgatttctgccaatagtctacaatggatctccaccatttcttgcctgtatgatctctctcatttactgtgattttcttaacacataatgctggtgaaattatgctaatgatgattgtgtaatttcctctgttttcatcataacgtcaataacataagttaattgctatactgaatggtgtttcatttctagtgcattgatgcttgcaaggggtactggtatacataagtcagttgttgttccactattcgctctccacgcaccatcgagcatcgtcgcctggattaagtaagcttttaacatggagatatattcattaacatggtgatatatatgggtctctcttcttctttttgcatgcttgagcagccatattgaagtcattaaacttaaacttgtgtatctttatttttgtaggggagagtatggtgtatgggcagcattcttggcgcttattgctcgacttttcttcacttttccaggttcgtaatcatcttcaatatgtaggttgattacaagttagttattaattaaagttatacattaataggtgaacttgagcttccattcatcgcattactcttggtgattgtggcgccatatcaagttatgaacataaggttagaatcttaaagaatgtaatgtttttatatatatcaaggttttcttttctttagtcgccgagactcattgacttcattataaacttgcagagggaagcaagaaggggcaatcatagcaatagcaatatctggttttctggctttccaacatttctcacgagcagggagcttggagaaagcatatgagaagggttcagttcttgccactgtagccattattggtgtcacagttgtatcgctccttttgttgctataactatatgctcctgaccaaaaatgttaatcagtgtaagaatgtgtgtgaaggaaaaaaaagaaagatgtgcttgcatttatccgctctttaagaaatgctggtacatttttggcaactattcgctggcaataaaaatgatctttcatgtacaaacgtaaaaacaatacacatttaaaatctttggtcgacatgggattgggatatttaaaagctgacgtggaatcctacgtggttagatttgcagtcgtattgatgccaacaacggtggagattcaagattctttgattgattgtgaactaaacgactgtcgttttccaaacacgtgtttatgggccccactttaaaagcattcccgctaaatctacaccgtccacgtagcgatcatgatattgatgcaaatgattcaattttaacggaaagatgacggagtgatctttccaccaccgtaactaatcttaacaattcatg

SEQ ID NO: 29288 - DNA, 2353 bp, Unknown; identical to SEQ ID NO: 167
  misc_feature (1)..( 2353): 2750-1469P.txt file - cDNA_ID_3014240; gDNA_ID_3572; Annot_ID_146354

SEQ ID NO: 29289 - DNA, 606 bp, Unknown; identical to SEQ ID NO: 166
  misc_feature (1)..( 606): 2750-1469P.txt file - cDNA_ID_3014242; gDNA_ID_3572; Annot_ID_146353

SEQ ID NO: 29290 - DNA, 1991 bp, Unknown; identical to SEQ ID NO: 157
  misc_feature (1)..( 1991): 2750-1469P.txt file - cDNA_ID_3014266; gDNA_ID_3413; Annot_ID_146281
  misc_feature (523)..(523): n is a, c, g, or t
  misc_feature (1597)..(1597): n is a, c, g, or t

SEQ ID NO: 29291 - DNA, 3003 bp, Unknown
  misc_feature (1)..( 3003): 2750-1469P.txt file - cDNA_ID_3014269; gDNA_ID_1972132; Annot_ID_179101
ttgatacacttgtctaagttatacactaattcttgttctttttatattttctgaaaattttggcagaaatcttcgaatgttgacgctaccaaaggtggtgctgaagaggaaactcttgatattagtgctatgggtgctgttatctttgtcatatcagcgtccacattcctcgttttgctcttcttcttcatgtcatcgtggtttatcttgatcctgaccatatttttcgtcattggtggtatgcaggtaatgttagctaatcttgagcatatccttagtttcatggttcaatagctagaactatgatcaatgtttggtaacaggttgatagtaaactttctttagcattgtttccttcccttgtaaaaatacataacatgatgaactctttatgtgaaatgaaacagaggcctgctaagctaagcattattatgtcaatatcacaattattaatttattttctatctcagggaatgcataatattaacgttacactcataacaaggtactctcagaaacccaattaagtttttgaaccgtgaaagagctctattccagctagttaaaagcatcatgtgatgttttctctttattcatgtttatatttctgcaggagatgcagtaaatgtggccagaagaatttaaaactacctctgcttgggaatacctcgattctctcactcgtggttctgttattctgctttgtggttgctatcctctggtttatgaatcgcaaaacttcgcacgcatgggccgggcaagatatttttgtaagtccattttagcctggtaattttacagttgtctaaagccaaattatccctatgcattttggttcttctttgatttttttccgtatgtctaaacacaacttctggcttgacgcactcaacatttactttcacttcttgctcaaatccaactcaaggttctgttttgttttcgacatttatcggttgacttctgtaggacttagcttaggatgcttttggttcaaaattgtccttagttggctttctaaggttgacgtgtcatgtgacagggtatttgcatgatgattaatgtcttgcaagtagctcggctacctaatatcagggtaaattttctgtatgtattttcctactaaaattcttttgtgatccctttgtatgtgttctaatgggtgtctcacacttaggttgctaccattcttctctgttgtgcatttttctatgacatcttttgggtattcatatcaccactaatcttcaagcaaagtgtaatgattgcggtgagttttcgttattttccttcatttaacaaattgtgtgtcttacaccttaatatttaattctgtttctgcaaggagaagaatatttagtgttgtttcttcaaaaatccatcaaatcatatgattcttataaacttaagcctcatcaaaccagagcatgtttaccattagtgtgttttacttttactccggagcatgatttgtgtcggataattgctcaaaaccccaaagattgagtttgagttcacttgttgtataaaatgtttgcacatagcgagaacgaagaaggtcgatgataggttaactaacctcaatcacgttctagttgattactatattcttctgtttgtgtaaatttatggcataggttgcacgtgggagcaaagacactggagaatctattcccatgcttttgagaattccacggctttctgatccatggggtggttacaacatgatcggttttggagacattcttttcccgggccttctcatatgctttattttcaggtaaccctcttatgcatgatgcattggctcaataacgattatggttcacgacaccaattgtgaacacatcatctgttacaaacgctgtccgtattcaatatgccccatctcaatatgttttttgaccgctttttaactcttttacgtctcagatttgacaaggaaaataacaagggggtctcgaatggatattttccgtggttgatgtttggctacggacttggcctcttcttaacatacttgggattgtatgttatgaatggacacggtcaacctgcattgctatatcttgtcccttgcacgctcggtatcttgttcatctcatgaaaaactctgaattttgatgattagtcccctatatatgcattccattgaaacccaaccaaatgcaagatttcttacatattgagcggcttgcaggaatcacggtcattctagggttggtgaggaaagaactcagagacttgtggaactacgggactcaacagccttcagctgcagacgtaaatccatctccagaagcataaattgcttcaacatacataactcaaaactctggagactgaagaacaagaagaagaaacatcaaaaaagaaacaatttttcttttgcacataaaaaattataagaaatatacacttttgtgcatacacatgtagtctcgagcccaccaaaacgtatataatgtaatgtatatgtatacatacacacaatcaacaacttctgattctgaaatgaacaagtttttgtatactgtacaaatacgaatttgaatttttttttcccctcaaaaaaatataaaaccagctttaataaggatttgaaaagtttccaagttcatatatagataaaccgaaagaatttggatcaaactataatttttaggaactggaactgacacttatcattaagacaacaagagacagattcgattaaaagagaatcttcaggcaaaacggcgtcgtgtcttgtttacacataaacagaggttattaaaaagtttgggaagagcagatctggaagaagaaagaagaagaagaactctctactggttaattttagccggcgggtaaacggatatttttggaggaagagcagctcttctctcaaaaccatccctctttctctaaaaccctaattctcgacatccttcaaaacctaacaatttcaatttcaattaacccaacaactttcttactctcttcctttgaatgatttcaatg

SEQ ID NO: 29292 - DNA, 1015 bp, Unknown; identical to SEQ ID NO: 158
  misc_feature (1)..( 1015): 2750-1469P.txt file - cDNA_ID_3014269; gDNA_ID_3416; Annot_ID_146286

SEQ ID NO: 29293 - DNA, 674 bp, Unknown
  misc_feature (1)..( 674): 2750-1469P.txt file - cDNA_ID_3014276; gDNA_ID_3380; Annot_ID_146266
aattctctctccctttgcaagtcttctagttttcaactatttttagccctctatgagtgatcatagcattagttgagcgtcttctgcggttctgccctggaaaagcggcaactgatctctcaatgggtctcaatccaataatggttgggtagtttgtagggaacgagaactgtgagtgtgagactctgtagctttggtatggtttctatgggtgattatagcattatttgggcatcttctgcggttctgccctggaaaagctgcaactgatctctcgatgggtctcaatccactaatgctttgggtagtttgtagggatcgagaactgtgagtgtgagcctctgtagcattggtatgaatgagtgaccattgcacaacaggatcttctttcgtcattaccttttattcagtttcaatttctttgcaattctagcagtgctgggtgggttttgggtggggtactgtgttgtcccaaggtttcattgtgattgtatgggccttaatgttccgagcaatatcgctgtatcatagcaaaactcacatctatgaagagaacctggtggacgaggatctcagatcaggggttttacatccatcttcacttttgtagtgtaaatcatttcctgagaaaagcttgctaattattacctgatatctattcctttcagccaatg

SEQ ID NO: 29294 - DNA, 559 bp, Unknown; identical to SEQ ID NO: 152
  misc_feature (1)..( 559): 2750-1469P.txt file - cDNA_ID_3014282; gDNA_ID_3334; Annot_ID_146253
  misc_feature (10)..(10): n is a, c, g, or t
  misc_feature (47)..(47): n is a, c, g, or t
  misc_feature (75)..(75): n is a, c, g, or t
  misc_feature (168)..(168): n is a, c, g, or t
  misc_feature (183)..(183): n is a, c, g, or t

SEQ ID NO: 29295 - DNA, 2302 bp, Unknown; identical to SEQ ID NO: 144
  misc_feature (1)..( 2302): 2750-1469P.txt file - cDNA_ID_3014290; gDNA_ID_3265; Annot_ID_146194
  misc_feature (1290)..(1290): n is a, c, g, or t

SEQ ID NO: 29296 - DNA, 2881 bp, Unknown; identical to SEQ ID NO: 129
  misc_feature (1)..( 2881): 2750-1469P.txt file - cDNA_ID_3014315; gDNA_ID_2921; Annot_ID_146041

SEQ ID NO: 29297 - DNA, 225 bp, Unknown
  misc_feature (1)..( 225): 2750-1469P.txt file - cDNA_ID_3014326; gDNA_ID_2973; Annot_ID_146069
tatctcaaatagagtcatgagaattgtatttggtatcagagtagtctaacttagatcaacttttgactagttgtttgtttccattgaacctactttcaacccaattttattcacaagatctgcatttctctgcacccacaatgttttacattgcttatataatttgtacattgatcaggtgaatctgatcttactttctggtccacctctaagcacttttaaatg

SEQ ID NO: 29298 - DNA, 463 bp, Unknown; identical to SEQ ID NO: 121
  misc_feature (1)..( 463): 2750-1469P.txt file - cDNA_ID_3014342; gDNA_ID_2850; Annot_ID_145983
  misc_feature (38)..(39): n is a, c, g, or t
  misc_feature (80)..(80): n is a, c, g, or t

SEQ ID NO: 29299 - DNA, 2086 bp, Unknown; identical to SEQ ID NO: 123
  misc_feature (1)..( 2086): 2750-1469P.txt file - cDNA_ID_3014360; gDNA_ID_2866; Annot_ID_146003
  misc_feature (127)..(127): n is a, c, g, or t

SEQ ID NO: 29300 - DNA, 3000 bp, Unknown; identical to SEQ ID NO: 115
  misc_feature (1)..( 3000): 2750-1469P.txt file - cDNA_ID_3014384; gDNA_ID_2804; Annot_ID_145941

SEQ ID NO: 29301 - DNA, 987 bp, Unknown; identical to SEQ ID NO: 97
  misc_feature (1)..( 987): 2750-1469P.txt file - cDNA_ID_3014460; gDNA_ID_2431; Annot_ID_145728

SEQ ID NO: 29302 - DNA, 447 bp, Unknown; identical to SEQ ID NO: 81
  misc_feature (1)..( 447): 2750-1469P.txt file - cDNA_ID_3014503; gDNA_ID_2330; Annot_ID_145648

SEQ ID NO: 29303 - DNA, 336 bp, Unknown
  misc_feature (1)..( 336): 2750-1469P.txt file - cDNA_ID_3014587; gDNA_ID_1915; Annot_ID_145419
ctcttctatacaaattatcaaaacagttgtaagaagtttcaagaaaaacatttgatatctcactaatttggctatccttgcaagttgcaacgctaaaatgacaaataatgaattctcggcccaatgggcttacccaagccttgttaaagatagcgtgaacaaaacgcggctcactagccctaacctgtctctctttcgcttaccttcttcttcgtcttcgttggctcagtcacttgacttcacggccccgctcaagctctgacacgaaactcatttcaaattaatttaataaaaccttaatcacaaaaggggcaaaagcaatcgccggcgattatg

SEQ ID NO: 29304 - DNA, 576 bp, Unknown
  misc_feature (1)..( 576): 2750-1469P.txt file - cDNA_ID_3014600; gDNA_ID_1974; Annot_ID_145464
agaactccaccatcaaactccgtctccggtggagctcgaactccatctccggtttcagctactcgtcgtggtggaacaggagcaatgtcgacttcgccttccattgctaaggcaatcacaacaagattaatcgaagaacaaacacgattttaccaatgagagaattagggattgagttttcgatttgggcattttgatttgtttcgttaggtttgaaacgacggcgttttggtcttaacagaattcattaacgttctcttaacggggttaatcagcgagttaacgtcttgggattttggcgggtcaacgttttgtttctgttaaaatggctggtcaacgtatttttcatgtttattttggccgacgtcagagttcacgtatagaatagctactttttgaaagttcgcgtataaaacaacatttttcccaaatataatttggtaatttttgtcttcaaggaaaagaaaaaggaaaacataagagtacttatgtgtgcgttaagccctgctcttttcaaatcaatttttaatttaccttcgtcaagaagaagacgacttgagatttgcgaaaaagatg

SEQ ID NO: 29305 - DNA, 113 bp, Unknown
  misc_feature (1)..( 113): 2750-1469P.txt file - cDNA_ID_3014612; gDNA_ID_1870; Annot_ID_145393
agaggtcgaaaattaatctataatcttatctttggttttgtaatcgcagatgctaaacttatgttgtttgtacttataatggcgtcttctttgttacttttcaggtacgcatg

SEQ ID NO: 29306 - DNA, 689 bp, Unknown; identical to SEQ ID NO: 12
  misc_feature (1)..( 689): 2750-1469P.txt file - cDNA_ID_3014674; gDNA_ID_649; Annot_ID_144481

SEQ ID NO: 29307 - DNA, 50 bp, Unknown; identical to SEQ ID NO: 13
  misc_feature (1)..( 50): 2750-1469P.txt file - cDNA_ID_3014688; gDNA_ID_654; Annot_ID_144488

SEQ ID NO: 29308 - DNA, 378 bp, Unknown; identical to SEQ ID NO: 14
  misc_feature (1)..( 378): 2750-1469P.txt file - cDNA_ID_3014701; gDNA_ID_655; Annot_ID_144493
  misc_feature (356)..(356): n is a, c, g, or t

SEQ ID NO: 29309 - DNA, 340 bp, Unknown; identical to SEQ ID NO: 61
  misc_feature (1)..( 340): 2750-1469P.txt file - cDNA_ID_3014774; gDNA_ID_1938; Annot_ID_145440

SEQ ID NO: 29310 - DNA, 34 bp, Unknown; identical to SEQ ID NO: 151
  misc_feature (1)..( 34): 2750-1469P.txt file - cDNA_ID_3014874; gDNA_ID_3328; Annot_ID_146249

SEQ ID NO: 29311 - DNA, 2891 bp, Unknown; identical to SEQ ID NO: 143
  misc_feature (1)..( 2891): 2750-1469P.txt file - cDNA_ID_3014900; gDNA_ID_3254; Annot_ID_146185
  misc_feature (1888)..(1888): n is a, c, g, or t

SEQ ID NO: 29312 - DNA, 117 bp, Unknown; identical to SEQ ID NO: 24
  misc_feature (1)..( 117): 2750-1469P.txt file - cDNA_ID_3015042; gDNA_ID_911; Annot_ID_144641
  misc_feature (66)..(66): n is a, c, g, or t

SEQ ID NO: 29313 - DNA, 692 bp, Unknown
  misc_feature (1)..( 692): 2750-1469P.txt file - cDNA_ID_3015073; gDNA_ID_178; Annot_ID_143977
  misc_feature (19)..(19): n is a, c, g, or t
  misc_feature (33)..(33): n is a, c, g, or t
  misc_feature (45)..(45): n is a, c, g, or t
  misc_feature (58)..(58): n is a, c, g, or t
  misc_feature (61)..(61): n is a, c, g, or t
  misc_feature (80)..(80): n is a, c, g, or t
  misc_feature (468)..(468): n is a, c, g, or t
  misc_feature (590)..(590): n is a, c, g, or t
aaacacacgctaacaattnctttttttttcctntcacattttatntttttaataattnaanaaataaatgttacggcatnggttatatcatatattttaatttcatggaggatattagattgttcccattttctattgatcatattagattaaataattagaaaatactatttttctgtctctattgtagtggtatgtatgattggagagttgatgaaaatgtaagcaagtaaaatcatcgtgcagatcgcgatgctatgtttattatcatatatgcttaaaggatcatttgagattaataccgcaatcagcgggtgagtaagaaacttaaaacacataactactctctttgtcaatggaagaccctcttaagcatctaacacatgattcgtctacacaaccatttaactctaattatatcccctaattgatattaattaaatcaagaggacaaaaaaaattaaatcncttataaatattaattttatagatgtatattttaaaaaagagaaaaaagaaaagaaatgggaggaagacactgggacgaaagacgacgtcatctattgttagtaagtttagcccaatcgtgnttctctctgcgcttgtctcccaaattctcagatctaatcagatcgacgattcctgatttcatcagcttcgagagagatccttcttttgttcttcgttgaatg

SEQ ID NO: 29314 - DNA, 233 bp, Unknown
  misc_feature (1)..( 233): 2750-1469P.txt file - cDNA_ID_3015217; gDNA_ID_1227; Annot_ID_144896
  misc_feature (57)..(57): n is a, c, g, or t
  misc_feature (63)..(64): n is a, c, g, or t
  misc_feature (104)..(104): n is a, c, g, or t
  misc_feature (145)..(145): n is a, c, g, or t
  misc_feature (179)..(179): n is a, c, g, or t
  misc_feature (223)..(223): n is a, c, g, or t
  misc_feature (226)..(226): n is a, c, g, or t
tagtgctactcgtcatcaagacaataatgttcccgtttataacagccacgatatccntcctcnnccgtcgtaacgtcttcgtcagactcttgggtctacctccnaaaagatcgttagtgcaagacaatgacgccggagggaaaancgggcggaagagcaaacgttagtgatgattaacnaagaaatccgacgtcgtatagagggagtgaggatgaggagtttnggnaaaaatg

SEQ ID NO: 29315 - DNA, 24 bp, Unknown
  misc_feature (1)..( 24): 2750-1469P.txt file - cDNA_ID_3015233; gDNA_ID_1329; Annot_ID_144986
cggagctcatcgccaggaaacatg

SEQ ID NO: 29316 - DNA, 3003 bp, Unknown
  misc_feature (1)..( 3003): 2750-1469P.txt file - cDNA_ID_3015313; gDNA_ID_2684256; Annot_ID_193150
caagaatcatgttcctaccaaaggagcttatttccctgctgtagagaaggctttagagatgattaaccagaaaagttcaccccttaacaaggtagtttagactttagagattgtgttcgtatctattcttaaaacaagtttataggtttcgttttaactgatgtttttggctcgtggaattaggttgttcttgctcgtaacagcaggataattacggataccgacattgatcccattgcttggctagcacagttacaggtgtgtttttatctctggatattatatagtagtcagttttcaatgtttagatttatatctcactaatttttttgtgtgacagcgtgaagggcatgatgcatatcagttctgtcttcaaccacctggtgcaccagcttttatcggaaacacggtaggtctttttatatgtagtctgtgataataagttctgttgataaagatatgtgcacatttgttatttatttctaagaaatatgtttgtgacatacatctttgtgaaacagcctgagagactattccaaaggactcaattaggtgtctgcagtgaagctttggctgcaactaggcctagagctgcttctagtgctcgtgatatggagatagagcgtgacttactaaccaggtcaatttttacttcaagtgctttgaacaattacagaatccagttctccattatcattttactgaatttttgctaaactgttgcagtccgaaagacgacctcgagttctctatcgtacgagagaatataagagaaaagttaaacgtaagttcaatcttgatgctctgcagcttcaatgcttcatttcttggataatagtttggtatattttttcttattatgctttcttctgctttgcagggtatatgtgacagagttgttgtcaagcctcaaaaaactgtgaggaagcttgcaagagtgcaacatctatattctcaattggcagggagacttacgaaggaagatgatgaggtgagataatagtattggaatagtttttacatttccaagctcttcatttcttcgaattagctttaaccctttttctttctatctgtctatagtataaaatattggctgctctgcatccaactccagctgtttgtgggcttccagcagaagaagcaaggcttttgattaaggagataggtaaaatatctaccttggttcaactatcttctagtaactatagatgtagagattaagaattatgctgactcaaacattttgcttcttctagaatcattcgatagaggaatgtatgcgggacctattggattttttggtggcgaggagagtgaatttgcagtcgggatcagatcagctctagtcgaaaaggtgagcttatttgatctctttctccctttaaaaaacacactttaacactaattgttatagcaaaatcgatcattacggtttttgctacaacttgtaaaaaaatgctgaactgtattttgatttacagggtcttggggcattgatctatgcggggacagggatagtagctggaagtgacccatcttcagagtggaatgagcttgatcttaagatatctcaggtacgagcttttgtccagaaaatgtttagtgacatcatggttctctgttaccaaaatcctaatttttattctctcttttgttgttgtttttgcagttcaccaagtcaattgaatatgaagcaacaacatctctacaggcgattaattgaagaaagagtaacatttgtatttgattgttttgtttgtatgggggataaggggttctcacaataagaaagcaatgttgtctctcttgtaaattaaaaaagaaatgctttaatttgttaatgggccgagccttttcgggttgtaactagggcaggcctatcatgaatgttcataggcctagctgttatgattgttaatgagcttctatagtgtttttcttcaaagacagatatattcaatatggatctaaaactgaactgaatttaactgacatgacaatcgaatcaaattgaatttattttttcaattttcatttagcaagaagtgacccatcttcagagtgaagtaatctatgcttattatctcgattaagcaaaaatccgtagaatgcttgggcctttcaacgatgatgtagccgtgtaggacaggtttacggaatctgcttttatgcaaatggtaaatattaatattcctttataagttagcgtttcagatcatcttctttcgttagattaagaaactactttgttattatataactataaataccatccaacaaccttactcgccatatcttttcatgtgtggtggtttataggaacattgaaaagtaccatattataaaatgaagaatcaacacgtcaacaaaaacacaaataaaatgagatagtacaattaaaaaaatggagcgcatgtaaaaagtgaagaatcaaacgaaggcttggcgatagagaatggaatcagatttcccattatccccactctaacaccatatattcctttccctttttaccctccacctcaattaggtttattaatcatatttaacactctaattaaccaacccatttcatctcttttattttactaatcacaatgctttggcctcattacgttttacctagatttactttgtcacaaactacacaaatatgaacctaattatctacactcgtgtcagaaacagttttagctaatatttagtaagttttaattaaaactaatgaaatgaataaatagtgtatagtacataggatttgtttttagtttattaatggaaattaagatttcattagtactaaaaacatgtaaataaaataaagctttaaagaggaatatattcaaataaaaaaagcaagacctcgaaaaaaaaactttctattatctctcttccgcgattaccgtaatctctgtcacaaacaacaaaaccttctctctctcactatcttaatgagagaagaagacattctcgagaaatgagaagactaccactacgatg

SEQ ID NO: 29317 - DNA, 3000 bp, Unknown
  misc_feature (1)..( 3000): 2750-1469P.txt file - cDNA_ID_3015321; gDNA_ID_2684256; Annot_ID_193147
gctttgttttcaaacttttcagcatgatttactatctgcagtttaaggatatatgaaatcttctatgaccatcaagagacagaaagtaacaagaggtgtcaaagaaaggaggatcctgacctcagatatatggatatgtccataatctctcgcatgctctaccgataccgaatcatcaagaaatgtgctctgcacaagaggaaatagagacagcttcccttttaatacaaagccatgaaacttggaccgggaagaactatatcattataaatcacgcacattgtccaaattcatatcagtagcagatattcacctccatgacgagaacctttgccttgagagcatcagcattagtttcatcaactacaaaatccgacgttgtatctcccgtaaaagcaacttcaggagttattatgctgtctgtaatctacaatccacaatccaaacttattaaacaggcttatatactttggaaagaccattgcaaaactattgactttgtgatagacaaacataagaaaaaattgacaagcaatattaagcaaatcaaagacaaacctcaacacctgaaaccttcaagttcttaatttcatttccagataggccaatatattccttcttgagtttatatttagttgaatacactacataaccctgcaaaatatcaaacgaaagcatgaattcaacgaagacacataacgctaagatatcgaaaatctcatgcgagtttactaaaataaacctggctttggatgacatggaatgtcttaaaggctttgactttgagatctttccttataataaactcctcccctgcatgaagaagtgtccaaggtttaacaaaaaagccaaatcttggctgcaatgaatgctagaggttgagttaccacctatgtccaagccaacaagattgtgctttagctctgaagaatctaactttctgtgaacttcgaataaactctcaacagtttctttaatggatgcgggtactataatcgttggaggcttcattttgtacaagcctctagtagcaacatacattggtaatccaccctaacataacaatacgaatagtttagctcacaatttgagaatgtaacacccaaacagtaacagagcaataggctaatataacataacaatttagctgacaattagagaatgtaacaccaacacagcaacagagcaatatgctaatgataataaacacatggtggctctcaacaagggtttatcaaaacagtaacagagcaataagctaatgataataaacacatggtggcagtctcaacaaaggcttatcaaaattgttcttaaaacaaaaagtcaaaagaaggatctttgcaaaatataatccgaaatttcaagtctttttatagaagattcaagatacttacgatatgatccatgtgagagtgagagatgaagaggaagtcttgagaaattgcgcgatgtgggcaacgaccaatgtcgaaagctatccgaagagatggaaatatgatgcacgtctcgtgcccaccaatcgacaatccctcgatcgggtaaccttcaatttgcattgctttcttcttctccatctcactgttccttagggtttatcgaattttggctgtgctcttcgttttcaaatattgatcaccaagtgttcgatgaaatgtctcacaatcacaagcttttttcttccatgatcattttttttttttttaataattttatggattgggcttaggcccataacggttaacgagactacttcactggagcgggaaccactaggcactggttaataaatttcccacgtgcctctggtgcaaaagttggtctttcgtattcaacgacagtgcaagggtatgattgtaaatttacttcgaatgcttcattagaacgtcgcggtattcttacacttgttttcgaagtaatctcgacgactataacaaaatctgagcaatttcaattaaatatctgttactgttgtattttaaaatctagactactgatgacataaccaaatttttagactaaattaccctttttcttctattttaattatcgcatttaatgattttcagctttttttctttatagattgctctcttaactcttctttaattttccctctttcgagttctgaatttttctgtaaaaattaattttagttaaactaaaaatgtttgacaaaaatactaaatttcagagaagatccaacggctagaaatcaactgcgtaagattggagttatggagatgctcgcttactttttggttaaaattagaaatattattttgcgcaaaatatttattttctctttccgtctggtcactgaaagtctctgaaaccaccaccaaagagaaaaacagttctttagagagcatcaaagctccgaggaagagagagagagacgctatggaagcattgaactaacacaactctaaatttctaatttacggtatattatctccttctttgttattgtttttgtttggtctgaatcggacttggatttagaacggagatccgacggttactccaactttaaaccgactttattttaagacattgttcgagtagtgttgggttttagaaggatctctctgtttgggatttgttgtttgactctgtcggtgttttttgtttgtttgttgttgtttttcattttggaaagtggattttgagtcatttagggttcttctttttcagtctgagttccagatctggtaatttcacttcataaatttatatggtaatcattgttttttttttttgttctttcttgattcttacatttagttatcattaggtttatctttataagcttattattagagttgattagaacaagataatgtgttactctccttttttgccataactaattaatgaattaaaagacttcttcattttgactattgtggtagactagtagttgccatattcacatactaatattggcttgtgttgtttcttgggcaatgcaggtttgttttagttctatacattatg

SEQ ID NO: 29318 - DNA, 3003 bp, Unknown; identical to SEQ ID NO: 21408
  misc_feature (1)..( 3003): 2750-1469P.txt file - cDNA_ID_3015321; gDNA_ID_1971889; Annot_ID_176838

SEQ ID NO: 29319 - DNA, 3003 bp, Unknown
  misc_feature (1)..( 3003): 2750-1469P.txt file - cDNA_ID_3015367; gDNA_ID_2684256; Annot_ID_193111
cgtggagattgtgcgactccataagccccgtgggattagggtttctatgtaacatcggcgcaacaaatctaaaactaggttccgtttcctaaacatcaagttaaaattccgattcctaattctaaaacctatgcgattatatcccgactaagccagtacaaagtttctacaatgaaacgggacgaatcaggtttttatcaatctctttgcttaaatcaacacagaaatggaaggaaacttacgttcagggatgcgaaaagcacgattggtctgagagatagaaatcgaagaagctcttgctttgcacagtgaattactcgagattgagaagaagaactcgtgacttgagaataggaaggaaggagggactatttatgaaataacataaactattgcttacttctataaattacattttgacacctttagttgtagaatatttatgttttaaacattttttttataacagacttacaggtaatttagtacgcaacaatgaggcagtttcatttaccatgaaagcgcaagaaaaaatatagacaaaaatatcattaaatgataaatgattaaattaataaattcgttaattcagtttgataattaagatagaaacatgagtgatcagctcttcctacgcggtggaccgacatcatctacttgttcaattgtttatcagtttcctatcaattgacactttcttatatgtaaaatgcgttgcttcatgctttgcttatattcattcccccacgaatacaataatatctaatattgagctacgttttaagtttacgtaccccctaaacctctaattgtttaaaaggtttcaaggttcaagaactcgggtttgggtcggattagagcgagtggatatattagtacctacaatatatactttctcttattggatccaaagctatttaatttggtgtcgtgcatgtgcaagttattttaggtgataatgttgaatttgaccaatggaaacatcaaaacaacaaatgggtacgcagagaaaaaccaaaacgcacaaacgacgtggctttcaagtggcatggacttttaaatttcatagcaaaattttcttttgtttggtcgccttagttgtttgccttagttgttttggcatgaacaatgttggctcaataccattcacacgtccttagtgttgttgaatggaccattgtttttttatcggaggtttcctttagttttttcttttcaactggtggaagttaataactttaaaattggtaccactttgatttttttagaattttgatcattatgcattctagtgtcagaagacacaacatggatgcttgaaacatatgtggcagaagagagtgattcaacttcctactatgattagttgaagcttgaagctactactgtatctttaaagtaataaaattgaagttatagaaatatgactgtagttgataaacatataagtagactatttttaagataaaaaatattagatgattatcctaaatcttgttgcatatcatctatcaacaactttgaaagtttgatttgtttctgagtaatactactttttgcagattttgtttctaatgacacaaaatatcattttagcaattaactataattccttttttatattgttctctttatggaagagaatagtagcctctgaattttctaattcaaaaaaatatcaatggtctatcacgaagtgttatactattcaattcaaaattaattgaatacttagactaatcaaggtaaaataatacacgcatttgactcttatcacgaagaaaaaaaaaaggtaagagaaaaatatttataacgggaaaataaataacaaacaaaagaaacgaataagatgagatttaatgattaacaatgatttaaaaaaaaaacattggtcaaagcacgaagtaagtcaactagtgccgtccatatgaatcacattggaccccaccatatacatgtatattttgttaacctctttttagtaaaatatctttaattttttgaacatttcaaaatgatgccaatttcttctctttagtcgtctaaaacttagttaaataacacttttaaatctctggagaagcaaatatatcttttaatgctacataagtcacattcaccatatattgtatgtaacgtaatttttagatttacattatgcaaaagttttatctattatcataaacttaccaactctgacacgaagtcaaactactctggaccggtcaacttagatgtcacaactgctcacctaattgttgccctcgcgagttaacttaaataaagtaatctaattttatggtttttttaaccaaatcacacgattaaaatttctaaactcacacatacttcaatatatataagttcaaactgtcaaaatttattaaatgttacccactaggataagttcttgagtgcgcaagtggtaccgtacaaattaaaagaaaagctaatggtgaatcaaaaacaatatttgtaattgtttactttttctaaggagaactaaaatgagttatggtttagttttagtcatatgagactcatctagtcgataaaacatcaattttgtttttgttctaaacgacttcaaagttcaatttttgaaatattcaacaaatgcggtatttttccttaagaaatttttgataaagactagtaacgtaatatatacgtttatacgggtcaaaattagcataatatgatgactcaatttcacctttttgtaattaatttttgtgtttgaggaaaagtctaataaataggaataaatctgtgtgatgttcaaagtttttcagttgcttggtctacgtgcgggctgctttgtgtttttttccaacttctctttttctcaaatctctttccacacatgaatttccatgaaattcatcttcttccccgataatttccacatcttctcgaggaacatcgcagaggacagtaaagaagcaaaccaagaagaccaagtggaggaggacgatgactatggtgacgcgtgtgatcatg

SEQ ID NO: 29320 - DNA, 3000 bp, Unknown; identical to SEQ ID NO: 15031
  misc_feature (1)..( 3000): 2750-1469P.txt file - cDNA_ID_3015371; gDNA_ID_2684256; Annot_ID_193108

SEQ ID NO: 29321 - DNA, 3000 bp, Unknown; identical to SEQ ID NO: 5343
  misc_feature (1)..( 3000): 2750-1469P.txt file - cDNA_ID_3015409; gDNA_ID_1620781; Annot_ID_50354

SEQ ID NO: 29322 - DNA, 3000 bp, Unknown; identical to SEQ ID NO: 5343
  misc_feature (1)..( 3000): 2750-1469P.txt file - cDNA_ID_3015409; gDNA_ID_2684095; Annot_ID_190084

SEQ ID NO: 29323 - DNA, 3000 bp, Unknown; identical to SEQ ID NO: 5343
  misc_feature (1)..( 3000): 2750-1469P.txt file - cDNA_ID_3015409; gDNA_ID_1620781; Annot_ID_167937

SEQ ID NO: 29324 - DNA, 3000 bp, Unknown; identical to SEQ ID NO: 14257
  misc_feature (1)..( 3000): 2750-1469P.txt file - cDNA_ID_3015413; gDNA_ID_2684095; Annot_ID_190083

SEQ ID NO: 29325 - DNA, 3000 bp, Unknown; identical to SEQ ID NO: 14258
  misc_feature (1)..( 3000): 2750-1469P.txt file - cDNA_ID_3015432; gDNA_ID_2684095; Annot_ID_190075

SEQ ID NO: 29326 - DNA, 3003 bp, Unknown
  misc_feature (1)..( 3003): 2750-1469P.txt file - cDNA_ID_3015454; gDNA_ID_2684095; Annot_ID_190068
ttggggagacttcaagcacaggcaaaatacttgcagatcaagcgatgtatacagtacattctacttcatcgttgctgtgataccttactggtcacgttttcttcagtgtgttcgaagattgatcgaagagaatgattcaagtcaaggctacaatgctctcaagtatttattaaccgttgtggctgtttgcttgagaacagcttacagctttaacagaggaaacatctggaaaatctctgcctgggttttctcggcattggcaactttttacggcacatattgggacattgtttttgattggggattacttcacagaccatctaaacatttgttgagagagaagcttcttgttcctcacaaagccgtctactacgttgcaatcgtgagaactatgaaaatcaaaagaacagtacaattcctgattgatggtttccttataagttttgtttctgcctcttcttctttgtaggtcttaaacattgtgttgaggatggcgtggttgcagactgtgcttgatttcaatttatcgttcttacatcgagaaacgatgattgctcttcttgctgctcttgagatcatacgtcgtggtatctggaatttcttcaggtaaatttttgaccacgacacgatcactaaattctctttaaaccattttttactcaagggttcttcctttgacgacttgcgaacacaggttggagaatgaacacttgaacaatgtgggaaagttcagagcattcaaatcagttccgttaccattcaactacaacgaggaggaagatcgagatagttaactcttagattagatctaatcaaggtttctccaaagagtggggtttcaattttgtttagaacttgcttgtctctgtttgtaatcattaaagagaaggaaatgagcacaatgaggcttcggatataactatcttacctagggttatcattgtgctcgctatcacaatgtgcccaaatcagatctcaaaccaaaattagtccataaaactaccaaacacgagctactttgactatgataaaccaaaaattacccttgaaatgacactcgagtaaactaagaggttattgagacagcgagcgtacatgacgagagcttcaaaagcttgtatagatggtttcacgtgaatatatttatccatttcgaatatatttagctgttgaatccaaatctaagagcacaaataaaagtgaatgagataatcctacactttgcaacaagcaatgacaataacataatttgtcaagagaagcatgagaatattgatcttgcagcatacaataatttgccaaaacagcatcaactaagtcttttatcattctagtgtactactaagaaagccaagattttatcctcttgatatccaacaaggagtaatcatattggaaaccatgaccagttgttcgaattgccttactcagtagggtttagccgctcaccgctgcaacagaagaaatgtggcagcttgactcgcccgcaactcctggaaacacaaaagagtgtgcacttaaactggcggcatatataaaattctgatacaagtgccctcacaatgagatcatgaaaacaaaagaagttttaaatcaaacatataccaaaaccgaacaactagactcatattttgtaccatgttgcacacaagtaggtctttcgtcaaacatgttaacgatacacagttctagttactcaagtgcagtttataccaagtgatagttaggagagacaatgaatcacaaagcatatgcatttattcttcagctgttgctgcagcaacaacaacctagataaacctaacagaatttttctatcacagcctcaaaactaaacacccataccaaactcaacctaatggatatattaagaagcatcaaacagataaaacaagaagagaagctaatctgcggacaaaaaaaaaaagaaaaagaagagaagctaatctcttacctgcaacggatgatcacaggaacaggcttaagagcctttggaccatttcttatccctctcttgtgtttagaaatctgcatgtttcatcaagaacagcttcaattaacactatcattctccaaggagccattaaaaattacacattttcattcacatgtgaacctaaaggaagtaaggaaccaaatcaacttaaacccaaagatacacaagcaaatggaaaaacaatggacactcaaaaacacacaaagagacaacatttcttagatagattctatagaagaagcaatctagcacttagtatctcaattgcataatcaactaataagtcctatagtgcaccttcctaaaaccctagataaaccctgactccgtcaaaaaagctaaccctagataccacaataaatcaaaaccctaagaaattttatcatttcagaagtggaaaacgaaaggagaaaactaattaagggactgagagttctttgaccttcttcttaggcacagccattagctccatggatccattaaaagcaaaactaggaagcccgaacccgaagctcttttcttcgatcaaacccggttgattctgatcgaactcaggtaaaaccagcggcggcatagaaatcgggcgatcaaaagctccgttcaagggggaaggcatcgcagcgacatgacttaagcttcgggtttccaaaatgcgacaggactcaaccgcggcgcgttttagcgatgtcaatctcaacgccattgatgcagtttctccaaagctatagctgacggaagtgaagactagtagaagaaacccaaaagaggtgaaaatttatcaaggcaaatgtatttacgaaacggctgcgttttgacatacgaaccatacaattgctctgttaaccgattttagaccgtaatttagagtgtgatgtacccggtttaattcatgaaccatgaggttttatcaaatcgagccatttctgaaacccttgtgtcttcgtcgtctctggtaaaacaataacagatcaagcgaagaagaaaagtgaagaagctcagcaacaatg

SEQ ID NO: 29327 - DNA, 3000 bp, Unknown
  misc_feature (1)..( 3000): 2750-1469P.txt file - cDNA_ID_3015478; gDNA_ID_2684095; Annot_ID_190062
tctttcattttctccaatgcagcaaacaaaggttttctcttagtcttttgcaaccactgtcccaaaaacaaaactcaaaagctaattaagactatcaattagtggaggaaacttcaatctattatttgacatttgattaccggaaagatcaaaattagaaaaataaaggaaattcctatttcaaaggaaagtccttacgttattttaatttgacatttttttatattgattataaatataaaagtacttacgttactaagccgatgaatggaacgttcaacgatcaaagaaacaaatacaaagatagtcaatactgtagcaactgaccaagttggtgttaaacccaacgttctctcgcttggttctgtttcttctctcatttcttcaaccgaattctttatgaacaaattttcagatgtttctttcttcgcgtgcaagaaaccaaattagctctgtggttcaaggtcgtatcgagaaacttttaaactcttctcatgccaaaatgttacaagctaatgacacaccgttgactttatctcagtgcctttcaccggatataagtcctttgcatcttccaagaaaaactccctctatcatctaaaacggccaaaacagaaatttaattgcagtaaccaatttaattggaaaaaaaatataattgtttttgtaaatatatatgaaatgaaaaaataagataattttaaaagagtggataattttctgttttgagatttcttaaacaatagtatatctacaaactttcattaatgaaatataattgaaaatatagaaaatataaaaatactatttccctccatttcacatgattcaaatcttaatataacgatataaccagataaacataaacaaatctagatttggatccccattcctaaacatgaacctccaaatcttcggattgtggtttctgatttaaaacttcaaaacccattcaaatttctcaaggttggatattgtgaaccaaatctttattaaactaagaaaaaaaatgtgaaccaaacgaaaaaatggatccgaaacgaactggctttacatattcaatctatatgaataactgatcctaaatattcaaggaaaaagaagaaaacaaatcaaacaaatgacaaaaaaatccaagaacttacgggaagagaggagcaagcgagctgagccgtcatgtttacatagagagaagggaagtctttttgaagcaaatgtttaaggtaggaataatgcctcaagtctctctctctctaatgcaattatcagaatatatcttagattaatattagatataagtatttattaattaagagtttacatcacctcctacgactctggttaattatataatgaagatttggttcagttaattaaaaacaagatgtggactgacagcacacttataggatcttgaggaatctaattggaaactactggataaatgcatgtgtaaagacagaccacttattaataaattaggaataataaatgattacaaaaaaatagtgatcgataaaattagcttttctactttctaagtattttgttgttggtgttgttgtatggtgtgtcattggaagaatggattaagtattttacgatagtcttgacggtaaagaaacacatccgaatatgcctacacatttggtggtacaacagcttattggcttccaaaagtgtagaaggttgtaacttgtaactttattaaatgtgaagttgtaatgttgttgcggcttcgtgtactatcgggtaacgtgacgaagcttttgatatttttaaaacgatttatttcatatgttgatgttatttatttcattctaagttacagttttgtacgatatgatatatgatatttgcttctgttaggacatcattggtccttcttcacatgttagattgtttttcataatttcatgtctatggcgaactggcacgtataataaatttattcgacaacccgatgatcaccacaatttgtattttttcttttatgaacttctttttaataaaataaaaaatgttataacgatgcatacgataatgtcatgagattatatgaaaagaatacgtgctactagtgaaaaaacaaagaatatatacgtgccactaggtgatcagtaggtgataatctagttgaattgacttatcacttgtaatttgataaaagttgcaaaccgaacattatggagtaaatttcgcattattattaaagtcaaccccgggaagtcaataagaattgcatggtgccgatgtgccattttatacttttgtactgcatgattagagatcacaaagaactagaggaagctaagcgatactattttactgtttcaatgtatgaagaaatcttttaccaaaataaaagttgtgtgaaataagtaacaataaacgttcgcgatacttataaggatccttccaaatttcaattgattttcaactttcatgttcttcaatttgacagcataattatgcacataaagcaaggacaggaaaaattcaagcacatactggcttagcttccgttgcctagttataattccattgaaaatatcctcaaattttatttttctattgaaaataaattgggtatacaaataaaagagaaatcaaaacaaaggccatgtgaaagataaaaatgatagacatttaaaccatccttttaggctgtttaataagtgccaactagacttaaaacaactgcttatactttggaatccaataattagacacacgtaaatagaatttagctttgcatgtgaaactaaaaaaaataacactatgttgtcccgacatactaaaagtcaaagtcagcgttacgaaaactctagatgagaaagagagtttcttcgacgtgtatttcacgagttaaaattaaacacgtgtcataagctctcttgttccattgtacgttgttgagttcttcttcttcgtcttccatctctctaccaactccacgatcaacgaaaccaaagatctctcttcaaagcttccaccatg

SEQ ID NO: 29328 - DNA, 3003 bp, Unknown
  misc_feature (1)..( 3003): 2750-1469P.txt file - cDNA_ID_3015486; gDNA_ID_2684095; Annot_ID_190060
tgaagattatatagcatcccaagttcgttcatagttctgctcttgtttctttttagccagtttgattgagtcttgaaaatcttgggcgtaaaatagtaaaattaaaaagtaggtgggcctttatgcaaggtaattatattacaaaggacttgaaattaaaaccaaaagtaagaacaaaccggttcgcatggtttaaataatctgtgctcgagcggtcaaattgtaaaaccaccaaataattcttcgtctccctcaccgtcgcggcgtcgccactcgccgtcacaaccaccgtcgttcaacatcactgtcaccaaaagaatcaccgtcgttcggtcgtgacgtgtctggacctatttcatctctttgctcgtgactcgtgagtcaaatactcttggacctttgctgttatctgtacctctaattttgtgattttcagattccttctcgtttatcgagttggattctctgtatttgaatgtatttttgatagggtttcgtttggaaaccaatttgattctcatatttaaagtgtagttacgtggtttgtgttctctcttggggatgttcaccacctgttcgatgaaatgcttctacgtattagtttgatgcaatttctgtatagtttcgacgctctccgagcttgtatttagatattgatggttaggtgactctagattctgaaacgaacatttcaaggctctagaaacttattctggactaagtttatcaaataaacaaggggatggttagagccttaagcttgatatgtttatgttcgcattgcagtaatggaggagggacgtcaaaaagacttgcaattgttggaggagattatcgacaaaggtttgaaacagaagcttgtacatgcaactgcttcacggtatttatatttacttccttttcagatcaaaattaaaattgtgagtatgatattaaagtgtatgtaggattagtttagtttgttttctttgcatgctattcactttttgtttgaggtttcgattcattgtggtctctgcatttgttggttttgcagggacaagatctttgaagaacaaaaaacactgtatccttttgtatagggaagactctagcttctcgtgatgtgcatcatcttgttaagctgatcctaagtgttttgttagtttctcccatgtcttaaccctatcaaagatgacgggttcatttaccagtcagtttttgacttagttttgtgtttctaaatcgagaggaactcttcttggtgtagttattgacaatactttgctgttctagtgaaatctaattcggttgaaatattcttgtttccttgacggttactcccactccagctctgacttgcggaaaaacctagaaactctggagaagaatggtgtaaatagtctcaaaacaagggtcaaccttggttcagaagtttacatgcaagctgaagtgtacgttacttatagctttggttctttcgtttaattttagtcaagtcatttagctatgaaaggtcatgcattgtctgcatacaatgaaatacactgtctccatacacagcttaatgcaattaagaagtgtgcttttactgtgttctgtatgttagaagctagttatgtattattgagcagaaaacgtttaataaatggggattaaaataggagatgctttctaccaggtttgcttctgatttcgtttcacttgacttgggtgtttgtttgagttcaggccagatactcggcacatattcatggatgtaggcctcggcttttatgtggagttcacacggcaagaagctcttgactatatagcacaaagggaggaaagaactcaaaagtaagagaaatctttgcttttctagttttcttgctccatgtacaaggaaaatatggttgtatcattgtatatgatgaatgagttctccggtggaatgcagtatagtgactgaatgttgatgcaatataaatgtggttttttttgtttttaacagacaactagaagagtatactggtgttattacgcagatcaaagggcgcatcaaactggtaagttcaagttcttatcttgctttgtgatagtagtcaatcatttgtcttatgaggttgaattggactagaaaatcactattgcgtaggaaccctgcatcagacggatatatgaaagtgtcatcggataagtattaatgttaaattaccattgcaggctcattaccagattcagcaaatactcaatcttcctgaagagaatccgtcatcccggcaacgtgcgttttagtacactacctagtggaaagttgaggattttctcttgcagtcttatcttctcgatttgttctgcttactgttttgagtttttaaagcagagaattaacttagtttgttcaatactaactctttctccggaatggaccaaactgttggtgttagataaacatatcgattaagcaatcaaaactttatagaatgactattgttgtgggggtgaatagtgaatcgcactctgttaaatctgccatttctattttaaatattaataatcacatgttagaacttagaagatcattaacagtttaacacagctgatgaagaatgaaataaaagtatgaacgaaacagatacaagataatgatattccacgtcagcaaagtgtccaaatatcttccgcttccctgtcttcgtcggtcccttttcggttttcacggtaaggctcggaggaaaacctaattcgtccggagaatctccacctcactctcgccaaacgcatctctgttgtaggtaagtcacggatcttcattctacgctaattgttattgttatcgttattcttgatctgggcgtttttgtggaatttgcatctaaaattagaaatttggataccaaaatccactccaattgaataaggtttctgaagaattttcgtttgattttgagatcgaaaattgcgttttctcgtttttgttttgttatcgctaacgcatcaggtcatatatctcaagtttatattttgtggcagcttgtgatg

SEQ ID NO: 29329 - DNA, 3003 bp, Unknown
  misc_feature (1)..( 3003): 2750-1469P.txt file - cDNA_ID_3015490; gDNA_ID_2684095; Annot_ID_190059
gaagcttgttttaagcaactctttacatgatattcattgctatttgcacgattcaagagtgacatatacattttatttaacaataacagtgtaagatatgtgattgaatacttgtggaaacatagagttacacaggctgcgatagtattcgacattttaactggttttgacattacacgattttgtattccttgcacaaagtctggtaaaacagtaatagcaagaaaaggtcaatgctttcctttgttgaggaactggaattagtgtatttgtcaggagattattctactttgagaatctgatgatagtaccaagccaatcttcaggaacactatctctcaaatcaccgtttagtgctctctgtgaatgagttgtcgcagcctgtttgaggagattgaaaaaaagagcatgatggcggttaaaagctccatctttatctaagatatttagttggttaaaggcaaaagttgtctataatctaccttcacaatgtagacatcgactccaagttttgcaatcatagcagcttctgatatcttcgtttccattccaccggttgtatcgtgcgccgcaacagagtagtcaactgtttgattccaaaaatcagagaggtttgaacttttaacaaatccctcagacttattgtattgcatagttttacaacattggttctttcgtttacctttcttgtctgtgtgctccaacagtggattcacaaccttccagcttccatcttctccaacagctgcatgaactgttagtatcaggccaagtctggaaaagatataaaaaaaacaaacagtaaagtttgaaactaaccgatctctttcaagagcacagcgtcgggctctgaaggtgaaggtggtcgatcgtagacacctagtacatctgtctttgtaaagagttactcagataacaaagaatatataggaaagagggagagagaacacaaattaaatttccggtttatactatgaataggatacgagaaagacaacatattctggcttcaaatgatctgcaagatgacggatgataacatcaccactcaatatggtgcagccctgttcaggacaagattttcaactgttcaaattctaaacggacaagaatctagatagctatttggtatctctggagagcatattaccagtatattgtccagcactgcatctccatggagaacctggccatgacaaaaattactgtccaaattacagtcaagagactttggtaaacatctacctaatttcactggtgggatcaaaacttacagggacaaatcctgagtctatggttttagctacggttgctagatctgcagaagccacctaatgcaaaaagcagtctcattgaaatctaaacccacatgcttcagatcaggaaatatgttaagaagttcagttagctcttacatctcttttggaggttgaccaaccacatgaaaatggagacatgcctatcgtaggaatgccctctgcaagagatcataatgtttagcttcaaaattcatcttttcctcttagccagagtaggaaaagagaataagcttaagagatacctcgggctagtgctcgtacaatttcaagattaagatttgtcacctgcaaaaagaagttgtagactatcagaacagctcaagactatcttacgtaagagcatcagatttagctaacagtctcacagatatacgagtagcaacgaaaccagctttgacaataggtttctcaagtcctcctttgtgaaccccagatctactggcctgaaagtgcccaaaggaacctaatgacaaaaatcagaacaacacataagaaacccaaaaactaaataacagctcaactaacacaagcaggtcaatgatctgtaagagctaaatcaaaaatgtattttgatccttcattataagatttaagcagataagaatcaatctccaactaaccagcgccatgaaccacaacaaatttactaaactcagaagacttttgatcccctatgtcatccacatcacaagaaatctcagagcttccaggtctcttgctccaatccatgccaataaccttgcttggagctgaaccctccaacatagcttgacgtaactgacacgccacgacctccagattttcatcgtgaatcttctccagctcgtttttgcaagtaattgccgcacctcctatcaaatcatttagacattctgctgttacaaagtctagacaggtaaaattgatgggaaatgaataaaagacagatctttaaagtctttcctcatcttcggtattcaatagtcaaatcagaatcaaacccataagacagaacaactaaaatgcgatctaagaatcgatccagcaagtattttaatagggatcaaaagacaaaccaagtttcacaatgcaacgaattgatctgcttcgactctcggaaatattcagctccattgttgcgtctctctctaaagctctcgtctttagtggtcaacggtatgtctctctctcccgctctaactcaacttcatcgtactcgtatccttcttcttgccatttcccattcaccggaaagattctctctttttttttttttttttttccatagaaatattcttctttttattcctctaaagaagcccattaagctattattgggcctaaccaaattgatcaattttttcaaaccgggtttatggtttagtgttttaaggtttcagttaaattagcggtttagcttcaagttcgcgatggagtagaagaagattacctccgacaaaagcacgttcacttgtgccaccgacaaaattggaaatcttacattttttgttttctctaatcaaaattattgttggaacgtagacaagatccgttccaagattcgtctttttttttcaatttgattcctgggttatctgaaagatcttctctttgcttcgatttctatctccgctgcttgtgaaatcaacctttatggtatgtaatctcgaactcagctaaaacacacttcactctcggaaacatg

SEQ ID NO: 29330 - DNA, 3000 bp, Unknown; identical to SEQ ID NO: 14252
  misc_feature (1)..( 3000): 2750-1469P.txt file - cDNA_ID_3015494; gDNA_ID_2684095; Annot_ID_190058

SEQ ID NO: 29331 - DNA, 3000 bp, Unknown; identical to SEQ ID NO: 14265
  misc_feature (1)..( 3000): 2750-1469P.txt file - cDNA_ID_3015578; gDNA_ID_2684096; Annot_ID_190127

SEQ ID NO: 29332 - DNA, 3003 bp, Unknown
  misc_feature (1)..( 3003): 2750-1469P.txt file - cDNA_ID_3015582; gDNA_ID_2684096; Annot_ID_190125
tgatggctgaaaaccatgtgccaggtctctccaggagcatcatcagctgtgattttggtgttgagaaggcattttccagtgtaaggctcttttggtctgtacctgttaacaatcacaccttcctcgttcttctttgacactttctctactttctttgcaggagtaggagtatctgtttctgttgtgatttgtgcttttatggaaaacactcttttacctgtcactacattgttgcttttgtagtaaaaagcacccttttaaacacacccaacaacaaaaccagagagacctaatcaagatcccatcaacagtacattgatcttccaaaagtttttggtcatatttgagaaaacccagaagcacatttatccaaattccaaaactttacttaacatgttacttacaagacccagaagattattagcaaaaccataaaagcagagcatctctagactctcgactacacaactttttttgtgggatcttgactttatcattatccagttgagaaaagcttataaagtaccttagtaaacctgatcctttcaggagcaatggcacaacttgtagcgggaaaagaagaagagtttgaagatgtgagagaaacagcagcattcatggtagtcgccattgcagagcaaatgagatcaaactgagagaaaatatcagaggaatataaaaaggaatcacaaggagaaagataagagaaggattacaagacatttgtgtttgggtggatgaggttttaagaagagagtatctcgttcatcaaagttgtggttatcgttatttgacttgaggaagctatatatctcttttgttttttttcctctaaatatcttgtgtgtataaaatacgaaaatcaactcaaaacataagttttaacacatgttttttttatattaaaaccccataattatattgttttttcattgctttgcacttttttattttccagaactattttaccctcaattaagtttcaaatctcattagacacaatccaattgtatttaaaattttaattataaagcacaccaaaaatatgatgtggtcaagctttatacaagggccctttcctttaaatatactttacaatgttttatttttggacaagatattatcacccataactttcctacctgatcaaaattatatcatattttaccatttcacttttcaatcaatgcctatatatccacatttgcaaaatgatgaatgtatatacaaaattgaagttgtggattgttttgttttagggaatctagtttacatatggagatgatgtcacttccaagagagttggtactatccaacgctctctcttgtttccaagatgtttcgtctatcggttgcatcacctgaactatacgcgagacggtcccttttagactgtcccgaatgctatatctatgttttcatgttgaacctcccagctaaactcagctggtatgttctcgaccggaaaacatcaggtcctagtacagctaagagctaacaatctcttggtggctgttcccttgctccacttacatagttatatgtctctacgttcaagcttagccgtcgttggttcaacaatctttgtcatgagtgcttgtctgtattgctcatggactgcccatctaacatgtgtgccacgcagatgactgtgtctagtagcatagaaaaaacttgtgtgtaccccttgattgtgtcgaataaaacagaaagctcaaagtttacatgaattactaaattgtttctctttaaaatccttaaactatgtaccatatatgcatatgggattaagataattactacgcaataatcgaagtctaattcagggagactaatccaagtaattcacaatcttgattaagagatcattggtagttagaagtttcagtgcataacagtttctcaattggtcaatgtatttactttattgtttcggtcatctccacaaggtcgtcaaaccatatacagatatactataaagtagtataacacaaccaattccataaatctcttttctcaatatgaaaaacgaactagattaactacaaatcaacaagagtttggattaaaacaaaaacaaaggagatttgggaaagaagaaagtttatcatcagagaggagtgatcggtacatcaatcggccacaaaaggcctcagacgaccgtcgtgagaattttagatcaaatctcatcacttgaatttaacttcttcacatcaaaaaatcgattactttagcaaagtaaaacaatatcaaagatgaaagctacaaaaacacgaagaaaaaagagacgaatatagccggcgattatgggtactgaagactagtttgcctttttatataggatgatggagcaaatctagggtttagtttgacaattaaagcatacgacaccgtttatttttaaatgggctcgtctatttatctacatgtctggcccatgtatgactttactagatctagttctgaaattgaaagttataaatttttgtatagattactttcttcttccttatttttaacacacaatttattatatgaaaacaatttaactacattaatgaaaaaaatacaattttttcaataatacaattttgcataacgtgctcccatatctctactctacaactgggaaaaaatatattataaagcttgtttttgtatagacatattcatgtgtatacaacatgtcaacaacatacattggcaatatatgcacatgcatgctccaagttgctaattaaacactgaatctgaaatctgaaattatgccaatctaaaaacctttcggcggtaaattttgagtgaataagacaatgtaaaatgactaagataaaaaagtgttaggtggggtgaaaaaaaacagagaataaaaacctcgcaagcgagggaagtgatgaataacagagacaattggttatattagctgtcactcccatctttcatattccttcaccatctctctctctctcgatcttgtgaaccactacacacactaacacaatg

SEQ ID NO: 29333 - DNA, 3000 bp, Unknown; identical to SEQ ID NO: 14269
  misc_feature (1)..( 3000): 2750-1469P.txt file - cDNA_ID_3015586; gDNA_ID_2684096; Annot_ID_190123

SEQ ID NO: 29334 - DNA, 3000 bp, Unknown; identical to SEQ ID NO: 14270
  misc_feature (1)..( 3000): 2750-1469P.txt file - cDNA_ID_3015592; gDNA_ID_2684096; Annot_ID_190121

SEQ ID NO: 29335 - DNA, 3000 bp, Unknown
  misc_feature (1)..( 3000): 2750-1469P.txt file - cDNA_ID_3015609; gDNA_ID_2684096; Annot_ID_190116
gaaccaaaagagccagttagcgagaaatcgcgtggacagctcgtggttgaagtcgaatataaaccttttaaggatgatgatattccagagaacattgatgatccaaatgcagtagagaaagcaccagaaggcacaccttctactggtggcttgcttgtggtgatagttcacgaagctgaagatctagaaggcaaatatcacactaatccttctgttcgtttgctattcagaggagaagagcgtaagacaaaggtatatataaaacttctcttaaaactcaaaatggaaacatatgagaggacatcaaattttacacattttggtttgattttgtagcgtgtgaagaaaaacagagaaccgagatgggatgaagattttcagttcccattagatgagcctcccataaacgataagctacacgttgaagtcataagttcttcttcaagactaattcatcccaaggtagaaacaaaatcagatctctctttaaagattgcatcaaaatcgtatctctgagaaagcaaaaactaacattttgatatatgatttgatcaggaaactcttggttacgtggtgataaatcttggggatgttgtgagtaatcggagaatcaacgataagtatcatctgattgattccaagaatggtcgtattcagattgagcttcagtggagaaattcttcttgacttcaaaggttcgtgttttcttctcttagggttcacgaaacaacactttttgtttgccttccttcctatgtacgtaaaacttctatatttgttgcatgttggttgctatggctcgattcgaagaataatgggttacacagtataatgggccacgtataagccttatagttcatatggattttattgtttggaccttttggtttatttcttgtgacattttctgatagttttttttgtcgtttctgaattattttgcagcttattggattatggcaatagtgattatggattgtctttttcatctatttcttagagaattctggtcagtaattgaattattctatcaaaaaggaaaaaagatttttgaacagaaaagaagtgaagttagttaataaagagagattggtcactggttggtgaatactgaatagttggtaagctactaagcttaacttctttgatatcatgatttggttaattcatacttttcgtgtacaatttagtggtttgtgctactatcattgaatgtgattatttaaatccaaatccacatgataaatgtttattaaaaaaattatgagtggttaaattaacacataattttgtacgatttatcacggtcatttgataaatatttgtggataactttattacatttctaattttcattattaaactcagtaagcatataatcaatataagcaatttcttttttggtcagcaatatatatatatatatatagtcttatggaatgaaaaagttgaaaataacacatgatggcaattagctactaattcatcaagtttgacaaataattataagaagctaccgtctggtgtgattatgattaggtgatgggacaatcagtgacgtggtggatcgttagtggattgatttagttagagttgggcacgtcccattggactctagtcgcctatgtttcgtaatccgaggggaatcgaaaagagaaaataagtaaaaacatcataaataagacatttatgaatcgtgccggcacgttcttgatgagtgagagttgccaaatccaatgattaaagatttcattcatgcctcttcgtattttgcttaagtctctctcgtatgccattttttttttttttttgctatactataaagtctatcttagatcatttgaatttacctcccttgatacattacatacgagagaactggcagttgtagaagatgttgtgaatgggagtcttataactggatatgcggattcaaattcgctagctaaagaaagtttttatttgaagaaaatctatagttttgagacggtataatattttaccaattactatttgtaaaataatcgatacatggttaaactaagtaagataacaacttttagttgttgttttggtgaaatgataaacttctatggaattcttatcttgttttggtaggtaccaagaggattagacagataagcgacttcgtttactgctaatattgataatcaaaacttcgttagctatgttttaataaagttgtgaacaaaaagaatgttatggaaaactgctcaaaactggataagtctcatgccagtaagaatcaaagtggcagtgcaagtccaaagacacaacacactaggattttgaaacttgcattgttcagacaatatatgatagttcaaaatattaccttactaagatttctctaggcttcatgtcaatgatttagtccaaatttaagagacaattttaactcaaaacaacaatgaaaatatgtatcacaataaaaaagtgttaaacgaaatatattattaaaaacatttaaaaactgttgagaaaccaaagagataatacaaaaacattcatgacaattgtatttttcttgttgtttaaaaaaaactgacagatcttctccatttcaaaattcaaaatccgtgacataaaagaaaagagactttcaaaattttgaaaaaagaaaaatagaggtgaaaataaaaagtataatataaataaaaggggagtgagtgtatatgataaggaggtgtttggtgctgttctcttagctgtctcagagttgttgtttttctactagtcccctcctcctataggctcctctcaaagtcatctatcaaccgccaaatcaaccttcttcttcttcttttccttctctcttcgattctttttcgaatttgggtgattctcagattcacaagcttttagagctcgaatttgattggcgagctagaaatgtcgaggttttgaggaagaagcaaccacaaaagaggattgattttaagggcttttttgtttgtttccgatcttgcggcagagatg

SEQ ID NO: 29336 - DNA, 3003 bp, Unknown
  misc_feature (1)..( 3003): 2750-1469P.txt file - cDNA_ID_3015612; gDNA_ID_2684096; Annot_ID_190115
aatcttaatagaaaatcacatcgaccatatgtaactgtttaatactagaggtctcacgtaagacataaacatttctctagctattctatttcgtcaatgtagtttgcaagatgatcatacacactgacacaagtgattatgaggacctccctgttttccttattctagaaaaaattgggtcccaaaatcatacaacgaaagacatgctatcaaaggatctaacctgtaagtgcacagtgcatgttggacaagctacttctttcatccgcctcccagatccttccctcaaacctgttagaatcatagctatcattgtcagcaaccataaaataccagaaacaatatatcataaacataagtatattagatatgaaaaattaccagacgaagacttgcggtttctctccatttcctcctgtatcaaacatatccgccatcagaaaacaattatatactttgcccaagatattaactcaacttgtaaatcattaaacttaataaagaaccaaggacgattagctcacctgtaactttctagcaaggtcttcatggctctgcaggctcacattcctgccagtggtttccttggcattactcaacctttgtgacacttctgcctgcacatccagaaacagattgaacttagaggcatacgcataaaagacaagataccagttcaaattaacttaaagctacattctcaggaatcaacggaacatgatttctcaacttaaggaaaaataaacagacagataagcataccatgcaccggtcacaaacacggacttgaggagcattatcctcagcagtgagagcaatcctgccttgagtacacttgtcacagaagacgtcaccacaattcctgcagtggtgctagaaaataaaaaatccataaggtttgatagtcccaacatggccaaaaatttaattcagattgttagatcggggaaaataatacccttcgtataaatgcaccgaaatctgaaccacatgatgtgcacttagaaacagcttcatcaggtacctaaagccaaaaataacatggaatgagaacaacataccacagctaagcaagaaaataagaatcaagtgatgtaactaatcaccaaaactaccctagcccttttactttgactacaagagaaatgtgtttttcttccaaaaaaaaaaaaacctacccaatgatctttctcctcattaacaggctttataatgttcatccaatcacccaatccttttttcttctcagcagtttgttcaatcagttttccagaggtgggaggcctgctacttcccccgatctccttggcctaaaacccaccaacataagaacattggattagtcaaaagaaatcatgatggaattgacatatagacttttaatgaaacaaaatttgtaaattttatgaacctgaaacattgcagccgtcacagtgtccagaagggtgttggtggtgtaactatttgattgcaatctgatacgtttagcttcaatgtctaccggagtcttagaccagaaagccagaatagacgaatctagtttctgatagaaagacatttacaacaatagataagacctccagtcacaaaaatggaacaaattcagtcataagaagaaggtagataatctcttacttcgcatcttgtgatgttctcaagaggatatattctcaaagttcggctagtacttggatcaagcatacgaagaccatccaaaccaatctgctagcacaaaaccaattcactaaaactagtttaggtaacacaaagttcaaattgaattggggacattacctgacaaagaacatctgttgtggtttgtccataagtctcagccaacaatttgacacgaaatttctgcacaccaccagtggaatcttcctgcacatcagccttaggaacagctctcacgatcttagcagaattcgagctaacagaagaatctctccctgaagaagaaaagctaatggatcgtccataatcatcgaacaatgttgaattcgatgatttcggcgcagttccacgagaaccgtatggctcaactttgcctccttgataagcataaacgccatcgccataggaatcttcaaaagcaggatattctccgctatcagatcgttttccgtatagatcagatcctaaatccgatctgctccggttataaccgtcataaccagattgatcaaatttcactgacggtttctcatacgaaggaggtatggatgatcctccgctactataaggaggtgcagagtacaaggatgatgaataaggcgcgggattaggattcggcgcaggcgcagatgaaggaggaggcgcagatgaatagccagaggtttgatgctgatcatacggtgagtaatacatatgttgcgaggtaggttgctgatacggagcagtagaatcaaatgatccataagaggatagaggttgtggatgaatcgtgggtggaggtggtggttggttgaaggttgaataagaattagggtttagtgatgtcgccggcggagaaggaggaggttgtgatggtgaagtgaaggaaggagctgaaggagggacatgctcagagttttgcccgtaaggagtgtaattctgtgaatagttagagtaatcggcggaaccgtaaccgccggtgaacggtggcgctgatgcgtacgtgtttcgagtaagatcggtcggaccagctacggttgccggcgccggcggagaaggattgggattaggattaggattcggagtaggattttgaaattgagagtattggtggtgatagtacgaattgtaatctccctgttgcatcgctgaatcggtgatcgtcggcgatgatttgatcagattatatcggaaattggaaacgatgacgaagatgaagatgaaagatagatcgagagagtcaagggaatatttggtgagggaaggattgtctgtgccgcgaacttttttgtatatttaataataatacacgtggcggtataatgaaccgttgattagaagtaagagatg

SEQ ID NO: 29337 - DNA, 3000 bp, Unknown
  misc_feature (1)..( 3000): 2750-1469P.txt file - cDNA_ID_3015615; gDNA_ID_2684096; Annot_ID_190114
caagcatcatgcttaaagagatctttctccagctgcctaagcaagaagttaaactggggaacggctaaaccagtcaacttcttgcaagaaattgcttatttaaaagtagccagcttttgcaatcgcattgatcaattcaaccaaaaacttccagttgacaaaaatcatgtagacgatagtttagtaagtggaaaccatgatttttgattagtgtcaaaaatacagagatcgttcaagtatcatagatcactgtgattgttacaatgataactgtacaaagctaaggcctaaggctaagctgagaaagaacaaaacaatatgggacctaaaacgggacagtatatggtaatgaaaaaattccaacttcagacaataacatagctctaggcaaagaggaacaatctcttgacgtctgcaagctcatgatcgtgtcttcatcagtcttataagaagacttggcagaagaaacattttctttccgacttgttccaaaaagccagtcatcgctgctgctatcatcttcctccaaggaaatacagggaggaactaattcatcaaacaatgaattgtaccgggattctttgctaggcttatgtttctttctcttctttgattcggaaataattgctaccttgccactctcaagagaagttgagggtacagccacatcatgatcacagatacttggaagagagacagaacttggtaattcgctaggtctctgagtccctgaagtggaacaaacaggatcctcttgaggtacagcttcagcttctttcggtttcttgaaaacaatacgaatccgtagtggtttaccagctacaggtgtagctgcaaatgattaaacgtctctgtttcagtatatgtattcaaacacaataaagatattcatctaatccgggaagaaacaaagcacaaacctttgatttgactctcaacaacagcaggagaagtttcccttcttctcttcttactgttctggctaccatcagacaaatatccaacctgaggttgctcaaattcttctgttaaacaagatttctcaagctgttcggattcatatgagactgtcttggttgtggaatacttctgttcaagggatttcttctctttctttaatttcttttctttctttttctccttcttctctttccgatgcagctttttagaatcaactattggtctttcgatctttataatccaatcagaataaaggatttagactagaggaaggatttatcaggcaaacaaccagatacccatatacgtgggtaacatcattcaaccacaaacacacataatgttaattactcaaaacatatatctacaacgcgtctttatggttgactttataattggagaccaaaccaaactaacatacatgtctacacgacatcgttaagaacgaaattcattatgctaaaacatgtatagtgtagattcaattcatagatctatgctgaagatattttcctacaatttaaccaatcaataacttatatgcaacctagagatctggctacaaagaggatattataaggaaatttaactctgaccgaacacagaaacccatgttcagacaagaggacaccgtagcgaatcaatcacaagaattgagtgctcgacgaaccttagtccattcgaccaagttttgaccgttcgcccagttcctcgcatacacaggcggtggggatgtgaaatatcgtgacatcgttttttcttcttctctttctttctttctcagatcgaatcgactaacggacaagacaacggacagtaattcggacagaactaaatcgaacctaggtttcagattcgcgcctaatgaaacttcttctttgtggcgcgaaatcaaaacgaaatcgataacgagagacggaagagagaagaaccctaattttttttttcgattcgattttgttaatcgatgagagagagagaaagaagaaaaaaaccaattgcggttgagaaaataatggtgaagggtaaggttctatttaaagacgcgtgaaacactcagatccgccgactcgggctatacttacgtttttggaaagaataatgtgaaaaccctaatttgtaagggctattccgtcaattagtcgttatcatctccgtgaagctcggtccgagtttgctacgtcatctgaaataccctttttatcctttgcgtctttcttactccaaactttattattgggcttaacaaaaactacaaaagcccaaaacccaatgttaatacgaggagaataattaattttaattgactttgtgattaatgggtctcttgtccgacttggttccttacgcttgcatagaaaaacagctacaattatctgtgggcatcacgcgttaaaaaaccatctcttacttctaatcaacggttcattataccgccacgtgtattattattaaatatacaaaaaagttcgcggcacagacaatccttccctcaccaaatattcccttgactctctcgatctatctttcatcttcatcttcgtcatcgtttccaatttccgatataatctgatcaaatcatcgccgacgatcaccgattcagcgatgcaacagggagattacaattcgtactatcaccaccaatactctcaatttcaaaatcctactccgaatcctaatcctaatcccaatccttctccgccggcgccggcaaccgtagctggtccgaccgatcttactcgaaacacgtacgcatcagcgccaccgttcaccggcggttacggttccgccgattactctaactattcacagaattacactccttacgggcaaaactctgagcatgtccctccttcagctccttccttcacttcaccatcacaacctcctccttctccgccggcgacatcactaaaccctaattcttattcaaccttcaaccaaccaccacctccacccacgattcatccacaacctctatcctcttatggatcatttgattctactgctccgtatcagcaacctacctcgcaacatatg

SEQ ID NO: 29338 - DNA, 3003 bp, Unknown
  misc_feature (1)..( 3003): 2750-1469P.txt file - cDNA_ID_3015630; gDNA_ID_2684096; Annot_ID_190110
aagctaagatctgaagatgaagaaggagaaggagaagaagaagagagtttgctacatgatgttatgcctaattgatcttctgcttttgtccgagtctctaagtaggagtttgttctaaatgcttccttgtactcttcattaacacttagcttcgacgtcaagctacgacaacattccttgtcggactttcctgctccattgacaaaacaacaatttagcagatatttttacaatctttttctgtttttctaacaatgaagaaaaactatctctggttaattagagaacaaatgtataaatttcagaagttaaaacatttaaacgttctttgtagaaaaatattcaagattgaacaagttaagagaagaagagaaacaaatcattcaaattttttttttgatattttcttgagtaaaagtagagcacagaagaagaaaacgaaccttttcttgtagggaaagactttaatctagaaccaagaaaattcttcactttcaacatcttcgatggaactcaaagagagaggcgatttaggtgaataatagacaggcttcttgtttctttatatacataagtctttttgttgattggttagacaaagatagagagagagagaagaaacaaaagaagaaggaagagaagattgagaagcgacagctagagagatggtggacgttagcaccgctcgatagattttgcttagtgaatgatggcttttggcgcaagttagagggaacgacacgttgtgtgttgacacgtgttgtactcttggggtcgagatgacttgttagtttggagaagaagtttccttttacggttttaccttcgtttgttgtgttctctttactttttttttcaattgattaatcatgaaaattaaaattgattgatattaaaagaaacaatttcgttgtgggaaattagcatggagttcctcgtacgtttccccaaaacgagtaattgccacgtagacctttctcgtttcaatattatctggtttgggaatcttaaattgtttttttttttcacttttttttgtttatctttttgcaatatgaatgggtcaatgtatcaaaaagaaaaacacaagtcgccctcttctttaaactgcatgcatgtaattgaaatatatctaacgttttggtatgacaataactaatctcatgcccttgtttcactttgactacaacggtgctgaatgttaacgtttatttttaagttcgtgtattcaaactaatgactaactaatggagtttgaataaaatgactacctagtgaagttcaatatgtaccatattatacatatacttggttttaagtatatagaatttacttcacattgataccaaaaaaaaaggtatacaagtgtgtaattcttgttcattacacgtttgcctcactgtattactaaaacattatctcacatctttctatttctatgattgatgaaactcgaatgaaatttggaatatataattgaaagtttatatcaataacaaaatccgatgtcgtccagcggttaggatatctggctttcacccaggagacccgggttcgattcccggcatcggagcttttttattatttttgaattgaatttatttgggctttaagaagggcttagcatatttctatctggggctttgtttttaaaaggctagtttatgactagcccaaattcattgttcttaacatttaaacccaagtcattgatcaagtcatacgtaaactatcatctatagtttggtttctctatagaagaattttgcaagattagtctctttcggttttcttaagtgtttgtcttctttaagctcaaagacattttcattagaaaaataactgctcaaatcgaaaggtgagtatgcaaagttccttaaaaccatttttttttttttaaatggtttctacactcactaagatacaaagcacacccaaacaagaacggaacggaacttttttacttttgatagacttatttgggattatagagactatcggtgggcctttcttcactcggccgaacttcagtttctctgtgttttttttgtcttatattagacaatagaaatcaagatcatgcgatggcaatggcatatatgactcatattgataatacatactttcccaaagtagcacgagcacgaccacgagcacgaccaccagcacgagtgcactccactaaagtggtcggctacaatattccattcttaaaatcatattttttgttggttttgcgatatactatataaaaaatgatatgatatcgactatacatttgtttacctacaagcctacaagcatgctttggattactaggattcgataagagtggaatgtgaatgtcatttctggcttatcaactctgcaggcccgcaccaccctctccttttattggctactcaatccaaaatcctttgatctaattttgtcttcgaataaacattttaaggtaacctattgtttattattttttacttaaaagttaagagtcatattgctaaatgatactaacatcaggtccatcaccatgacattatatgaacacacatataacttcatactttggaaactttaatgaagaactttcagacttatttagtctcaatcaagaatcctctaattagtggacactccttccccatcaaataaatggctttatcttgatttgaattttgctaaaatatgggatgaagtaatcattttgttcattgtctttggaacctcggaaagaagaagaaaaaaacatgtggagtacttgtgatgtaatgactcaaacagaagatagtggtccgatcactaccctattctatctccactttttgcccaattcagaaacccaccaatacttcaaagtgggataagcaattcaaccattaacgactcataattcttttgatctatctatagcttccagtgtctctcaacctgtataaatacccttttcttgagttgaggtatgtgaataagtctttccagtgattaggaaactacaaagccatg

SEQ ID NO: 29339 - DNA, 3000 bp, Unknown
  misc_feature (1)..( 3000): 2750-1469P.txt file - cDNA_ID_3015634; gDNA_ID_2684096; Annot_ID_190109
atatgatccatctgaggctgatgaaggtggaccggaatcgacctttactgatgtttggtacttgagaaagtcccatgaatgagttgtatgaagctggaagtgtgggtcaggaaaaactgaaaccactcccggtttcttggctatgaccttggcctcttctgctgtcaaacgagctgcaaaacctgagaagccatgcttatatgtgtggagaagatcgtttgctctcctacaaaaccaaaccataaaaaggtctcaaaaatccacaaaacactaacaaatgtatattttgcacttcatgtaaacagtgtataaccttttaaacatggtgtttatgagtatttgagctctattagcgtttgcagcagaggaagctgatcccatgtagacaatgtagaccccatcaccatttctcgacccagcttcagtttctgtcataaacaagatgcataagagatatagaaatgataaaaagggtgtgaagaatgtaatgcctttcatggctttgtagtttcctaatcactggaaagacttattcacatacctcaactcaagaaaagggtatttatacaggttgagagacactggaagctatagatagatcaaaagaattatgagtcgttaatggttgaattgcttatcccactttgaagtattggtgggtttctgaattgggcaaaaagtggagatagaatagggtagtgatcggaccactatcttctgtttgagtcattacatcacaagtactccacatgtttttttcttcttctttccgaggttccaaagacaatgaacaaaatgattacttcatcccatattttagcaaaattcaaatcaagataaagccatttatttgatggggaaggagtgtccactaattagaggattcttgattgagactaaataagtctgaaagttcttcattaaagtttccaaagtatgaagttatatgtgtgttcatataatgtcatggtgatggacctgatgttagtatcatttagcaatatgactcttaacttttaagtaaaaaataataaacaataggttaccttaaaatgtttattcgaagacaaaattagatcaaaggattttggattgagtagccaataaaaggagagggtggtgcgggcctgcagagttgataagccagaaatgacattcacattccactcttatcgaatcctagtaatccaaagcatgcttgtaggcttgtaggtaaacaaatgtatagtcgatatcatatcattttttatatagtatatcgcaaaaccaacaaaaaatatgattttaagaatggaatattgtagccgaccactttagtggagtgcactcgtgctggtggtcgtgctcgtggtcgtgctcgtgctactttgggaaagtatgtattatcaatatgagtcatatatgccattgccatcgcatgatcttgatttctattgtctaatataagacaaaaaaaacacagagaaactgaagttcggccgagtgaagaaaggcccaccgatagtctctataatcccaaataagtctatcaaaagtaaaaaagttccgttccgttcttgtttgggtgtgctttgtatcttagtgagtgtagaaaccatttaaaaaaaaaaaaatggttttaaggaactttgcatactcacctttcgatttgagcagttatttttctaatgaaaatgtctttgagcttaaagaagacaaacacttaagaaaaccgaaagagactaatcttgcaaaattcttctatagagaaaccaaactatagatgatagtttacgtatgacttgatcaatgacttgggtttaaatgttaagaacaatgaatttgggctagtcataaactagccttttaaaaacaaagccccagatagaaatatgctaagcccttcttaaagcccaaataaattcaattcaaaaataataaaaaagctccgatgccgggaatcgaacccgggtctcctgggtgaaagccagatatcctaaccgctggacgacatcggattttgttattgatataaactttcaattatatattccaaatttcattcgagtttcatcaatcatagaaatagaaagatgtgagataatgttttagtaatacagtgaggcaaacgtgtaatgaacaagaattacacacttgtatacctttttttttggtatcaatgtgaagtaaattctatatacttaaaaccaagtatatgtataatatggtacatattgaacttcactaggtagtcattttattcaaactccattagttagtcattagtttgaatacacgaacttaaaaataaacgttaacattcagcaccgttgtagtcaaagtgaaacaagggcatgagattagttattgtcataccaaaacgttagatatatttcaattacatgcatgcagtttaaagaagagggcgacttgtgtttttctttttgatacattgacccattcatattgcaaaaagataaacaaaaaaaagtgaaaaaaaaaaacaatttaagattcccaaaccagataatattgaaacgagaaaggtctacgtggcaattactcgttttggggaaacgtacgaggaactccatgctaatttcccacaacgaaattgtttcttttaatatcaatcaattttaattttcatgattaatcaattgaaaaaaaaagtaaagagaacacaacaaacgaaggtaaaaccgtaaaaggaaacttcttctccaaactaacaagtcatctcgaccccaagagtacaacacgtgtcaacacacaacgtgtcgttccctctaacttgcgccaaaagccatcattcactaagcaaaatctatcgagcggtgctaacgtccaccatctctctagctgtcgcttctcaatcttctcttccttcttcttttgtttcttctctctctctctatctttgtctaaccaatcaacaaaaagacttatgtatataaagaaacaagaagcctgtctattattcacctaaatcgcctctctctttgagttccatcgaagatg

SEQ ID NO: 29340 - DNA, 3003 bp, Unknown
  misc_feature (1)..( 3003): 2750-1469P.txt file - cDNA_ID_3015638; gDNA_ID_2684096; Annot_ID_190108
ttatttgccgaacttacttgaagtgtccattttgcctgtccttttcatacttctgacaccacctcttaccattaccatcgatctaccttgtgtttttctttgctacatatgaattttgttctttttttaacccttcaattgttactgtttcaaaagaataaacagcaagatgacttgtctaaaacattatactttgcagttttgtaggtaccttttctatctcgggaagattcgtactattcagctcgaatatacggacgcaaaagagagccttcttcaggcggccaggaaagcccctatagcagctttgggcttcaggatccaatgcaataaatgggcaattctggttcgtctactgctgggtgagataccagagcgttctatcttcactcaaaagggtatggagaaggccctcagaccctacttcgagctaacaaatgtgagtccactttcataatcttgctgctgtgacatgtattcattaatttatgagcggataactaaactggtattagtatgtggtcacttgtgatcttgctacttcacttctgattttaaaccggttcctacttttcacttactggcctatacacctcttctgttaaaatctctctgtggtcacttgaaacacaattttgttgctgctgttgttttctgctccttcgaattatattgaacatgaatttctggctgtttactgttgctttttagagatatatgatgcaactggatagttgatactgattttgatctgaggcttactattaaagctctgttttgattttacaggcggttaggattggggacttggagttgtttaggacagtccaggagaagttcttggacacatttgctcaagacagaacgcacaatctcatcgtgcgactccgccacaatgtcatcaggactggactgcggaacataagtatctcctactcaagaatctctttacccgatgttgccaaaaagctgaggctcaactctgaaaaccctgtggctgatgcggaaagcatcgtggcaaaggccatacgcgacggagctattgatgctacaatcgatcacaaaaacggatgcatggtctccaaagaaactggggacatctactcgacgaatgagccacaaactgcgttcaactcaagaattgctttctgcctcaacatgcataacgaagctgtcagagcattgaggtttcctcctaacactcacaaggagaaagaaagcgatgagaagaggagagagaggaagcaacaggaagaagagcttgctaagcatatggctgaggaagacgatgatgatttttagacaaaggtcatctatttcttataagagttgactctccatctgtctcactttttttatgttcacaagtttacttggtactcttctcatcgtctctaagtgtttctttattgaggatttttatcctcaggaacctttttattactctggtttcactttaggaaaagatatttatcttgttggtttcagaagatcaaattcaacttcgtttaattgtgtttgggagattttcgcattttaagaattgaacacttgtagttatagctagctgtattaggtgggtcattattagaaattgaccatgtgaaatgctatcatctccaggcgatgcataccattaaaatccacattcataatttacattaaatgatagataagcagtcataaatatctaaagaatgaaaacaggacatgtgtattgaccattatgtgtattgatacattagtctatctctgccaaactaggtctcattttcttgaataaaacaatctcatgttatgcttttaattataggtgtttctggttcgattcattaacttcttaataatgacaaaaatctgtagaataatacccgggctctttgatagctacaactgccaactatttaatccatacaatcaaaatgtaattttcataattgtagatttgtaatgggtcaatatattcttacactctaatcatatccaaacaagctcctcaattccttaatcttgttgtatccagtatccatattttgttttcttactgcggaagttacttggtagtgtagtctggatttcggattgcagactttgcagtccacgatttttcatatgttggtgacaacgaacaagtgttaagttgacggaagtgttcgtaacaaacgacgtcgtgacggtgatcttcatcaactttgattggaaatcaagttttgagggacaattaacccaaaaaaataatcataatgataatgaaagagatttggcgtgttgctaataatgtaggacaagtgagcatgtgagagtctgtgaccgatgaacctgctcagaccaacctgcacatgattgtatcacaaacaaaaaactctcatttgtctttctttcgtcttactttattcattttaagcaaaaattaaatatccaccgcgttgcacaagaaatcatttacccatatgattattctcttagttttgaatttttgatgaccatgctgatttaaaatttgcaatcttacaataactttaacttatgtataaaaaaaaatgctgcatcaaccaataaaacaaaactttaggattacaaatgtttggctatgagtaaatcaagatattatctgcttcaagtctctttttcttatataatttcagaggaaaatgtttatatatagttcaaagcaatattagtgtaaccaaaggtaaattttgtatgaactttttggaggaatagaaatccatctgcagcattattacaaacagagtttgcagatctactgtctttttttggacttatactgttactaacaaaaatacacatgtaagagatttgcccaaataaataaattaaagatacacacaggctagataaagataagaccacatgtaaggtttttgttgctatactacattagtttacactcgcttcccacctttatttaaacaactctcacctccttcactcgatcatcatcatcatcatctctttcttcttccaaaagtcataatcatg

SEQ ID NO: 29341 - DNA, 3003 bp, Unknown
  misc_feature (1)..( 3003): 2750-1469P.txt file - cDNA_ID_3015642; gDNA_ID_2684096; Annot_ID_190107
aaaagatgatctggtattcatggttctatgaattggtgtagtgatgagatttggtacagtgtagattatctatatgatataattgtaagttcaaaaaatgcggtttcataatccagttgcatttatgttatttggatgcatcttggtgatttatatcaatttcttacgtttcgtgtcggatttagtagaaaacttgtacatgaatttgctttctcaaaagtgcaagttattgattaactgttttctttaattactttctcgctgcttgctattcaaacttttttagtacttagtcatgtgattagttgattttttgacatagaaattttgcttttgcttcttcttgaaacttttgtttttgtaacggaagttgttttgttatcttataggaaaacaaatcgaatgaagttatcttcaaggctatgggaagagctatcaacaagagtgtgaccatagttgagctgattaaggtattttctggttttagtctgtttcctgatctcagagttgtagttcttttgtgtatctgaagattatattgttatccttgatgcagagaaggattcctggtcttcatcagatcacatctattggatcaacggacattacagatacctgggaacctacagaggaaggccttcaaacgtatgtggtcactagactttagtatcaagtttattgttttaagtgtaccggaacacatgtaaccatgttgtattcttaattttgttactttgacctgttatttattaaaactcatctttttctcctgaagaattgagaccacgaggcatgtgtcgatgataaccataacactttccaaggagcagttgaacacatcctcagttgggtgagtttctaggactggttgttttgctatttctcgtctattctcttattggggattttgttgttttgtgtctagagaggtacattgtctccaatgctaatatatcttattaaataatgctataggtaccagtgtccgattcctattgagatggtgaagccattggctgagattgactacgaagggcaaggtattttagagtctcactcttaatgacgtttttaagctccctgccctgctgtcttttttaagtttttaaattatctctttcttgtagacggatctcctagaggcagaggaggaagaagaggtagaggaggaagaggaaggggaaggggaagaggtggtagaggtaggattactttagaaattgtttatacagtgtcgtagtttcgttgtaagcttttgcatgtgatttgtggataagcgtttgagtggactgtgctaattccttttttcgacttatcaggaaatggacctgcgaatgttgagtatgatgatggaggaaggggaagaggtggcagaggtaggatatctttagccaaatcgtatttgagtatagatttttgcatatgatttgtggataagggtttgaatgtgttgtgctatttctttttttgtttgatttaccaggaaacggatatgtgaacaatgagtatgatgatggaggaaggggaagaggcggcagaggtagaattgctttagaatatttctttccaaatcttagttttaccttttaacatatttgcatgtgatcggcggacaagtgtttgattggcttgtgctatttcttctttcggatttgccaggaagtggatatgtgaacaatgagtataatgatggaggtatggagcaggaccggtcatatggcagaggacgcgggcgtgggagaggaggtggacgtggtggtcgaggaagaggaggttacaatggccccccaccaccttactatgaagctcaacaagatggaggagactatggatacaacaatgttgctcctccagcagaccatggatatgatggtcctccgcctcagggacgtggtacgttgatgattttgttacactaatgttttctcattaaataatgatgagttgtaaatgtttaaaaattgttggaacaggacgtggccgtggaaggggaggtcgtggaagaggaggaggccgtggtggattcaacagatcaaatggagcacctatccaggctgctgcatgagcgaccagggtcattgaatgaagttggatctttcttacattctcatgtttttgtctctgttcttcaaagcaacttgttgccgtagaataatctttcgttcatgtcgctttaggttatatatatcctcatttattttatcatggatcttggattttcaagtttttattccttcaagagttttctagttttgtctcttttttgagttttggatatttgtttgactccaattacattcgtcggcgtattgacactaacaagtaaacaaccccctttggcattgcctttttccattggttcgtatatcagttgattatatattctaacaacataaaaagataacaagaaaaaataatgaataataaaattgtaattccaagttccaacgtgttttgagacaaaaagaaattaacccaacttgcgctggttgtgttttgggctattcgaagaaagcgtacgaaaataagtgagagaggtccaaacaaaactagtaaccaaaaagttaatcgccgttgccggggatcgaacccgggtcacccgcgtgacaggcgggaatacttaccactatactacaacgacatttgttgctcaatcgtaatgtagaagatataaatactaatatggaaaaaagctgtcttgaacaaaaagaaatatactttttttgttgtgtccaaaaaaaggaaaatacttaggaaagaaaagagtctcagcagcatcagctcgtccttaaatctgatccatcatcgtcactttctcccggcgaattccgttttatcgatttagtaagctctctgtctttatctctccgtctttctcagtcaacaaattggttgaaacttcaatcggttccttgaaatctcaccggcttagttgcatacttctgcaaaaaccctaaccttgtttttgtctttgtgaagagtaacgagatttgtgcaaagatg

SEQ ID NO: 29342 - DNA, 2620 bp, Unknown; identical to SEQ ID NO: 14261
  misc_feature (1)..( 2620): 2750-1469P.txt file - cDNA_ID_3015646; gDNA_ID_2684096; Annot_ID_190105

SEQ ID NO: 29343 - DNA, 3003 bp, Unknown
  misc_feature (1)..( 3003): 2750-1469P.txt file - cDNA_ID_3015679; gDNA_ID_2684097; Annot_ID_190165
attgaaatagtttagatattcaaaaagaaaaaaagatactcagctacaccaattaggacgaaacatatggtcacaaatgcaaagtttagaaatgtacaacgaactaaatgtattgcatgcccacatatactaaatatatgatgacatgtggtcaacatcacaaacatttttccgatatactaatcgtcaaaatccagtgttgaccataattgaccggcattgacaaacaaaaatattttgtatttttttaaaaattattttattgaattgtttatagtgttgtataatttaaaagaaaacatattatatatttcccataaatatattttgtatatctattgaatacattgattattataattagatagtcttttcaatttcaaaagtaaattaaaagtgaaataaaaaatattaagcgaatttattgtttttacattgtcaataaaaaattagcgtcttattgtacaaatgtttttactaaattcgttatcgttaattttctatatattaaaaataaaactttgcgacctttttttatttagactaaagaatatgtaaatttttctctatttttttaactatgtattatgattttaattttggcaaaaaactttttttttaccatgtaaaatttagacgaaagaatcttctacttaatttattcctaatgaaattaataaaatttattttcatttcccttttaatttagcttgtaaaaaaataaaataataataagaatcatacaaaatatattttagttaaatatagaatgtgtttatctattatacaataccataaactattcaatagaatgttttaagtaatattaaaaataataaaaattcatatatttgaatatttttgttggtctatgccggtcaacgacggttaacatcggaatttgacaattcgtataccgaaaaaagatgtttgtggtgttgaccacatgtcgtcatatagttggtatatgtgggcatgcaatacatctaatttatgtagttggttgtacatttctaaacttggcatgtatggccatgtatttcattatacttggtatagctgaatatctttttccattcaaaaataccaaaaatattaaaataaacttggaaaaatatcaaaaatattaaaatatccgaaatgcccatatatatccaatatacatgaaaatatccgaacagatccataaatttaagaaccaaacaggattcgaaccggaaattttgtggttcctatatagatcctacactctaaaacagaaaaagtcggaaccaaaccgaatacataatagatgtatacctaaaatcgtataaaatactatcctcatacttcatgagacaacatgtatggctgcaagtccaaaatggacgggacactgatgggctacacagtttttctgtaatcgataggagttaattaaaatcattttatttgctgtcacaaaaaactagcaacattttattgttgatactaattttgtatattttatttaattgatgttttaatgtaaataacaaattagtatattatttattgatgtaaatatatagatttgtatcaaaaacattttataaaaacattagttattataattgatgctaatcagctatatttgtcatatttatacataagtgatttaatatagtatcacttagttttgtagtacaatttaagtgatttaattcaacttttttgtagtacaattgtagttgcaccaacgaagttggaaaaaagattagagcacatcttattaaatcaaatttaaaccacactcaaaaccaaagatgtatatagttcaaatttacttcttatcgtactgataaatctacgtttatttcttacatctatatacaccaaatctttttaaaaaccccacacattttaaaccttttaatgtgatgtgaagctatgactccatgtgactggagttaggtctaggaaacaaaagtaaataaaatggcataattcaacgttttctgcccaaaaatatcactttttcaaaaaaaaatctaaactgaagtatttattctaatagatgtgtgattacatagttgagagattgcctaaaataccaaaaaaaaaagatatttgatttcgtattccaataggttccggtcaaatgaaaattttcttaaacgtccaaaagaatttttcggaggctcccagtaaattaaatagagactggaccacgaaaatttgcttcaaaaattaatgttctaatgttttggctgagatgatgcactagttataccacaattttcggtatctccatatatgtatatgtacactctatgagtctgttcgctcaaccttctgaaaatctcaacaatattttctgacaacgcacggttccagatgatgaaaaaatattatattttatctacaataataatttaaaaagttacaaataataataatttaaaagatttttttttattctatcttatcaaataatatcataacaaattttttaaatattttattattatatatatatatatatattaatgaactaaaatatgagaataactataaaatatttttgtatataaaaatatatcaaaattaacctcttaaaataaatattaaatagaattaattttattctataatcatgatgagagagaggcgatttttcttgcgatcgtatctcttcatcttcgcctcttctttgtatcgtttcttgacaagcggttgtcgccggttatcggcggttccttcagagttgatcaacggtattacagttatcaatcgcataactgacgctacccaatacctatttaaactatgtgaatgtctctggagccaatgggttgatcagagtgaaataagccaatttcctttgttcatattaatcatggcagactgcaagaaattgcactaggaattgaagatgaagcgatcaatctcccttttgatttgtgtgaagaggcgattagctaaacccgctatagtctaattgtgaaaccggtgaatccaaggaagcagaacttacgagcaatg

SEQ ID NO: 29344 - DNA, 3000 bp, Unknown; identical to SEQ ID NO: 14286
  misc_feature (1)..( 3000): 2750-1469P.txt file - cDNA_ID_3015748; gDNA_ID_2684098; Annot_ID_190199

SEQ ID NO: 29345 - DNA, 3000 bp, Unknown; identical to SEQ ID NO: 14287
  misc_feature (1)..( 3000): 2750-1469P.txt file - cDNA_ID_3015752; gDNA_ID_2684098; Annot_ID_190198

SEQ ID NO: 29346 - DNA, 3003 bp, Unknown; identical to SEQ ID NO: 27045
  misc_feature (1)..( 3003): 2750-1469P.txt file - cDNA_ID_3015757; gDNA_ID_2684098; Annot_ID_190193

SEQ ID NO: 29347 - DNA, 3003 bp, Unknown; identical to SEQ ID NO: 27046
  misc_feature (1)..( 3003): 2750-1469P.txt file - cDNA_ID_3015763; gDNA_ID_2684098; Annot_ID_190191

SEQ ID NO: 29348 - DNA, 3003 bp, Unknown; identical to SEQ ID NO: 27047
  misc_feature (1)..( 3003): 2750-1469P.txt file - cDNA_ID_3015767; gDNA_ID_2684098; Annot_ID_190190

SEQ ID NO: 29349 - DNA, 3000 bp, Unknown
  misc_feature (1)..( 3000): 2750-1469P.txt file - cDNA_ID_3015835; gDNA_ID_2684103; Annot_ID_190295
ttcatggatcgatgaaggaaaataagtacatcaaaagccgttttttttggcgtaacatatgttttttactacttactattagcaaacatattgggtagtatctgattggaaatctacgaaatttcgaagtgatgaaatgattatgtgatttcgcatgtttctatatgacatcgtttttgtgtaattatgtttcacatcttctatcctattgactttgtaagataaatgacaacattgacaagtaacaaaatataaatagttacgacatagtttgtagttgaattacaactttttgttttccttaatcactatgtcatttaataccacaaatttctcattcgtgatgattccatcattttccttgatcactagtcggaaccaatttccattggttaatggataactttttgcatgaaatataggttctacaagaaaacataaattgatataacctttggagcaaagataaagttcagttgttcagctacctggacggctcattaagattcctcccgagaagtattcttaaattatattatttatttttaataaagagatattcgtaaaatttcggctctgttttgcaaagttaacaatatctcaattcatattacaaacttcattaaataaggtttaacctaaccaaaaaaattgctatagtgacaatattttttctatgaaacaaacccacttggataacacttctatttgtggttttgtttggacaaacgtttatttttatggttcatatatgcatatccacatatacattatctccgaagtcccaaaactgtggaagcagctggaatgaaaatgttggtgacaaatgtttgtagccgcaaatgttaggctacaatacgtataagacatgcaaggtgcatgccccatttaattacgagtaaagaaatctaactcctacttcgatattcaatttgttcatggtctatcacgttatatacaatattgatcgacaaggcaatgaaacaagaaaaaaaaaaaaaaaaactcacgttcgatcaagatatcggttaacattcaatgcaagggtcgaaaaccaaaccaaccaattttcagtctggtttgggtatgggattggtttggttaaattcacactgatcctcctagaaaatatattcattgtagtaacagaggaaatgtaaattctgcgttttcattcatttcaattggctaatggacatggcaaagtgctcaccatcaatagttcacaagaaaaaatccttcacagcacgaaaccaatcaacttttttggccaacatggggctgaagacacttgccggaatttcatgagagttcatcatgccactatcttgaatcttcttatcagctgaagcaatcatgcattaccttggatggatttttcaaattgctggagctgcgaaatgaaaccgggattaggatatgcctgatgtcgtcggctccttacaagttccatagctttagagaatcccattccatgctttttcatcaggtaagccaccactatagtcacacttcaaagaaaaactcaaaccaatcaaattgtgtaagtatatatataacagaacgacacaataagcaaattacaggttcaagaaaaactcttaatttgtccacaacaaaatgtaatctgttcactaccataactcctactaataccagaatcagcaagctataaaagaatcaaagcaaactacaagattcatatacacttttgccaatctgagtctctgtagtttcctatggttactcagttggcaatttatatacacttttttgatatggttacataatttgcaattggttcacattgatgattcttaaacactaaatctaataactgaatgtatgagatttaagggcaaaagaatcaaaacctcctagacattcccatgaagcaatgaaccaaaacaccaccaccagattgaatagcttggtcgatgaagctataacactcatcgaaatatactgtcaaatcggtctcggatctatcaaccactacacgatgaagaacaagtttataaaatctctaaacgaaaaatttcaaaaacaggctaaggattgaagaaaaaaaacccaaccttcaatgactttgtagacaaaatcatcaggataaggaggagccaaggccacagcaacggttaagacatgagtgatattagagcttttgagaaaatccttgttattcgcttcagctactgatcctatgaacaatccctgagaataaactcatccaacaaacgatttttcggaattaaagactccaaaacctgagaaattccaagtgtgaaattagacggatagatagagaagagaaacgaagaaaacctgttggatctcgctgagatctttgcctccttcgagtagcttctgggaattagcttctccgactccgaagagatcaaccactttctccatcgctctctgcttcttttttcaaaattccacttgtacagacgaaaactcttaatcagaaagataaataaccctagattcgtaattaatatttaatagtttagttcggatagatgaatcaataagcaccagtggtctagtggtagaatagtaccctgccacggtacagacccgggttcgattcccggctggtgcaacaatttgtttgtttttttaagtgaaaagatttaagagagtcaacctttttacacatgaaatgaagatgattaaaataaatagatgacttagaaatcaccaaattaacattaagaaatattggtaggtaggaagtgaaaattgaacacaagaaaagtgttgagcaccctcttctcctttcagactgcttaaccaaaggaatatagcagcactctactaattcttctttttgttgaaataaaataattactctttaatttccatcttctttgcgtttttctctctatctctctttttttgttccattagatcattcataaagcggatcaagccaccttgattgtgactttcctcagttcttgatcactatatcttgaaggaattaagaagatg

SEQ ID NO: 29350 - DNA, 3003 bp, Unknown
  misc_feature (1)..( 3003): 2750-1469P.txt file - cDNA_ID_3015854; gDNA_ID_2684103; Annot_ID_190323
agtcttcttctccactgagagaactaaaagcgatgatgaagaacaacaacaaaagcaaattggctctcgacaattaaacgctgcgttttgatgatgtcgctttgctgggctgatattgggctcaacttaatagcccatttggtttgattcaaaacccgatttctcattgtagggtttatcacccgtcatcttcgtcggcgaaatcaattttcggactccgtcgaattcgaattttcaggtacgctaatcattctagcttcttggattttgactcatttcttgctaatttttcatttctttgcttgtatcgtgttcgtcttgttgtagtttgttctcgaactgagatttctttgctggattctaggttttagatctgttttccgcttgattttcgaatctctaggttcatagatttcaaagaaaagtcattgtcccatatgatttagaaacaaatccatttctaaagtttgtgcattttcgaattatagctataaaaaaatggaaactttatacgttttgtgacctctgtttcatcagttcggaggattttagttatctgtaatgaaaagaatggtaatgtaatgtgatgtcattcttgataaagaaatgggagacaagaggaagaagacgttcatgttcatccgtctagtttcagcagctggaactggattcttctatgtcaagaggaagagtaccaagggacttcttgagaagctcgagttccgtaagtacgatcctcgagttaatcgccatgtcctctttacagagcagaaaatgaagtgataagacaaaagaagcttgcttttgcctgttatggctatcatagatcaaataaacgtttcaatttagagttctatcgaaactctttgtaggattctctaaaacttaagtgcagattgattgtattgtgatcaatttcgacacccttgttgatttccaaatgaatgtactgtgagtgttaaatcgaattactcatgcgttcatctaatctaggtacttgaaaactgatcacaagttagattgatcagcaagcgatatgtagcgagcacgatagatactataagtttcttacccgacgagctaaccactcttatggtttgcctaaaagaagaaccaaacaaaagcctaacaattggagatctttgtctttttctacaaaacttaaccatctctcaattgtttggtcttcccaaggaaagctaaaaattggctttaattagatagcctagatcgacccaccatatttatgtaaagcatgactttgagtagagatgagtaagccaaatctttgatatcaaatcgaatttttattccatttaagaagattcaatgaacacacacttctcttgggttggtagttatatgatgatgtttttgacatatgatactttgaccagtgtctactttcccattgtgtttggtaattgatagtgataggagtgggacacgatgctccatcctacgaggttcgaccatactaatcgttgaactaatttacttgtcaaacacattaatttcagtgtagaatgactaaacacaaatggaaagttataaatttccattatcttttgctttaacgatggagacaaacttgtcttgttacagcttacatgttgcagaagaaacatagaatccaacatgagctataagttctccggagcaccgtgtggattctattacgatgacgatgattgtcgagtgttcgagacaagctcttttgggagatgtgcatcgcatttcactgcattcaaacttgtttattactatatataggtacatacaaatataaaatatattgcgataacaacaaactgttagaatacgcgctgcataaacaaacggctactaaattttcatataagaaaacatagatagatgttatatgcgatgttgatttataaatcatgtcctatgaattggttcgtgtagaactacaaatttgattaagcaaaagttgtaattttgtttaagagattctacagggtttgccaaatgttgtattaacaaatgttttagtgctctttaaataaatgcgtttaaaaaaggtttgtacaaaacatcatatatgtatgtttgaatatttgagataaatgtacacaacaactatataaacaaaacccacttaattaacatatcattaactctcttttttttcataaaacatatcattaacttaataccatatataaatctacacaacccaccaaagtgcattatgggtttctttggaatggtataatcatagcaccctggtggtctattacgtgggagataagacgagtagttagtttatacaagaaattctggtcatgaattaaaaactcgattatttgtttagtagatagataaagccgcttataaagttcatcaacctaaatttaaagttttttttttcaaaagtagctttttctttctttctcactttcaagtattttggaaaggtgagcttcctttaaatttcttctttttttgttgttggtaaaactatacatagaaaatcacataatatagttagaaagaaaaaacagtagttaatttaaatgcgtaagaagtaagggataatgatatgtttcctggaaagtgacggcaatcgacaagaacatgagggtctgaaactcgtaacgttgaattttcatcgtcatcaaatcatcatcgaaaatcaacgacaagaatatgattcgtatttttcctttgtcgattttttttgttaattagtagataatggaaaattaaagaatcttattaataaatgaagacagaagtaaagaccagtaataaaagagtagagtgacaacaacatacgtatatttaattattgatataagtggataaaaaaaagtaacaatgtcattgtcagtcgtggattcagcttaaatttaatgaatataaaccacaactatttcttcattactagatttatagatttgattctttctctctcagaatttttgtcgaccgaatttcatattcatatatagttttattaaataatctggttagatg

SEQ ID NO: 29351 - DNA, 3000 bp, Unknown; identical to SEQ ID NO: 14299
  misc_feature (1)..( 3000): 2750-1469P.txt file - cDNA_ID_3015858; gDNA_ID_2684103; Annot_ID_190321

SEQ ID NO: 29352 - DNA, 3003 bp, Unknown
  misc_feature (1)..( 3003): 2750-1469P.txt file - cDNA_ID_3015862; gDNA_ID_2684103; Annot_ID_190319
ggtttgttcttgatgaatcaactgattgggattgctcctcgacctcaccggattattctccgcagaagacggagagcgcctacacaaacatgagaaaaggttccaggaaataagtttcaaaagttagtgagaggatagaacaataaattagtataaagatcaaggagcaaagacacaggtatggttcaaatcattatccacaaagagtaaagacaccacaaaatgaaatattttatgacctttttaaaaccaatcaaaaccaacagcgaaaagagaatgagaaacgaaaacattatgacactgacaagaggataaaaagctcacatccaagttcggctagaaagtggctgaaaaccatctaccaagtttccattctcaaaacctgatactggcgattgatttcttcgagaaaaccccatattctggtcaggaagaatatctgaccgactgcaacaaaaattgagaattttatagaccgatattagttacatcaaaaaaaccaggatatcagtaaacaccatggccatgtctatgacatctcattcataccacctaggccacacaacaaactgataaaatctgaaagagtaagatacatgatgcagaacaaggaaggtgtaaactcccacaaggacagatgttaaaaggttaaggataagatagggatacaaaacagacagaatgtttatttcagaaagatcctgctggcataaatgaccttgatctaaaggaaatggcataaacgacctttttctttttgaatcttgtgatcgaccaatctcaacagcatcagttcccattctggaaagaatgtgagatgtagcaggtggagacgtggctcgactatgttcaccatgatctttcaagaaattccttgatccatcgtgcccatattgaggatttaaattaggcctgtgaggaaaaatgaagcaggtaaattcagctaagtcgttaagaaaaatccagcagcttgcttattaaaggctataagccaaatccagcgataatgatctctttagagcttcaaagccgctgccatagtaagcccttatgtattaggcagagaaacttatagcactccgccacactctactttcttcctactgctataatttcaattgcagaaactgaaagcatttgagatgtgtgattaacacagccgcatatgagtaatgacactcttcttagtcaaaatatgtcacgtacacttttacctctgaactccaggaaattggtaaggtctcacagaggggcttgtacgtgaagcttctggaccccatgctattccattgaaaggttctgggatcctgaaaaacatagcatcaaagtgttcttataactttctcggcgtaaaaattagtgcaacatatagaagattcaagcagaagttttacaaaaagaatcaaagccaaagaaaacagaaaatttggtttatcccatcttcactgttttgggttcccgaagatcctttacaggtataaggagtgaaaaaaaaaaaagagagccataatagtaagttatctgacctttgaattccaccaggttggtaaggttgtcctgaggagggtgatggattttgaaaagccgacggagatggtattctattaattggaggaacactgcaagcaaaaaccataataacttaggctagaatctaaagaagaagaaaacccgagagtagactgaaaaattaataattgaataagtaaccaacctaacatcatcattagacacatagaactgaaagagaaaaggaataaaagcaagccatacgattaagaatgtctaacctttgaaccccacctggtcggtaaggtttccctatagagagctgagggttttgagaagccgacagaggtggtgctcgctgaattgaaggaccactacaagccaaagttacgaaagaaaactgagcgaatttacgaaagaaaactacaacaagtagcacaataggctcttcctatggaggctcagaaacaacctaacatactcgcatagaaagaaatcaaagctgtagagctaaggttaatctaaccttcgaattccaccaggtccaaaagattgtcctgcaaaggctgaatggttttgagacgccggtggttgaattgatgaatcactacaagcaaatccaacattcgcagtgtgtaagaataaaaaagaaaggtacaatctaagaacaaaaagcaaagtaaagcaactcgcagcttctcctaaggaagatgaagaagcaaaacccgactgcctaagtgatatagaacacaatatcatagaaaattcaagatacttctctcattctcatgatcctaaacactttaatacaacgatagcatatatgtaaatttgacagttcaaaaaaatctctgagtataatagatccatagcgtgaaatgaatcctaaaaatctcaaaactcgaagaaaagtccgattgaagcatagatacatctatagagaatgaagagcacacctagtggttgaagaagcaccgaacggtgtaaacggcgctggcttagagctcatcggacctaagtccttcccgaaaggcctaaacgccattctctgagaaaattccttgacttgattatcgctgcctctcttctaattctccttcaaccttcgtttaattacgtcgccggctaaagtcgaaaccggagcaaattgaattttctgttctggtgacgcctcttccgtccggcgaggattattttacgtttaaaaccaacgacgtcgtttttatttccgaattttatgttgggccttttaagtaacaataggcttattatgggctttggtcaaggaacaagaataattgttcaaccaagaagaacgtgcgcatgttgtcaccatctcccttgagcctccttgttttaggtagaacatcaacttttcatgaccgttgacattttttttccctctttattttccgagaaaaaataaataaaattatcctctagttttcgatctcgatcatctggatccaagaaattactacgattgctataatg

SEQ ID NO: 29353 - DNA, 1470 bp, Unknown; identical to SEQ ID NO: 9796
  misc_feature (1)..( 1470): 2750-1469P.txt file - cDNA_ID_3015862; gDNA_ID_1972192; Annot_ID_180234

SEQ ID NO: 29354 - DNA, 3003 bp, Unknown
  misc_feature (1)..( 3003): 2750-1469P.txt file - cDNA_ID_3015865; gDNA_ID_2684103; Annot_ID_190317
cctatatgtgccatgtttaatggtttttttcttttgcctctctactcttctaatgaatgtcttgatgaacggtacagatcatacggtgcccatagatgatcaacgatacaaggcttccttgaatctagtcttaaccatggcttcccttttccactccagtgaagaagacttatcggtcccggatgcaacgttctacatcttccttcgaaattatcacctcctagaccatgctggttccacctatgattaaccgcttttatatcaccggcgaatatcagcagaaacggaggtaatgatcccaaatggtatatcctcttctgcttctgaattgtcatccactcttctaccttctgtgtatacattcctttcctccatttgtttacatccacaaccatcacccctgtgttgaaataacacggacgttttccttcaagaactttgaccaataccgggtctgaccagaaagttcttgtgaaataatgggtgaagtttgcgtggcagtactcgggagcagccaccactttaccttccatctccacatgccacagcttctctatgtcgtctaccacaacgaggtctgagtctaagtagatgatcctgtcaacgctgctagggatgatatccgcgaggtagattcttgcgtagttaagaggctgatcaagggcttgcctgatggatttcgatatcttgctgcggacgaggtttggatcaaactgataaatcttgaagtttaggtaaggaaaggttgatttgatgctggtgaaaaggtcgttttcgaaatgaggaagggacaggaaatgaaaagagaggttttcagggcaagtggaatgttgaaggagagacaaaacggcagccattgtgccacggaggtagtttgtgtcgagagtcatggcgatatgaatctgatcagcctcacgagtcccgcattgatcaccgtttcgaaaagccggggcttctctgaaaacaggaagagttggagcagaaggcttatgaagaatgactccaacacgaaccgccatagtggtggttgtgaccaagaggagtataaaggacaggaggcctaggagttgtgtataggagaggctccttgaggccatcctgaacctaattctcaggtaaactcttttattattattttcacttttttttttaatttttttttaaaaaaggtttaaacattacaaattaaaaagattgattagttaatagagccattgttagggaaaggctagaataaaggatttggggagaggcttgttttattagcagtctaaatgtggggaagagattgaacttcggactgtttctcacacaaaattttgtctccaaaaaaaatccatttcctatgaaataggaacaagacaagtctgttgtccaatgaaatcggagtgaatttttagattttgtttcttcttctttagattcttagaaactggtttatgtttttttttggaaacaaaaattattgtttatttttaggacaaaattggtctgatcaatttgctttgctgtcatttctttttacacttgattgcgtcggcgggtttttttttttcctttttggaagtaccaaaattagaatactgtaacaaactcccctaaaatgtattaatgcatgcttttcatgcaagaaaataatgatttttatgtgatcaaatccctgataacatcatacgatctcatcatatatatagtggtactggtaaaatctgtaattccaaaagttaagtaaaatagtaagaaactaacttaagaaagtgtgtgttactccacgtttcaagaaaagaaaaatgtcttatatactccaatcttcatgcatggctactaagacagtcgcgtgtcaatcggtcattctcatgcctaatactaatccatatatataaataatatatgaaccagagagaagatctcttgaaactctttcgattacaaatatttgagttcaaacttattctttcaccaatactagccatttgcagataagacaaatagaaatcgagtcgaatctttcttgcttgagtggtagaagatttctttctctagttccatgtaattggtctaaatcagtgaactcataatttcatgtacacaaaaaaaaaagactgtttcataaacagtggatatatggattggactcaccatgtcatacatggtctcgaggtaaattacacttactaagtaatcctttatattttacattttttaccatgttgtatggtaatgtgatagctacctaattcacagggccttaggcccattaggttttcaatattttcatggattatcgggtcgagaaaatgttatgatacccgacccgaaacggggagaaaataaacgagaaaagtaaggaattatctcgaggaaaagaaagcatcgataatctcaaaaagtttttggtttgatttgggaactcgtgcgcggctgtggcagaggccaaacccacccgtgtactccatccgtcggatccaccaaaccaatattctttcatctctctctctctctctctctctcttcttcttcgtcttcttctctttttattctttcttcaggaacaaattcctctgctttgggcattttagggtttctcaaatttttgacgctttctcttaaaagggttgacgaaataaccctttaagggaaaaaacaaaggttgaggaagaccaccaaggtgaaaaaagaaagaagaattcgaacaacagcagcaacaagataaagttacgaatttttcctcttttgtaacctttgtttctcttcttcctcttcctccatttttttccattaaagattctgcctttgggttccaatttcgtctttcctttttcgattttgccgcgtttaacatgacattcgcaaaaccctacacttttctggacgccattgttgaatcccacgaatttcgtttccctagagattgcttgttctagccccagcttgaagctaaagatttttcaaggaaagcacgtttttttgtttgtgcaatcgaatctgtttttctgcgttatg

SEQ ID NO: 29355 - DNA, 3000 bp, Unknown; identical to SEQ ID NO: 14301
  misc_feature (1)..( 3000): 2750-1469P.txt file - cDNA_ID_3015870; gDNA_ID_2684103; Annot_ID_190314

SEQ ID NO: 29356 - DNA, 3003 bp, Unknown
  misc_feature (1)..( 3003): 2750-1469P.txt file - cDNA_ID_3015890; gDNA_ID_2684103; Annot_ID_190303
ctcaataaataagacgattgtcactttaaaaagaaaatagtaattatccaaatatcaatttcagagatttttttggctaaaaagataaaagagctagctcagatgttataattatcagtaaatggaaaaccgttggagatttagtacaactaacaatttttgataagacaatataagaattttcttcttcttagattagtagttgtctattttcaataccactttagcttaatcaaagtgtccattcacattattcacaaaaatagttcatctattttattaatcttcttactttgattcaagaattccttttttttttgttgttgctcaagatagaatttagcttatacataaaaatgatactttttcgcagttttaaaattctctaagaaaccaaactgataaaatttaaagcgcaagagaatattaaagtaagaaaaagagtaaattattacagaatctcctcactaaacgagcttatacgttaatggctctaatcttgaatatgttgttgttggccgttgaggctgtgtttaatcatgtgacttttaactccaaagctaccaaaagtcttcggcccaagagaaaagagctacatgagtacattctacattcttcagccaataatgagactccctactatcttaattattgggccgaatatgggcctacattaactatttaatgggcttgatagtattgttagcatctagctttttatgattttgtttcagtgaggagaaaaacgctttctcaattatgaactctgcatctttgtcactgattcttctcacctgatctgttgcagatatttggtcaaagagtttattaaaagataacataatataaagtgaaaaagcaatgctgctttctctcattggttgtgcatagagcaaggacagagaaaaacaggttcgtacgtaagaaacacacattaactgtgttctgcttcctttgtattctctcacttttctcttttttcagaattcaatctctggaaattttcttcctaaagattaaagagaaccgtttggaccagatcagcttgcctcttggtaatggtctctcttctctttgttcccaatttctgtagctttcttctttctccctaactcgtctgctctctttgtctcttcctctcacagttcatacgtcttccatggcttccggtgatgttcttcctagattcttcactgtcttcctctcccattgcagctccgaatccatggtgagatttttctctggaatatttcatggaaaaagctgcttgggttgatatgtttcttggatacagtaacgatgtgaatgagatctgcaacattatcttaattcttaactctatatgtttaaatctcttgacactgacaaaagttttaactttcttcactaatgagctcaggattatctctgtttgtgttacttatgtttgaatatgatagagtatgtcaaactaaacactgaatttcctcaaagagttttctcctttgttgaaaaaattgaacaagaggtcttggtcttgttgtttgtctgtttacctccgcttgcagacagagtctttagcttatattttgctcacttttaacagtttagtttatgctacatctttgtgttgagcaggtgataccaaggtcttactacaatcttttaccacgtccgttgcccaagactgcgattctcatcggaactggtggaagattttggaaagtagcaatgacgagcaagcaagagcaagtgtattttgaacaaggctggggaaatttcgttgctgataaccagttaaaagagggagaattcttaacttttgtgtttgatgggcacaaaagttatgaagtaagtatctatggtcgtggagattgcaaagagactcgagcagtcattcaagttgaagagatctctgatgatacagaagatgacaacgtttctcttcatagccctagcaatgtttcacttgatagccttagcaacgattctcatcatagcactagcaacgtttctcttcgaagccttagcaacgattctcttcatggtgatgctgagatagagagcgacagtgagtattctcccgagaacctaccctcagcctctatatctgttgaatccgttgaggtggtgaatccaacaacaagcaggcagagaagttgtaagtaaacattgttcttttaactgatgcttataaccgaagctgtttagaatttgatctcaaatgggaattttgcagacaagaggaagaccattgagaatccacatctgtatttggatgatccaaacaatgtctgttttgagacgtgtcttaagcttagaaagtttgagctggtaagacttcattagatattattatctcgtctcattaaaaatcctttcacgagttgatgattatttttctaactaaagctctatatacattatgcacagttagttcatgcacagttggtgaaagactacggcttgatattcagcgacaatgttgactatattgacggatatggaaaactaaccgcgaaaacgaccaagtgggcagatcaacgggtttgcataaacaaatggcagaaaatatgcgagagaaaccagttcacagagaatgactccatcctatgtgaaattctccgcaacgaggacaaagtggtttatgcaatcaagattcacatcttccgcgatgcagcagcaagcacttgattctctgatgcagttctgcaattgtgtttcttctctttcgagtctagtcttttgtagtaaactattagaatgtctaatttcaaaacatgtttaagacttttgagttctcttgtagactttgaagtaaacacaatgaggagcaggcttaagcttacccgttaatcactctgtttctcttacaagttacaatcatgtaaaatgggttagaatgatcgttttaatatgttaggtacagatttcgtaatttctcgaaaatgtgatatctcttcttcacaacagaagaacagattattgtgaaagtcaaaacaaaaaaaaatctctgaaacaatg

SEQ ID NO: 29357 - DNA, 3000 bp, Unknown; identical to SEQ ID NO: 14305
  misc_feature (1)..( 3000): 2750-1469P.txt file - cDNA_ID_3015894; gDNA_ID_2684103; Annot_ID_190301

SEQ ID NO: 29358 - DNA, 3000 bp, Unknown
  misc_feature (1)..( 3000): 2750-1469P.txt file - cDNA_ID_3015902; gDNA_ID_2684103; Annot_ID_190298
caacaaaagtctaaaaccacatattaaaccgaactcaataccgaaaccaaaccggaaaagagaagttttgttactcggtttaaaaagtaaaaaagagaaaagtcaaaaaagcattaacgaatcttgaacaagacatcttctagttcttcttctaccaaatcttgtttttcttcagtctctctgcttctcactgttgtgctttctgtcttgtctctgtctttcccattgtcattctctcaccaatgggaatctcctttagcaacaacaacagaagacgagacaacaataatcgtcgccacctccaccactatcctccgccgccgccttactattacctcgaccctcctcctcctcctccgccatttccaccgcattatgactataactactccaattaccatctctctccgcctctaccgccacagccacagatcaactcttgttcttacggccattaccattatcaccctcagcctcctcagtatttcaccaccgctcagcccaattggtggggcccaatgatgagaccggcgtactactgtccgcctcagccgcaaacgcaaccgcctaagccatacctggagcaacagaacgcgaagaaggtgaggaatgatgtcaatgtgcatagagatacagtgaggcttgaagtggacgatctcgttcctggtcaccatctagtttccttcgtcttcgatgctcttttcgacggcaggtaatattcagcgatctgatttcgactttgatctgtgaagaatgaagattgcgtgaaatgtgattgaatttctagggttttgagattgatgatgcttagaaccataattgggacgaaataggtaaattaaggcttagggaactattaaaggaaagatctttactcatgagaacaatctggaatcactcttccctatagaaaaggtttaaactttacatgatttgcttgatgggtttgtgaataatgatttcaaggcttgatctacaatgtgttgtgtaagctttaaactcaactttagatcagaaacgtagagaggtgtccttgtaaactgatcccatctttcttcagaattggattaacctcacttatatgatttgtattgatcaatgttacttaagaatagactctcattgtgttgtcctttcgttttcagtttcactatcaccttctttgcaaaggaggaaccaaattgcaccattatcccacagtttccagaggtttattcacccacaagattccattttcagaaaggtcctggacagaagtttctgcagccttcagggacaggaactgacctgagcttctttgttcttgatgatctgtctaaacccttagaagaagatgtgtatccgcttgtaatatcagctgagacgataatctctccaaattcaatctcagagcaatcatcagttcataagcaagtcacacaagcggttctcgagaaagataatgatggatctttcaaagtgaaagttgtgaagcagattctttggattgaaggagttcgatatgaactccgtgagttgtatggctcgaccactcaaggtgcagcctcgggcttagatgagagtggttcgggtacagaatgtgttatctgcatgactgaggctaaggacacggccgtgctgccttgcagacatttggtaacactttctcaatcttttgcttgtggtttcacaattatcatttcattttccaaaccttatcgagatctctgcctgatagctgataataccaacatgaactgtcatataaacttccaaagttatgcattttctttgatagacagttgttgttttcgatcagatccaaccatcaaggtctatagatcactttagaattagtttcaagaaaagaactttgtagttgctttattcaaacgtcttataataatgctgtatgtccttctttgcagtgcatgtgtagcgactgtgctaaagaattgaggcttcagtccaacaaatgtccgatttgtcgacaacccatcgaagagctcttagagatcaaaatgaacagtagtgatgaacaacactagtacaaaaaaggttctttctttacataaaacaccattcttgattctttcttcatttttctctgaaaccctccatatctgaatctgtatttccgctatcattgttgtgcaacttccttcattccgcatatagatttgtttgatctaatgctttgtatttgcaagatataagcatcatcagtacatgtatagataacttcctaacactctcaccaaactacttaatgtttgtaattgaatgcttttgttggtttgcttaagcacaaggatcctatgttgtggtccaagtctctcatagtatccaaacaatttattcacaagatctagatattaacatttgcagagttgctacggccatattatttaccatttatctctcaccagaaagttagaaattattagagaacttgaagaatttggtatttgcagagatataagtaaaagaaaagagagaaaaagaggagaagttgaagaagaagaagaatcatttttctgcctttttgcctattaggctatataagtttaaaacatcaattgaagaaaaagctgcccgaggaaaaagaatgtttcccactgaggtttagcttaaaagaaaccacaaaaggtccttttaaaattaaaaattcgattttttttcttttgacagaatggtcaaacttttgagttaagaaaagtcttaatatgatctgttattatgaaaaacagttttcatggtggatttttttttttttttttcctggttgattgcttgaggacaaaattatgtctatttagcttagttttatagctgaaaattcaatttagttaaagatcatttaattgactaaaagtgaaatgatatcaacggtgacgtcgaagagaataattaccttttaaaggccaaaacgtacaataatgcactttccgaaaatatgaagatgaaaacgaatccaaagggaaaagatggtaacacgacaaaaagcttgaggaattaatg

SEQ ID NO: 29359 - DNA, 3003 bp, Unknown; identical to SEQ ID NO: 27059
  misc_feature (1)..( 3003): 2750-1469P.txt file - cDNA_ID_3015906; gDNA_ID_2684103; Annot_ID_190296

SEQ ID NO: 29360 - DNA, 3003 bp, Unknown
  misc_feature (1)..( 3003): 2750-1469P.txt file - cDNA_ID_3015972; gDNA_ID_2684104; Annot_ID_190347
ttgcttacacactctataaaactaactaaacccactttacacacattacaacttccaccgtgaaaaaaacaaagacatggacaaaacatcttcgccggaatctgccaccatctccaccaaatctccgtcaacctccaccggaaaaatggagtgttcttggttcgacgatggttgcattcttggcattgattatttcgtcaaaaccatcgccggaatcaaatccaaaggtgttcgtcctgatctcattggatccatcatcgttcattacgcttcccaatggctccctgacctctccgacatcgtcctaaactccgatgaccagcaaccgcagccgcagcagcagtcagagagcttctctgttactgcgtttgtgatgaagaaacgttccttcgtcgaaactctaatcggaatcatcccacctgagagagattccgttccttgtgatttcctcctccgtctactcagaaccgcgaacatggtcggagcagatgcaaattacaaggcggagctcgaggcgaggatttcatggcagcttgatcaagcttcactcaaggagctaatgataccttcctttagtcacacgtgtgggacattgctcgatgtcgagctcatgactcggttggttaagaaatttgctggcttagacaacgaaggagttaaatccggtgcttccctaattaaagtagcgaagctcgtggactcttacttagcagaagccgccttagacggcgatttaaccctctcggagtttatatctctcgtcgaagctctccctaaccatgctcgtgtaaccgaagatgggttataccgtgcaattgacacttatctcaaggtaaatgttaagttcaatgagcttcacgacttaaaattaattggtaatgaatggactggcccgtctcacatttatatttattttacatagtagaagtaaaaaaatcgaaaatttgaagcatatataatttgtgatgggttttattcaaattgaattttggttatgttacttaggcacatcctaacgtgaccaagcaagaaaggaagagactttgtggactaatagacagcaataagctatcaatggaggcatctcttcacgctgcacagaacgatcgtttaccggttagaactattattcaagttttgttctctgaacaggcaaagctgagtcatcgcagccacaacaatattgaatggagtggttcatcgttcagtggcgttaggagcagccctaatccttctggttcacactactcagattctggtcctgcgcggtgtacgtccaaacgcgagattaatgttcagcaagcagagataagaagattgagagaagatatggcgaagcttaagtgcgagtgtgaagcgatgcaaacacagttacataagctggttgagaagaaaggaacttgtactagtgggaataaaggtttttttaggtggaagaagttgggatttaggagcggtttaagcgttagcgttgtggaaaacacgaatggtgaagagtttggtaataatggagaaggtgaaaattttgagtatgtgactcaaacgcctggtaatatgatgacaaagcttgttaaaggaagaacaccttctaggtggagaaaatctatgtcttgaaaaaccgtctttagtttctgttcttgttgttgccttcttgtgcatttgttcttcagtctttgtgtctgaatctaatattttgtacattttgtaagctcatatagtcatatcgatggcttgtgggtcaagtttcacaatggtttttatcttatccaagactctcttagaatcttagattcttgtacatcttgtttctctgttttatcatcagttagtttcttatcttcgaaacactacaagtctacaataggttttaagacattttctttggtttctcactgtcttggtttgttcctcttcaatttcctaatgctttttgtctttcactttcagcctcagctgctatctataaacctgcattagctatagcggctctttgggccaaatatttcggcccaaacaatatcaagcccaaaatatttgtcgttgaaaaaggctacttctaaattatcttctatatatgtacgaatgaaattgacgtatcttatggttcgaagaaaacaacaaagacttgagaagaaaactaaagtaagtcgaggtcaatgactaatgggatctcacttaaaacatatcccgtcgaacacgcctcttccatctttaaagtcaagtcaaccactcacgcataaatttattgaaccaaccactaaaaattgtgataacaatcatttatatttagataaatcattttatttattcaaaactttgttatgcgctaattactattaatatctaaccaattagtcaggatttttcgtattttttaacatgacctaaatatagatataaatttagaaatataatgttaatgattaattttttttcattcttattaactatatagttagacaacggaaaacatctgagatgattagttgagggtctatgaaaaatatcaaatatatatatatatataattattttcagcattaatatttatttactggaaaaaaacaatgcaaatgttggagtaaattaaaagaaaaataattaaggggaactaattgttcaaataaattaaaagaaaattccaaagacttttctctgttcactgttctgcttaacttcgagtgtaattgtctctctctcgatctgtgtcatcgtcactagtgatgtaacttcttcaccaaatcgaatattacagagaaacccatacatcaatcctcattgttcccaacttcctcttcttctcttccgaaccctttaatcaaagtttccatctttgtcccgaaatcaattgtcgcgactcgcaagttcctgtcttttttctccacaacaagagcttcttctgttcttgtcagtatgaaaacggtaataaatctccttcctttgctctttctctcatttgggttcctcttctcttctctagtaattgcttccttctcggaaatg

SEQ ID NO: 29361 - DNA, 3003 bp, Unknown
  misc_feature (1)..( 3003): 2750-1469P.txt file - cDNA_ID_3016015; gDNA_ID_2684105; Annot_ID_190500
cgttacatatttaaaagaaatcggtttgtggggattcatattcccacaaataaccaagtaaagatattgagtatcatgcattatcaaggaagtgcacacgtgctgaaacagattagccatttcttactggaaatggagtgtcttgaagttgtgaaagttgtcatctccaatggatgacccccaaaaggtgcaactcacaaaggatctattggaacttgccaccgcttcacccaagctcaagatattgaagaatctgttgaagcttgccaccgcttcacccaagctcaagatattgaagaacctgttgaagcttgccaccacctcacccaaggtcaagatattgatacgagatacggtatcacatacacccgtagaggtttccaaaacccgagtccagtcttaaagagtttctagttaggtttttggtgcttttcccttttggattaggttgtttttggttcttcttctttttacattaggatgtgtttgatcgttgagccgaataatttgctttgaatctctgagatcttaggaacagctaatggatcgtagtatgatgatattaagacatctttcttatggttatgaaagaatgcaaaataaatacatgcatctttgtactagtgtatgtatgtaaattacccactaatggtggatgtacgagagaaaaaaatacaagatcaaccattactaggacaattcaagtagccatacatattacttacaacattgtagaaaacctaacaaagttttgtaacagcaaataaataattttcttaactaagacataaaatataactttgaagtttgaacaataatcacaaactatagattcataaaaacactttaaccttcgaaatctgttttaacccactgaacatgtttcacattcatcttctcgtccaactccattttctttaaatccgaactagtcccatcttcagcggtcgagactcttcggttacattttcttctaaaagaatcttcactctcaacatctaacccttcgaactctctaacccaataacaatgtaacaaacaagccagcactagaaccattatctgtaacggaatcatcgccacgaaaacaccacattctactctaaccaaagctttagcctctctagggtctcgagtcgatatcagcaaagaaagactctgtttctctctactaaacaacattaaaactgcaataaactgacccgtcagtgaggaaacatgaagcgttatccgcgcgatgaaacatgatcgagattggtgcgaagaggcactaccgaaagaggagatcagagagacgagtgagactgcgaggaaggctaaaccgagtgaagttggagggtttctaagaagaatgattggtacgaaagaacagagggagaggaggaggagagtgaaattcagacacgatacgagaatgttttggaacaaacataactttctgtgaaaagaagccattgatgttttgtgaaattatgttttttttgtttgtttcaagttttatataggtaaagtaagaaactaagcgcccgttggggagaagatgtaacggctatgatgaggtttaacggttatattgacataatgggcttcacaaaagtattgtaatagatttttgacctttagcctcacgaaaatgacggtcgtatatatttgaattagtaatactattttatcattattgtttacataaatgcctgaaactaaattgcttttttttttcttttcttctcaaagacctaaaactaaattgctactcgaatagaaatttgaaaaggattattatttttgatatatttcatgttgtccataaaatactcttttatgtcaattgtattttttaagcatctaaaatatttaaatttttcttctttctcaattgcaatattttaatattttatttacatatacatagactataccaaaaatcccaaaaaagattataaaaatattgaggtacaatatgagcttataagattactgtttaactgcaaaagaaattgtgtcttgactccatccaaacccacgtgtcaacaactgcgtgcaaaacaacatgtgttcgatgagtaatcgtacgatttccaagatcaaccttggtcgttgggtatatatttcggtaaaaaaatcatcgtcgaaacacaatcgatcattaattcttttatttgtcactgtagttaagccaattgaaactctaataaaaaattaagagcttaaaaacaatagaatatgcatctaaagatttttctttccttcaaaccaagacacaatctttaataatataattaaaacaaaaaaggtaaacataaaacaaagatgtttgaagacaccaaaaataggacggtgaaatttgacacaagtaataaaaaataaggtttgtattaatcaacggaaaaccatagattagaccattagagcattctcattgcataattatttttttagtgtctcaaaaccaatatatttaatattttaatattaaaagcaaactaaccattaaaaaaaaatttacagaagtggacgaaaaaagatttgctctcaccgtttgtcaaagtgagaactggtttttacggtttgtcttttcattcaatttcggaccaaattaccttgggaaaacttaataatggcacaaaccaaaccgtgcagcagttcgtatcggttcagttgatggcataaaccaaaccctacagcagttggtttcggtttagttgatgcggttcagttttgaaaaagacaaaacaaaaaaactgaaacgaagaaaccgaagaaaaagaaaaagagaagagagtaacggagagatttgagagagaattagaaagcgaaacgaaattcagtatccattgtttcaaaattcgacataacttcgaattgttgggtagttgaattgagtcactgaactcccacatccggggaagagaaagttactgtttttcccggcgaagccaagaaaaagttactgtttattccgacgaaatttgaacctccggcgagatagcaactttagctatg

SEQ ID NO: 29362 - DNA, 3000 bp, Unknown; identical to SEQ ID NO: 14336
  misc_feature (1)..( 3000): 2750-1469P.txt file - cDNA_ID_3016205; gDNA_ID_2684108; Annot_ID_190559

SEQ ID NO: 29363 - DNA, 3003 bp, Unknown
  misc_feature (1)..( 3003): 2750-1469P.txt file - cDNA_ID_3016209; gDNA_ID_2684108; Annot_ID_190558
atttaatgtttatctctaaccgccatgcaagcatatacacaggattgagtaaggttagacacaaccatccatctcacgttgcttcatatagtatacatatatcgatttacttaatctgccaataagctggttctattttgattggataatgaatgatttccctaatattgttgcaggtctatacgcaagccaaccttgctgcttgcacggttcacctttggcgcaatatcagacatctatataagccaaaaagcctctgccgcctaatgtctcaagctgcacaagctttccatgtcacggatttcaatcggatattcctgaagatacaaaaattgaaccccggatgtgctgcatatttagttgatttgggtaagtgtttttctcagcttacatatattgttattaacgtggctgagatgaagtttactccataacctctgtactttgtaattcgtatagggttttcagagtggagaagagtgcattccaaaggccggcgtttcaatatcatggatagtaacatatgtgagtcttggaacaacgttatcagagaggcccgcgagtacccgctaaactgcatgctggagtacataagaacgacgttgatggattggtttgcaactagaagggctcaagccgaagactgccctacaacattagcttcgagagtgcaggaaagagttgaggaaaactatcaatcagctatgtcaatgtctgttaagcctatctgcaactttgaattccaagtacaagaacggacaggggaatgttttattgtcaaattggacgagtccacttgttcctgtttggaatttcaggggttagggatcccttgtgctcacgcaatagccgctgctgcaaggtttggcgttccaacagactcgttagcagcaaatggatattttaatgagttagtgaagcttagttatgaggagaaaatctatcctattcactttgttggtggagaggtcgcaccagaaattgctgcaggaactacaggagagctgcaaccaccattggttcgctggccaccagggagacaaaggaagatcagaatcttgtctcgtggtgaattcaaggcaagtacctattagtaaacattacaatgtacttcttatctattaacaagctaatagcctatctacttttaatatgcagcggaacaggacaaggtcccagaggaggtgttcacgttgttgtggtgttggacacaacaaggcctcgtgtcgtaatgctatataagtcgtcaactactgctatggggtgctaataggtgttatgaagaaactttgtggagtgggcttaaataatggttgttcccacatatcttgcggaagcgggtttgtttacttctactaatgcaggattaagtacatttattgaaatagtttggtatacccaactttgatgtataccttattattttgatttttatgtactacctgttcatcgttatatttgtattggtatctctaatcccgatgtaattaagtaatgccctgtaacaccgcttttgaaatgtatatatatgaaaccccgctgtttgtgtaatcacccttctctgcttctttcaagtgcaaaatcatccatatcttacttacatactatacagtataacgaattacgaaaactaaaccttaataatgaagtgggaacccaagcaatgatgcatcagtaattgtatacacagatttttcctgtaacataatcaatggggtaaaccataacaaaccaaaaccatcactctgcctttggagcccaagcaatgagtttgtttacacgtttgatgaaactgttggccgaataacatatgttttacttagtttcattatgctgtatgttggagatgcaatttcagtcaatcgcgagcttctacctgcaagcatcacgtttataaatgttatgattatatagccaaacgggcatcgtggatggcagcttcggcataaatagttttgcatggtatcctattctatttactacttactgtactattccgaaccatatgcaagattcaaataaaaaaagctcgtgtcgatatccaaagtattcaactaaaattgttttcttttgatgtcatgttttcagtatatatgttgatattactcgttaagttataaggatatgcaagaacttgacatttcatttattagttgaatactttggagttataggagtttgtagttgtaggagttcagcatatctgttattgcatcactgtaatataacccaacacactaggctaatagactgaaacatttcacttcaaacataaatattcaaacatcacagttattagttgaatttcaatacaattggtctctgattacaaaagaaactccatgtttgttcaacataaattacacatctacaaatcaaacaccacgttctgttggagacaatgcattgaaagtttcgatagcgtactgtttagctgcatctcgcatcttcccatcatctaatttcccacaatactctagagcgtgtgctcacgcacgggttaagtttgtcaatattacataaagttcaatacatattggttgaagtgttagttttgcaattataattcttttgttggtcatatttgcaaatttcccatatttttagtctaatttcagtttttagtttatttcggttcggtttcatagatttcaaacggtttataaatacatttcggttcgattacagttcaaataattctatttttccggttcaggttattcttttttccggaatgcgaaaaaaagaatatcattgtttgctctctcaatctcaacaacaacacttctctcactcaatcgctttctctttgagacgtttgtttagtttcaacaaacaaatcaaaacacacaaagtttgtgtcttcccttaagattcactcaaatctcgcaacacacacattcaacaaatcctgattcataacatctcaccaaatctctcaaaagatctccaaatctaaaatgttcttcttcttcttcttcatctgaatccaaaacaacaatg

SEQ ID NO: 29364 - DNA, 2909 bp, Unknown; identical to SEQ ID NO: 14494
  misc_feature (1)..( 2909): 2750-1469P.txt file - cDNA_ID_3016263; gDNA_ID_2684124; Annot_ID_191050

SEQ ID NO: 29365 - DNA, 3000 bp, Unknown; identical to SEQ ID NO: 14333
  misc_feature (1)..( 3000): 2750-1469P.txt file - cDNA_ID_3016263; gDNA_ID_2684108; Annot_ID_190542

SEQ ID NO: 29366 - DNA, 1192 bp, Unknown
  misc_feature (1)..( 1192): 2750-1469P.txt file - cDNA_ID_3016274; gDNA_ID_334; Annot_ID_144272
  misc_feature (9)..(10): n is a, c, g, or t
  misc_feature (23)..(24): n is a, c, g, or t
  misc_feature (45)..(45): n is a, c, g, or t
  misc_feature (77)..(78): n is a, c, g, or t
  misc_feature (83)..(83): n is a, c, g, or t
  misc_feature (85)..(85): n is a, c, g, or t
  misc_feature (88)..(88): n is a, c, g, or t
  misc_feature (91)..(92): n is a, c, g, or t
  misc_feature (98)..(98): n is a, c, g, or t
  misc_feature (134)..(134): n is a, c, g, or t
  misc_feature (137)..(137): n is a, c, g, or t
  misc_feature (142)..(142): n is a, c, g, or t
  misc_feature (145)..(145): n is a, c, g, or t
  misc_feature (154)..(154): n is a, c, g, or t
  misc_feature (163)..(163): n is a, c, g, or t
  misc_feature (180)..(180): n is a, c, g, or t
  misc_feature (186)..(186): n is a, c, g, or t
  misc_feature (201)..(201): n is a, c, g, or t
  misc_feature (212)..(212): n is a, c, g, or t
  misc_feature (222)..(222): n is a, c, g, or t
  misc_feature (235)..(235): n is a, c, g, or t
  misc_feature (283)..(283): n is a, c, g, or t
  misc_feature (288)..(288): n is a, c, g, or t
  misc_feature (308)..(308): n is a, c, g, or t
  misc_feature (316)..(317): n is a, c, g, or t
  misc_feature (329)..(329): n is a, c, g, or t
  misc_feature (335)..(335): n is a, c, g, or t
  misc_feature (337)..(337): n is a, c, g, or t
  misc_feature (346)..(348): n is a, c, g, or t
  misc_feature (352)..(352): n is a, c, g, or t
  misc_feature (357)..(357): n is a, c, g, or t
  misc_feature (361)..(361): n is a, c, g, or t
  misc_feature (372)..(373): n is a, c, g, or t
  misc_feature (382)..(382): n is a, c, g, or t
  misc_feature (384)..(384): n is a, c, g, or t
  misc_feature (393)..(393): n is a, c, g, or t
  misc_feature (400)..(402): n is a, c, g, or t
  misc_feature (412)..(412): n is a, c, g, or t
  misc_feature (463)..(463): n is a, c, g, or t
  misc_feature (470)..(470): n is a, c, g, or t
  misc_feature (483)..(483): n is a, c, g, or t
  misc_feature (488)..(488): n is a, c, g, or t
  misc_feature (516)..(516): n is a, c, g, or t
  misc_feature (539)..(539): n is a, c, g, or t
  misc_feature (671)..(671): n is a, c, g, or t
  misc_feature (680)..(680): n is a, c, g, or t
  misc_feature (682)..(683): n is a, c, g, or t
  misc_feature (696)..(697): n is a, c, g, or t
  misc_feature (716)..(716): n is a, c, g, or t
  misc_feature (725)..(725): n is a, c, g, or t
  misc_feature (745)..(745): n is a, c, g, or t
  misc_feature (751)..(751): n is a, c, g, or t
agtctcaannttcctagaattcnnatgtggggtttgccttatgcncatatgtatatctcataaatccgatacaggtnngcagnancgnagnnactgtncttgtggaacaacgagcacattgtgggtctaatcgncgncaaanccngaagcgtgnatccttccnaatcatatatcccacanctggangaagaacatccagtntcactggaacncaagcagttncatggtctaaccncaaatatcaagaaaatgttcatggaaatggatcctgaactgtttgaangaatntcagagacagtatgaagagnaaacaagnngaaatccaaagnaagtangnagaacaacnnncaantatancatnggaagagattnngcagaagcnangcggcggangcgagannnggaggagganggagaagaagatcatatgatcacttcctagatcgatcaaaaagggtataanttctttncactttttttttngtttngtactcattttatcaaatgagttactantattaattttcttatcaaacttnggatttgtttgttgttttgagaatcatgggttcaaaatctgattgctcagagaagtagagagagagaagtgagccattactatcagagaatatgtctttagtactaagaaatgtgtttgtgatcttctgtcnaattttgtncnnggaaaggcacttnnaaaattttgtaaaattttnaattatatntactgtggatggatgtttgnagctgngttattagccatctcaaaatccaatttggttttcttgttttgatccattcttaccctactttttgtgttatttgtatcaaaactttgaatttgtatataggaggaaactagtcttccaactgatccaggacaatgtatttgattcctcaatttccaaaagataagaagagttttcattttaactcttaaggtaaactaaacacaatatcgtcttctttattattaaccaaattggttcagagccattggaccgaaaacatagaccgagagaatataccaagttatatacagttaactgcgccaattcaccacgagaaaacctaaattttattgaggtagcttattgcacggcggcgattagttgttttacttgttacaagaaaatcattcacggcggtggagaaaaaacaaaagagagcgagacaaagagagactacaatg

SEQ ID NO: 29367 - DNA, 3003 bp, Unknown
  misc_feature (1)..( 3003): 2750-1469P.txt file - cDNA_ID_3016285; gDNA_ID_2684110; Annot_ID_190581
tgcaatgataagtagtgtactgttgataaccataaccttatagtagaagataggaccatgttggtatttttccacaacttttccttctctttttacaattcataacaaatgaatactgtcgattagttcaatatataaatataagtaatacaaatattcctatattcttgtaaaatgacgtggtgactatgactaaacaggtgattaagtatattatcaaatatatcaatggaatataacagtgattaagaagaataaacaaaattaaaagattttgtggaatggattccactaaaccactacgcaatttaaaaataaaaatacttaactaatgtatagttatttattcccatccatgcgttcatattcactttgaatgatcatattcgtaatcctatttatttattttactatttgaaccttttgtgtgtataaataatttcaactagagagaatatccgcagcagctcgttaaattagtcattgaattaaaaaaagatattcaaattttcacccaagaaaaacgaacgcaactaaaatgacgttcaaatttggcatcatctttaggtgtatattattgtgagagatatgcaagcatgaaatctcatgcaggataagaatcattgttaaatttattttaattccgttatatttatggtaatatcatcctattaccttttctaaaattatgtttcactctttagttcaacctttggtgatgaaattcgattctttcatatctcgtctccgctttgcaaggatttgtccgtacaataatcatatgcactattttaattatttttttgttgggtgggattcaaaaaagttttttttacccctctatcagctagttagagaagtgagactatatatgattccaatcaataatacatcacatctatatttcgtcttgtaacgcggccacataatcttcatcaacgaagcttgaatgttgtaatagtgtttcactatcaacaacacacatttgtaggccttatgtaattagcgagagaactctacagtctacactataactttgagtggaaataaatactcgtatatggtaacataaaaatactatgaacttatgattatacaaacttgtaagtaaaaaagagtggtaaggctatgtaatatcgtcgacgttttctaggtaaatcttaagctataaaaaagattttgaaacccaaatagtatcgagtgatagcattagtctcatcgggtggttacaagccaacattgattcgtgttgcaaattttattaaatacaagggtgtacacaaatcaaaacgcaataatatttttggatcatagtctttcttcactatcattgggaaaaataaaataaaataagaaaaatagcgatagaatttcctctgtaaatgagcaaaattggtaggacaagtcagcatttgacacgtgtcggtcatgaatacgactaaacagcgtggcaatttctcttactctgacgtgtccatgtggggaccactttctcctccgacacttcggcatggctttctcaactttttatcactcttcttcaccattctcatttactaagcgcgtgtctcccacctctatccgatttaattttttaaatttgacgtttcaaaagttccttctataaaagcaattaacgataattatatgaaatccgtaaacatgaatttttcaaataatttcgatttttgatttgctaagattaaaagcgcgtgaaagaaaaaaaagaatacagcatgaacaccagcgactcagaactgactcggcacgtggtaacataaaactcacacgcttcccaagacgctcgtcccataaagagtcatggctgtgaccttgtgcgagtgtgggtgtagccatagcctttgtgggtcctaaataaaaaaaacgatcaatggcataatgtgtaattaactcacattccacagtgttaaataaaaattaaatctgtaacggaaaaaacaatctatctgatgttacacaaaaaaaaaaaataacggaaaaaagaaaatgtggccggggtttaatagagaagccgacacgtttgcctgccacgatccagacacaagacgatgtgggtaacggcaccgtcaagtgctaacggcaacggggtcatcagtaaaaagggcaatttagggatatagagtaaagtcataagcttatttattactatcgtcttgatcggacggctgagatttgccctctcctttaaatgcaccgtacgttttttttttacataataaaatgtaattagttcataagcaattcccaaaacgccgcgtgacccttcgtttgcctttgaatacaatttgttttattttagcgcatttaatatatttgagtttcctttttagcgatgacatgataaaacaaaaaacaacaattttagaaaacatttaattaaatgaatagaaaaatagggagattcaactgaagttactgtgggtggaaatgacaggtctccaggatctgaactaagagaaagtctctctatattttgatatatagagagagataaagaaggagagagtgtgaatatatgtatgtgcatgatactgtgagacttcttcagtaaaggaagcagctttggtttgctgcggatcgggataaaaacggcgagaagtttgtgattgttgaagcaaaacaacacggaatctgaaaggaaaggagaagacaaaaaaaaaaaaagattttaagaggaagagagagagagatcggtttcgtggctgacggaaaaaaaaaggggagagatttagttttatccaacagtgcctgaattacgttctgcaatcaatacggacataaccgtccgttgtgtcctgtttataaagttttgctttttttattttctccattgatgggtcttttctttcttctctctctcgtgtttctttcatggggttaagactagtgtttaccgcgtgaaggtttttttttctttctattttctttcatttcctctccttctacttcttcttctccagttctcatctgggttcttcaatg

SEQ ID NO: 29368 - DNA, 3003 bp, Unknown; identical to SEQ ID NO: 29367
  misc_feature (1)..( 3003): 2750-1469P.txt file - cDNA_ID_3016285; gDNA_ID_1972158; Annot_ID_179524

SEQ ID NO: 29369 - DNA, 3000 bp, Unknown; identical to SEQ ID NO: 9582
  misc_feature (1)..( 3000): 2750-1469P.txt file - cDNA_ID_3016291; gDNA_ID_2684110; Annot_ID_190575

SEQ ID NO: 29370 - DNA, 3000 bp, Unknown; identical to SEQ ID NO: 9582
  misc_feature (1)..( 3000): 2750-1469P.txt file - cDNA_ID_3016291; gDNA_ID_1972158; Annot_ID_179517

SEQ ID NO: 29371 - DNA, 108 bp, Unknown; identical to SEQ ID NO: 339
  misc_feature (1)..( 108): 2750-1469P.txt file - cDNA_ID_3016291; gDNA_ID_1564055; Annot_ID_148763

SEQ ID NO: 29372 - DNA, 3003 bp, Unknown; identical to SEQ ID NO: 27074
  misc_feature (1)..( 3003): 2750-1469P.txt file - cDNA_ID_3016329; gDNA_ID_2684110; Annot_ID_190602

SEQ ID NO: 29373 - DNA, 3000 bp, Unknown; identical to SEQ ID NO: 14339
  misc_feature (1)..( 3000): 2750-1469P.txt file - cDNA_ID_3016333; gDNA_ID_2684110; Annot_ID_190597

SEQ ID NO: 29374 - DNA, 3000 bp, Unknown; identical to SEQ ID NO: 14362
  misc_feature (1)..( 3000): 2750-1469P.txt file - cDNA_ID_3016361; gDNA_ID_2684111; Annot_ID_190636

SEQ ID NO: 29375 - DNA, 3003 bp, Unknown
  misc_feature (1)..( 3003): 2750-1469P.txt file - cDNA_ID_3016374; gDNA_ID_2684111; Annot_ID_190632
gtggcttaaaataattttgctagtgtagaattatcaaaatggtagtttggtagcaagtaaaggagataggagatctcagttgaaatatttgagaaattgttggttgtagttattatagagagatttatggaaatgttttgagttgttaatattatcaacaataaatttgtttttttgtaaaattgaattattaagagatttctagagtattaaatattaatagagagttttgtggaaagttttgttaaatgctaaatctttttttttctatttttaaacaaaatatgtaatgtcaatggcattgggttgtataagttcaaactttaggatttatttcataagagtgtttgaaaaatgtatatgtagatatttgctcaatgtattattattgttgtataaatttgtttttaaatgttatatttttttatatttgaatgtatttgaatttatatgaataaatttgtaataattaaatgtaatggaattatttgtaagatatattaagtttaaggaataaaatgaaatttagaaaagttttttagggtgtgaatagtgtactctcaaatttggatgtgcactaattaggatttgaaggtttgttggaattcaaaaaatcttcaaatttaaaaatctgaggccttgttggagatgttctaacacatgtttttttcaaacacacaaataaatttatacgtgttttttaaatgtcatgtgattttgtccacatttttaaatgtcatgtgatttctattataatatcaaatatgtaatgtatcatacaaaaaaacacatagcttaactataattttactaacactatttttttttgttatttgcctgtttggagtttacaatttgttaactactatcaattatactctcaaaaatattttaatgccccaatatacacggtgcattaacttatactttggataactctcacatgcgttctggacaagactaaataaaataataataatattaagataatttatacacggacaattttgttttttaaaagttagtttatattaaaatttgcaaattttctctattgaaaaaaaaattcttttaataattgacaattgttattaagtaacagtatacaatatgtctcgtaataattattaataaactgaagatttaagctgtattaaaacgaaatgttaataatatttcaaagttttataaacattgatccaaacccactgaccacatagtcccgtaccgaaatataacatgtcccataatttcttaatctatcccatgatttattttctaaaagtagtgatttttaaaatttaataattatttattatatataaaaatttacaaattttattattatatgagaaagttgtattttatagtttacaattggtattaagtaacatttcttttctaatctgattaatttgatatgtctaatattggtggtgttaaaaaaaaaaaaattaaagatttaatatgtattgaagcaacaaattaataatattttattaatgttgattcaaaaacccgacccgtcaaatccgtcccgccaaaaaaacatttattttattaatgttgatttatgatatgattctaaatcattgtctaaacattttagcccatatgggacattgaaccaacacattttggcaattgggtaatatatgtttgtttttaaaatttttaatcacaagatatgcaggaaataaaattgagatttgttttaactttatatattatacaatgatttaacagaaaaagtcaaataaagatgataggagattcatagtcttaaatcattaatcaaatcttctatatatctatattgttaatatgaaaacatccggtgtaagagatttaaaaacggatttagaatcaacttttattaaaaccgatccaactaaaaattaatgtacaaaattgctaaatagactggtaccaaattgactcacgaatgtatttttcccactcaaataaatccttacgttctcttttcctaatcaacagactcgactaatactccttaatgtatttttgtaagaatcaattatcgggttgaattttttccaaccagaaattacaaaagtctgaactgttatcctaccttattcttttaggcatttcccaaagaaacaaaatgttatttagcctcaattttcttttcctatgtttgtgagagatggtagtatagattaagatccagtgatgtcgatcaagagatgaatattgagatataaaccggttatctttggttacattggttaagtagaatccggtttaatgtacagactatatataagcttatgtgtatgattaagtttaattaagtttttgtaaactacagtttaagctgttaataaagagtttgttatcttttctgttctccgactatctgcgatcatcggacttcaacaatgaagatcacgaaacgaagatgaaggcactggaaacgagatggtggtgacgatgatgagatcgagtgataggatgaggggataatgagatccgatgacaaattttgtttagaatcatatatatgaaaggcagtgccgacttttgaagaagatgagtcggatccaacaggagaggagccatcaagtgaagagcctactacaccaccaacttcaccaacaagttctcaaatagaagaaagttcgagtgaaaggactccacattttagaagtatacaagagctctatgaggtaaccaaaaatcaagaaaaccttaccttattttgtttattaacggagtgcgaacccatggatttccaagaagccattgaaaagaagacttggaagaaatgccatggatgaagagatcagatcaatataaaagaatgacacatgtgagttaacttcacttccaaatgggcacaaggcaattggcgtgaagtgggtgtataaagcaaagaaaaactctaaaggagaagtggaaagatacaaagcaagattagttgcaaaaggttatagtcaaagaaccgaatcaactatgacaacgttagactaatcaatg

SEQ ID NO: 29376 - DNA, 3000 bp, Unknown; identical to SEQ ID NO: 14367
  misc_feature (1)..( 3000): 2750-1469P.txt file - cDNA_ID_3016469; gDNA_ID_2684112; Annot_ID_190669

SEQ ID NO: 29377 - DNA, 3003 bp, Unknown
  misc_feature (1)..( 3003): 2750-1469P.txt file - cDNA_ID_3016479; gDNA_ID_2684112; Annot_ID_190666
cggaattgttttgtctatgacatttagtaacatcagcgcccacaaatactagcagtgtcatttgattatcctgacaaccaattacatacagatataaccaaacactataaccagtaaggaaaaatttgtgcagctacaaatatacctaaggttcccgtgagtgaagcaaaataaaaagaaacagggaaaaatagaaacagccaaccagtctaagcaccccaaatctgctttagaattatacttaaagagaaattaaaagattgcatgattacctttgagccataacagttactgtatcagaaagactcattgtccggctctggcaagcagagacacaagaagcgagaaacgaagtcctaagagtagctctagtaaagtcatgagcaccatgacatatgatcttcttaatcaatccggtgatcccctgaaactcaggctttgtactcaagaaccaaactgaatctagaccaacacacaacaaatcatttaaagtctgaggatcagccaactgaatcaatctctcagcaagttcccaatccagtgaggtaacagcgccttggaagagccgtcccaactcaattctttcttgcctattaagctttttctgctgctcaatattttccttctcaacgagatcatcatcccctttaaaatttagtttcttagcactacaaccacagcattctcccgaattagttccagctgaatcctttcctattaaaggtgcctctctcgaaaaaaccactttactcccctcgcctccttcaaatttctgagatgaagcaatggtttcagttttcatctcggaacagaaaggctcatcagggtacatctgatcacttaaattaatggtatcacacacaccttctttctccatccttgtcaagtctgtgactttccaaatcaaactaaaaaaagaagcacacaaagcttattcatccaaaagctatccgcacaacagaccacacactaaacaaagtatatagcaaatccaatccttgcatcatcgaaatctacaaaaccaaaggccaaaactcaaaacccggaactgatccctatcaaaatccaccaacacagttcattctaatcagcgtaaatcctcgatgccttctcttaaacgcactatctcttgaccatgggcataggaaatcaacaacaaaccctaaaaatgaaacaataaatcatcatcatcagcaaacggaaatctatcaattcgattaacagtgaacacgaaatcggacacccgatcagaaaaaaacgaatcgagcatcagaaaagagcgaagaacaacgaaattagcgttatacaaaagaagcagcacatgaaccatagaagagaaaaagagagagagaaaatggtgaaacctggacaagagttccattgagacagagagagagaaagagaaagagaggctgagaaaaaccctgtgcatcgggttctgtttttttatttttatttgacaaaagtactgctttttaatacaaaaatattctcttgatttattaacatttgtcgaatctttagttgattaaattctaattatagattctctcttctttctgtcgctgttaatctcccattgtaattcagaatctatgggaggggaactcaaactaatgactacaaatcatatggaggagacaaaaagacttggaattatttttaggaatcattcaacttataagtgttctcatttttttgttgtccctttagaaattagattttaaataagttgcgtcaactatacaaaaacatttcttatttttattctatctatattgcatcactaacatttttttcctttctatttctgtagtttaaaagactcgggtctttttacttctttgtttagtggttattattacattaagaaggaaaaagtaaaacaaatcatcatataaataagaggacgataaggatcggtcttcagctataaacaagtaaagaaagttgagattcgaagactctttataagtcattggatttgtagtaaataacaaattaacaacacaacaaattaacaacacatatactacaaattcgagttaaaaaccccaatataatatatgcatcgactactaaacgcgtttcaatgactggtaaacatatgtaactatctctgttacatattgaatgaatgatgatgtaatagtagatgctaacataagctcacaattatttgaataattaaagtcataaataaaaatcatctataatgcgtgtaagcttgcataaaaatacagtatataacttttatttaaaactattaagtatcaacatcaatcggaaaatgatttgcttttgaagttattacaactagtttattaaaaaaattgttatcatcatctcgattttaataatgctatatatacttagtcttttatttattgttattgtaatatgcgaaaatgacttgcaactgagttgcttacgggcaaacctgaccaagatgtgggaagttcgaaactgcaaatatgtataattcttaataaaaaaaaaatatatcctacatttcttcattttttttttaaaatactaatatttgcatactttgttgattgagtttctgaaaaatcataattgagtttttaaattagttggtttgtatgcatttgacaacttccaatttcttttaaatatatcacttttcatatattcttgtagagctataattttacaacaataattgaaatgtcgacccaaaaatatacatttaaaggcatttcgctgataaaaatccagtttagatgtatttgtattataggggaaaacaattatattattggttaatatttattagtcgatattgggtacatatgtatgttcttttacgattatgccatcaaaaaatttattagccattcgagaaacaaggcatctctatttttttgcttcttctaatagacttcttcgtcactgatctcccacgacgatctcccaaactcatttctctacgttcatcgatctctctctttctcgtttgctctacgaaaatcagccatg

SEQ ID NO: 29378 - DNA, 3000 bp, Unknown
  misc_feature (1)..( 3000): 2750-1469P.txt file - cDNA_ID_3016489; gDNA_ID_2684112; Annot_ID_190661
tcttctcccctggtcttcttttctcttactttttctaccatttcttttacttatataacatatgacgtaagctacaatctcctctgatctgaatatgtaagtagtatttaaataaatgagttttaaaaccatctttttaccattctataaatttttaagaaaataattttctagtttattttgaatcatccagttattaatatacaggttgatttttaaaattttataatcaaatatttgatgcgatgaggaaattatttttattaacgtacctaccaataattttgtcgatgtttatggataaataaggacccatagtgttgttcttctcgaagcacttcatatggtgaatgcgcttgttctaccaggaaatgttgggccaatatatgtatatgctctcatatttctatatataaagccaagttaaatagctaggaatgtttttcaaattaattcacgatgctatttttatatatttacgtgtatatggagatcggacatagtaacgtgacaacacgctttgcatgtgaagtcttgatgagaggatggtttttaataaagccaagatgtttatatcgccagaggatgaattctcacagaatgatgaattaaagcaaatagacttcgctagtaactcagtcggaaatcacttgttacttttaatatataaatatagttaatcccataaatataattcatggttcaatgaattgagaaacatataggccatttcctttagaaacaacgtcaagtggttttattagtttttttcctggcctttagatacaaaaaagccgatgagtagtttgggagaattgatagattaccaatactacaacactagttatccacattaattgtgcagcattactttaattaggccaaattaacaatatacgaagactgcagcttcagatattaaactatttgacgtgtaccaacaaagttttttgcatggatgacaaaccctaaattaataatttagaatgtttatatcgaaagatccgctagtttctactcctactctacagatacgaaaatcgtatatttagggatgagaaaatggatctccttgaatcgttgaccaaaaaaaggaaagaaaattgtcaaatggatcttctcagcataagctcaactaaaaaaatcaatttatttgtgtttagtgtttgtctctacaatcaagagaatacttttactaaaatatgggttcataaaaatgttcactgaatgtatacactagtaaccaaaacttatttggtgcggtttaagatttattttttatttaaataaaagtacttccttttaagttctttggaaacaaaagaattaatcagtttaaaattcagttcacttgtgtgtttgttcttggatagatatacagtattacgattaaacatctctatttgtacgtttttaattagtaatggaatttgtttattgaagactagatgagtaaataatggtggaaagttaagatgtaggtgtgtatatatggcaacccatgcatgattattgccttgaacaccgcacacatttagattggtgtccagtggacctgtatcaaaaagttcaagaaaaaaaagtattatcataatattattccctctgtcttactaataagtcagtcatgtttaaatattgcttcttcttgttttatataccctacttctaatttaattgattttcgacagtcaatatgcatagacatatgttttggtctaattcttagacacttgatgcattacaataatctcaataacaaggtccatatgctcagtttcataacgttcgcgaattttaaagatttttgttttggtcagcttttttagatttgataatattattcgattattatcttgtgaaatattattccattattatactaagtataatttgagaaaaagattactacagtataatttgagaaaaagattactacagtataatttggttgatttgtaaggagaaaggcgatcgatgagacactgaggatcgaaccacatgtaaacgtcacgtggctctttgcctttgattcaatgcatgatctctcgagtctcgaccaaaccaacttgcctaattaatattcctcgtacgactctttaatccccttttttgtttgcttaaaaaaaaagattacaaattattttgtttgttgtttttttttttgttttttttaatcccctttgatacaaattattttgttattgtggaaatttaacccaaattatttgaaattctttccccgacaagcatctcttattgtggttggtctaataggattaatggtcgttttcgtgagtgatgttatcatgaaacaagttaattgaaaagtgttcataatttggtttccaaaatttaggagtatgattaggttcagagtatcataagtttgtatgtcttagtgacaaagacaagaataggtatacttacttttatgggttaaaccttttcattttatcaagctttaattaattaaaaatcacagattgaaagggaaattaaacgaatgacgagaaaaaaacaatgtatctgctgcttacctgaggtcggtcattgggttcattgcattgatcctaatataccaaatttatggttcatattcaattttatatttttagctagctccaacaaaaacaatgtttccgtacattttcgttgtcaaaaaaacaaaagatgattcatgacctcttaattaaagtgaaatccggactctgaccattaattaaggaaaaagtagagaaactccggtttgataaattaattaaatagaaattccggtttgaccattaaaatgaagagaaattccggttttcaattttagtaacctttccggttttggttgaaacaccccaaccttaaccagaagctttggatctgacgtaaagggaaaatgtctaaaaccctaccgttcgccggttcgaatttttcagacaaggtttgaacataaattctaatttcgttgctcgacagcaatctcggaccaagtggaaaccgaaaatg

SEQ ID NO: 29379 - DNA, 3000 bp, Unknown
  misc_feature (1)..( 3000): 2750-1469P.txt file - cDNA_ID_3016497; gDNA_ID_2684112; Annot_ID_190659
tttggttgctcctttttttctgtggttatgttttatgtgtgttatcgttgaagaaagaagaaaaatagtaaaaccaaaaacaagagaagaagaagaagaagaaaggttattaacttattatgtgttgtgtggggaagttgggaggtttatggttttggtagtggtttggtgatttactcaatacataccttctatttatttcatttgtctatctttctttagaaagaaagggttgttgacttgttgacaaaaaaaaaaggttttcattttctcttctttttcaatataactgattcataaatattctttttgtttggctaatatcactaatggttgaatttacgtctaggcgtatgtgttagtactttcttgtattttataatttaactgaaactagattttaacccgcggtatatcgcgggacgatttatttttaaaagtaatatatattaaaatttgcaaattttacttttacaaaatatttatattttacagtttataattgttattaagtaacgctataccacgaattcatgagacaattgttaaaaaaactaaagttttgacccctattaaaacaacatattaataatattttaaaattttataaatattgattcaaatacatccaccatataacccaattccaaaataaaacacgttctgtaatttcattatccgtcccatgatttttttctaaagtagtaatttttataattttataattattttttatatataaaagttttgcaaattgtatcattctctaatacatttatattttatagtttaattatatatatattaacattatacataccacataacatttttggttctatataattttttctaaattaggatgatttgatatgtttaatattagtggtcttaaaaaataataaattaaagatttaacccatattgaaacggtggattaatatatttttttattaatgttgattcaaaaatccgtccctccaaatccgtcttgccaaaaagtcatttattttattaatattagttttattaatgatatgactctgaattataatctaaacattttagctaataacataggagtgcaccatatttatttaatagaggaatgtaccatatgactcgaatgcatttttatccaaatccactaaaaaagtcttgcaaaaatactatagagataagaaacgatagtcggttttggtagatataagattagcaaatatattagttagcttaaattagttaaagaatacaaattaaaaaggtatattacattttattcaaatatagtatcaaaacttatataacacagagatttgataaatttttaattgttgaatactttttttttgtgctaattttttgtgattaatatttaattgatttcatatataaaatattaaattgacttatttgtttataatttggtaacaaatatatatttgaatattcagtatattttgcttcagtttaggaaatctttgatgacccgtctttagatctaataagtcttataatctacagattaatctgcagtataccgcagttaggcttatattttagttaaactaaaaacttttattgtaaagataatttaaaaatatatgatattattttatttgattttaaatgtatagtagactgtgagttgtaaatgttttgttgatattatctatattgtttagtgtttaagattatacacttgtagtttgattgttaatttaagagtttcacatgtagtataccatcttgtattaatatcgatctaaacccgtcaattctaggattttccagcttgtattaaaaattgaatcacatctaatatgttattaactattgtagtatataagattataaaatttcaatataatatgtatgaaattgagtataaatatttcaaatttatgtcccgttattcagtagaaagttttcttaaatatatttttcacccgttataatattatttcatgtattgaacagtttatgttcgtttttaaaaattcaaattatggcatatgcgaaaaaactctatttttttttataatgatgatattatttttccgtaaaaatagaatgagaagtgaactataataattaataaaaaattaatatgataatttagataccaaatatagtttattgattttaattggttacttttttggaaattaataatgtattttgtttttctaattaaattaaattaattaaaatttagatatcaaatcttatatgttgattttgattggctattatttttggaaattaataatgtattttgttttttaattaatttaattaattaaattagtatttgactttttaatctttaaagatataaattaatttactctttaaatttttatttctaatatataattacttacaaaaattaagattatatttaaaatgtacttcccaaataatatagtagaattaatttttaggtattttattgcctttgtgttgttctatttaaaagccaccgaaaatataaataacaacttgtagtgatttaatactcctagtttgcaagatttcataattgatattatattaactataattaatgaattgattaaaagggccattgtgggaataagaacggaccgatgtgggcctagttcgattgatacttaaatgaatccgtgttttgtgggctttcgatttaaaaatttgccacatattcataaatgggctgactaatcaatgtgcgggttaataagctgaaccaaacctctcaaagctaaaccggaaaatttgattttcttttgttgttaattctctggttattggtaaaataataatatccatcatctcagctcacctttagcttcttcttcttcctcttccgatttcaacgttgtgtttatcttcttcttcataattccgacgaatttcaccagagagaatcaaacccccgaagaatcttaattttctctctgtattatcatcttccaattcaagtgaagaaactcgtacgtggtcgtagtggagatg

SEQ ID NO: 29380 - DNA, 3000 bp, Unknown
  misc_feature (1)..( 3000): 2750-1469P.txt file - cDNA_ID_3016507; gDNA_ID_2684112; Annot_ID_190656
gtcgttgacttctcacgttaattaacgtagaatcctcattcacatgtaccaatcatagagtcattgatttagtgataatctttattatatacttcctattgttttcggataaatgaaattgacacgtgagcaacaaattgcaaacagagcatagggtttcagagctcacgcaacgtggtgatctccgggctgacgtcacttaacagtcagatgtttcacgtcgcgattaacggctgcagtaacgtaaagctcgacggagtcaaagtttctgcagacggaaacagtccaaacactgatgggatccacgtgcagtcatcatctaccgtctccatcctcaactccaaaatctccaccggcgatgattgtgtctccatcggtcccggcactaacggcctctggatcgagaatgtcgcttgtggccctggccatgggatcaggtattgaattattaatttaattacttgtaacttcatttttatctttccattatttttagtttttataaggttttttttctttcacttttggtttatatgaattatagtaaacaagttaaagccgacactagtttatatagggttgacacggtttatccgtttatgaattagtaatcaacacaactacaaagagagaacaatgttttgttaatttgttccaattcattcattttcagtttcatgtatttctaatagttagaaaaatatatttgtcaatgtcacacagtggcactagattagttcagtttatcaatttatttgttgtgttctttttttttggttataaaatgtcaattattttaattttattatactgtaacagtaactggtttttggttcactttctagtgatcattttcttttatttatccacatcaatcatttttatattttggtacagcattggaagcttgggaaaagaaagtgtggaggtaggtgtacaaaacataacagtgaaaacggcgacgtttacaggaacagagaatggggtgagaataaagtcatgggccaggcccagtaatggatttgctaagaatatccgtttccagcattgtgttatgaacaacgtacaaaacccaatcgtcattgaccaaaactactgccctggcaacgaaaattgccctaatcaggtccacatttttctcaaaacatattaaacgtcacataaaaagctattcttaatttagatattaattggtttatatatgattgatatgaatgataggtttctgggataaaaatcagcgatgtaatgttcttcgatatacacgggacatcggcgacggaagttggagtgaaattagactgtagctctaagaagccgtgcacgggaattcgaattcaagatgtgaagttgacgtaccggaataaaccagcaacaacagattgtagtcacgctggaggtagtgaggcaggatttcaacggcccaacagttgtctatgaccagaaaagaaaaatatttgtcttctttttgttagtagtgtaattgtaagtaacgtcgtattttcatatatattacggctttattcctggagggttggaatacgtgaaattatggtctagtattttcgcaaaatcaatttctaatgatgctatttgttatgcattagtcaatgcggactaaccaatgattatgaacgtaggtggatatttaaaatgaatgggaattgtgtttaataaaacgaatcaaatcgataaattgtacatcataatgcctatagcctaagcctaatatagtattatcagctatataaatgaattacgtgtaaacaatgttgtctaagtaaatcgaaatgttacaaatccaatatataaaagcaaaatttaaggatataattggacggagacggtgagagatatttcatctagctaatactaagaacatttacattggttattagtcgtgcaatctaagaacatgagtatataaaaaataaagtaacatatgttcaatcgaatttatttcaactaatttattatttttgaaaaaaataagtgacatgtgtaagatgaatttcttattaagtaccacaatgaatcgtggcagcacattgttgaatattagagagtttagggtctaaacaaaagcaaaagtgagtcttggtggccctctatcgaaaactccgttaatctgtaatgcccgatttgagttggtcttggcttggaaatgatacatgtgacgccatataatgctgcgtatggcaactcgtcgtaggtactccagggttttgggacgcacatcacggtcagtcatccacatgaaagacttctaaagacgcatcttggagtttcagattcatcgaagcgcaagatccaagttgaatatttcatgtagcttagagaataattctgtgtaacatgaaactcatgaattgcaatacaggtcgcattgctcttactgttgcaggagcctcttttattgcagggagctatctttctttaacaattggcagtctctccctcagctgttaaaccagtaaccttaacatacctcgtcaaactctactagactaataataaattatgtatcaatgataaatcatgggaaaactattagaatataatttcttatttccaaaattcctacaaaatgcgtggatattaggtcacactcaagagaattttagacaaatttggtgaggttctctgatacctcagatctagagtttcagacaaagtatagtgttgtcgcatcacataatggagctggtacagtatctactaatacgtggtttgaattacattttatagtaattttgttggtcactagtcattatcacagtactatgattatgaattagaccatacactattttaaattttatcttaccaaacatactttatgcatgcaattcataatcatagtactgtgataatgactatgatgagcccattctatgtatgatgggagatgcaccaatttaaactttgttcagttttgaagatatatagatctgaccaaagcaagaagggcttttactaagagtaaaacagaggaatatg

SEQ ID NO: 29381 - DNA, 3000 bp, Unknown; identical to SEQ ID NO: 14370
  misc_feature (1)..( 3000): 2750-1469P.txt file - cDNA_ID_3016519; gDNA_ID_2684112; Annot_ID_190653

SEQ ID NO: 29382 - DNA, 3000 bp, Unknown; identical to SEQ ID NO: 14372
  misc_feature (1)..( 3000): 2750-1469P.txt file - cDNA_ID_3016525; gDNA_ID_2684112; Annot_ID_190651

SEQ ID NO: 29383 - DNA, 3003 bp, Unknown
  misc_feature (1)..( 3003): 2750-1469P.txt file - cDNA_ID_3016533; gDNA_ID_2684112; Annot_ID_190649
cattgctctacaaacacttgaagaccaccaaagaaactagccgcatttgttcgatccaaggaatcagcgcagttaaaacgtatcaccccattttgatgtgatctcaaacagaaggcaccttcaatgtcatcaatacagattacctcacctctgcaatctttcagtctttgacgtgaaggcaaatagtcaccttcagaaattcctattgccatagtgggagattttagatacatccacaatccttcaatagtttgctgttccccttttagtttcacgctggcatgccaatcataatttatcaggtgaacacgagtataaggaagctttccactggatttgataaagttcatcgattcttcaaaatgttgtactaagatacattctgatttcccttctccacttcttagtaaattaacgcacacaataggaacaaaagcctttttcttctggttttctccaacaggtgcatctagattcctagtatcatatcgcttgcttaacctttggtaatactctgtactgcctttataaggatccctatctgccacataaatttctgcttctgccgcagtcatctttaattctgcaccccaccatattggtatggtgccacgtcgccaaatgtacgagttgaaagcaatgctttgaccatttcttttaggtatccatacaagctgctcacactcaacttcgttacctgcactacacatatacttctaaattaggccctagtcaatccagagccacactttttaagagaacaacaaagaaattaagagagaggagcattttaggggggcatgtcacctgtgccagaacatgaattaatgcccctagctaggtaacgagtccctggatgcagtctgctacgacgggccattagagcaacaatcccttctagctggcctgagctcccaaaaggtcgatattctgcaaacccctataattaacatcaaataagaagatgatgtcatatcaatttatatgcttttgaatcttcacacaaaaccgaaatcggataggtagatcaaccttcatcaattcattaatggaggacgaacctgcagaagaatgacacagtgttcaggtagcccaatattcttaaaaggcacggacaaccatctattccaaacaaattcatcatcagggctttgaagtggcatacggcttgggaagggccgagtgatgtctctagtatcacagaaatagtgcttcccgtcgatgtcaagctcagtcaactcctgaatattcttggtttcacctttcccttgaggctgtggattgtagagtggtattttgacccattgactctcagccactgtatatacacatccaccaccaggcaaatctggaatacttggatttagcctggtcgcaactaaaagcatcccaaagctccccaagacagcataaccgagtattgccctggcataaacagagcttctaacacctcctcttgatccattcgtaatataatctaaggcttcacgctctgacttaaaattatcaaggccaggcttcccattgtaccgcaggataccagtcgtaggatcgatatagataacttgagtatcagccttagataacaaacttgcaatgacatagacttcaccagtgtctaaggtgacaacaactacagatgtcttttttgaaccacctacaccaagaagataagaaaattagccaaccaaatgatgaaaacagctagagtgaaaaaaaaaaacacttgaatcttcaaaaagaaactaacctggtggatgcagatccatctgagctcaggaccaagcggaccaggtgccctctttgacagcttcagggaccaagatatcaatgtggaaccaaaaatctagcaaaaagtcaacgaaataaggaacttccatcagagaaataaaaagcaatggaatccaaaaaatgtagcatagttagttctatacttaaaacgattcatcaacgccaattaaaatcaaaacagagagatcatcttcctaacaataatctccgatataactgagacaaaagatcagaattttctcacaaatttcgatagaagtaataaaaaaaacgagtaccagagatctgagactttttccgagaatagcaaaattaaagacgcaaatcgataattcaaattccgagaaagcagaaagataaattcttcagagaacccgaatcgaatcataagtcataagagaaggaactcaccttgaagttgtagagatgatcagatgcaaaatttaccaagtcgttcgtagacgaacaaacgaagaggaagaagagtaaatctgctgttacccaacacacagtacaaaaacaatcatagtacgacacgtgtgaatctgtttaattgatttatgaaaaaagagaagaaattattgataacttgaaaattggtccaattagttttaaaatgtaacgaatagacccaatcaaaagaaaagacaaaataaagtatagagatgatgaattaacggctttggacaagccacacgattcgctttgcttatcttgctccacccaatccaaattgagacacaatctctatcgaatccacgcgcctctatcttttttcaatcgagtcgccattaacatatttcatcaagctcagtccactcttctcatgaaacttcatcatcatcgaccttgaccctgataggttattaaagttactgcatttgatctctctttgaactgcttctgttgttcaaggttccaaacatgctcagactcagtaattgaataatgggtattcttgttgcaggtttcagacgacacccattattgtaaatctgctgctggagtcttttttgtctgaatcttcttcttgttgagacactgtttcttcttggtctgtgatttttgttttgttctcattaggacgttctttattccggttcagatttactggatcgtcattttctctttgaaattgtatttttttgttccttttctggtatgttgtgaaagctatgagattgctgtaagaatccaagactgaccaacatg

SEQ ID NO: 29384 - DNA, 3000 bp, Unknown; identical to SEQ ID NO: 14375
  misc_feature (1)..( 3000): 2750-1469P.txt file - cDNA_ID_3016537; gDNA_ID_2684112; Annot_ID_190648

SEQ ID NO: 29385 - DNA, 3000 bp, Unknown; identical to SEQ ID NO: 14364
  misc_feature (1)..( 3000): 2750-1469P.txt file - cDNA_ID_3016541; gDNA_ID_2684112; Annot_ID_190646

SEQ ID NO: 29386 - DNA, 3000 bp, Unknown; identical to SEQ ID NO: 14383
  misc_feature (1)..( 3000): 2750-1469P.txt file - cDNA_ID_3016578; gDNA_ID_2684113; Annot_ID_190719

SEQ ID NO: 29387 - DNA, 3003 bp, Unknown
  misc_feature (1)..( 3003): 2750-1469P.txt file - cDNA_ID_3016612; gDNA_ID_2684113; Annot_ID_190708
atcttcaaggagtttttgccttgtgcaattcaacttcttcccatgttgtttatgtgtagtccaattagtgttatttttaattaagatgtggtccaattagctgttctttttctaaaccgtataacataataatacgtgattcaaatacattaacataatgcaaaaatgtaacagcaaattcattaaaaacaaaaaatgtaacagcaaagcaccatactttctctcgtggggattagaatatacagctttcattacaaagactagtcaactaaatcgtaccagctaactgcaaaacatcatcttaggaaatagaaaaaggtatgtgtagatcaatcaaaatgaataaaatgtttgattatgaataaaaatgaataaggaagagttcaatgagatgatgatattaaattatggtagaagaaaagttaataacaggtcagatatagaaactttccgtaaagtcaaggatttaaattattcacgtgaatactctgtctaggtcctatcttgaaatttatcattcaaacctttaatattatctatatgtttttactttaaaattaaattttaatatatgtagatataaaaattaatatttttaatttatatattcttaatatttatatctagatagagtcatatcaaaacattttgtttgaatgcaaatttcaaaagataaattttggaataaacattttcaaagacgtaaattaaaaaagcaatttagaaataaagcattgcaaaaataaattcaactaaaatttagatgtagatgtatattgtgaacccccaaaattaattataaaatcttttggaactgacatgtcaatatttgtttgattgatcaaccttttttctcctccaatcttcgtttagttctaataaaaatatcataaagaattaaagattgcagttatgaagataatgacatttttctttaatattttatttttcttcattattttaaaaacgtttggctcaatttatagacagtgaaggaaagttcttggaatttggttcttcttctatacataagctttggttacacaatcaaaatcaaatcgagaactgttgttgtgtccgaaaatcaacatcaacatcgtttctttcttctgccattaaatttcaccatcttccaccttcaactgccctagacagctattctccacctttctcttttctctctctgttctctatcattcccagagataaccaaacaatctcagaagaaaccagaaagagcaaagaaactaaaaactattattcattaaagtcagtgtttttaaattcgatttcgtaatgggttcttctgcttcaaagaccgcttcttccgtttcttctgcttcttcctcatctgcgttttctccaccgccgaccaaattcagctccgattcatcttcaccggcggtgcagagagctttttcgtttccgacgccgttggttcaccatcctccggcgagaaaaggcgactctcatcaccttgtttcccttacatctacatcgtacggttctcttctcctccttgatctcgatggatccaaaaactcctcttccgaccaacaaacgctgcctcgtatctcaatctccgggaagaacacaccagatccggtctctcctgattcagtcataaacacttgggagcttatggatggcttggacgatgaattcgaattcgaaattcccaaaccgggtaagcgtctaaattcggatttttgctctaaacccgacccgaatcggaatgtgagtttaaatgggtcttcgttgaaattggatgaatcttacgagattgtgagaatcgaagaagacgatggagattgggttcctttgacttataaacctaagcaacctttgtggaagcatttgtctgaagaatcatttctctctgatttagatcccagcattgtctcatcctacaagaaagctttgtcttctaagctattaagcaatcatagtaatactagaaaccctcatagacccacaaagtctctctcttgtagcccatcatcaaatccatccatcttaataagcgaagaaccaaaatctgtatcctctagtcaattgatttcatcaccagccaaaccgagattaccaggaacagaagacaagattgtactctacttcacaaccctcagaggaattcgaaagacatacgaggattgttgttgcgttagagcgatattgagaggagttcaagtgtccgtagacgaacgtgacatctctatggattccaaatacaggaaagagcttcaaagcgtgcttggcgccgcagagaaaccggtttgtttgcctcaggtgtttatcagaggaactcacattggtggcgtggaggagattatgcagctaaatgatggtggtgaattagcagagatgttgaaagatttccctgcttgtgaacgcttggggacatgccggagctgtggtgatgcaaggtttgtgccttgtactaactgtgatggtagcaccaaagtgtttgaagaacaagatgaacggtttaagcggtgtcctaaatgcaatgagaatggattggtgcgttgtcgtgtgtgttgtctctaagtgatcagtttgatcaaaagatgtgtgtgagaaaggggatatagattgattgactaaacatggtatttggttagtaatgtatattcaaataagtaagttggctcaagccttttattatttactcttatgagttgtgttcttttgttccatttacgctcttgaccttttgaactaaatgattcttactatatgaagtacatcaaatggtagatgatgattgataattcgcataatagccgaatgatttgctttgtttgcaaggtattttttatcaatgaaaaatatgtgcaacattaccacaaatgtagtttgattgattgatgtcacctgctcgctcacctatattagctttcttccttctgttcttaaatcctaaaacgacaacgtttagtctccctttaaatcccatcactggactcgacgacttttgctcagataagggagacaaaaatg

SEQ ID NO: 29388 - DNA, 3000 bp, Unknown; identical to SEQ ID NO: 14386
  misc_feature (1)..( 3000): 2750-1469P.txt file - cDNA_ID_3016619; gDNA_ID_2684113; Annot_ID_190706

SEQ ID NO: 29389 - DNA, 3000 bp, Unknown; identical to SEQ ID NO: 14387
  misc_feature (1)..( 3000): 2750-1469P.txt file - cDNA_ID_3016627; gDNA_ID_2684113; Annot_ID_190704

SEQ ID NO: 29390 - DNA, 3000 bp, Unknown; identical to SEQ ID NO: 14381
  misc_feature (1)..( 3000): 2750-1469P.txt file - cDNA_ID_3016635; gDNA_ID_2684113; Annot_ID_190702

SEQ ID NO: 29391 - DNA, 3000 bp, Unknown; identical to SEQ ID NO: 14382
  misc_feature (1)..( 3000): 2750-1469P.txt file - cDNA_ID_3016646; gDNA_ID_2684113; Annot_ID_190699

SEQ ID NO: 29392 - DNA, 3000 bp, Unknown; identical to SEQ ID NO: 14380
  misc_feature (1)..( 3000): 2750-1469P.txt file - cDNA_ID_3016650; gDNA_ID_2684113; Annot_ID_190698

SEQ ID NO: 29393 - DNA, 3000 bp, Unknown; identical to SEQ ID NO: 14388
  misc_feature (1)..( 3000): 2750-1469P.txt file - cDNA_ID_3016652; gDNA_ID_2684113; Annot_ID_190697

SEQ ID NO: 29394 - DNA, 3003 bp, Unknown
  misc_feature (1)..( 3003): 2750-1469P.txt file - cDNA_ID_3016654; gDNA_ID_2684113; Annot_ID_190696
ttaacctgtgttatgttcctttttctgaaaatgttgagatttgtttcagacaaaccgaaccacggcaagaatattccctgcggtgctggatgttgagaaccctgagttcaagaggaaactggatagaatggttgtgagctatgagaagctgctggctataggagaaacagatgatgcttccttcatcaagaccctcaagaggattcctttggttacttctttagcctctgagatcttggctgcttatctcatgcctcctgttgagtctggctctgttgatttcgccgagtttgagcctaatcttgtctattagtagctgcaatgtcaagtcttgagtttacggctggttcttgatttcttgtaattgaatgatcgaaactgagaaacatcgtctttttttttttgcaataaacttttactgcatatatttgatcatattgcgcattggacttacttaaatttcagattttattgaactggttgatacagttgagtttgcaacataaaaaaaaaacacattacaaaatctacgaaaatatccctggaaacaatcctaccctctgtgtcttgtgtaaaggagatttatccagagaggattaaatatgaaagctgagctcattcctcattcctcactcagatttggccttaggtttctcttgttcttcggtgagaggcttaaacacaactttgaagaaccaaactgcaagcaacgtagccttcacaggtccaagccaatacacaagtaaatgctctttcgttatatgttcaccgcgtgcataagcccatcccataacctgcaaagattcacacaaaagcaaacattcaaaacaaagatcgctatttgctgaaatcacaatcacaagacttttttttggtacatacagctgcagggttcatgcatccaccggtaagatcagagccaagaatatgaagagttaacttagcaagactaccgatccaagtcttcatgaagaaacttcccgggatttttcttgttagtcccattgagagcagtacaatgaagaatgttagtatcccttctgttaaagcaccgtggtgaattgctacatttagtttaggtcctttcccaatctcagggaatacgtgaatgatatgcttaaccgcaagaattgatcctattacctgaaataacacaaaaccagagtttcacaatagtatcatctttgattacacattagagcaaaagatcttcaagatgaagtctttataaaacaatagagcatataaccaaaatgatctggttttcaaagaagaacccatcagctaaattctccttttttttctctaatttgacattttacaacattacacaaaccctgagacctctctctaacgaagagtcaatttcaattaaaccaaaaaaagtcaacgaaacaaacctcgacggggattcgaacgaagacggagaagatgaaactgctgaagccaccggagactccagcagccaaagcggtcaaaggattataaagcccgcctttggtggcttgttgaaggtaggcgaagatgaacatggagatgatagagaagagataacgaacgatctcaccggaaggatcggtccggctaaatccaagaactccatggactaaaatgttgaccagaactcctgcccatatccacatgaacgacaataccagatcagtcactactaaaccgattcgtcccatttttcgattccaacgatgagaaccaatttctcagaaagaaagaaattaaaagttagcgtttttatgatctgaatttaggataattgaggaccgttgaagagaatcgagattatatgattggctctaagcggctggtgaatttagcatataattgacgctagagacattgtttgagtctgagtcagcttccgacaataaaggttttggctttggtgtgtcgtgatgagattatagattctcttcgattttggaacgagcttcggctattaaccaatagacatcaactaaagtgatacgttattactggataaagtatttactttacacagttaactaataattacaaataaattactacaattagccttcttaagaattgtttacaaaaaagccctccaattttaacctgcgacggaagtttcccctcaggaaaaatatgaccttttgatctttacacgcttggctttgggttgtaacttttgtctctcttctatcgtttatggtgtttgaagcttcagcattgggaatggatctttccttttgaaaataagttgtgaatatacggaaaaatgtgacttgttagtggagaagcaatgcgtttaaagtgttcgacagaatgcctcagtgagttagagtttcagttacctctgtttttgattatagctcttagtgatctcagattggagacgttatcagtcttggctaaattgattaattattactttttccgattttttttgttctgaagaaaatatgtttgtttatgagaggaaagctcggagatgctaagaatagagaaaaatgggtcatgcttgtttctctaaatttgaaggctttcattggtttgaggagatgaacggtttcttctttgaacgacataattagttaagatgaattgacaagaaaagatgaaatgtcggagagaatttttttgatcccttaactcttttggccattggtttttctctctctctgattctttgttaggtttccatgattgttcatatcagctttcactccgaaaatgttgcattctaaaagaccaaaaaacattcttttttcttgtgattcaatggcatagagacaggaagtcacagagtaaagaccattgcagatttcttcatgctgcgtttgatttaatggttttaggtttacactttgttttttcttttgcacagagttcatggttttctcttgtgtatgtgtacattgataggattgttgtttagacaagaacaaatatgttttctgagtttatgttctaggatatacatataggtatcttagagaaaagttttattagtttaagaagatg

SEQ ID NO: 29395 - DNA, 1817 bp, Unknown; identical to SEQ ID NO: 14376
  misc_feature (1)..( 1817): 2750-1469P.txt file - cDNA_ID_3016658; gDNA_ID_2684113; Annot_ID_190693

SEQ ID NO: 29396 - DNA, 3000 bp, Unknown; identical to SEQ ID NO: 14392
  misc_feature (1)..( 3000): 2750-1469P.txt file - cDNA_ID_3016680; gDNA_ID_2684114; Annot_ID_190758

SEQ ID NO: 29397 - DNA, 3003 bp, Unknown
  misc_feature (1)..( 3003): 2750-1469P.txt file - cDNA_ID_3016684; gDNA_ID_2684114; Annot_ID_190757
gtctttagaagcagaaattgtgtgtggttgattgacgaagctgtatcttgtttctttgtagttcctcaagtggatattaactaaagagacaaacaaaactatcttgctgggtcgtcgttgtctcttttgttacttgttagaaaagatactgaaaaatagtcatcagattgttgattaactaaatgatctgtcccatttgttttattgaaacaaaaactcaaatagtgaaactgaaatctaaaacataaacacaatctgaactgaaactaaaacataaactcaactgaaactaaaacgtaacacttgaactgaaactaaatcataaactcaactgaaactgaaacgtaatacttgaactgaaacaaaacaagacatttaactttaagtatcaaaccaattttttcaaaagtacttaaactgaaacatccaagtacttaaactaaaagtacttgaactaaacaaagacatttaagctaagtctaaagtacttaaactgaaagtctaaaacattacaaaacagtgataagaaacatatttaccgtagcagcacatatctcagtcttgtttcttgatttcaaaagtgattgcttccaactcacaaacaaaaaaatatatccgtttttctttgccagactgcttggtgactttccctgtgagacaccaacaatataaatatatgatgtcaagactaaatcgatgtgggtaattcattaagaaggaatgaagatatatccttttttatatgaaagccatgacttctacaaactctgcatcaatctgaagcaaaggaccaaaaaaacactgaatttattttacaatgtcaatattttacaatgctgactataacgaaccccaaattctcatctctctgcctattacttctcaatttcacaacctcaacagctggcttaggagtgatcacagattcaatcttagcctttccgatttcgattgaacaaacatgaattcactacaaaaaaatcattgtttatttcagtaaatcaaggaacctccaaagaattgaagcaacacaaaaaaaaattacttatgattcattacaaatttatttcagtaaatcaaagattcaaaaagaactgaagcaggactgaacgaagatttttttttttttttttttttttttaatcatcccaaaatgggctttaggcaaggccttacaacaaccaaacgggtacaaaataagaaggtaacgactgacaaatccggtgacccgagatcggacccggaggttgatcggaaaacaaggaaacacgtccaatagtaccagcgattacaagaagcactgcttcgcggctacgacggcaaggacaaactcaatgacagaagtaatcagttcccaacgccaagtcgatcccgacgacaaacctgaacctacaacacttcttccggtatgaaccgaaacctagaaaatccggaacccaatccctctaatccttaacctagcaaaaagagagaacctaaaaatctaacacccagactccagatctgtcaagcaaacaaaaccttgtacgagcaaagccaacctcaaatccggttagacgaaaactaaaacttggaagctgagaggtttagtggctcaaaccaagcctccacggccaagatccaagattagccgaaacagatctacaagaaaagtcgttaatcgtctcaacaaacagcctaaacccaccaatccgccttcatgacttccgccgcaacccacagcacccaccgcaaacatatgagccgcaagaaaactccaccaccatgcctccgacgtccataaccagaagatttagccggggagatttctcaaaaatgtcgagatagaagccacagatgcatcacgaaccagattaaccatacgcagctgtcggagaagaaagctcgctcacccccactttattgaataaaaaccaaacctgcaatgaagatctaaaacaagaaaagaaaccggaaagtagatctgttttttttttctcttgaggagagagaagagagaacgattggaacgattgtccccttaaatcatcttttcctgctacaatattctattgtatcaacaattacagttttaaatctgctgtgtcacttttctctttgaaaggaatgatcgtcattttcttttgcttaaattatctttaaagtttttttccttccttaacgaagattcttcataaaagatgcaaaggttttttttttctctaacttttttccgggtcgcccgcaaaaccgcggtctttaatgggcatccatgaattaatccgcaatccaaacggaccattcccgcgagacccgctattttttttctccattatataggcgggccaggcctgcggaccagaggcccgattaacatccctaaacataataaatgacatctgaattaaatgtaggtacatattgtgtaggcattgttgcaagtgaaaagaattcagcatacgatttcaaataaagaatgatccaaggtcctcatttccaagttataattaaagctttccgggtcattaagtatattaattctgacccgattagcttttcttaaaatatacttcaaaaatgttaatttagatattggatacccaattagttaatcatgtcggaccgagtcagatcagattttcgaacataaatctttatctctccgaattgaaccaaatattaaaccaaaccaatttgtaaaaagaaaaatcggtttggtttggatcaatagaatcgggtcgcatcaaaactccatgcatgcctagttctgtccatgctggaaagaaaacccacctacactcgaaagttttctttaaagaaaagcgcgagagaagtttaggttttgtaaatttccaacttttaaccacattttttaaagacaaaaaatagtgaaaatggtaaataatatcccgcgtgtcccactctgaaactggcgccaaaatcgaggttaatactaaaaatgcccaaatcaatcagatagaactaaaaccctagaaccacccaaaacaatcaacatctccgatg

SEQ ID NO: 29398 - DNA, 3003 bp, Unknown
  misc_feature (1)..( 3003): 2750-1469P.txt file - cDNA_ID_3016706; gDNA_ID_2684114; Annot_ID_190751
aaaggaccgagattgaaatacaaaaaaaaactataaactatattgctattgctatgcactaaaatcaagctacgatgtttgtgtttgagaggagggatcctatatttataggtattttcagcataaggttttagggttttacatatgacagcgtaaattatacgggcctaatatctttgtttgaaaagcataagcccgttagggttgttaggcgacttatgattgattaggtttgattaggattaataggcgatttaggtttgattaggggcgccagagaataggaaatttagggttgagagtgaattaaaccttttttttttctacacattaaaatataaaaacaaaataataagttatctcattagttagtaaaaatattaatttatccttaaaaaccttaagagagggagggcaaatccatcagttcattttctgagagcgaacatgaaagtttttgacatctgctttaatatataagattctccaccgcttatgtttgggccgctacgaattcaagatgttctgattcgaatgattgagtgattatgaaattttttacaaaaatgatcgataggtattgtgttgttatgggttttaagaaatatttaaatacttttttagagacggtatgcttgaccttttgtaatattatggtcgaattttcaaatctcataactatattctatcattgaaatttaaatttttttttaaatactctagttggtattaaataacattccttagttttgcctcgtttgagctctaattattaatcggatgacaaaaaaaatagttaatattaaatagtgaaatcttttataaaaagaaaagaaaacatttatttactagtggggataatgtttctaaagcccaataaaggcccaaacgttctctgaaataacaccctaattatagcttctgaggcccaaatctctctctctcccctccggaaatctcctcgattcctccgtcaccaccgtaccgtaaccgagactggtcgcaatgttgtcgctcaatctatctttgaaaccccaacatctcaagctcttatcttgttacacggattcgtctgctccttcaatcgcgaaaaaggtacctacacacttgcttctgtttcttagttcacttcatatcttgaattttaggtatctctctactttgtacagttgatcaaggaatcaaagctatctagggacttcagtcaaaagatacaaatcgtagactacgctccattagttcaaactttaagccagagaagattacctgatgtagctcatgagatttttctccaaacgaaatcagttaacttgttaccaaattacagaaccctttgtgctcttatgctttgttttgctgaaaatgggtttgttcttcgagcacgtacgatttgggatgagattataaacagttgttttgtacctgatgtctttgtagtctctaagcttatatctgcttatgagcaatttggttgttttgatgaagttgccaagatcaccaaggatgttgctgcaaggcactcgaagcttcttccggttgtgtcttcacttgctatatcctgttttggtaagaatggacagttggaactgatggagggtgttatagaggaaatggattcaaagggagtgttgttagaggctgagactgctaatgtgattgttagatactatagttttttcggtagtttagataagatggagaaggcttatggccgggttaagaagtttggtattgtgatagaggaagaagagataagagctgtggtgttagcgtacttgaaacaacggaagttttatcggttacgcgagtttttgtcagatgttggtctcggtagaagaaatcttggaaatatgttatggaattctgtattactgtcatatgcagctgattttaagatgaaaagcttgcagagagagtttattggaatgcttgatgcgggtttctctcctgaccttaccacctttaacattcgcgctcttgcgttttctagaatggctctcttctgggatctacatctcactcttgaacatatgagacgtttgaacattgttccggatcttgtgactttcggatgtgttgtcgatgcatatatggataagcgactagcgagaaatttggagtttgtatacaaccgaatgaatctggacgattctcctcttgtcttaactgatccacttgcatttgaagttctggggaaaggggatttccatcttagctcggaagctgttttggagttcagtccacggaaaaactggacgtatagaaagctaattggagtttatctcaagaaaaagttgcggagagaccagattttctggaattactagctacatgccacatctttgctgcaaagaccgtcactctttgctcactatcacaatccccctgataaacttttccgatgcttgaaatgaaacattgaggttagagagtcttcttgctactagatttacatataaatcatacatgcctgtatttacaatgttttattgttaaatagatatgtatattgaattacatacatattattaatgcacatttttatccggagttgtggaccatagaaagacatattgactcctcaaagtaaattctgcatgttacattgaaatcataggctaaatttgagatgcactatttttagaaagtgtagagaaaaggacaggaagaaataagcgaaagctttggtaagccaccaaacctgattactggaagaaaagaaaaaagttccgagaatagagttagatcgctggtgagggttttaaatggaacacaacaatggttgttttagagtgtgttattcttttgtatttataccttctcataggtttcttgtaatacacgcttcttcctctctctccctctctcttatggcctcgtcttgaaagcgtcttgcatgctaagagaaggctttagagcaaggagagaagggagaagttgatttatacgtccatcggatatatcttctttttatatctgtctctcttttaaggaagaaaaatg

SEQ ID NO: 29399 - DNA, 3000 bp, Unknown; identical to SEQ ID NO: 14391
  misc_feature (1)..( 3000): 2750-1469P.txt file - cDNA_ID_3016714; gDNA_ID_2684114; Annot_ID_190749

SEQ ID NO: 29400 - DNA, 3003 bp, Unknown
  misc_feature (1)..( 3003): 2750-1469P.txt file - cDNA_ID_3016749; gDNA_ID_2684114; Annot_ID_190738
ttttagtaattatatatatttaatataattattttaagaaaaaggatagagtatttttcaaataaaaattcaaaaatagggcatttttccaaatttactctaaatttaaaccacaaattttttaaaactcagtaggaaacccgtatgattctgctatagcgagttaatagattatctcgaattctcttttctgctttgcttttcgacatcctcctctttgatttgctcattcttttattttctatttctctgcctacctcttgatccctaaagcggttactacatgattagaatgttggcaatgacaaacaaaagctaataataacaaattttggtgaatgtggtggaaaacaatcgtaacaaataacgatagcggatggaattgataattgatcttgtcaatctatagttttcaacggataaactaatccgagaagtaaataaattttattataatagataaaccctaaccaaacttggtcagcaaggcaaataaattcaaaattgataaaaaattttggttcggtcacaaaatcaaagccttacacctttgagtggtgagataaaatggatttccttatttcactacaccattcctcttaggagagagagtgagagatacatgttttttttcatcgataacttcactatgtgtagatcacaagcttatatagcgctagttcgccactcatgaccaagccgatgaaccgtgcgtcaccgaacatctacgcaaaagcaaagcggtaactatgataataagtctaatatgcttttgtttttaaggaataaatgagccgctaagagcatctacaatggtaatctctcaccaaaatctctcacctacaaaaataataataaaagaataattaatgttttttaattaacagagtctctcaataaaggtgagagtcatgagagatgataggagccttttccaactgttttgagaaactgcccttattaaattatattacttcttattttattaatacttttatatatgagagattttggtgagagatcacctcctttgtagatgctctaagagattaatctctttagaatttgattaatctgagaacatatttgttaaagtctttaagtaaaacaatcaattcactaagataaaggttgctacggaatagactatgactcacaatgttcagtgatcaggtttatcaacctctgcatgttgagatcgacacaagccttagaaaaaaagagaatacttaagccttgaatggctgtagtttttggatttggattttgtaaaaaccaaataattatccattcataattctgcaaaaatagattttctcaaaaatagtaaaaccagattttagtagattttacctatttgttcatagaatctaaaaacaaaaatttgtggattttttaaaacaataaaaattaaaaactaaataaatttccattcacgattttgcaaaaactaaattctacaacaaaaatcaaaaactaaaaacaaaaatccaaaaaccaaaaacgaaaaccaataaaaagtacaaaacattcaggaccttactgtaccatcgtacgttaggaaaaatattagaaaatcaacaaacactaaacaaaccaaaaaccctacgatcatttctttcttctccttcaattttttttcctgagtagatgccacaacaaaacaatagattataaactaaactgagcaaaatcatcaaaacaaaatgcaacaaaaaaaaacatcaactattctctttgaacaaacgtgcaacatatatataatatatataaaatatttcacaaagaatgaaaacataaaatttatagaccaaaaagaaacataaagatatagaacattctcaatattaatttcgatttaacaatcctgatatcttcagctccaatcacctgaatgttgttcacatgtagcccacttaatcatctccaatatcaatattttatatttatagattttccgttgcttccttctacaacttataaacaaaatttaacccactttattataagtgcaaacattaaagaaatatgtgtaccttcgaagacactacaatttgactcatcaaagcttcgttctttatcttatttgccaaattggttcaagaaacagagaagttagtgttgattcgactcgtatgtaccaaacaggacctacttcaatcccaagcctatcgatatggagacaaagaaagaaaagagcaaagaaggtttaatcgctgccaaagagctcaagcgcctccaaaccaacttagtccgacttgatcgattcattgattctcatgtttgtcgtctccttaaattcgatctcctttttgttcttgctgaattttcagagacaaaaccaaattttcctttgtatgacggacataagttagaactataccaacatgaacactatttattatatttataataatgatacaaaaaggtactttaaacagcaaaattatatatacttttttgctcaaactaaaagagaaaactatttaatatatgttattattctttatatagaataacataaaataatatagaaattaatataaaattatagaacggttacaaaaatatctatctatatatcttattttattgatttagaaaaacagataaagattagataataccgaatacttgtaaaaataaagttatattataaattgttactgtgataataagtttttaaattattatatagttaaatttatcattctcagcagccgtcatgtttcaggtatatatcattctgagtaataatatactcaatattaattactttaaaattttcaatcttcaatttagcataataatcaaatataccaatgcagccgatgaagtacattctctgttaaacttacgttagtttctgggtgctcctctacaacatcactctaggcacatgcattaaaatattcactgttttattaaatatatatatatatttatttattttctgacaagataagttacaaatttttgtttccatactctttgaaagagatg

SEQ ID NO: 29401 - DNA, 3000 bp, Unknown; identical to SEQ ID NO: 14401
  misc_feature (1)..( 3000): 2750-1469P.txt file - cDNA_ID_3016769; gDNA_ID_2684115; Annot_ID_190785

SEQ ID NO: 29402 - DNA, 3000 bp, Unknown; identical to SEQ ID NO: 14399
  misc_feature (1)..( 3000): 2750-1469P.txt file - cDNA_ID_3016775; gDNA_ID_2684115; Annot_ID_190783

SEQ ID NO: 29403 - DNA, 3003 bp, Unknown
  misc_feature (1)..( 3003): 2750-1469P.txt file - cDNA_ID_3016791; gDNA_ID_2684115; Annot_ID_190778
tgatttgcctgaatgaaaataatttattatacacagaaatgtatttgatttcaaaattcaatttatgtgacctgaatgacaacaaaattcccgaaaacaaaaccaaaccatgagatgttttaaccgttctaagttttgtaacccagccggagcatgtccaatgctccaccttgttgaaaagatatattaatatcatttttttgggccaccttttttactgcaaattaacaattgtttggctatatactccaaaatatgaaaaacaatagttgttttaactacttacaaatttgaggtaactccatgtattagctattaggaggtcaaattattcaaaattataactcaaattttcacgtttgcaaattaattcctcaagttttcgctaccacgcaacatcatgctaaaaatagtcaacgttaacttctacgttttcttatttggcgttgacttttttcaattgtatagtcaatttaaacttcaaaaatttaatgtgcgcacacacagttgagaaattaataagtcaattgcaaatatttaaggaataatgaataatttccctatctatttggtggtttaatctccaacttatcttttggagaatcttgtttcacagttattaactttcactaaaacaaatgagttctttctaaaataaccttttaagttgtaacctaattatagtcatatacacatacaaaaaatctacaaaattctatattcatatacacgacttttgctttctttcttctctaaaaccatcatctttttgtgtagtgaatttgagtgaaattaactttgatacgtcaaaaataattttatttttattcttgagaatttgctaatcttgccattaaaagtatttttgggatatctaaaaactaaaaaaatgaagaatctaaaataatatttgttctacaatatagagtaatctctttttcataacatcttttacaaagaagttacaagcaaaacttgaaataaatatgtggaacagcgttatcaaaatacatggaatgcttatgatgtttgctacataataatttttgtttgttacacattacttgatgttttcatttttcaatgcaaaattaattattttatttgtttttaatcatttatattctgcgctttgttgtctaaatagtttttaattaaaaaacattatgttttaattttgtttttaaaaaaaaacacaattggtttcttaatctatttaatcatcactaatattgaaacttaagaagtaatgttaaaacaaagtagccctatagggtttttatagaaattaatgtaccgttaagtaatagatttcagacatcattgactatcaaaaactaaattttcggacaaaaagaatttcattactattttaaatttgttgatgttaaagagaatagattggctgaagtgattgatgttaagctgaaaaacaatcacaaccatggaaaagtcacatcagcggcaagactggctagtagttgtgtgaggatgaaaggtaaaaaatggccaacaatggcgaagtggctgtcgaattggagcacattcgctcattagcgtagtcgcgtttttttttgtatttttttttttgaagaaaagtaaacaggacctagtgtgactgtgtgaggtcattgattcatgctgatcttcaagaccgatcgaagtgtagcaaacaatcatcctgcatgcaggcatctggttccttgagcagtctccatagctttgatttgcgtttgctcttgatttcaatctattttcacttattatactttaaaagaccttgaaaactcgaaaccaggaatattgaactgatcagatcctggaccactgcaataactgagttcatgtacgtacaaaactaatatgtcacgactaggaatttagcgtcctcgtgagattgagagagacacgtatggtgtcaattgcccgaaggtacagtattagtttgaattgggcaacaacaacaaaaacgtgcgttctctaatactcacttctctagaaaacaacaaatatgataacgtaacctcctttgcttcttttcttattaattaagaccactcgtaactaataaagatgatagatcttttatataaaaaattgtattcgtcaatgctcttttatgaaaacaatagttcaactacccatacttgcatctattagctatctagtattctcatattattacaaacattatgcagattggagataattaccaacatttctatataaacaatccgaatttggtgattataaatacttaattaccattctggaagtaacaatataacaggtagtatctatgttattttggcatgaaaggaaatgatcttaacttctcaaagtatatttcccacttttctcaagaagatcattaataaactaatacctcttcttggacagacatttttgagttatcttgtttttgtttcggtcactagttaagaaaagagaagaaaactcaacataccattttatcacgttatagccatgttcgaattgaaaactaaccacctaaaactagaggatatgatttcttatctattttttggtttcattttaagcaggaccaaaacctaaatggccggttcctccaaaactagttatattttttttttgtataattgcaaattcataaagatgaaaagagctgcattcttgggtatatacatgttaacatatctttctttagatacagtggtcctcctatgcatcacatgcaatatcgggtaaggtcaaaaagatattgaattgtccacaacacataagaagttaagatgtcactcgtggacattaacgtcgtagagtacccatatattcccatggaaattattggtattcgtaactcttggatatttttaaacgttgttaatactttaataaaatatattatattgtctaccgaatcaaacacagctgtatcaacaaaaataatttgaaacttgtataaatagatgaagtggatatgagaggaatgtaagccttatagaagagaaaaaaaatatg

SEQ ID NO: 29404 - DNA, 3000 bp, Unknown; identical to SEQ ID NO: 14398
  misc_feature (1)..( 3000): 2750-1469P.txt file - cDNA_ID_3016796; gDNA_ID_2684115; Annot_ID_190775

SEQ ID NO: 29405 - DNA, 3003 bp, Unknown
  misc_feature (1)..( 3003): 2750-1469P.txt file - cDNA_ID_3016800; gDNA_ID_2684115; Annot_ID_190774
tgcaaggaacggatgtgatgcttcgggaagcatccattcgccccctatataagggaggacgcccaaggcatctcacatcatctcacaacatccaaaacaccataaaacattcttaaaggagtcccaacacatcctagagttgttggtcggaaagggggtgcggctcggcgagtataactcgaccgaactgatgcgcatgctacctcccggtccaacggttcgatggagtgtagaggatggagagggtagaccgttcgtcttagagacgaatcggatccgatagaccgatcgttggatcggatcggccagaccgatcatcagacggatcggatcggccagacggatcggacagaccgatcgtcggacgggtcggatgggacaggccgatcgtctgacggaacgggtcggacagaccgatcgtcggatgggatggatctaattgacgtattggccaatcgagaccaacatgaacattgagaacagttcgtattgtcgccggcttgaccatcggactgaacgtctctgtgaaatcaacaccggcttcctgtgattttccattagcaactaatcttgctttgtgacgagttatgctgccatctgcatcatatttatgtttaaacagccacatagatcttacaatattgaccttaggaggtctaagcactaaactccaagtcttagtcttaagcatagcatctatctcatcagtcatcgctggtgtccaatttggatcagaaaaagcatgaatgtgactttttgggagaggcgattttgtggtggtgagaagtgagatgacctgttttggttttcgaatcccagctattgcacgtgtcatcattgagtgacagggctgaatggaaataaattgtgtttgtggctgggttctttgagcaggaacactagtaggtgttggttttgagtaggaaatggagtttgaagaataggttgcaattgagaagaaggaacatcatcatcgagaaattgatactttgtgtctttttgatgtgtttcggttgccggaaaaatatcctcatcaaagtatacatgacgagatataatgatcttattagtttttagatcaagacatatgtagccacgatgttgtgatggatatccaagaaacaagcatggacttgatcttggagaaagtttatgaagattggaatgatttaagtttggaaaacaaaggcagtcgaatactctcaagtgatcatagcttggtttcttattaaaaagacgagtgtaggggatttggttttggatggcggaagagggaagaatgtttaataggtggacatcgacatggagagcttctacccaataacttggcgagagttgagcttgaaagagaagagctctaatcgcattgttaatggtgcgtatcattcgctcagactttccattttgttgagatgtgtgaggacaagaaaaacgaactgtaatttcatttgaatccaaataattcttgaactcatggttattatattttcctccattgtcgcattgacaggattttatttgggtattgaattgatttttgacataagccgtaaattgaagggatttttgaaccattaccaacgatgaccgagtgagtgatgttatgattaagattagagtgaagattacctgctgtgcccgagagatgtgcagtggcagccgaatccatgacccatggtgcaccattaggatcaaccaaagtctttatcgtgtaagcttgtgtgaagtcagtcgtcgactgaatttccgtcagatgggcttgttgaggatactggtgtatttgaggaaagacatatgggcctcggtatgagcctagttgagagttgggtccccagttcgcaaattgattgggccacagattaaatggtctgggccagaaatttgagtaagtctaattttgttgattggggtgaaactgattgttgttcttgtttcctctgaaatgattgtttcctctgtagttgttgaatttatgcggctgtataggcgaggttgttgatggggttgcagagacggtgagagcagtggatgataatgagttatccttgtgtgttgcggaagctcggtgttactttttgaggcgagtttcctccaattccaacattgacttagccgtctcaaaacttggaaacagctctttgtgtttgattacgttgacgatgtaatcatatttgtcattgagcccgttgaggaggtaagtgaccagatgtatctcgttgaccggtgcatcaacattggcgagcagatcagcaagcgatttgagtttttgacaataagcctgaatcgtttgttctccaatctcttgattacgcaattcattatctagttggatcgctcgagcctctttgttgttgcggaattagttttcgattcggatccaaacgtcacgtgcagtgcctccagtcttgaatgatgagcggaacagatctggagcaagagttccatagatccagagtttaacgagtccgtcgcgtttcagccaagaaccatcgttatctccactgggaaacatagtaccatcaaggtgtcctagaacatcgaacgtcagacagcgtgtctggaaaagctctctccaagcatcataattgtgatcattgagatcgagaattaagagtatgtgggctttgatatttgtaaccccaaacgctcgctctatcgctggaagttgagcagccattggagacttttgaagaagaaaaaagagatgaaagaaggaaagaaggaaaaaaggaaagaagaaagagaaatgagagaaaaggttaaggagcgatggtgctctgataccatgaaagttaatgaattcctcttgagaggatcgttgaattgacaaggctatataaagccaatgttgttacacaaaatcagggattaaaaaatcatatatacagaatatataaaacagattgtaacagaacgtccctatattctatcatggatgtgtactttaattttttttagtagtaaatgaatgaaggtgttaaaaaaaaaacccaactgggcatg

SEQ ID NO: 29406 - DNA, 3003 bp, Unknown
  misc_feature (1)..( 3003): 2750-1469P.txt file - cDNA_ID_3016813; gDNA_ID_2684115; Annot_ID_190770
tctgccaacagagacaaaaatctatcaaggaatgcaaaactggttacttataaatatttacacacccaaagatcatcaaaggacctcataataagtctttcacatgaagaacaattcatgccagggcaaccaaaagattttacataataactatatcaggcttgcagagaaaagtaacaggactgagcacaaaccacaccaatcttgaaatatactacgagtttaagaaaagtcttgtccttaaccaaatcctaaaaagactattagagacattgataaagacgtgcattaactaactctcacagcagaaagctcaatactagtataacaaaatttccaaatttccaaactatgtaagatcaagtttagtcctttcaagatccaaacacatcattgatctaaccaatacaaaaaaagtctcttcataagattgatccatcaaaactaaaatcagaaacaacattcaatgagacaaaatcgaaataacaccttgaaggcgtgacgagctttgcaacccataagctgaagagtactctgcaaaacaggacgcgtatacctaaacgaatcatctccattattatcatcatcatcaccttcttcacgcaccactatatacaacaccttcgtcgcctccgtcatcatctctatacaaaacaaaaacaaatctcacaaaattttcagagaaaattcaaacgatcgggaatgcagatcaatcggtaacataccggagaagagaaaaatcggagatcggagaagttagagagaaagagaaaaactgttggaaaaatttagggtttataatgaggatcgtgataagaagaagaagaataagaagagaggaaagatattttcgccattgttgttggtcactcgcctttcttcaacgcatcgctcgaagagagccttcacgacttcttaaaagataccttcttcttctctctctctctttctcacgtttctcttttacacagacccaaaatataaatgtttgaactcaaccaacattttacttttcttgacaaagacgtccctagattttgtttttagatcaaattggtccatcttaatttcgtgaaattagaatctaatttttggttgccaacttgtttagaagcaagagattaaatctaaatcaattttaataaataatacaacatagtaaattagaaaattagaggatgaaatctaaaattgaaaagataaagtgtgtgaatttaagagataataaagtagagggggtttttaataattttattttttttggttattttggtagggttttctttgggtcaagatttcagttattagaagtttcaccgactcatttgatcaggtctttgtcagcaatttaactatatgttacaagaaaagtagattcgatatctaaccataagtgtaataatctcaaatcgaatctaaccataagagtaattatctttaatatatatatatatataaacataagtgcatatatatatatttataaaaacttaaaaaactttagaaaaagttatatcttaaacccgaaagaaaaaaaagctatgaacttggttttggttatgttactagtgaatcttttttttccatggaatataatatatgcacttgcttatctaattgaggtggtaagaattttaaaatagaagaataggattttacttcgattgagagaagaagagtatgaagatgtaccttcacaactgttttgtttgcacaggttctatcgatttgcagagagatgggattggttttcttcttgtgatatgatgtaaaccgtatttatagcgtttaagattctgaaatatatttagttttggatttgtgtatcgtgcatcattaaattttgtattttaaactacacaaaatcaatatccaatattgaacatatgtttttttttttcacttgcttaaattcaaaatataatgataaaattgattaatcagtattgaaggtcttaccaacattatataaaataaattttaaaatagtcaataattataattatattaaaaaggttatttcaacttaaaataattatttattcattatatatatatatatatattgaaataaaatatttagttatacaaccaatgagttataacttataaattttaaatttatttataaacaaaaagttgtaatttaatttttcacaataatgtaatactagtttattttctcaccaatttgagtatatttcattccatacaaaatcatggcaaaataaagctctagtggaaactacaaaaacaattaatttagtaaatggaaagagaaaaaacaaaatctaaaacttaatcactatcacatgattcagattcaccgtgtggaccccaaataaacaagaatcaacaagtggtaaaagtgtaaatctggtgtgggaacaatggtaataaaaagttttcttctgtgaatgatttgtactttgtcgggaaagaatctctaaagggacaaagaaagtgggttccatcgttaaacaacaaaaattccaaacgttacatccacgaagttttaagccctctataattggtcaatatattttcttgttaatttcctattgaatttaaaaaatacattataagtatctaccaaaactaggataaaataaaacatcatgagaaaaaatcgtctaatcattatatattgttatatcatagtcataactcataacacatttgaatgctctatactggtcggatgatgagaaatagtctcatgaaaaagtctatagaaagaaaaatgatgaccggaactttaaatgttcaataggaatatagttatgtgaatcagatttcagtattgactaaatatcactatacatttattaatagttgtaaccgtttttggtaagtgaaatcttgaaagaattataacttgtatatatatacaaacaaaatctttaagtttttttgctcaaaccatcatctaaactagactataaaaagagacgaaacgcatgtataacttcaccatcaaaagcagaaagaagtagaaaaatg

SEQ ID NO: 29407 - DNA, 3000 bp, Unknown; identical to SEQ ID NO: 14408
  misc_feature (1)..( 3000): 2750-1469P.txt file - cDNA_ID_3016837; gDNA_ID_2684116; Annot_ID_190812

SEQ ID NO: 29408 - DNA, 3000 bp, Unknown; identical to SEQ ID NO: 14408
  misc_feature (1)..( 3000): 2750-1469P.txt file - cDNA_ID_3016837; gDNA_ID_2926275; Annot_ID_205287

SEQ ID NO: 29409 - DNA, 3003 bp, Unknown
  misc_feature (1)..( 3003): 2750-1469P.txt file - cDNA_ID_3016841; gDNA_ID_2684116; Annot_ID_190811
attaaatttggtacatgacaatgggagagattgagagtaattaaatgattaaaatttgatttattcctattaaatagtgtaatttgttttgattatttctgattttatctccggctcttttttgtgttgaatgtatctttaagaatatttgtttttgtgaccgaaaatatcatatatgtaacgaataattcgcaacaattaagtggcaaaattaaaccattttttaattgattagttagatatcccaataactaaactgataaagtaacaatttaggaaaatgattacctcttttgataagagataaatgagaggtaaaaatcattcaaaggcgttactgttgtcactcattgttaatgcttagtttgtctccaaatttgctggcgactaactattctcgtttagacaactcgagaacatagagatgaaaacgtgagtatatacaacagaactcaaacaaaatattactattatatagataccaactaatcttgagtttatattttacagacactttggaaattaaggtgaataaacgttttgcaaggctgtcacattctacgactaaaattagtgattcataagaaatgattggtatccaagtaaggaatattgatcattacattgcaattggaccctcctcgtggatcaagtttaaaccaactaacgatgaccatttcatatctcttttgagttattgtaatataatatatttatttatttcattacaacaatcaatttttattaacaaattatagtttcgaattttagatcagataaaagaaacaaagtgattgaggatccgcatgataaggattaaaaaatgcgacacgtgacgaaaaaagaaaaaatctttgaagaaatcgagaagagagacaaagaaacaaaagtggggatcccagaaggctctgatagatatgagcatgtggtctcagtcaaggccaagactcaaagctgagaccaacccacttctattatagatacatacaatatttgttttatatcttgtcatgtattgatgtatatctaagtagatttatcataattatcgtaccatgctaagtgctaacgaataacgatcgttcatgaatccaaataaaatcacgtcaggtgctgcgacatggcttcttcattcggtttgttactgtttttttttcctctctttttctttctatgatcatcataaatgttgtaaaactatgttaaaaaatcgattcatgtctttttgtgtatgatgaggaagttttaacatttctttaggtatcatatatagtttatctttttgcatactataatatagttaactattttgtgcaaattttataaatcataattttttaaagtttagaatctatattggtattttcgtcctatacgaaaacaagtacaaagaattaattatacactacaaaaaaacgacattaattaattcatatagttgtacaactaatactataatccatcggttcttttttgtttgattttaggaaaaaaacgatattaagaaaacatattaaatgtattattctttgtgatttacaattttcaataattctaaacgaatgatattcaataatttttattaatatttacaatttatcaattataattaacaagtattgcattaataacttaaaaaatcaattttttataaaaacaattattctagaaaatccaaaaaaaaaacatatggagtatatattagaaaaaaatcccatggctgataaataaataattgtatatatatatatatatatctcacgcatacatatataagatatgatatcattactctataagatataaataattttattctatattttgaatagtccattttcatatgcaatttgaaaatttataacattataaaaaagggtaataaaacaagtagtggatcggaccagagattttgaggcgcaatttccaaagcgatctgcatctattcttacctccatcttcaagcaaagcatcaacgcctatagattcccatgcaacgctattttctttataacatataataaaaatatttctgttgctttttattcgtttcactttcctgacattgtttttgtttattcttactttctattcatagaattaatgaatccttatcatatgatccgttataagtctctgctttcgaacttaggaaaattaaattcgcattttttttatcaatgacaataatcataatcactagctaggttaggtataacttataaggtctcgcacttccttgattttaaaataactttgtctttaccaaacaaaaataactgaaccgtaaataccaaaatattttggataacaaaaaatattttttaaaaatatatatttcaaaatattagttatttctaactaaaaatagttgaaaatatatataaacagtaaaaatatttaaaaataacaaaaaatattgaaaaaatgacaaaaatatccaaacataactgaaatatccgaaaatattcaaagcaaataaccgaatgaatactaaattttaaaaccaaaagaaccggagccgaaccaaaatcgaaccaaactttcaaaataatcgaataaatattaaactttagaaccgaaaaaatcgattaccgaatagatacaacctaaactgaatggataacagaacgtcgagaattatttttaatggtcaaatcagttgccaacaattttgaggcattaatactctcaattttgccaaaacaattttgatctatgaatctggaccgactctactctccaacccaattggtattttccatctacttaaaatatgggcttgtacggcccaaattattattttactcatatcgttttaacgtcattaatgattttctgaagaaacgtaaacatttgcactgtatgacgttttagagtgacaaaaacaacagatcaacaaatttcgattaccgtagacgacacgatgtttcacacccgactacgaatcacgacgacttatacaaaacagcaaaagcgtaaagacttgaacttaaaaccatg

SEQ ID NO: 29410 - DNA, 3003 bp, Unknown
  misc_feature (1)..( 3003): 2750-1469P.txt file - cDNA_ID_3016900; gDNA_ID_2684116; Annot_ID_190793
ccgatagggtcgttgattaacgggattagagccctccaacaactcaattttgtggtcatgttgagtccgaaatggaggcaattcagttggttcagcaaaaatatcagggaagtctttgacaagctcctctatctccgtatcatcaccctccgtctttgctactgcattcacagaacaactcaatccctgttccaacaactcttcttctgctggcacttcacgaacatacaacaaagcaatctgaacttgatcatcatccaactttcttaatttctgtgctttcacatctcggacagaaccttcacgaattccacgtaatagcaccttctggttattgtacttaaacttcatttccaactccttaaactcccatgaaatgcggcccaaagtttccaaccattgtactcccaacaccatatcaataccttgtagtggaattagtaaaatatcagactgaaatgttgtagtctgcagattccaagtgaacttagaaatcttgccatccacattaatttttctcccatctgcaacagaaactctagttaaacctgcatattcaatcgcacaaccaagtttagcagccacagcagagtcaataaaattgtgagttgaccctgaatcaatcaaaataaacacaggcttcttcccatatgttcccctgacccgcattgttcgataaccagcaactcctgaaactgcattaactgaaatctgaggttcctcttcattgtacaaaacttcctcagcatccttgtattcatcatcaacatcgatactaaaaagctgagttttcttatgaaccaaatagtgttccggtgtaaacttctcatcacaaaaataacaaagccccttagcacgcctatcactcatctcttgctgtgttaatttctttgtattttgaggtttaaaagacaccttgttgccataattctcacctttctgatccacgtcacgcgaagtcttagaaacacccgtagtaacccctgctttagattgccaatttgtagaaaaagttttcttaggatgagccttttcatacaaacgtcccaaacgcaaacaatcacgcactattctcggctgaaacatcttcacatgcatttgtgtatccaaacgtaaacccgccaaatacacacacaccaaataatcttcaaacaaattcactctcatcttaatattctcaaacttctgatgacattccacaattccatctgtctcttgcaattttttcagctctgccattggatcatcatcatcttcatcaaatctgtctttcaacaatttcacatattcaggccaatcaaacataacatccaaacccacaccagactgaataaacgtgtatggaagccattttaaccttcaaatcctcaggagtaaaatcaacaccaaaaaattcttcaaccttaaacagccattcattgattctgcttccatcaaacctgggaaaatcgattttgcctaatctagtaagacctccacaataaggatttggttcaagtcttaccggttcagctcgatactccctctgatgatcagatccaccggatcttgccatcgttgatgttgatgaccttggtaagctccgatctaacacctcatcctcatccataaccttcttcgctgtcgatctgctcatcgcacccatcatatcagcaatctgcttcaacatcgccttatgttgctcagcgaccaactcttccaacctcgacatgcgtgaggcaatcggatcttccctctcaacacctttccctttcaaatcctcttcctgcgatctcgtagtcaccatctttgccgagaaacgacacagctttgatacctttaatacagtaaagtcaccgatgctcaccggactcttcacttctccgatcaacgaacaaatatgtaacctcactccgatgttcctgaaacacgaaaatgataaagcgttaactctcgagacgagagaaacttagctcatgaattgtttttgggttttttagatttttacaaatgattctcgatgatgatggaaatgatctgctcatgactcatatagctcctaacggccttctcacatctgcccgttataagcttccacgcgtcacttccagatctttcttatttgccacttgattccacacgtgccaactcacacgtgcgatggttctgcaacaacaatacttgaaatcgacaaaattaaacggatctccaattgtataaattcgagaacgttactctccccaaacaaaccatcattggacatagacgagccacacgatctcaatctcacgctcatatttcacgtgattccacgccacctgctcacgccgttttcttctcagacaacaatggagttctattagtttcaactagttacatatatatagagttcaatcaatgttgttacaagtttacagtggctccatcgttgaaggcttaattacagctgcagggaatcgtcggttcgacactaggttgtgtccgattttcttcttaactttaatttttaaaacgacgtcgttttgaactgttaacggaaagttgactccgttatttttctgttaacggaaatttcacggcatgccttaaatgaccaagtcaacgaaacttagacattttttaagaagttaactcaaactttgaggtttaaatgacatttcgaaagttcatgcttttttcgtcccaaatttgaaagtttgcgcattttccgacatttttcccattattacgtaactataaattttagcatttttatatttgacattaataaattgaaaaatccagttaaatattataaacaatttagaaaaaagatcctttatacttgatcaatcatttgaaagcctaaatttttaacctgtttcgaatatgaaacctgtttcgagaattcaaaggttctcagggttagggaacttaagggcttccagtgcactggatttaatggcaaggcctttccttttgaagtttaacctttcaatctcatcccggaaataaaaagctagccgatgcataccctaatcgatg

SEQ ID NO: 29411 - DNA, 3003 bp, Unknown
  misc_feature (1)..( 3003): 2750-1469P.txt file - cDNA_ID_3016947; gDNA_ID_2684117; Annot_ID_190841
tgaattgatttgattgcagtttccatcagtttgagtcttttatcttgctcttcatacttcttactgaaatttgtcatcctcttgttcatggacttaaatccattctccatcaaattcttcatttcgtttacaacctcagtcaaaccttcatcacttggactagtcagagctgcagcagtctttcccttgccttttttttccactgcggcttttcttggagcttgtaccacagtagacggagcattattagccacaaagctttggtgtgctacatcttcattgaacaacggttcaaaacatatagtcctctcctcatcaactagacgtttcttccagccatcagctattagatcatcgacatcattcactccacactccttatccataattcttttcaaaagtaggttctcatcaggagttggagccaagatactctgaatgtcatgtgcatgataagaaagtccaattaatagaacatacatgatagaacatacatgatacatgatagataactaataaatatgttatcactaaccttagttgtaccgagtttgtcatacacatctgacattggaaaccctttcatagtgcttgatttaaacttcattttacacatccggggacactgaggatctgcggattcaatatcttcgcagaaatttttcctgagaactggaatcgcctcgaatgctaaatactacaaaaaaaaatacaagattattcaaaactaagttgtataactgctaataaaaacaaagttgtacacagtttactttcttaaaacaattaatagatgcataatgaaatgacaaacctacaaaggcataacaaaactaggaaacaacttttgtggaccaactactccattgcactttttcatcaaatagaaaatgtctctcacattttcttcaaatgcattttttccccacggaaatgttttgcacaactctagatcagccacaaccctaaggaagaacttctccaaatttggtgcatgttttcctgtcttaccctttccaacgattacataagaagtatagcacaactactctcagacgagcttcagaaggttttttcatagacaataactttttctccacatcaggatactgaattgttgctccgggtccaaacatctagccaacaaaagtggtacacccaagctgtccaagggtttgggataattgtggcagtataatcctaacatgagtgcaaatttttcgagagaataccggatcggtacgccattgacaataaaccatacttcctttcttatctaaacatgttgtacgaataaataacagccacatacccatcaccttatgatttggatccttatgcatgtggaagaagtgtttgaattgtgggtgctccaaaaaccacttcaactcagactcttcaagatgactctccaataatccgactgccttatgaagataacactttgctgtaatcttgaatggctttgtataatcactcggaccgaaatacattttaagaggttgaagagcttcggtttcctcatcagaatcctgcaatcaagatagagatataccttagaaagcaacatagataaattagaaatcaagatagatatatctagtttatacatagatataccttttagttttgaaaatttctaagttagaatcaaatatagatatacctagtttcaatatagatatacattttagtttcatataatttaaaggtagaaatcagcatagatatacctaatttaaaaatagatataccttttagtctctaaaatatctaagttatattcgaacatagatatacctagtttaaatatagatatactttttagtttcatataatttaaaagtagaaatcagcataaatatacctaatttatacatagatagattgtttagtctctaaaatatttaagttatattcgaacatagatatccctagtttttagtttcaaaaatttctaagttagattcaaaatagatatactaatttatgcattgatatactaatttatacatagatctactttttaaaatttctaagttataatctcaacaaagatatacctaattcatacatagttatacttttttagtttcagaattttgaaagttacaaaatcggcaaagttctactataatctgctaattgtgtaaagtttaaagttcataccgctctatcgtcgttagagattagatttgttgcttcagaatccacttcagcagccgacgctactactacttcgtcattgattgtctgtgaaactacctccgccgccaacggcacacctgcgttctttgttcgagccatttctccaaacctacaaacaaaatcatttggattagtactactcttcaatcaatttcgatcacaaaacccaatctgaaataactcggatccgattttaacttacccaatttcttagttttctacagatataccaagatcgacgaacagatctgtcgttgtcgttgacgagaattgagaattgttttactggatttagatttacagtgaagaaataagaaaaaaaaacagaaaagaaagagaagaaagagatcgtgaatcgattttaccgcagagaatttggaaaacctagtgttttactagggttttattggatatgacccaaatacaatgagcttggataattttggaatccatttatattggttgggtcgtaaataatcaatatttttaaggttttctatgtcatttacttcttttacggataaaagaaaatcatttttttttctttttttataatataagtatataagattactctccactaaaaaggagccctgaaaatttctttccactacattatccacattataaaaccacatatttaataattttttgaaaactgttatttttgcaattcaccctaataaaaataactttctgtgaaaaaaaaaaaaaacttgttaaaaaaaaaaaagtctgactaaacgtttgcttcttcttcttcacacaaaactgtagggaagaaaaggaataatg

SEQ ID NO: 29412 - DNA, 3003 bp, Unknown
  misc_feature (1)..( 3003): 2750-1469P.txt file - cDNA_ID_3016966; gDNA_ID_2684117; Annot_ID_190835
taaaatatccccttaaaaataaataaatgagaaaataaactctattggttatctttaatcatttttttcatattttcgtaatattcaacttatttactcttttttaatacatatttatttaaaaatatattactatattaatgaacgtatattgttattagttatatgtttttgttttgaaatatcattagtgttttatttatttatttttcaaaagaaaaaataaaataaattgagaaacagattttttgaagattatgttccataaagaattatgtacttttattttgaaacaaaatacaaagatgttgtaattaattttggaaggtgtttgattacacggtttgtgggatttgtttggatatgctatgtatacccttaatgatttcaattgtgattttgcatcttttgttaccttccaaacaaaatctggagattaatctatttaaaaaaataattattctactaatattaaaaaggaaatacatcttaaagatttgtagaatattgcattataataatataccctttatgaatatttcattgatttgtagtaataacagatgcaaaatcacaattgaaatggaatttggttccagaaaaatacctacaatgttattacttgtcatggtgagaacaatgttatcacttcccagtatataaaatattctccaataatattaatttaatttgaacttataattgtttaactgtcacagaaaaaacaatgatgtgtcatgtgtttatgcatacattgaaattcaacatatttacacatttactactaatgttggttctttgcttgagtctctgaatccacaaattcagcgactgaagaagtcatctgatttggtttcttgggagctttctcttcagggatgatgtctctctcaggttctttcctcttcgaacttacactctgagaacctgtatgcattgttcctagactcggtctcatttctatctgagaagagcctgtggctgcactaactgtaacccttttttttccactcctgagaaactcttcctcagcttttaatcgttccaccaacatacaaaccgttagaaactcctcttccatcaatctagtcacaaagccactccacgacgaaggaaacttggaaatgatggtactcacataaaacgtctcatcaagaaccataccagcacccacaatggaatctgcaatcttgataaactcttgaacttgctcaagaaccggtctctcttcaaccattttgaagtcaatgtactttctgacttgtaccatcttagaattggattcctcacgacggtaaacccatttcaactcttcccacagttccttagcatgcttgaatctcttcaagtactgacggtacagatcatcagacaatgatttcatcaaatgattatggcaaagataatcatctctcaaccaatcttgagagctaccactaccaataccaggataaggctcagagagaacataagccagcttcatttgcttcaaaaaaagctccatctctgatgcccatgaaagataactcctcccatcaaatcgccaagtctcgataagcgaaaaaccgtgagtgctactgcttctcgtatccaaagcctcacaagcatttccatttggtgttctgcagcaagatatgcggtccaatgaatataaaacaccaaaaggagaacatgaataaggtaacattcttacgtattctttaactggaaatgcttaatagcttcctcagtagcagagaaatttttcttgaacacagaccattggtgtgttgggaaacttattcctaacagagaacacaacatgaaagctttttcatcattcacaagagttgcttcagagtaaagataacaagtaagtgtgtgtgttcaaaaattgtacctctaaattttgcatctttttccttacgaacatgtttcttcccaatcaatagagaagttttgccttggtatttattaaccatcacatctttcgtctccgagaactattaaacatataaaaacagattccagaaaaatatctcacagaacaaatcgaaaatcaaaaccattcactagaatagaacatagagagtagagtaagcaaaagtcgtaaccttataaagaaagcgttcttcttcagcaacggaaacttttcttttatacgccggaggcactttctccggtacgggtgcttcaccgtggtctatgtcatgagatttaacttctctgagagtgtctttcactgtttcctcgtttttatctgtggtaattatctccgttgtttcgccagaatcgagcaacgatttctccatttttagagacgatttagacggtggatctccggtgaggagggttttggttttctgcgttgatttattgggagactacacatacatattgggatgaaagaccaaaaacgacgtcgtttactaatgcgaagacctgggcagatgtaccggacccatccgaaaattttggtaatttgggtattcttaaaaccgttcagaaacttgtttttgaaatcagtgaccggttcggtgatatgaggaggtgcaccaatcggttaccaaaatattctttaaattgtccaatttttgctataaatcgatggcaaaattgtttgaaatgttccgaaatattgaaaaatatgccgaaattattggaccaatcggaatttaaactgagcaaaccgtattaattattgttgtttcaattcagaacacttcagaaccgaaatatatcacttcagaactgaggaaaaccgtagttcaaattcggttaatttggttagattttttattaatcaaacaaaccgaaattccgaactgacccggaccgaagtaccgattgcaatgcctaataaagtaagatctaatgaaaaccggtttgcagataagaccaatttagccggttaaggttcattatttgattaacgttttttgttgttgattttctccaaaatcaatcaatcactaaaattagtcgttaaacaaaaagcttgcgaagaagaagacgaagaaaatg

SEQ ID NO: 29413 - DNA, 3000 bp, Unknown; identical to SEQ ID NO: 14418
  misc_feature (1)..( 3000): 2750-1469P.txt file - cDNA_ID_3016968; gDNA_ID_2684117; Annot_ID_190834

SEQ ID NO: 29414 - DNA, 3003 bp, Unknown
  misc_feature (1)..( 3003): 2750-1469P.txt file - cDNA_ID_3017015; gDNA_ID_2684110; Annot_ID_190604
tcaatcaatctcttttgagaattttatcactttaaactacacatcgctcatgatttcatcttcttgttttggcattttataggtgtgctggtgcaggacatttgcgagaagacatcgtttactacagtaaagagctgaacaaacttcctattacaaaagatgaaaaccgttcatacatcatggacatgggtgttaaagccttaaggttagttacttacaacttcaatccggttaaaacgatccaaccaaaccatgagtttcgtttcttcccatatccaaacaaataatatgattgttttgtatgagcaggcgctacttttacctgataacattcagatcatacctctatagcacgtcgccggaagaaatgaaattcttggattggatgaagtcacggccggaacttggacatctctgtcataacctcaggatagataaataaaagtgtgattttgggtttcagtgtccatacatatatgtataaatctaggcaaagttatgttgtttggtttatacagagcttttagtgtataaaaaattgtacagccttctcttctccttcgtctgctttgtagagagatctctgtttataggtttgtacctttatatgcattgcttaaaaccctccagctgattcagcaggttattctaatgaacaaggtttattttttcctttattaaaatttaaaaaccaattaataaaatttaaaatatatatatataacgacgcgatttttagactttcttgggagcaaacttagatttgattttttcgatttctttcgttccgatttgaaacgtcgtcgttaaaacgtgatccggaatcgccggagtggctgtgaatagcgtggcggcgatcgattgtgttcccggtaattgactgttgaacgcagagatcaccgacgccggtttcgctttgtcgttgtttttctggtaatgaatcaatcctctagggaagacgaacacttctcctttcttcaccgtcttagcgaagagcttgttcgccgtcgttatgaatccaacgtcaagctcgccttccaaaacgaagatcacttcggtggcgcgtggatgcgtgtgcggcgggtttaaacctccgggagcgtagtcgatacgcgcgagtgagactccgagcgtgttaagccctgcgatcttctctacgtttgctcccgtgacggctgacccgactgtgttgttaacgacggcgggttttccgattccggcgaagaaaaaatctgaagcggtgatgtttgattcgggtttacatgtgaaaccattcacttttatccctacataatccaaaaacgacgacatttcattactttaacaaatcattcaaagtagacagtaaatttaatttgaagatatatgtgtacctgaagtgcgatccgcaacgcagagatcttgaagtgtgtcaggatcgtaagcaagaacaatcacatttagagataacaaagtaaagaagaagccaaaacatctcgagtccatggttttgacttttgatgatgtactgtagaagaacaagtaactagatttgaagctctaatttgaaactgtgtgatatgtttttgtttcgatttggatcgttataaatatttgaatctgtttgaggagaaattatgcatagcttaactaacttaaacgcaaagcaaagcttgggagttggaggaaagatgtgatgtcgttttcttacacatgtacatatttaatctaacttttaagttttggttttcgttagctagaattcttggtttaaccgaaatatattccagatcagagatctatagatcaataataaaaagtttcagtttcaaattcttggtaaggagttggaaagttaattaaaaacttgagtgacaagcattttcttatcatgatgggctgggcctggtagataaacaaataggcccacttgtggtaatcatcgatagggtaaattaaatcgaggtgttaggttaaagcagatccgtgccttgtttgggccatggtgcggcccaagtgatgtttttcctggattgacaaagaaagttactcaattaccctacagttacatggttgtgaatgtgccttggcaaggggtagagtcgaaattagcacacgacaaccagtgaaagcaaaccagtaaatttcactcatccacaaccacagataaatctaactaaaaccctctcagctaccaaacaatctcttagcggatgagaaatatcaaagtactcttggcactcaaggaacccacccccatcagcaatacaatttccttatgtaagctttgaatggctttggcgaaaactcttagctgatgttccgtttacttcttctcccttacgcagtcggtgctcaacagaagctgttacaaactccaagagagacgaaagttgctgatgcatggtacagcaaattatgtgtgtttaaataatgtccaaagactgtagtagctttgtgtatgaaaacatgaacaattttgttggttcttggagtttgtggttttgatctattgagtgtgaaataatagacaaaactaatcttgctggtcttatgatgttgttcataaaaacatgattttgttctaggaatattaaatgccaaaatctgtaagcagttaaattttcagagaatgatatcaaaattttggaaaattaaaaattgtgtgctttagaaagaaaaaaaaaggctttctacagcaaataataaaaaaaggctttctacggcaattgtacttgatagtcatccgcaaccacaggtttaaccctaacccaattttttgttgtaacttaagagagaaagcatttggataaatgacttgggctgggcctaaaagaaattaaaaataggcctctagctgtcattatcattaggcgtaagttagcatgagatgctaaggataccaccaatccatagagttgctaacttaaaaaacaaggctcgaggcggttctcttatctgcaaaactaaagactgttgtctaaagcgaaccaacaaaaagtcttcatctttaatcattcaatg

SEQ ID NO: 29415 - DNA, 1355 bp, Unknown
  misc_feature (1)..( 1355): 2750-1469P.txt file - cDNA_ID_3017015; gDNA_ID_2684118; Annot_ID_190853
aagcttgggagttggaggaaagatgtgatgtcgttttcttacacatgtacatatttaatctaacttttaagttttggttttcgttagctagaattcttggtttaaccgaaatatattccagatcagagatctatagatcaataataaaaagtttcagtttcaaattcttggtaaggagttggaaagttaattaaaaacttgagtgacaagcattttcttatcatgatgggctgggcctggtagataaacaaataggcccacttgtggtaatcatcgatagggtaaattaaatcgaggtgttaggttaaagcagatccgtgccttgtttgggccatggtgcggcccaagtgatgtttttcctggattgacaaagaaagttactcaattaccctacagttacatggttgtgaatgtgccttggcaaggggtagagtcgaaattagcacacgacaaccagtgaaagcaaaccagtaaatttcactcatccacaaccacagataaatctaactaaaaccctctcagctaccaaacaatctcttagcggatgagaaatatcaaagtactcttggcactcaaggaacccacccccatcagcaatacaatttccttatgtaagctttgaatggctttggcgaaaactcttagctgatgttccgtttacttcttctcccttacgcagtcggtgctcaacagaagctgttacaaactccaagagagacgaaagttgctgatgcatggtacagcaaattatgtgtgtttaaataatgtccaaagactgtagtagctttgtgtatgaaaacatgaacaattttgttggttcttggagtttgtggttttgatctattgagtgtgaaataatagacaaaactaatcttgctggtcttatgatgttgttcataaaaacatgattttgttctaggaatattaaatgccaaaatctgtaagcagttaaattttcagagaatgatatcaaaattttggaaaattaaaaattgtgtgctttagaaagaaaaaaaaaggctttctacagcaaataataaaaaaaggctttctacggcaattgtacttgatagtcatccgcaaccacaggtttaaccctaacccaattttttgttgtaacttaagagagaaagcatttggataaatgacttgggctgggcctaaaagaaattaaaaataggcctctagctgtcattatcattaggcgtaagttagcatgagatgctaaggataccaccaatccatagagttgctaacttaaaaaacaaggctcgaggcggttctcttatctgcaaaactaaagactgttgtctaaagcgaaccaacaaaaagtcttcatctttaatcattcaatg

SEQ ID NO: 29416 - DNA, 3003 bp, Unknown; identical to SEQ ID NO: 29414
  misc_feature (1)..( 3003): 2750-1469P.txt file - cDNA_ID_3017015; gDNA_ID_2684110; Annot_ID_137153

SEQ ID NO: 29417 - DNA, 3003 bp, Unknown; identical to SEQ ID NO: 27082
  misc_feature (1)..( 3003): 2750-1469P.txt file - cDNA_ID_3017039; gDNA_ID_2684118; Annot_ID_190882

SEQ ID NO: 29418 - DNA, 3000 bp, Unknown; identical to SEQ ID NO: 14436
  misc_feature (1)..( 3000): 2750-1469P.txt file - cDNA_ID_3017047; gDNA_ID_2684118; Annot_ID_190879

SEQ ID NO: 29419 - DNA, 3000 bp, Unknown; identical to SEQ ID NO: 14434
  misc_feature (1)..( 3000): 2750-1469P.txt file - cDNA_ID_3017051; gDNA_ID_2684118; Annot_ID_190876

SEQ ID NO: 29420 - DNA, 3000 bp, Unknown; identical to SEQ ID NO: 14432
  misc_feature (1)..( 3000): 2750-1469P.txt file - cDNA_ID_3017058; gDNA_ID_2684118; Annot_ID_190871

SEQ ID NO: 29421 - DNA, 3000 bp, Unknown; identical to SEQ ID NO: 14428
  misc_feature (1)..( 3000): 2750-1469P.txt file - cDNA_ID_3017066; gDNA_ID_2684118; Annot_ID_190863

SEQ ID NO: 29422 - DNA, 3000 bp, Unknown; identical to SEQ ID NO: 14427
  misc_feature (1)..( 3000): 2750-1469P.txt file - cDNA_ID_3017070; gDNA_ID_2684118; Annot_ID_190862

SEQ ID NO: 29423 - DNA, 3000 bp, Unknown
  misc_feature (1)..( 3000): 2750-1469P.txt file - cDNA_ID_3017074; gDNA_ID_2684118; Annot_ID_190860
ttctagataaccaatatgttattacatgtatttggtcaagtattttctttgaataacgtataaaattctggaaagcgaacatagatagtaaaaacaagaaaaaaatagagtcaattctaagtaaattaaatcctatttgtgaaagtataaaaacaatactaaaagaaaattggagaattgagatttcaccatatgtacatagaaatgaaattcaaaagaaaaacagtgattctcagattttcaaggcactcatagttttttagtttcaagatttaatgataatgtctcgtccttttacaaatcattaagttgtaagagagttttgcttctttttgaaagaaaaaaaatactactcataatttactttatgtttatcataaattatgataactcgactttactgcaatgtgtttgcttgtcagtaaaaacatgggctggcttcaaatccggatgattgcatgtctcgtgactcttttgtagcctctcttgttggccaactcattccattttctcgttttaggctctttcttttttttagtcacaaagttgaccataccaacatgcaagaccaattattatatctctttttgacataaaccaattattatatcttcaaaattagaggtttttgaccaccactctgatatatttttggcttcgaaaccaaccaacaaaaaacatagcggtttaaaaattaaaaaaccgtctttatcataaaccaaaccataaaatgcagtgattcaccttctaatcttctgtttgacgtacaagtgataaatgacttcaaagctactcccgtttctttacgagtgatttcatttcatcataaagaaatatgtgttgctcttgttcttagaaaattatttctcccagtcctttacaataatgtagatttcttctgttagtatgataaatatatatatgattgaatgtatatatttaacatgttttacgaaaaaagtcagtgtatactatttatgggaaaagtatcactaacttcgaaatatagttgatatttgttagttttatgtctactttaatttaagtcatttaatcaaaaattataatgttgaggtccataaactttaaaagtcccaataatgtgtaattaagttttagaaagaatacttattggattttcatctatgactctatttagaaaagttgtgtctacagtgactagctgcaaaaaaaaggttatgtatagtatcgattgccccttaaaacggagtgaaaacatgttttcttgaatcaaatccaaagtttacaaaatagaggaagatttagatatggtctctaaagtctaaagtagtctaggactaggagggcaatcttgtgaggtattagtgatgttcttttcatgtatttaatatataaatgtaagtttgctgaagcttaatacattaatgaatatgaatgcatgaaaactcgataaagcaagatacgtgcgtgttactactatttgaggtttcgttcgtgccttttagaatagacctattgatactatattttatttcaataatttgggttagattacgcgctaaccccgtgattgatttgttttttttttgtctttaataataataattaccgaatcttaaaacatgataatgatacgtgtgggtgtgtgacattatgttctcttttaagattctatatgacgtcatttcccttccaaatgacatttgatttgcccttgtgccgatgcatagttttaggctctatctctttccttttttcgtgatgacaaggttaaagccttataacctcttggcccaataaatttgtatttgtatatgtaatatgttagatcaaaatgttttactgtgcaatgttattttacttggtttaatatttcaaacgacaatgttaccctgaaatagtataatagctagagatccctacttgtaaatatcaaaacattgaaaactatttttctgaatcatttggtgtaaccggctaagttatattattggtcggacaccaaatattatagaatagaaaaataaaataaaataaaaggatgcatgagtgagtcatttgttatggaagagtagtgaggacaagtgtctaatacactgcatacgggtacccccaaaaaaaaaaacacaaaggtacattgaatcacgtggctttcacgtgaacttcacgctctgctttttttacttcttccattgtttggtctactttttcctttcaagagaatgctgccaaacaccttgtaggtcctatcaatattttttgtgggcccagcccattccttattgttcttgtactgtgaatgttcttcccacaaccacgtgggctttttggcccgttctctctctctctcctccccaacacttttttttttgtcgtactatcggtttgtgaaacagagatttgttgtttcactgatgtttacaaaagatatttgtctatgttgtggcaatctgatattctgacggatgtctattattatatttttaagtcctttctatttgtattttatgtgatttcgtttttggaaacgacatcccttgcatttaaataatctttttataatttataaaggcacaataaagtatcaaaaaaaaaatctcaaagatgctaagattcgacttatataaacagtggtactgtacaacaggaaattcattgcacctgaaaaaataattaaaaacaggtgaaagagataataataccaaaaaaatgaaaaggaaagaaaagcgaaatataaaataagagcaaaagagtctgaagttgatcaacaaaagaaagattagctttcacttacttccactgaagaaataacttttggaacattcaacaagacaacaaaatatgacttccccatcatccaccttcagaccaaattaagttcttcaatcttgtttccctgtttcacacacatatatatatatatatatatatatatatatatatgtgtgtgtttgtgtgcagacgatgatgttcttaccaaccgattattgttgcaggttaagcgatcaagagtatatg

SEQ ID NO: 29424 - DNA, 3000 bp, Unknown
  misc_feature (1)..( 3000): 2750-1469P.txt file - cDNA_ID_3017126; gDNA_ID_2684119; Annot_ID_190910
aaatgattatgaaactaactcctatggcataatgcatcccgatgtcaacaaatcagatactctggaagaccgggaagattccaaaggtctaaggtatagaggagggtccttgaatgataaaaaggaagcatacatgcaatgtgaaagacagagactcctaaatgattatgaaactaactcctatggcatgatgcatccccatgtcaacaaatcagatactctggtagaccatgaagatggcagaggtcggaggtatagaggagtttccttgaatgataaaaaggaagcatacttgcaatgtgaaaggcagcgactcctaaacgatcatgaaactgactcttacgtcatgaggcatcccgatgtcaacaaatcagatattctggtagaccatgaagatgccagaggtcggaggtatggaggagtgtccttgaatgataaaaaggacgcatacttgcaatgtgaaaaccagcaactcctaaacgattatgaaactgactcttatgtcatgatgcctcctgatgtcaacagatcagatattctagtagaccatgaagatgcaagaggtctaaggtatagaggagtatccttaaatgatcgaaaggaagcatattttcaaagtgaaagccagcaactcctaaaagatcatgaaactaactcttttggcatgatgcatcccagtctcaataaatcagatattcttgtaaacggggaagaagccagagctcttgagcgtagaagaggatccttcgatgatggagaggaatcatacatggattataaaaggggggatgcatatctgcattacgaaagccaacaacttaagaaagatcatgactatggcattgatgacaggatatatcgtgatgtcaactcgtcagatattatagtagaccatggagatgccaaggcgctagagcttaggagagtagccttcattgatagaaatgaagcgtatttggataatgaaagcaaggatgtttatcagcattacaataaacaacaactgaagtactacgactctggcattgatgagaggatgtatcctgctgtcaccaaagcagagattgtggaccgaggaggtgctagagctctagagcgtaaaggaatgtcctcgaatgacggaagggaagcctatttgccctatgaaagccagcaactcctaagagatcatgaaattgattcgtatggggtgatgcatcctgatgtcagtagatcatcagctggcaagcaagatgaggaagctcttcgaggcaggagatatctttttgatgaccgagatcaagtctacttggatgatgagcgtttgcaacgacgtaatggtggtgatgttaaagtttatgccaatatgagatatcaagatggtagacaagaggtttatcattcgaatgattcaattttgcgtacaagagatgattatggtcttagagacaacgcaagtgaggttatgcatgagaatatgccttatgattacaactacagggatgctaagcaatcaagaatgtcttatgagaaggcagatagtaaaaggttccgtgaacatgaagtagcatatgattacagagacaagctagggaactatgcagtggatggaggaataagcagagaacaattccgatactcagctgatgaaaggaattctggtaatgttgatcacacatcaactcgacgccgtcgattatctgcaaaggagcggttaggtgggcgtgttgaagaagattcacgtgttcatgtgaaacatagactgcatcaggttagaaacccaaacctaaaaggtaagtcccataagaggtacctctcctgaggtcatcatttctctcaacattgttgattcctccaaacaagattgagagagaaaagctcctaggttttcaaaggatgggtgtgaaaacgaaggatcctaaagttgtaatctcggctcttttttggtctgaaaaaggttagaaacagattcaaggattgaagttttttggcaatggaggatattatcttggttagtagatatgctttcttttggcgttgaacttgactttaaaatgttgagatttttgtctgtcttttagattgtttggtcggtggtttgtatcgacctatcaatcaagtagacagtggttacgagacgttggtcttttttggtctctggtagtgacattgacatcggagatcaacaagtaaataactcaacaagtttatataatctaacaacttcttactattataatctcgaaattggttttctttctcattttgattgtgatcattccttggtcgaatttgattcagtttacatgttttgaaattgaagatgtatactaaaccagacaagagaaagaagaagatataactaaatcgattgatttatatacacagtatcaaattcaatttcgattcggttcaaatgatggaaagctaccggtctggtattataaaaccatgagtcaaaaccgctttttatcaaatacactttaaatgacgtcatctgtcatgtcatcagaacactaaaacgacatcgtttcacttttgactctccccttgttcttctcttctctcttcttcttttcgcttcgttgctgctctcttctcggctccgccggagaatcgtgaaatctctgcgacttcatcaatgaagaaatcgtctcatctctctactgaatctaagcagacctgaaatatctctgtataatctttctttaagattgatttcgtacgatcttcgtgtcttttcttctttaagagatgcgttccaaggacaaaatctcttacttttatgatggtatattcatttctttcccttttcttctttatttatggtaaagaaactccaaaatccttgagattgatgtaactcttgagcaagttttatccacttgaaccgcactagtttttgtctttattgctcaatcgatgcatcgaaaggtgaaatctttcatatctatagtctagaataagtaaagggttacgattagtttggaaatactccagaattgagtagggtttttgatg

SEQ ID NO: 29425 - DNA, 3003 bp, Unknown
  misc_feature (1)..( 3003): 2750-1469P.txt file - cDNA_ID_3017133; gDNA_ID_2684119; Annot_ID_190908
aaaaaagaaaccctacctcgtcgcagcccccaataaatacctcagcagaaggaaaacaactcttttcagttccattgcttatcattttctctgtttctttattcatttgtgttttcgttttacattctttctaatgttttttatttaacatcgagtcttatgttgctcgatatatatatatccatctgattgcaaatgatgagttaaatcaccattgataaaagaagctcaattgagcagtgttggaaatctaaaacttccatgactctgatgcaaattttgatcaagaaaaatcatatccttgatcttttttttctgttctttctcagattttgttaataatcactgaattttgcttttcaaatgtatttttctgtttaatcttaataattctctgcgtatttctcactagcgtttttaaatctattttttctattaatctttagtgttttttactaacaaggctgcctaaaaataaaattgaatttgatcaagtgcaaattgtactgtacaatatgtaacgaatttgatcactatataagtcacaatgatgagaaagtgaaccaaaaagcttcattcatatacaccaagacgaaaacatgaagaagatggaatcaatcagaagcggttttggtgccccaatagccgttaaaatgttgatattattacaaatctcataactaaacaaaaaaattaaccaacaatttctaagaatcgatgttttacgacgcatcgttatcgttgtctccatcgaaatattcatcatccctttggatctgcttatcccgtgaacgctctgaaacattccatatataacattagtcactaagaaaacaaagggactaaagtagagccttgaaggtggttatcgatacttacgatccacacgtacatccgggttttgttcgtcttcatcaaaatccggtatgtagaaatccggtggaacctaagaaattcaagtaaaaaaactgatcagtgtaagattgataaaagcatcaatgtgtcctatgatgatctgagtttacctcctgcatctgtacgcttggagcgtgttgaatgtatcgcaaattctccaaaatctgcactttgatcgaactgatgtacgatttggtattaagattctcctgttttcatttcaaacacacaaaatgattctcaatctctctttagattttgttaaagcaatgaggaactataagttacataagagctccttacaatgtgaccacccggtatcttcaaagaaaaatccggcgcaaaatactttatgtagtcgttttcaggaatctctgcagaaacaattaacccctgagccccaaaacattaaactttctctgacaaaatattgaaacaaacttttactaaccattaggaagttctgtatccaaaagaatgccagtctcaacggtccaacaacgagctacattctcctttgtgtatcctccacctcctgtaacctaaacaacaatcggaaaaaaactgacttattcgtagagaaattaaacacattcagcatgtcctgtgaaaagcatagagaaagccatttcaaaacccaattcgcaaagaaattagcaaacgggagattgaaagagagaaagagattttgattacaagaagaaaaagcaccatcaatagagagattaaagcatcctagtcgataatatgagtttgaatgtttgtagaggatatattaaaggcttataatgtgtggaaagccagatgcagataagaaggtaccgttagtgtttttttggtttttgctggactttggaactctttttaggagatttttcagagcattttcattgaatttttaggtctagctaatgtgagtatgaatgtttgatgtttgcagaggatatattgaaggcttataatgtgtggaaagcgagagggaatttcccgcccgatgcagataagaaggtaccgttgttgtttgttgttgtttgctggactttggaactctttttagaacactttcattgagttttcaggttaagcttatgtgttcgtattgcaagaaacacaatgcaagtttgttcctgatccatatgatggtggagctcaaggttttgagaaggtaattaccattagagactaagccagttgtggattagtaactttttggtttaggcagatgctacctataaaatttcagctatgttgtcttttcaaaatggttgatttggtttataagactttactatggcattagcataccattgttgtcactcccaaattgccttccgttcgagaattttgcaagggggaatgcttatatttcctgtttgatctattttgttaggacaaaagtcacttggaaagttgaatcttgatctgttacttgtctagttgtttctttcataggtactggacttgctagaagatgcttgtgagtctttgctggacagtattataacagaaaaatgatgtgaagcttgaaacttgctgatataaatcttgttaaactgaactctttacacgattgaatgatatgaactctttacaagattgaatgatattaactcttttgttttatcattattattattaggagagaaatagaaagaaaaaaatatatattgtgtggacgtaactttgtttgagacagtgaatggtggagcatagggacagtaattttgtcgtttgcaatattttccacaaaatctcactatattttccaggaaacatccatggagtttagagtcgtcaacgatctatatcttcagtcacacaaatcgtttcaactacaaaaattacactaaacccgtgtgattcttcaactctctagagatttctcatcctttcatgtatcggtgagattttccaactatttttaagttttgcttaaggttttatcactgtggaatcgaattgattggactggctcttgatgattatgctgatattgatgctttgattagtgttttgagctcatttcttgattatgtgttcttgattttatattaatttcttgattcatcgataatcaaagttctcatg

SEQ ID NO: 29426 - DNA, 3000 bp, Unknown
  misc_feature (1)..( 3000): 2750-1469P.txt file - cDNA_ID_3017137; gDNA_ID_2684119; Annot_ID_190907
taatcctgagtcccaaataaatcgaaagttatccctataaaacgcctactatcctgaaataaagccaaaagaaatataagtaatgatggtttgttatcaaataaactcaattaacagggggcgatgcaatggcaaaacttactattgtatcgtcactaagtacttcacatatatccctttcaccaaccaaaagctgacgtttcgtaaagccatgataaacgaattgcttacgagaagtttctcttccgaattgtctgagcaaagtatgcatatttattgtgtctccatataaggaattctcatcaatggatatgagagatttctgagctaatacgtgaagaccttgtttcacatccaagaacttgtttgcaagaacctcttccactttggttgttgattcgtagttaaaaaggcaggctatataaagaaggagatatttatcttcgtcacataagccatcgtaactgaactgtataatgctcccgatatttccgtcgaggctagtttttaaccttggtagtgttctttcccactctggcttggacttcccccgcaaagcagagcctagaaccttcaatcccaaagggagttcaccagctaaagccataacttcccatgcaatctcatcgaaaccttcatgtggttgtttctgaccaaaggcattcatacagaagatttgaaaagcctcgtcatttgatggatatttcactttgtaaacatgatttatcccatgagccttcaaaactcctagatcttctgttgtgataataatccgacttccaggaccaaaccatcgagtttctttcgccaaggcatctagttgtcctaattgatccacttcatcgagaacaagaaacactttcttgtctctcaaccgttcttgagccactcctaaatgagaaatcatgatatctttatgattgatcatctgggacaacatttggttttgtagttgcaattgtgcactgtactcatcgaaacaaggtcttggatagattcctctgatattcacaatgatggcactaagttggaatctgtcggagacttgattaaacagaaatctggcgatagttgtcttaccaatcccaggcggtccccaaatcccgatcatccttacttcatccaaatctaggcgcaacaattgttccagcatatccatatgagctctcatccctactaacccgtcgaaatctcttgatggtgtgaaactatttaacatgtttgaaacatcagtggctattttctcaatcatgtctgcttcattcctcctgacattagaggatagatatcaaatcaatatacaaccgttatgacaaaatggtcatgaagatctgaacgaatacactttaacaagtaaatcttaattatggagagtagaaatcaagaggacaaaccagttgcgagaatgttctccggcgattgtggccacatcctccaaagcttttctccatctctcaacatactcttttgttttacctttacatgtttttgtgaaggcttttccaaattcaccggtctgtttctttatgtcagttggatccacttcatagaaaatagtcatgactatctgacccaacaattccctacacttcatgatttctgctaattcatcaaggcaccaagatgaagaagcatagttctttgagagcaagacgatcgcgatctttgatcctttgatagcttctttgagctcatgaccgatcgacttactcctctctatattattatcaataaatgggtcaattccctttcttctgaacgattcgaggatgtgactaagaatggtttttcgaacatctgccccgtggaagctcgggaagacgtggtgtttccagattcgagacactgaagttggaggagatggaagagataaagcagaagatttagtatatttgttgtcttgttggaatctgaattttgtaaaagctgcggctgccactgaaccaaggaaaataagaataatttattagtaaaaagtgaatcaagatttaagatggatgaaggattaacaaagaggaagaggcctctgtgtgagtgtcatggatacagaccgttgacacataaactccatggatgtttccaagatgactcatcctgaatgaatctgcaattctcagcatcgtttgttgagcatatctttcgtcttttacgagattcggaatcaacatcctgactcgttgctttcctcttggaacagcccaagctcattacagaacccatgagaactttgattatcgatgaatcaagaaattaatataaaatcaagaacacataatcaagaaatgagctcaaaacactaatcaaagcatcaatatcagcataatcatcaagagccagtccaatcaattcgattccacagtgataaaaccttaagcaaaacttaaaaatagttggaaaatctcaccgatacatgaaaggatgagaaatctctagagagttgaagaatcacacgggtttagtgtaatttttgtagttgaaacgatttgtgtgactgaagatatagatcgttgacgactctaaactccatggatgtttcctggaaaatatagtgagattttgtggaaaatattgcaaacgacaaaattactgtccctatgctccaccattcactgtctcaaacaaagttacgtccacacaatatatatttttttctttctatttctctcctaataataataatgataaaacaaaagagttaatatcattcaatcttgtaaagagttcatatcattcaatcgtgtaaagagttcagtttaacaagatttatatcagcaagtttcaagcttcacatcatttttctgttataatactgtccagcaaagactcacaagcatcttctagcaagtccagtacctatgaaagaaacaactagacaagtaacagatcaagattcaactttccaagtgacttttgtcctaacaaaatagatcaaacaggaaatataagcattcccccttgcaaaattctcgaacggaaggcaatttgggagtgacaacaatg

SEQ ID NO: 29427 - DNA, 3003 bp, Unknown
  misc_feature (1)..( 3003): 2750-1469P.txt file - cDNA_ID_3017155; gDNA_ID_2684119; Annot_ID_190901
ttctcacaattaaaaaaaaaaaataataaaaatgaaggaaaaagagtgtagaaagtttctcacttgagaaactctgagatactctttacaacccatcatgataattctcttctcattattggttcaactttttaacaaaaatatttttttaatcaaaaaatcaaattataatataatattaattttttgtttgtttgagaaactttgtgggtttctcatggataaaaaggcccttaacttgtcatagaagttacaacacaacatgaaagttaaacatcgccggccaaaacaaaaatatttctgtgaatttacacaaaattatttgcattaccgaccataatgttctcctcagtaccttcaacacaatacaacaatacattaacaaaattggtcttctagcattagcctcgtctctaaaatctaacatcttcttctactcctaatccaacaattgtttatgtatattcccaattatacccctctattactttgcttattacggaaaaggagttcaaagagcagaagaagaaaactcgtatatcccaaatctccaacttttcaggggaatgatgatgtactgtcccaacctcacggcttctctaacaatcccttcatatttaccattttgccactacactagacaatttcgtccttctcatttccgatcatctgataaaaacccgaatctcgtttctatcatccgagcaaaacccagaatttctcattcgcttaggtgctttgtatcatcttcaatggcgactcctcctccgacgcagagcagcgaaaccaaaccttactctgttctttttgtctgtctcggaaacatttgtcgcagcccagcggctgaaggtgtctttagagatatcgtgaagaagagaggtctcgattccaaattcaacattgattccgctggaacaattgattatcacgaggtatgataattagttccaaaacaattaatctaattttagggtttatgagagatgcttgattcatggttgatttgaaatattggtgaatgatggttttgtatgtagaaaggtttggttttggttttaggtttttttggtggatgtaatttggtaggaatacagagttatagagactttgaaattcatgtttctgaatcaattttgatgtgaaattgctcttcttactagggaagagcaaaaacagtaatctatttttatggtgattgatgctttgattggaacaattaggcaatggtgctttcagattttggtggatgtaatgtggttgtaaattaggagcagtggagactttggaatttatgtttctgatttgtgaaaatgttggttttttaaaaggggaatatggcggatccaagaatgagaagtgctgcgaaacgtcgcgggattgagataacatcactatccagaccgatcaaggcatctgatttcagagaatttgatctcattcttgcaatggatgaccagaacaaaggtagctgatagagtaatttattcaacctttgtagggtctgatcgatttctatgcaaatgggattcaacataggatagagacttttgcaagttgggatctgattagagttatatatgtagaattgaaataagtatgagtttgaatgtttgatgtttgcagaggatatattgaaggcttataatgtgtggaaagccagagggaatttcccgcccgatgcagataagaaggtaccgttggtgtgtgtttgctggactttggaactctatttagttgatagattttcgttgaattttcaggttaagctaatgtgttcttattgcaagaaacacaatgacaagtttgttcctgatccatattatggtggagcccaaggttttgagaaggtaattaccattagactctaaagaagctgaatgcagatatttaatttggttcataccattagaggttgtctatcaaaatggttgagtcagtctataagactttaaaatggcattaccagtgtcactcccaagtaacttttccattcccgaattttagtgttttatgtggacaaaactcacttggaaacatgaatcttgatctcttacttgttctttcacaggtactggacttgcttgaagatgcttgtgagtctttgctggatagtatcactgcgcaaagttgatgatactacaagtacaaagtcccaatcctagaacctttgttgtttttgcacatagaactgaaaagttctcttattatatttaagtgtcatcagtgatgacaatagagtgagaactgatgtgaagcttggatcttgatcttgttggtgttttccttgaaaaaccctttgttaaatgatctactgatggatcattattattgagattgatagcttcagtgatgtcaatagtttgtgaggaatgatcttcctgattcttaagaatcatagagagtggcactctttacacgcttgaataatacgaattcttttgttcgatcattattattaggaaagaaatagatttaaaaaaaaaagaatgtgtggacgtgaagtgttgttgtttgagatgataacagaatattttctcttatcattatgtggcttccgagaaattaagtgaatggtggtggagcatatggacaatgattttgtcgtttgcaatattttccacgaaatctcactatattttccatgaaacatcaatggagtttttctgtgccaatagactcgtcaacggtctatatcctcattcacacaaattgtttgaactaccaaaattccattaaacccgtgtgattcttcaactctctggagatttctcatcgttttatgcatcggtgagattttcatttttttactcctcactgtctgaactaagttccaactatttttaagttttgcttaaggttttatcactgtggatttgaattgatttgatgataatgctttatttgttttcgattagtgttttgagcccatttcttgattatgtgttcttgatggtgggaattaatggttgcagcagtgaatcatcaataatctaagttctcatg

SEQ ID NO: 29428 - DNA, 3003 bp, Unknown
  misc_feature (1)..( 3003): 2750-1469P.txt file - cDNA_ID_3017159; gDNA_ID_2684119; Annot_ID_190900
ttaaaaactatatattataaataaatcgccactttatagttttaattaataactaaattacactttctagtcccttttcatgtggcgtatatagacttttctagtctatctaaaaatacactacactatcgtgcacatcaatcaataaaaacatatattccaataacaaatctggaaaaattcatttcaattatataagttaaggttactgaaaactgccaaaaattcagaagaaattacggaaactaaatctcgttactataattacgatgtaattaccgttaaaaaggcaataaatctagtactagtgattaattaacggtgccattaaattcagttatgtgtgttttaagtgttaactacgagacaattcgccagctggcgagtcccacttccctgatttcatcaggcttttatatttattcactgcttcatagtaataattacttcccaaaagatttttttttgaattagaaactgaatatttaaaaaaataaataacttaacggaaactgttacctgacggcggattcatggaaacgtttatgagtctgtttttgacggagaacgtgaaggtcaccgccgggacaaaactccgttaataaacagagccatttcggagaatcaatggcggcgtaaagcgtcggaagaaacggatgatcaagagattcgagaatctctctctccgtcttagctctaccttctttgcttctgctcgcgagctcctttttatccataactttcgctgctaacagaggtaatttaacggcggtggtttctgttacggcggttagggatttgaattcggctaagaaaacagagccgatgtcgccggaaccgagacggagacggaatctgagatcggagagtgagagagatgatcggagtgaaggagggagtttcgaagatgagaatgaaccgtgagctgatggtgctggtgttaaagctgcggcggaggaggaagagcgagaaccggagcttgtgcttcgattcacggtggttccggctgatgtaaagcttacactctgtaagtcgtcggttaattcgtcaatccatggctccattttccgatctactgagagtgacgacgagagagagaagaagaagaagaagaagagagggagagaaagagagaagtaactgtgagattttgcctttttggggaagagaaaaaatagaatcaaaagaagatggcaaagttgtaatttaagggttgagatatggtgcgtttcgtaatttaaggtaatagttcgattgttaaggagatgatgatacagtattctataattgagatgttttatttatgtaaatagacaataattagggaattatttgagagggatttttgatttctctatgaatttttaagatctttggtataggatttgtttcaaaagagagaaacaaagagacatataaatctaggcccctacagaattaagataatgacatatacatatcttgtgtttgttctatttcagttgtgattactagtattttcttcgtatggtacaattataaataaatatctaatcactgtcttttgaatattatgtcaccaagtacaaggatggtgttattggtgaacaatttgtatcgtgaactcaaatccctattgcacgaacctcaggttagtggtcgactggtcgctcggcctcgttttcatttcctttgaaaccattatggtttagatattggtttaactcaattgcatatacctaaccggtttgactcgggtgaatatgttagataaggaaagtgtatataacccttgtattttctcattaatgaaatcagcagaaacattttaggttggataaggaaagtgtctataaccatatcattgaaagacaaattgcttgggtcgaaaccggttttgttaagtccggccctggatatattaccaatttgtaacactcgtcttaaaccggatattttctagtcagaccgaaaaaatacaagtgaaagaggttcaaataaattgataacttagaacattcataacaatgaccaaaacaaatcttttcaatgaggtttgtaaattgtaactatatatccgaattaaaaaataatcgtcataagtactaactgtttttcggagaatgaaatgggctatctgttgaaaaccttaggcctgagtttaaagaccatctgtacaattgggccaataagtaacgcattatccatcaacaaagtactgaaacatgagacacttagaccatctccatcgggggtttcttgtaagaatttctcacaattaaaaaaaaaaaataataaaaatgaaggaaaaagagtgtagaaagtttctcacttgagaaactctgagatactctttacaacccatcatgataattctcttctcattattggttcaactttttaacaaaaatatttttttaatcaaaaaatcaaattataatataatattaattttttgtttgtttgagaaactttgtgggtttctcatggataaaaaggcccttaacttgtcatagaagttacaacacaacatgaaagttaaacatcgccggccaaaacaaaaatatttctgtgaatttacacaaaattatttgcattaccgaccataatgttctcctcagtaccttcaacacaatacaacaatacattaacaaaattggtcttctagcattagcctcgtctctaaaatctaacatcttcttctactcctaatccaacaattgtttatgtatattcccaattatacccctctattactttgcttattacggaaaaggagttcaaagagcagaagaagaaaactcgtatatcccaaatctccaacttttcaggggaatgatgatgtactgtcccaacctcacggcttctctaacaatcccttcatatttaccattttgccactacactagacaatttcgtccttctcatttccgatcatctgataaaaacccgaatctcgtttctatcatccgagcaaaacccagaatttctcattcgcttaggtgctttgtatcatcttcaatg

SEQ ID NO: 29429 - DNA, 3000 bp, Unknown
  misc_feature (1)..( 3000): 2750-1469P.txt file - cDNA_ID_3017166; gDNA_ID_2684119; Annot_ID_190898
aataaattactctatcagctacctttgttctggtcatccattgcaagaatgagatcaaattctctgaaatcagatgccttgatcggtctggatagtgatgttatctcaatcccgcgacgtttcgcagcacttctcattcttggatccgccatattccccttttaaaaaaccaacattttcacaaatcagaaacataaattccaaagtctccactgctcctaatttacaaccacattacatccaccaaaatctgaaagcaccattgcctaattgttccaatcaaagcatcaatcaccataaaaatagattactgtttttgctcttccctagtaagaagagcaatttcacatcaaaattgattcagaaacatgaatttcaaagtctctataactctgtattcctaccaaattacatccaccaaaaaaacctaaaaccaaaaccaaacctttctacatacaaaaccatcattcaccaatatttcaaatcaaccatgaatcaagcatctctcataaaccctaaaattagattaattgttttggaactaattatcatacctcgtgataatcaattgttccagcggaatcaatgttgaatttggaatcgagacctctcttcttcacgatatctctaaagacaccttcagccgctgggctgcgacaaatgtttccgagacagacaaaaagaacagagtaaggtttggtttcgctgctctgcgtcggaggaggagtcgccattgaagatgatacaaagcacctaagcgaatgagaaattctgggttttgctcggatgatagaaacgagattcgggtttttatcagatgatcggaaatgagaaggacgaaattgtctagtgtagtggcaaaatggtaaatatgaagggattgttagagaagccgtgaggttgggacagtacatcatcattcccctgaaaagttggagatttgggatatacgagttttcttcttctgctctttgaactccttttccgtaataagcaaagtaatagaggggtataattgggaatatacataaacaattgttggattaggagtagaagaagatgttagattttagagacgaggctaatgctagaagaccaattttgttaatgtattgttgtattgtgttgaaggtactgaggagaacattatggtcggtaatgcaaataattttgtgtaaattcacagaaatatttttgttttggccggcgatgtttaactttcatgttgtgttgtaacttctatgacaagttaagggcctttttatccatgagaaacccacaaagtttctcaaacaaacaaaaaattaatattatattataatttgattttttgattaaaaaaatatttttgttaaaaagttgaaccaataatgagaagagaattatcatgatgggttgtaaagagtatctcagagtttctcaagtgagaaactttctacactctttttccttcatttttattattttttttttttaattgtgagaaattcttacaagaaacccccgatggagatggtctaagtgtctcatgtttcagtactttgttgatggataatgcgttacttattggcccaattgtacagatggtctttaaactcaggcctaaggttttcaacagatagcccatttcattctccgaaaaacagttagtacttatgacgattattttttaattcggatatatagttacaatttacaaacctcattgaaaagatttgttttggtcattgttatgaatgttctaagttatcaatttatttgaacctctttcacttgtattttttcggtctgactagaaaatatccggtttaagacgagtgttacaaattggtaatatatccagggccggacttaacaaaaccggtttcgacccaagcaatttgtctttcaatgatatggttatagacactttccttatccaacctaaaatgtttctgctgatttcattaatgagaaaatacaagggttatatacactttccttatctaacatattcacccgagtcaaaccggttaggtatatgcaattgagttaaaccaatatctaaaccataatggtttcaaaggaaatgaaaacgaggccgagcgaccagtcgaccactaacctgaggttcgtgcaatagggatttgagttcacgatacaaattgttcaccaataacaccatccttgtacttggtgacataatattcaaaagacagtgattagatatttatttataattgtaccatacgaagaaaatactagtaatcacaactgaaatagaacaaacacaagatatgtatatgtcattatcttaattctgtaggggcctagatttatatgtctctttgtttctctcttttgaaacaaatcctataccaaagatcttaaaaattcatagagaaatcaaaaatccctctcaaataattccctaattattgtctatttacataaataaaacatctcaattatagaatactgtatcatcatctccttaacaatcgaactattaccttaaattacgaaacgcaccatatctcaacccttaaattacaactttgccatcttcttttgattctattttttctcttccccaaaaaggcaaaatctcacagttacttctctctttctctccctctcttcttcttcttcttcttctctctctcgtcgtcactctcagtagatcggaaaatggagccatggattgacgaattaaccgacgacttacagagtgtaagctttacatcagccggaaccaccgtgaatcgaagcacaagctccggttctcgctcttcctcctccgccgcagctttaacaccagcaccatcagctcacggttcattctcatcttcgaaactccctccttcactccgatcatctctctcactctccgatctcagattccgtctccgtctcggttccggcgacatcggctctgttttcttagccgaattcaaatccctaaccgccgtaacagaaaccaccgccgttaaattacctctgttagcagcgaaagttatg

SEQ ID NO: 29430 - DNA, 880 bp, Unknown; identical to SEQ ID NO: 14462
  misc_feature (1)..( 880): 2750-1469P.txt file - cDNA_ID_3017198; gDNA_ID_2684120; Annot_ID_190949

SEQ ID NO: 29431 - DNA, 3000 bp, Unknown; identical to SEQ ID NO: 14463
  misc_feature (1)..( 3000): 2750-1469P.txt file - cDNA_ID_3017202; gDNA_ID_2684120; Annot_ID_190948

SEQ ID NO: 29432 - DNA, 3003 bp, Unknown
  misc_feature (1)..( 3003): 2750-1469P.txt file - cDNA_ID_3017205; gDNA_ID_2684120; Annot_ID_190947
acaaatcttaatacgtttttttattttgctggctctgaggcaacaaactttttttacaattacttctttgtcatccccacttaatctggccttaccgtttttatttggcttcccgggttatgcataagaagatgtcaagtaggtgagaggttggtgtgcgtagggaatttgcaattaacacgtgtttattttaactctcttcaattttaaatggtgagagtagacgtagcaaactagtctaatcgcgaactaaaccactttatattttttgaacgaaatagaaattgttgtagttttctataaattattttttaataatctccaaatagagcaacgtatccacttatatatataaccttatctctttttttattggagaaaaaaaaagtacactgtgataatttgaactcatatatatacacactagttgtgtgtgcttgtcttaagaaaaaacaatgggatcaatggctcagaaatcggttttgatgttatgcggagagttcatggaagcctacgagactatagtacctctctacgtcctccaagcgtttggtgttagcgtccactgcgtttctcctggtcgcaaaactggcgacaagtgcgtcatggccgctcacgatctccttggcctcgaggcatttctcgaatctttcactttttcttcatttcagtttttttcccttgcaatcgttctttgcatatttagtaaaacaatgcgatcaaatgctcataattgggtggactttcccctttattatctttatccaaaaagtttagataattgggtggtctcaacccaaaatgcatgggcctactcttaacagtaaaaaagaagagtttcaatttgacttttacctttttacagatatacaccgaactggtggttgaccatctaacactaaacgctaacttcgatggcgtcatccccgaccaatacgacgccatcatcattcccggtggacgtttcacggaacttttgagcgccgacgagaaatgcgtgagtcttgttgctagattcgccgaactcaagaagctcatcttcacgagctgccacagccagctgtttcttgcggcggcaggtctgctcaccggtggaatgaagtgcacggcgttcgaaagcatgaaaccgtttatcgagctctccggcggcgcatggtggcaacagcctggagtccagacccttttcgaaatcactgattgtgtcaaggacggcagtttcatgtccactatggggtggccaacgcttggccatagtctcaaagttttgttagaatcacttggctccaagatttctagctctaaagagaatcatcagacttctttgcttttcttgattggggtaagtagcttattttcataagactctcttttagactttatatattggaattaaaaaaatggtctgactaatacgtaattttggtatatttaggattgtgttgaagattatagtatcaacgtaccatttaaagcgtttcaagctttgggatgtaaagtggatgcagtgacgccaaccaagaagagaggtgagaaatgcgctacaatcgtacacgaccttgaagacggacggcaacttcctactgagaagtttggtcacaacttctatgtgaccgttgcgtgggatgatgtctctgtggatgattacgactgcattgtggttcccggaggaagatctccggagctcttggtgatgaaccccaaggccgtcgaattggtcagaaagtttgttgagaaaggcaagtttgttgctgccattggaatgggaaattggctacttgccgccacaggcgcccttaaggtaatatacaccgttttacaaaaattcgttttactattctaaagacttaaaagttaaaactgaagccgaaccaaaccatattttaatttaaacgaaacaaaaatgtcaagataagttgctctaagcacataggaatctcctatggttatggttatgactaatattattccagcatattgttgaaggttagtaagatataattcatcacatttatggcaccacttccttagcatagattataatttttgccagcttgttataactcatctaattcccattgtggcatgctatattattacattgcagaagaagagatgtgcaagtagttatgggacaaaggtggctgtgaaggttgctggtggtgagatcgtggaatctgaacggtgcgtgaccgacgacaagctggtcacagccgcatcaacttccgatcttcctgcctttttgtatgcattgtcgactgcacttggtctctctgttgtattctaatgtcaagtggtgctttaacgtctaatgcctaaaaaaataaaaacatatctttgtatgtcgaaatataaggtcgtccctctaattatttatgtacaagcttggatttgcatatatatatgggaagaagagttgccacacttgcttacacctcttctaattgtgtttttttataagaaattaccactatcaagttgtcattctcctcgttttacatttggtaaacaagctctattgaccatttatgttgtaacactacttcaagactaaagttgattagagatagcaaaatctgtcaccagcaaattgtgtttccttgttaaatactagtaacagattccaaacacattaaattttgtgaagttaaatttaacaacatactataaaataaaacaacacataaacggattaaagacgttaatgttcatccaaaaagtatactgaacttttaaataatttaccgacgaattgtactgtttatatccgaccaatatagttaatcacattttaatcactgcataaatttactcataggaattacaattaccgaattagtttcggtttaaaatttgttggatcaataaaacaaaaaaaaaaaaacgatgccagaatattccgttcgtcggcgtagtctttcccgcccccaaattatctgagcaaaaaccctagactctcgatttcgtcacgattttctcaatcaccttcactatactgcttcgatg

SEQ ID NO: 29433 - DNA, 3003 bp, Unknown
  misc_feature (1)..( 3003): 2750-1469P.txt file - cDNA_ID_3017209; gDNA_ID_2684120; Annot_ID_190946
gttctcccccaccaccgtactactctccttcacctaaagtgtactacaagtctccaccaccaccatatgtctacagctctccaccaccaccatattactccccttcccctaaggtgtactacaagtctccaccaccaccttattactcaccttcccctaaggtatactacaaatccccaccacatcctcatgtatgtgtttgtccaccaccacctccatgttattctccatcccctaaggttgtgtacaagtctcctccaccaccatatgtctacaattccccaccaccaccatactactcaccttctccaaaagtttactacaagtctcctccaccaccatcttattattctccctctccaaaggttgaatacaaatctccacctccaccatcgtattcaccttctccaaaaactgagtactaaatttctcggctgcctctatatgagtgaaactaaaaaatgtaattcttaaataagttatcgaatattattcgattttatctttccttttgttctcgttttttaatttctcttatctaatcaatttttaattttcttgggatttggctacaaaattttcttttatttgtgtaacgattgcttgcgatctatataaactcctttgcaaattcttgactttgtatcgtttaaataactatatgatcctctaacatggatcttgtctttggacagcacacctaaaagcatgaattattttaattctagtatgtcttcaaccttaacgatccacaatttttaactcttggaggtttcattttcctacctaaatctggtatggattaaaaaagaaaactcaaactaaaaaacaattatgagacgacaattcccaaagatatcaagaagacaagaactacattttactccacaactatattctatcgcattatttttattaaaagattttcattgatataaaaggaattaaaaaggaactctaatcgaaccattacatccaaccacaaaagggaaaaaaaaaggtgaaagtttaaaacatgaaatagctaattcaagattttatatctttatttttccgaaatatttttgtcccttacgattaaattcaataaaccaaagaactaaaagagtggttgtctagtggtagtacaagggaattggtttctttgtacaccgggttcaattctgtttagaaacagagaaatattctttaaatgaaaatggactaaagactagctccggatatagaagaagattatagatccaaattccaaaactttcgcgagcccgaactttcttagctaaacaaaaagaaatctaatataaaaataagaagaagaaacaaccaaggaacgataagaggtaattatgctataaaaagcggtcacttgtcttggttctcgaggatagaaatcaagtttgcacaatcggaagcgaaaataccaaacatcttgccggtagagatcatgcattaattccattgcccataacagataatcaaattctgcatggagcgacaataaactccgacggctacttctgagaccttgatgaagaactaagttttgtttcactagaacccaactatatccgctcagagccatcttcatgccaaggcgcattaaacagagatcaagatagggggatctagattaaacgttggaggtgtgacagaaattatggactcttcttttagggaagcttgtttccaagctgcaagatgttcaacgctcacaaatatgttagcatatgatatgattaggtttttgaattctatatttttatatgtcgcaagcgcactacaattaataaatcttcttagggtagaatttcaatccataagcaggctactaattataccatgaatactaccattttcccctcttttttttatttatgataaggtttctacgttagtaactcttatatatatgttttgactgttacacacttgtggaatcatgatggctggattggtgattcgaccattttgacattgaaaaccggtctccctccaattaccttgaagcgttatgcaataagtgtaaatgtctgctttcgaatggttttagcagtccatgaggctaatcgacccaacccaactcatagactatagagttacatcatttccgttgcatgtctcttgtgacacaaagaactaaacaagataagagagaattagagaagctataaaacataaaatcactacatgtcacatttatcatttactatgttgaatatttttaccgttcaatttaaagaaatccaacaatatgcttaaaataatttttttgattaatgtttccaaattctatatgttcttttaatcatatggtaattgattattttcgaccattctgataaagtttggagtacactgtatttttttttaaaaatagaagaaatgtatatataaattaactaagaatatattaagttttattgttttaataaagtagtttcattgctgcatgcactctgccatttacataaaatgcaagccttgtaatttacttttcttcattaattgtttaagatttgttttcaattttaattttgttaagaaaacaaatcttaatacgtttttttattttgctggctctgaggcaacaaactttttttacaattacttctttgtcatccccacttaatctggccttaccgtttttatttggcttcccgggttatgcataagaagatgtcaagtaggtgagaggttggtgtgcgtagggaatttgcaattaacacgtgtttattttaactctcttcaattttaaatggtgagagtagacgtagcaaactagtctaatcgcgaactaaaccactttatattttttgaacgaaatagaaattgttgtagttttctataaattattttttaataatctccaaatagagcaacgtatccacttatatatataaccttatctctttttttattggagaaaaaaaaagtacactgtgataatttgaactcatatatatacacactagttgtgtgtgcttgtcttaagaaaaaacaatg

SEQ ID NO: 29434 - DNA, 3000 bp, Unknown; identical to SEQ ID NO: 14461
  misc_feature (1)..( 3000): 2750-1469P.txt file - cDNA_ID_3017239; gDNA_ID_2684120; Annot_ID_190935

SEQ ID NO: 29435 - DNA, 3000 bp, Unknown
  misc_feature (1)..( 3000): 2750-1469P.txt file - cDNA_ID_3017247; gDNA_ID_2684120; Annot_ID_190933
gaagaatccagatataggtaagcaaatttatgcgtattattcaatatggttaacttcgtacttagacaatgtaaactagtaaaactacaagcatactttttcgtaaatgggggttaacctttttaataaatgctaccgagttcatcatcactatcaatcaaattgtggtttacataactagcttttgtatttgatatttacagatatgctgggatgccagatacagaagcagtgaccaaccccacagacagaactgtggctcatttgctctttcataggccttttgatatgttggcggcaaagcgaatggaaggaccagaatcacccgcttcttcgaagatgggaactgaagaaaaagggaattttcctaaatgcagcatacgagagactcacttaactaagcagaaagctcaaaaggaagaaggacctgcagattcacttgctttggggaatgcacccaactctggatctagtagtactgttggtgagagggttgttgaagcatcccaaggaaacaaaagaaaattgtgaaatttagaaggttgttatttccatactataactctataaatcgtttccatgcccttttgtatacgtgcatagagcttgtatacagattgtaactaatacgcaggtgttgcttttgctttcaatcagtttaggttgccgtgttagagaggagctttgggtatttctgcagactagacagcatctttctgcgtctcttgaaacaatctcctgactgctcctttcttgtgaagctcttattcttgtaattagatttttttttttttgttacttttcgaaaacctcttttgttatacgtatctccatgacaactacattttggaaaacgtgtagtttgcaatgtttttcccccattcgaaaccagattcaatctcttaatacaattgtaagcacacaccaaggacacataaagtactgttttgaggagaagaaataggtaacaggagtgtcttagttaatcatagagtagctgcaacgaatttgcctttcttcagagttcagatgatgcatcggtatgtcacaaaatccccaacaggctctttactgtatgtaatcttcaccacctgttttttctttaacccatagtacctcacaaagctgtccttctcctgcaaataaggaagctgaaatggaaaagaaacatccattaaaacatagcatacacaaataggcaaagaagctttgtgcagaatataaacagacctgtttgtcctcaagtgcatgcttcctcagcagttgttctttctcctctttgtttaaaatctcaatctttggctgctgaatgtgctttgtgatgttgaccaacaaatcttcaatctgttggcatattcaataagtataaacatgtaactgttcagttaacgtatttccaattcaggtctcaatttcatgatcctcaatagatatcatgcaagacaatccaaatccagagctataatgtttcatcatgtaggaaaacagataagtgctgaccgggaaagtttcaactgtaaaagggaaggtagtcaatgccttctgggcaaagtggttcattttgctctgtaaaaccagaatcatagcatgcaagcctacattgttggaaatctgaatatgaagagcacgaactgacttcacggtgattggttcagttcccatgaacacaacaaggatctgcataaaaccatttcaataagcttaatgaaaaacaggtaaaagcatgagaatatgtctggttacattctcatctcaactagctgttcaaacataacattttaatgacaccttaatatgatcccatcctttcccattataaagttaaagcaatatgccattcgttacaacacaagtaccatgcgaggaaccttactgctacaacaaattttcttggttcccaagaaaaaaatgggtatgtattagttcttcagcttttccaaaacatataccaaaagctataaattaaacagaacaagaccaaacgcaaaccacacatcattggaaagaagaagataaacccatatacttctcagttctcactagtcttatcctaaaaataccctataattaaaagttgaaatctttttgttgtattaaggcaaatttaaaccaaggttaaaccctaaatctaaaaagtcgacgcatttctcaaattttcttctgttttaacgcaaacccaagctggaagctcaaaatcgataaaagtttaagcgttttacacattttttttctctttgaaggcgttaaaccaaaatgcaaacccaaaatctaaaaaaggtgatgcctttttcacattttcatctgttaaaaacaaaaagtaacacccaaatcgaaaaatagcggtggaacaaagaaaagctgaaacctttttcttgggatctgagcgaagaggaacgcagatacggaggcgttcaagctcaggcttctcaccaaaaacagaacgaaactcagaaagagtgagagagagctcagcttcattaacttcgtagcctctatcgcgaagcatctcaaaagctgtcgtgcgagccaagtaaaacctcttgctttcgattcctccggtgtcctcagtcttcgaaatacagttggtaccgtcgtcaaacgtcgactcaacattttcacagcacccttcttcggccattgtctcctccatttttctcctctgtcaatttcagagttttgctgttggaagagagaaaggttttatgagtttgttttgtcacaagagagagtgttgtttgtgcttgagacttctcggctggccccttactaaaatacatctggactgtccattgcattaatcaaccaacggttacgattcctctcttttttattcaattttacttttaagaaaactccaaaaaagcataaccataatgtcataaagacatgtttttgttggaccggacataaccaatgtcgagatgacgtcaatggatagttgagtcggctgttattaacgacggcgacgagttagggttcatacttcctaaagcggccatg

SEQ ID NO: 29436 - DNA, 3000 bp, Unknown; identical to SEQ ID NO: 14466
  misc_feature (1)..( 3000): 2750-1469P.txt file - cDNA_ID_3017251; gDNA_ID_2684120; Annot_ID_190931

SEQ ID NO: 29437 - DNA, 3000 bp, Unknown; identical to SEQ ID NO: 14458
  misc_feature (1)..( 3000): 2750-1469P.txt file - cDNA_ID_3017261; gDNA_ID_2684120; Annot_ID_190928

SEQ ID NO: 29438 - DNA, 3000 bp, Unknown; identical to SEQ ID NO: 14456
  misc_feature (1)..( 3000): 2750-1469P.txt file - cDNA_ID_3017265; gDNA_ID_2684120; Annot_ID_190922

SEQ ID NO: 29439 - DNA, 3000 bp, Unknown; identical to SEQ ID NO: 14456
  misc_feature (1)..( 3000): 2750-1469P.txt file - cDNA_ID_3017265; gDNA_ID_2926250; Annot_ID_204344

SEQ ID NO: 29440 - DNA, 3003 bp, Unknown
  misc_feature (1)..( 3003): 2750-1469P.txt file - cDNA_ID_3017301; gDNA_ID_2684121; Annot_ID_190991
ttaattgatttataaatacataatatattgatgtgttcgtgtctgacggtgccacaaaacaataagaatataatatccaataactcgtgaataatgccgtaagcgtaaatgatgtaagttatcaaaccatacatcaacgtgacaacgtccatgggttcttataagttacaagttttgcatattcgacttttatttagttttctttctccacgtttaacgttttagaccacaaaaccaaattgatttttcttatagatttctgatattattgtgttttttttctttccttttgatgaaagaagttttggatgaacaaaagtgaaatgttttatgtctgtatatatatattgacccctaatttggtaatactactaggtatagccattcattttattgtatccaatgtcattaaggaatcttgaactaatttttttcccttttatatcgtaaacctttatgcactctcttttacaaatacgtgttattcacttatagtatttggcatttaatgaataacttcgacctataagcaaaagctattgaaacgtttctttggtgttagataattttggattcaaacatgtcccgtacctatcatgttttaataagtgcggatcagatccgaacgaaatatttagagtagttgagttgatatgaatgcatattattgcagtggtctagaagaaaatgggagtagattagtattgactaagagcctttagttaattgtttaatgctttgcatgcttcaattaagaaagcccattcagtttagacataacattatgtctacttggttttgtttaaacaattacttagtttgaaaacttcaaagttctttatgacatactccctccatttctatgtaaatattaaatgtatttaataatttttgatcaatcatataatacattatactccctctgttcctttttgtttgattgtttagaaaaaatacacatattaagaaaacatattaaatgttgattataaatgtattattttcagtgttttacaattttctatacctctaaaccaatgataattaactatttttcttgaaaaattacaattcaccaatactaaccaataaatattacatggaaaacttcaaaaatcaatcttttagaaacaaattttttttctaaacaatcaaacaaaaaggaatagagggagtagtttttattggttgcattcattctatttaatgatatttttataaaaaaagagaaaaattatatatttttttaatctgtttgtaacaactttaaacatcacttaaaaagaaacggaaggaatatatgagagttagtgagatttaggcatgtgcttgcttcatcattgggcttattaatttataaagtttaaatttatcaagcataatataatatgaagtcagctttgccgccacagttgatgcatggcctctaattattggagcattgtacgtgatataggtgttaatggagatggtttgtaggtctttatcaatacggaatctttatcttaccaagtcatttctaagtgttgcatctatgtataaactaatattggagacttcaacaaaaagtagtatatatatacatggtttgcacattgtgctatatatatgtttagatatataactcaaaaacacctttattgcttaacagtctttggtcggaggggggtttggtgaggaagacaatgaaaattattattattaagagaaaagggaatctttctggtttcaacacaaactaatctcccaaaaaaaataaaaaataaagctagcaatatttagaagacctaaaagagttaattagtgactttaatgtgaaactttttcataaaaaatgaatgcagcgatttgttggaggccaggattgcaaattgtttttaaacttcgaaagcaacaaagataaaacatcttagaaccctaaagtaaatccttgacgttagagaaacaagcttacttaaaatctaacttggagatgaaaataaagatttactgatttatgtaggaatacgaaaccctaatttcttgatttaaatcaaaatggaagataaatgtgcatcaaaactctgttttgtgtgtaagattcttcttacaggtttcatcttccatgggatataaaagaatttgtgaacgtcaatgtagcaaatgaattcacatcaagtagtatttccattgatgtctcaggacgtcctttcaatatctcatctcttactacatcaagaagattttctggaagctgcacaacaccattcaatatctgcataaccacactcatatccggtcttattgactcagattgatgtgaacacaacacacctagcttcaaaaccagctcaatctctcccctgttttgttcttgacgtatacattcctctgccgcatcgaaaatgttcccatttacccaaagctctaagatccaatccactagaacttcttcattttccgcttcacgtcgctcaatcaaccttctaccacaaacaacttcaagcataaccaacccaaaggcgaaaacatctgtgcttgtagttgctcttgttgaaagttaaacttgattttgaatcaagtttaattattggatcaattatccaataattaattatggccaaatccaagttctagagttttctctagaaatatcatcatttccacctccttaaaggattctagaaattttctagaatcatcttccacctccttaaacataaaaatctagatactctaatagaataatctagataatttgaataatgtaatctagatcttatgtaagaactctctagacttaagattaaaatattttagatattttgtagtttggaggctataaatacctcctccccctctcaaatgttgtaatgttgtgaagttgtattcaagtttaaagcaaagtaataaaagttctatttcctaaaaaactctctcaaaacacttaaacactttctccattacctctaaaagaattttactctaacaaagtggtatcagagcttgaagatcctaaagatg

SEQ ID NO: 29441 - DNA, 3003 bp, Unknown
  misc_feature (1)..( 3003): 2750-1469P.txt file - cDNA_ID_3017305; gDNA_ID_2926279; Annot_ID_143594
ttcccatcaagaactcatctttctcattcaacatcatcttcgggatcgtccctgaacataagcagcaaggttcacacggtatggctttcgttttctctcctacaagaggccttcccggagcttcccccgatcaatacctgggaatctttaacgagacaaacaacggtaaagcctcgaataacgttatagctatcgagttagatatacgaaaagacgaagagtttggagatattgatgataatcatgttgggattaacattaatggtttgacatctgttgcctctgcttctgctggttactatgatgatgaagatggaaacttcaaaaagctttctttgatcagcacaaaggtaatgaggctttccatcgtttatagtcacaccgataaacagctcaatgttactttattacctgctgaaatctctgttccgccacaaaaatcgctcttgtctttgaaccgagatctctcgccctattttttggaggagacgtacttgggtttcacggcatcgaccgggtcgatcggagcactctattatgtgatgcaattttcctatgaagaaggagttatatatccagcatgggaccttggcgtaatcccaacccttcctccatatccaaagaagtcgtatgatagaacacggaggattttagcggtctgcttaacgttggccgtgttcactgcattagtcgcttccggaataggttttgtcttttatgtgaggcataagaaggttaaggaggttcttgaagaatgggagattcagaatggacctcataggttttcttataaggagcttttcaatgccacaaagggtttcaaagagaaacaacttcttgggaaaggaggctttggtcaagtctacaaaggaatgcttccgggttccgatgcagagatcgctgtaaaacggacttctcatgattcaagacaagggatgagcgaatttctagccgagatatcgaccattggtcgtctcagacatccaaatctagtcaggcttttgggatattgtaagcataaagagaatctctacttagtttatgactttatgcctaatggaagccttgacaggtgtctaacccgtagcaacacgaatgaaaatcaagaacggcttacttgggaacaacgtttcaagatcatcaaagacgttgcaactgctctactacacctgcatcaagaatgggtacaagtcatcgttcatcgagatataaaaccggctaatgttctactcgaccacggcatgaatgcgaggctcggggatttcggattggcgaagctgtatgatcagggatttgatcctcagacatctagagtagcgggaacattaggttatattgcacctgagctcttaagaacaggaagagcaaccacaagcacagatgtttacgcctttgggttggttatgcttgaagtcgtttgtggtagaagattgattgagagacgtgcagcagaaaatgaagcggttcttgttgattggattttagagctttgggaaagtgggaaacttttcgatgcagctgagggaagtattcgtcaagaacaaaacagaggagaaattgagcttgttttgaagctaggtctgttgtgtgcacatcacactgaattgattagaccgaacatgagtgcggttttgcagatcttgaatggcgtttcgcatcttcccaataatcttcttgatgttgttagggctgagagattgagaggaattcctgagacatcaatggaagtactacttggtcttgatctgaattcttttggtacaatgacgttgacgaattcttttgtgtcccatggacgctgaaaccataaaaataagttagttttgatcaaacatttatattccatcgggagcttctgtatccgtctatttgataaatgagtacatgtttctgtatctttgaatcatgaatgccttccaattcatccctaaatttctagggtttacttttagggttataatatgtttgtttcattcttgctttcaaagtaatcttgttcgaatttgtttataaaaccaaattttcaagagcaatgacttataacttaattaacttttttttttctgtagaccaatacaaaatctgttaaactttacattaaaacatgtcaaaaaacttattttttttacattttatggtcaacacgttggttgttaaacttacattgtttatccatttctacgctccgtaatgttcgacggattaggttgtagaaaagataagagaagcttttttgacctttttatttctttggtagagatctgagaagaaaagtttttttgattattgcttattatgctttccactataatcgctatttaatcttagcaggattagaagatttgttttcttataattgatttacgactttatcttggccatgcacagtgcgtaattactaaatagtgaacatgtgttttttctctcttaagtttgcttacttatcttagttcgttggccgcatataacatgaatattcattagataaataattaacagcaataggtaaacagcaacaataacaatagtttaagtcctaagactaatcaacacattaatggaacgataagaagagattcaagagaataattaacaataatgttttgtaaaaagaagaaaaaaaatacaaaaagcaaataggatgtcataatctcataaccaatatagcaaaatttcagtagtaaaataggtttgcaaacctaacatgggtccgcttctacactctgacaatcccacaataattgctattattaattgaaaaatgatcagaagattatttgtttattgtgttgcggtttgatcatctaggccatgtgggtaattaaatacaaactacatatgtttatgacatgaccagtttcgttcacattatattggcttgatcatattcatacagttttacttatttttatgttgtatcttcttacataattcttctgataaatatcacattacgatcaaaaccttcccataagccaaaaaaaaaaaacgaacaagaacatg

SEQ ID NO: 29442 - DNA, 3003 bp, Unknown
  misc_feature (1)..( 3003): 2750-1469P.txt file - cDNA_ID_3017315; gDNA_ID_2684121; Annot_ID_190987
aatttgtgtatccagatttctgtaactatataccattaacaaaaatctacaaacagatccgatatttaaaagttataaagatataatactttattcgaaagaaaaaaaaaaagttctaatacttatgttcaataattatatcatgatatcttggagatatagacttcgttgtggttcctttttcccaactagttaagtatattttttttgctaaacttggtaaatattataaaatgaaagttaaggtatgacataagcattacctagagctagggagagtcaccttggtaaaaaagaaaattaaaataaacaaggctacaataaatttacacttgtgaaaaattgctaactaagtaatttaagtgactaaatgtagaagaaaataatcatagttaatagaggacgtgaccatatttctcacgaatgcattcaaatgtacggaatgcactaaacaaaatgatgcttgcatgattacatatttacatctattgtcaggataaatatttgttaattgtatttatttattatatttttaattacgaatgtacaaactttttagtatatgtttcaacaattcaatggttttttgttgttgtttaaatcgtagtacattcaaaagtcaacaataaaatttaaagtgtattattgacgttctgctatattacaattacaaaaccacaccttttctttttgttgaagttatatttgaactcgtcatatggctgctgactgctgaatttttctatttccaccagttaattcatatgtcccatgtatctgtagttgatcgtataaaaagacacacgcacgcgactgaggtggcgtgtcagcagtatatgaagaagaaggaatgttgggaaggagacttgtcagttgtcactttgggttaattgttttattttttcaatcttcttgcttgaattgtattccaagctcatatcatttcattatttttcttacttcctttctaacatccacaccgtgatttctcttctttatattactgataaaactctaaaatatcaattacacttttatatgaaaacatcaatgtcaagctggttgagttttagttttgtaaatatatgtttagtactcatctttgggctaccagataatgacacaacttttcaatcctaattagtataactctattttcaaaaatttaaatagtacttaaaacaattataccccgcttaaacagaatttaactctattttcataaaaaattagaatttaattccagtacatatttcaaatatagttgatcactagttaacattttacataataatcttttacgtattttgaagatgtataatttcagcaggtttgaagtctttcactcataaaccctacttttcttttaaaaagtattatttcttaaatgcataattagttatgcgttaaaatactaaatttaaaattctggtactattattttaaaattttcgtaagtaaagcttgtgaatataaccgttgtcgagtgaaaataatttgatttttttaatgaaaaaaaaaaaaaaaaaaaaaaaagagggggacaaaattttgacttaactgacataagagatctagaaggtgaaaccacgcgcgtgtggtagtcagaaacgaccaaagaatcaacctcgtccttgataataaaattcttgagattggtcacaccaaaacaaaaaaaaaacgttttatcattgcttcttcaatagtatcaactgacgtaatcatgataagtctacgacaatatccctccaccaaacctaaccgttttggttcaacatttaacaattatgatgagtttaatttttttattggagactgttaccactcttagctttcattatctataacctaagtctggttaattcatgattatgtcaacagtttctttggtcgaattttgatatcgagtttggtttctaggttttagtttccttaaatgtttgtctttacaatgaagtaaagttaaaacaacattgagtgagaaagtggccaactaattctctctgtaccatcaatccaaaattaaattgatttgatttgattaatcaaaaaggtggtcagagaaaaacaaaagaaaaaaaggttttaaatttcttcccgtaccagctagacccagaatcaaagtagcatacttttgctacatattcaaagtaatttaacccccaaaaaccaaaaagaatgtgttagaaaagcaacaagaagaagaagaaagcaaattaatagacaaataatctttcttctctggttgcttctttttatttctttctctggaacagcttttctctgttactttacttctttgagaaactccataatcaaagaggtaagtgattcatgttgcttgtgattatcccaatggttttgttcttttaggttttcggaaataaataattattcttaattaccgagttgtgtataatttgtttttgttagtttctctgatctatcccttgtctaagttatcttttagggtagtttgttttcagggaacaatttttatcagtataatatagggaaaattttccaaacaaaatcgataataatactaatatctgcataaatacaattctagccagtatgtgttatgatcagtttacctaattgggttagaaagatggagttcgatttaagatatcttaaaagttcaaaaaaaaactttcctttttcatgaaaagctcaacaacttcaaaatctttgttttctggctgtttcctcttgtcttcgattgttcttgttctttggatttttttgttttaactttttttttgtctgaaactgctgtttcaatttggaatatgttgcaggagtttttgaggttgaagctgttcctccttggtaaaacagagcaattatgctaacttgcgccgtcttttcaaatcttgaccatcatcaaaatcatcagtaagctataaccatctgtttataaccatttgcttgaatcaagaaaaaaagtttatcttctgtttcttgttatgaacagttgaaaggaatgttcaagaaatg

SEQ ID NO: 29443 - DNA, 3003 bp, Unknown
  misc_feature (1)..( 3003): 2750-1469P.txt file - cDNA_ID_3017325; gDNA_ID_2684121; Annot_ID_190984
ccctctgcctcatattcccatgagagtctaaacaactttaaggtgaaataagtttcctaaagcagtaaatgatatttaaccttagcaggaagttcatctgtgggaaaattgaactcttcaccccacattggatttctcgagccagggaccatagaactgtaacaagcacagagctactacattaacattagaccatcaaatgtgtaagcactcaacaaccaaaccaccaattatatgttttcactttttttagatggatagaggttgttgttggtaagaagctaaaagacagcggaaaagagcaggaaagaaacatgacatcgaaaaagttgctcacatgttcctttgaaaagttataacactaattgaaaaggatatgtaacaacctgaatcgcttttctgatccacaattaacaatagcataaggatctgatgttccatttaagttagcaccaattagattcttagcagccaagagttccacctggaagaagatcctcacattgatgcaatgttagtatcctatctatgcacagatgaatcataagaatcaggagaagcatttaccttgactatataagcagcattagtttgagtgtctcctctcaagtgtcctatctacaaaaataagtgcagaaactgcaagtcaaaaaatttggaaaattacccaattagagaaggggaaagctaaaattcattaagaacccacgagatttctccggctaagtaaactgagaaaccgatcaatttagagaaatgaagaagatgatataaaaaccttgtctttgtcaaaggcgtcaccggaatcgagattctgcatgagacgagaccgatcaaatccaacaccgacgacatcgtcatctccgcctcctctgtaagcgaatagccaataggaagcgattaaaaacacagaagcgaccaccgcgacctcaatctcccacgccgacggtaatagaacttccaccgctgactgtaccatctcgatcaacggagttaaaaagtttaaatttttcgaaacgaaaagcgcgatcaagaggattgtctagggatttatcctatggaggatcacaacacagagaatcaacattattctggagagaagaaacttcgccttctttagaagaagaacaagtgagtcaaaaaaggacaatcgctgagaaagaaaggattttggaaagaaaagtagaaactgagaaattagttgtaaggacggagttacggaaatacccttggaactgtaaacagttactggctgtgggactcgaggactgtgaggagaattcgagggtagttctggtaattaagaaacttcgaacgtaaatagtaaccgtagaaaagtcgtacgaagactttttataaactgaaaaatgaaaaatcttgtcgtgatgtatattaaccaaattttcttactggttgaataaaaagggaggccaaaaacaaaaatcgaactagtcaaattgaaccaaaccacactaattacgttaagtttggtttaaaatttcaataaaaactggtatatgactcaaatccgtgaatcaaattagagtttcttacttttctattgactcaatggtttttatttgttttacttagaacaaatttgtaaaactatattaaaaaacattaaacaaaagaaacaagtgtaaatatataccttagatcatttaattaaaagctctatttatagaaatgtatattcatattattttttttgcatatctaattaacaattaaaaaatccaaggatacaatagatttgatttctaaaacctagtaaaccggataatgatccataataagattaattcagttaatttatcggttcggtcttaataaagtggttttaattgtagaaaaggcgaatggaaagaggccacgtggaaaacaaaggagacagatagagagggaaggacccgttttaggttttttgattgaggtataaatagatttcgatcagtagacgtttttttaagttgcctttacacattctcttttgctcctcctccttctctcttactctcttctcgccgcaaaacctcacttgctctctctttctctctggtatatctcattatctctctatcttctgtgttgttgtatatatgtatagctctaacttcgattctttacgagctcaatttctttgtttagatggttccaaatgttttacctttttactttttttaatacctttttgtctttgttgctgccatgtgagctcaagctctgttcttgttagtgggttaaattcctttcttttatggatattctgattctttgagcataattgttgagaattgaagtcagttttgtctcggttactcaaaagtttcgagctttgtatattgctagtgatagaggcagcttcaaatccgaacaataggaatacttagagtggactttgattgtggtgcccctgagatttactctgtttatttggttgcaaatattgtacctttgcttttacctgccatgtgagctccaactccgttctttgtcgtttgctagcttcccttttttaaatagttttcagattccttgagtataattgttctgaattgaagtagggtttttcttggctgctcaaactttgtagattgctactttgctagtgatagaggcaacttcaaatccgaacaaaaaagatacttagattgtgcttctcctgagattactttaaagattttactttggctatgaacaaaagcctatagctttgtcttttatagtctaatttaagtaatgaaatcccagattcttagttaatttagagaggaaaatgggtagtttgaaaggaaagtgatgagatttcaagaattctactaagattttatattgcttgatgcattctactttcaacctgaatgttagtagcagaggtactgacagtcttttatccgcaggatctttatcggggagcattacccgcgttttaacttacggtttccaatgtgaactaagagtgtgttatcagttgtgatgactgtggctgaaccacacatg

SEQ ID NO: 29444 - DNA, 3000 bp, Unknown; identical to SEQ ID NO: 14474
  misc_feature (1)..( 3000): 2750-1469P.txt file - cDNA_ID_3017331; gDNA_ID_2684121; Annot_ID_190982

SEQ ID NO: 29445 - DNA, 3003 bp, Unknown
  misc_feature (1)..( 3003): 2750-1469P.txt file - cDNA_ID_3017335; gDNA_ID_2684121; Annot_ID_190981
gtataacgagtactggctaaagattaagcgatcatcaacaagtctacctggtctggtaacccgggcaaatacaaacgcatcttgagatcttatgttgattcaaatgaaatgaagatagtgatcggttttcttactggtttaagtagtttcccttagacccttacccgtgtttttgtttttgtttaagttacttttgccagtagtaaatattgatgctcatcgtcacaagtattgactctgtcgtgtttacgtaaatgaaaagttaccctgaatggctgaatcatattatatagaaaaagtaatcgaaatcgataacaagagcagagcatgtaaagaagaataccgaggagatgacataaggtgttagttagggaaccggaatgagagtttggaagtaagaagaagcaacaacacgagcgtatgcagacttgtctatatcaccaaggctactggaggatgagtgtgacttaagatacgacaatgcaacttctagcatcacttccacttctttaaagaaagtgtcaaaaacaaatgcatcagacaaaccgaaaaatgacggccttttagtttatcgattgaactaagggcaccaaactaacctcgtcaattgcccctgctttaatcttcgattgcatcaaacaccatttcttgaaatgtacacctattgaggaagccaaagagatcattccacactatgtgctttgcaaaatttcacacggaaaagtagaaatcattactttggtttacttaccgactcttatatctataacagatgaaattatctgggaggagatcaaatatcgtttgcagaggccctggcttttgatgtacaatggttgggccttactgagccaatgacccctagatatcttttcagagacctacctcatgattccagctctgcgtcttcctttgaaagtcaaactacttttgtggtaatagcagccagtagtaaatgtaaaccaaggccaaatagacaaacttttttcgtaacttttttgtattgatattaaaaatattctgagatattacagactccagaaacatttcccgtatctcgagtccgacttaacacatatagtaacacctttacttaaactaactggtaaaatggatctttaaaagtgttccactggttttcccactgcagctttgcgaccatctgctcaaataaaaggatccattttaggatctacacaaattaaataattaactggtgtagatcctatatagtttgagcatatactttgaatcttaacaaattgtttcagatccaatttgtaaaagcttgcaagagcacatatccacttagaaatcgacaagcatctatgtatctacatcacataaagcatttgttggaaacatttacaccaccaaagagtgttccaacaaataatgtcctacgactaacctcaaacaacgttttttttgcttgaacaatgctgaattttctgcagtagattctggttttctcgcagatcttcacgcgaaaatcaaacatccttcgatactaaacttcaacatttgaaactagtagcatctcttctggtactctgacgagggagcagacactatgggaatgtaagggcagttccaacctcccagacatattttaataccaaatgaactaagattagaaagggtaagagatgcgtgtacataccagttattactataatagttagtttttataatttcaaaactaaagaatgtaaaaaataagttaaattttttaaaatataaaaatttaaattaaaaccagaaaaatcttattaagaacaattaagtaaaggaacttttttttgtcttatcaattaaaaaatattaacttcttattttcatagaaaaaaaattattacaattaaacccaatacacatgactatatgagttttataagaaagtaatatgaaaaacaattgagtatataactttttagtctaacttttgcacggtaatttttaaattcaaaatcaaaattttaataaatatttaatcaaataaaaattaatatttttaattgataatataagaaacaaactaactattgattaaaaatatttagtaaattaaaaaaattaacttcttaagaaactaactattaatattatgaatagttcatatcttaaaattgtttattctttgcacacaaaaaaaaatgtttattctcttaatttagttttgaaattgaaaaaagctaactattataataattatctagacgaaaaaattgtttaaaaacaatacagtttttagattttctatgcaatattattaattactattgataaactgtaaacttgaagaaaaaataattgactatcattggtttagaattgtagaaaaactgtaaatcacaaaagcatcatatacatttataattaacttttaatatattttttgtatatgtgtgaaaactctaaaagatcgattatttacacaaagagtaaatttaaacataaataaaactgaataattaatattaccccacatgtttataaaaacaataataataaaatactacatcacaagattgttttgtatgtagactctaaaacaaaataaaaattaatttaaaaatattcgggttacgccaggtatattttttaaattttatcaattaaaatataatttaataaatataaaatttatggtttaacataaaaattatttgaaataattaatatgaacttgaattagggttttattttttgagtgacgttaattattaaagaaagaaacaggaatatcataaaaatagtttctagtaacctttaaaaaacgttgtaattcagaaaaacgtgaaaccaaacgggctacaaaatatattaaaacacagagtacaacaggcttttggtttgagcccaaacaagcccatttaaatctatttagtctgtaacataagtcacgtgcacctatcacgtgatcatcttctttcttccttttttcttgtcatctgttacacatcggttagggttttagtttctcttaccgagattcaaatg

SEQ ID NO: 29446 - DNA, 480 bp, Unknown; identical to SEQ ID NO: 122
  misc_feature (1)..( 480): 2750-1469P.txt file - cDNA_ID_3017335; gDNA_ID_2862; Annot_ID_145993

SEQ ID NO: 29447 - DNA, 3000 bp, Unknown; identical to SEQ ID NO: 14477
  misc_feature (1)..( 3000): 2750-1469P.txt file - cDNA_ID_3017338; gDNA_ID_2684121; Annot_ID_190979

SEQ ID NO: 29448 - DNA, 3000 bp, Unknown; identical to SEQ ID NO: 14470
  misc_feature (1)..( 3000): 2750-1469P.txt file - cDNA_ID_3017359; gDNA_ID_2684121; Annot_ID_190973

SEQ ID NO: 29449 - DNA, 3003 bp, Unknown
  misc_feature (1)..( 3003): 2750-1469P.txt file - cDNA_ID_3017363; gDNA_ID_2684121; Annot_ID_190972
gatttcataaagagacaggaaatttgtatattgcagacgcttactatggtctacttgtggttggtcctgaaggagggattgctacgcctttagctactcatgtggaaggaaagcctatactctttgccaatgaccttgacatccatagaaatggctccatcttcttcactgacaccagcaaaagatatgacagagcgtaagacaactctcttattcttgctttgtatgtcaattcctaccgtaaattgtatgatatagaaattatacttgtattttgtaggaatcatttctttatattactggaaggagaatcaacaggaaggcttctaagatatgacccacctaccaaaacaacacacattgtgctggagggtttggcttttcccaatggaattcaactctctaaagaccaatctttcctcctcttcaccgaaacaaccaattgcaggtatgaccctcaactttgtgtttatatagctgtatctatcattcatttctcttcatcattatgtgtatgacagattggtgaagtactggctggagggtccaaagatgggtgaagtcgaggtggtggcagatctcccgggattcccagacaatgtaagaataaatgaagagggtcagttttgggttgcaattgattgttgcagaacaccggcacaagaggttcttacaaacaacccttggataagaagcatctactttcggttgccaataccgatgaagctgcttgcgaaaacgatggggatgagaatgtacactgtgatatcgagattcgacgaggaaggtaaagtcctggaggtgctcgaggatagacaagggaaggtaatgaagctttggattggaacagtggctcataaccacattgccactctaccttatcctttgacaatgaatcaatgaaggactttgttgtgtagttcctgaactaaatcatctctctgtaacttaattatcttcgttttgattcaagttcctttggaccggtttgtcttttgttgatattatgtgtgaccttagattcctcatgaaattctctttctttctttcttgagtctctttttttttttgtttggttcacgtcctatggaaggcttcataacttgagccatcgcccagtcttcttcgactcccgcgaaatagaaaacaagagtatgcaatgaagaattgccttggaaaacaagagtatgcaatagagaaagtctcgaaagtgttggaaggttgaagataaagagaatacagagaggtaacggaaaaataacgactgctttttctccaaaatgatgacgttacaatcatctccattacgacgttttactcttttttcagtaactttttctgtagtttgtttggcatcacatagcaatgaacattttatgaaatctgtggtgtctgctttcttctcaaagcacaactatccaaaactccaaactgttggggccatatatattactaaccaagttgatagcaaaaaaaaatacaaatccaactcataatttagtcttgaagttataagaaagaaactcaacggaagtctgaatcatagtcattcaaaagacagcagaaagggaaaaaacaaaatcatctaagacaagggtatataaaaccatgatagatcctgatttcataagatcttcaaaggtcttgcacactcaaacctgaaataaacaattggcaaattcaacttagatagagatagacgcatgcgttcatggaccaaccaaaaataacttgtgacctaaacatgccaattaaaagtgtctgaattaaagtagattaaccacaagactattcgaattcaaaaaccaaaatccaacaatattatgacactagaactttcaagtgatgaattactcaaagctaggaacatctatccaatctaacaaatgttatgagataagaggtttcaagtgtgtaatgtttgggctgagtcacagagagagagagagagagatagtgaacctggaggaagagactgcttcaacttatcggccttctcttggtcgaagacacatagtgtgtagaggtaccttgagcacctgaccttgaacttcacaatgtccttgcttctcttgatcttcacagaccttgcatccttccttctcgccgtcaaaaggaagtccttgatctcatggatttgcttcggctgcagattatccaaaccaacatccattttcaatcaatacaaaacaaaacagaacacacaacaagacttcgacccaaatgttactgcatgatgaacacttcatacatttcaagatgaaacttaaaccaatgggtcaattacgaggaagactctaatctactagattatcagtaaccaaacaagaaacccacaataagagattgattactttcagctcaatcatgcaaactttactaaaatcctagtcgtgagaacagataatcaaacaaataatatttagcttcaataatcctcctgagaataataaaactgagaggcgaagaaaactttaccattgtcggatctgatttagtggctgcaactttcttccactcaagagaacaaacagcaaaagcaagaacccagcgtctgaaagaaatagagaaacctaaatatgaagaaaaccctagactctcatatacgcgaatttccaaatgtaccccttaggcccattaatccgaaaagttggccattgggtttagtggcccaagttgttttgtttggcaaatttcaaaaaactcggatccaataagaaaagggtatttaagtcattgcgtctatttgcctatgatttcaacattagcgccacaaaatgttttttcccgctccactaaaaaaacacttcttcctctctccaaaagcacacaaaaccctaccgcttcgtctctctctctttcgctctgcagtttcctattcaaaattgattggtttctctaaataatgtaacaccttcgattcgataatccttctctctcaaatcaacttcagtatctccatctctgcttctttagggctccttgttcgaaggaattaaaatg

SEQ ID NO: 29450 - DNA, 3000 bp, Unknown; identical to SEQ ID NO: 14468
  misc_feature (1)..( 3000): 2750-1469P.txt file - cDNA_ID_3017391; gDNA_ID_2684121; Annot_ID_190963

SEQ ID NO: 29451 - DNA, 3000 bp, Unknown; identical to SEQ ID NO: 14483
  misc_feature (1)..( 3000): 2750-1469P.txt file - cDNA_ID_3017401; gDNA_ID_2684122; Annot_ID_191011

SEQ ID NO: 29452 - DNA, 3000 bp, Unknown; identical to SEQ ID NO: 14482
  misc_feature (1)..( 3000): 2750-1469P.txt file - cDNA_ID_3017409; gDNA_ID_2684122; Annot_ID_191009

SEQ ID NO: 29453 - DNA, 3000 bp, Unknown; identical to SEQ ID NO: 14481
  misc_feature (1)..( 3000): 2750-1469P.txt file - cDNA_ID_3017419; gDNA_ID_2684122; Annot_ID_191006

SEQ ID NO: 29454 - DNA, 3003 bp, Unknown
  misc_feature (1)..( 3003): 2750-1469P.txt file - cDNA_ID_3017437; gDNA_ID_2684122; Annot_ID_191021
ggatgttactatatatattggtaattcttggcgtttgttagtttccaaaccaaacattaataaataaataaataaaagagttgaggttagatttagtctgtaaatgttcgaaatattacgtaagagtttgactgtaacaaaatattatagtctatatgtatatactagttacgattaaaacataactattaaaaaattgcaaaagtttgtacttggtaatatgattacttatacggttataccattaaacatttctcttgaaaccgcttcaaaacagtgccatataaacttaagcagcacctattttagtatatcttaaaattaattcttaaaaacataattcgtgttggtaaatattaataactgaacaagtttctggatattctaaaaagtataagccattatgaacagttttgggcttgggccatgttagaaaagccactcaaaaatatcatatactaattcgtcagctaaaacaagaaatttcatacgcagaaatttgtgttgaaaataccatagttcaaatgtttaataaaaatatgtaaaattagtttgattgttttgactttttcgcgtctaattagtttgattgatttgattgcttctgttcccagtacatgcaatatagtgatatattagaggtaaaacatccgtgttgacaacagattaaaaaaaaaaaagtaagacagtgcatagttcaatttctagtagttgttctcatcttgtttttggcaactggacgtgtcataaaatttgtttcttaaacatgaattgtattttcgtagggaaattaattcaacgtttagtgaaaagaatcaaaatcaatccagaactagtataatacatttttctaaaactattatgatttttttataaaaaacatttttttaatagcataaagtttttggccaaagcccataatccttttagatctgaaatcatagcatgtaatattagttttgtcccaaacgttaaaccggtgacctttaaactttgcttaagatcttttaccaattgagctaataatactcgattaaaaagatattttttgactttctcacgaaggatatttttccttttcatataaatgataagttcttttgtattaatctttttgtttcctgcattatttttttcgttttcgttgttagacattgtttcgttcttgaaaatgatagtaggtaacaaatgaaaaaaataaaaaatacaccttttctcctaatttcttatatgttttattaaattttattattaaatcataaatatagaaatgtataatttactaaaagggagggacaagacaaaaaaaagaagaagaagaatatataagcccatctccttgtgttggaaaattagttgctcctttacaatatacaatttcttaataggaaaacatgtcactgccagttgattgttctcatctctttttttccttagtggaatccgataaggacaattgctcatatctgtttttttttttttaattgaagatgtacattttctcttctctgattatcttccatacaaaatctgcactcagtaaaaagaaattatgtattgctgttttaataccactagatgatcacccgtactacgccgcagtttttttggattattttatattatttaatttaaatttaatttttatttgtctaatcattcactcatacaataagcaattactttagtattaaaaatatttttttctaacaatattctcaacaatgcatcatacatataattcataaacaacatttatcttaaattaatttaacagagggtagtattggattctagaaacctaagaatatgatgataaagctccttacgtattcttcagcgtcagtgatttattctataaatatcataagagaatataaatatcaatttaagagaataacttactcaaatcattaagtaatctacgactattatacattcatactttgaatttggattacaaaaaaaaatcttcgagtatgagaaaactattaaaatagttttattgaaaaatcatataaaataaaaataaatttagtaatagtataattaaatatgtaaaataaaattaaataagaaatatatcattaacctataaattagaagttgaagagcttacattaattatttaatagacacatgtcaaatgctaaagtgatgatgtgtcaatcatatgaagagagttggccaactttcatatatatgattcttagtttcgtaccaattagtttctcaattcagtgcatgtgtagtcaaatgtccaaaagattgtttctaagcaattaaaatcttatcaaaacttcattgcccaaaatattacgaaagcttgtttctgtgtatgatatacccggtaaaattaaaatgatcattatacagaacaaatcagcatgattttcggataaagatgacacacatttgaaatcgtagccgtactacgcgaaatacatgcactcttcgttatgttaacactttaacagtgaacgtagccataatgttgaccacattcaacagtcaacacaaacattactttacacacaaatatatgattatatatacatatgtacatgtaagtgaatgtgagcaataatgacgggaatattcagagaagacgatggtgaatgttagcagtgatcacgggcacattcaaaactgactgtggacaaaaaaagctcctggccttaaatatgattgtgccaaaaatagtacaaaactaagaacccaaaatggaattcgagacctatataataatatatatgtatatagtctttccttggaaagaaatcttatgttattaagaaaaatactataagttatctctctatctagatatgatatatatgtccaaacatttccacgtagatgacgtatattaccgaggataatcctctatataaggaagagaagctcgagtaataaatctcatcactttgaaatctcaaaagacaccaagcaaaaaaacaaagacagacaaaaaaaaaagagagagagagagagagaaaaatg

SEQ ID NO: 29455 - DNA, 3003 bp, Unknown
  misc_feature (1)..( 3003): 2750-1469P.txt file - cDNA_ID_3017441; gDNA_ID_2684122; Annot_ID_191020
gccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcactttaaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaacaatgagaggtaaatttctaagtttactgttgctcattactttggcctgcattggagtttccgccaagaagcattccacaaggcctagattaagaagaaatgatttcccacaagatttcgtttttggatctgctacttctgcttatcaggtttagttcttattcttttgtccattggttcttttttgtatgtatgttaacatttttcgattttgcagtgtgaaggagctgcacatgaagatggtagaggtccaagtatctgggactccttctctgaaaaattcccaggtttttttcctaattagaaaccccaaaagctttagatctctataaagatttaagcctcaaaatgttggagtttggttcatatatgtgaatctggttttgtcttgtgttcataacaaaaatgggttgatgatgatgaaccttcttgatacttctttctttttcttggtattaaatttaaagataaatatttttgtcattttcattttcagaaaagataatggatggtagtaatgggtccattgcagatgattcttacaatctttacaaggtcttatttgctttcttcacccaaaaaagaaataaagtcaattatacatcaagcattacattttgcttcatgatttttttttggaaaatcaggaagatgtgaatttgctgcatcaaattggcttcgatgcttaccgattttcgatctcatggtcacggattttgcctcgtaagatatcgatattatcggattagatctttgtaacttgtaagcgttgttatatattcttgatgtaactcttctcaattgtttattaggtgggactctaaagggaggaatcaaccaggctggaattgaatattataacaacttgattaatcaacttatatctaaaggtaatgtttctctgtttctcagtctatttgattttaatgcacatagaggaaatcttggtgatgtttaggatattgccaaaacccttgtaatttttttttttttttcttgtaatgttgtaaatgtgtcaggagtgaagccatttgtcacactctttcactgggacttaccagatgcactcgaaaatgcttacggtggcctccttggagatgaatttgtgtaagttcattcataagatctctatatggtaagattacgacactgcgaagatttgttgttgatattttggtaatgaaacaggaacgatttccgagactatgcagaactttgtttccagaagtttggagatagagtgaagcagtggacgacactaaacgagccatatacaatggtacatgaaggttatataacaggtcaaaaggcacctggaagatgttccaatttctataaacctgattgcttaggtggcgatgcagccacggagccttacatcgtcggccataacctcctccttgctcatggagttgccgtaaaagtatatagagaaaagtaccaggtatgtttgttctatttttttatctagagtagaattgtttgtttgtgtttgaacttagatttgatgtgtactctttccaaatgatctcatagtaattttttatcatactaataaaatccttttgtttgtaaaataaaaatgtttacattgtcctttagagtcccttactctgtttttgctttaactctgttttactcttgtttccggtctgctctgttttcgctctgtttcttgtctgctctgtttttactctgcttaccatttgctctgttttactttatttccgctctactctagttctactatgctctgtttatgctctagtatgtttctttaccgtaacagtactgggattggcttgatcaatctcgtatcgaatcttaattttggttaccaaatcctcataaaaggtagactgttgtaaattgtgacaacattttcctcctaatatgatgtccataggcaactcagaaaggtgaaattggtattgccttaaacacagcatggcactacccttattcagattcatatgctgaccggttagctgcgactcgagcgactgccttcaccttcgactacttcatggagccaatcgtgtacggtagatatccaattgaaatggtcagccacgttaaagacggtcgtcttcctaccttcacaccagaagagtccgaaatgctcaaaggatcatatgatttcataggcgttaactattactcatctctttacgcaaaagacgtgccgtgtgcaactgaaaacatcaccatg

SEQ ID NO: 29456 - DNA, 3003 bp, Unknown
  misc_feature (1)..( 3003): 2750-1469P.txt file - cDNA_ID_3017444; gDNA_ID_2684122; Annot_ID_191018
gggtcacactaaacgaaccatgggtgtacagtattggtggctatgacacgggaagaaaagcccccggacgtgcctccaaatacatgaacgaagcagccgtggcaggagaatctggtctcgaggtttacactgttagtcacaatctacttctggctcacgccgaagctgttgaggtcttcaggaacaatcccaaagtacggaaaaggataattaatttcactttaacgagcatttttgtctttaaaaacatacttattgagatatacgacgtttattgtttggattacagtgtaaagatggcaagatcggtatcgctcattgtcccgtatggttcgagccttatgactcgaactgccctaaagacatagaagcatgcgaacgagctatggagtttatgtttggatggtgagtggttttatatcttaattaaaggttacatatttcaaaataaaactagtacatatgttttgttaagtttctaattatttttgtttgggtgctttctttaattaacaggcacatggatcctacggtgtatggagattaccctgcagtcatgaaaaaatcgatcggaaaaagattaccatcatttaccgcagcacaatccaagaagcttagaggatcttttgatttcgttggggtgaattattacagtgctttctacgtcaaaaatattgatgaagtgaatcatgacaagcccaattggagatcagacgcacgcatcgaatggagaagtaagtggagttgtatataatatttatatcattttagggtttcttggctccaagctttttgttactgttttcttgtctcacaagttttcaatttctattggtacagaagaaaacaacgcagggcaaacattaggtgtaagaggtggttcggaatgggactttctatatccacaaggccttagaaagtttctaaattatgccaagaataaatatgaaagcccgaaatttatgattaccgaaaacggtaataattttataagaagttctttaattagtcttactcaatttaatccgggatatagtttactaactcttgttttgttaaaattgttcaggacactgtgatatagattatgagaaaaagcctaaactttctaacttgatggatctccaaaggacagagtaccacaagaaacatctccaaagcatccaacaagccatccagtaagtgtctcttctaaacatctccattataagtttcttgtgggacaagaaactttactgtgttgaaaccatatactttgtttcatactgacgatgaaaattgttttggtcagggaggatggggttgtagttgaaggatactttgcgtggtcattactagacaattgtgaatggaacgccggttatggagttcgatatggactattctacgtcgattataacaatggactaaaacgtttcccgaaaatgtcggcgatgtggttcaaagaattcttgaagagagaagaagaaattgaagattcagaagaagaagagtacgtgttgaagtcaacaatgaacaagaagagattcttattagcaactggttcatcagcttcatgctttattcctaagatgtctgaatcttctaaagccctcgaactattattctaggtttaattttgttttccttattaaaatttgatttgtcaaaaaaaatttgatttgtcaaaaagcaaagcaaagtacttcaataaagaaggcttaatgcagggtgctttgcggctttaaactttcttccttttttggtctcctttgtacactatcagttgttgatttcaaaatttcaaatcaatcattaaaataagataatcgttcgttggtttataaaaagcatcacgcgccggagttagcacacacgatctacgcgcgattgatgcgcgtgggttaaaaagtagaagagtgtcccgatgataacgtgtgggctcaaaatcatttatttggactttgacggacccaatcccatagcccataaacccgtgatggagtattgtcattcaattaaaaacattaatatgtagtaactatgggcgtatgctttactttttaaaatgggcctatgctataattgaatgacaaggattaaacaactaataaaagtgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcactttaaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaacaatg

SEQ ID NO: 29457 - DNA, 3003 bp, Unknown
  misc_feature (1)..( 3003): 2750-1469P.txt file - cDNA_ID_3017460; gDNA_ID_2684122; Annot_ID_191014
gattagtggccgctttttttttggataattaattaatctttttttttgggtcaaacaattttggatttttgatccaaggaatcaaaacatcaaaacaaaaagctttgcacgtgtacagatgagtcacatatcacgtccgacgagtatctgtcgtgtttattaagttattagtatagggcacacggaatttgtttttctttttgtcggtttatctaatctcttaattccgaaacaaatgtaatttttttactattaacgatgtttaccatagacaataaataattacatttcacatatgctccgtgaaaattactaagacgaatttcacatatgtagtgaaagattgttttaaaatatatgtacaactccaagaaaccctatctccataagccatgtaacaaattattattattattattttggtaaaggacattttaacaaattcgtaaataaaacaaagtcaaattcacctccaaaggttaagtcgacgacctatattatatagtcaaccacatatattaaataaaacatcgctcacgccatctactcatatgtatgtttttacttaattatatagctaattgattatatgatatatcatcagttggaaaattaaaaaccattttattccgatagcgtaaaagaaacagatcattctttttgtttaaattacaatttatttaactcaagttgttgaaaagtgtgtaatggaaggcaggtccatagctatttcgtcttatatttttaactattttcattttgtttgtctttaagaaatagtattttattaatgtttttttacaaaccaacaataaaactgtatattcacattttgttttttttgtgtatatatatagagacatataatccacaacatatgcatatcatttcccaaaacaatacaagaaacctgaaatccaaaaaagaaaaacccaaaatcttcgcttcttcatcttctttttacgtttatatggtgagaaattctatgaaggctgagtacgatatagatcatcttcctcatcaaaccttttatggtgattattcaaaaactttggttcccatgaacaagaactcccaaataataaccaagatcaagcctaagatccgtatcatccatatatttgctcccgagatcatcaacaccgatgtcaagaacttccgcacactcgtccaaagtctaaccgggaaaccggagatcaccaaaaccggttctaagaaaaagataaccaacacaaattttcctgcgccaccgggtttgcctcaagattccggccaagaacatacggctgaactggacaacagaataatagggagccacgtggtgaaggaagaatggggatcaagttcaaacacaaatacttactttgattttgacggtttgatcgatcttgatgaagacgacaacatattctcaagtcgatggtttgatcttcaacaacaataattagtttggtcacaccttaccctaatatgtagggtttctactaatcgtaagtcctgttggttttgatgatgatttgatcatttattcgatatggagcataacaagacatgggtcaagacaagaccaaggttgagacgatgatcatctatataggtaggaacatacataacttgtatatatgtacaaatgtttggattttttgggcttgggtgccctttgatttaatttgttagactgacttaatttaccaagaaagagtgtagtgatgagtttgtagactgattttgccaagaaaaagtaagtttgtgttttgatctccgatcatgtgaaaactctacttaaaaatggtgtaacgttgtactcacgcgtgcgtgtgcaagttttatatatagaaaagcgagaatgatattgtgattgaattttttagattgttcattttttttcgtcaaattattttgtttgttaattcatatataagtcatgttacttacaacaaattgtttgataaaacaaaaatgaattccattaaactgaattaacgaaatactataatgataaatgattcttacatgactctaaaagagtttcgatttgaatatataaatgaataaagttctgttttattggcgatgttcttgatatataccttcaaaactttatggctaaattacattttaacttctcaaaacgttagattatgaaaggtggactcacatttcataaacattaaaatgatatggtaatatgattataatgagttgtaatggatatatgtcatatttttccaatctcattcattgaaatatcagtttattttttggatgacataacgatcaatagtgtcatataatatgatatccaatgttttaatattaactagctatagctatatccatcattgttaatagttgtgttacatcattaaatagtatttcaaaagaatataaaaatttctgataactaatggagaatgaagaatatcaaaccgcccattcgaccaagaaattataataacgaagtttataactttttttttcaattgtgaaatgtcatttttactttatttatttccaacaaaataaaattatgttttatctaaacccttggactttaccaagaagctacttttttatttagcaacagcaaaagctacataccatttgttctttatttattaatgaccgtttttttaggcattagaatcgttacggctgcttcgaatcttgcgtctcacggaccgacggaactaaccaatctcaaccgaacccgaacataacctgttcgtttggttttctaaatggtaatcaattggttcattataccggtttggtaagaagaatccgtgtgtttggtttacatatgttgtaatttgacgcttgttcatcacgttgcagatatatctcaacatctctcaatttttctctctacgttgaagaaactttcgaatttcccgttagttcttctccacgctttctctttccctttatctcttatctggttaagccaatcttgattgtttggattcgtaaccgatcagtgttgtgaggtttgaaagaatg

SEQ ID NO: 29458 - DNA, 3000 bp, Unknown; identical to SEQ ID NO: 14495
  misc_feature (1)..( 3000): 2750-1469P.txt file - cDNA_ID_3017511; gDNA_ID_2684124; Annot_ID_191036

SEQ ID NO: 29459 - DNA, 3003 bp, Unknown
  misc_feature (1)..( 3003): 2750-1469P.txt file - cDNA_ID_3017649; gDNA_ID_2684226; Annot_ID_191999
ttaaaacccactcattgctagtacacatcaatccacaaacaggaacacaaactccaaacgagtaatctttagggacatccatatgattatcaacaactacaagatttgagttctggtctgaaatcagatactcgggggatgagaagaaagaccacttaccctcagcttgaaaagtgattaggagatgtggccgagccgaggacctcttcaggaacaggttggtgagatatggactgcggagaagagaattccaatcatttgacacgcaacggaacctcgcggccgatttcgcaggcaccctggagagtatttcgaccatgagatcagttggcaacgtacccgagttctctccatattcacccactgaagaagatatggttagggcaacattttccttggagactttcctcttccgttttttcatcatggcggacattgcacatgaaaaagaaatgaaacccttagagttctgagtaccgatagacaaacacaagacgaccttataaatgaaacccttacagatccactagacagacacgattttgccacctttcggattatgtctacctaccacattttttttttttatctttctccctttttctaaccttatctttttttctttaatttcctttttgtagcatccttattagataccattacatatatagataattttatctataatttttcttcttttccttctaaattcattgataccaatcgagattacaaagttattatacaaattatttatctataattaggtagtactttttaatgtatatatacatacatacactatactaattacccaatcataccgttgctttcacgcctttttgtatatttttaaaatgacttactaaaatattgagtgtgattatcttgaaaagatatcaaatttctatttaatcaaattgaataaattttgagttcaatttattatatgcataaaaaatatgaaaaggatatgactatgaggggatcatatagttttatgaaagtagatgaaagagaataacatacagtaaaagtaggttttagattagagaaagaaaagcaatggattaggtcgatgaaccgcgaccaccacggccaaatcgtagtacattgattctcttgatatttttgcgtaggcttgattggccttcctccttgggcttttagagaggagtcacccatctcaaaacaagtatcaccaaatcctgagtttaaggaagcaaaaatattgctttcaaaaacattaactagattttcatttgccaatgaacctcgttgggtaggaataaatagggtgtccacagatgaaggagtatcaaccatagaaagaagcctcagttggtgcagcatttgaaaaggctagtaaatttggcgtttattgacgccagtagagagagagaagctaagtatagtggcagatggcgttgctgggggggcatactcgtttgtccgtgatataacgtgcttaacaatttcattatggtctctacatttttgacgaatgaatgcctatcacctagggttttcttgtgttttaggaaacattcttcctcaaaataattctccgcatatcagatatatatcaacttaactgagaatagcgattagtgcaatagtttcaaattaaagaatgatgtcctacaagtaaacagcctattaatttctcagggacaaatctgtcagtaaacctcggaaacaggcgtttcggtatctaaatacaatccaaacttagtcatatgtagggtttactgtttaggtaagcgagcgaaattaaccgaaaaagtgttatagcccaacattgttgcattgattatagctcaaaactcatgataaaacctgtcccaagtgtttgccaaaaaaagacatgttccaagtaaaattactaggctttcctaagaataaaataaatctcaaaaaattgagtcgactaaacatcaattgccttcaaaagataggttaaatctattagtcaacaatccggatacaaaatcatcgtcactctctcccttcacgtcctcctaaagatgattcatcacaagaacaaattaaaccaagaaattagatatttatattgaatatcaacagtaattacaattatgaatttatgagtatagtatattaattagtaaaagggttcaaggagagaagaatacgataccttatttttctcttcagctactggggcagcttgagtggcacttccagatgaaagtgcagaagaaaaaacggccatgggagaagcagcagatccaccggcaccagcattcatgatgagatcatccatgtttttgttctggcggaagactaggccagtatgattcaatgttcaaattggctgttttcaccaatgttgacatctttctcagcctagtttacaagtaaacaaaatagtttgagtacatgttaattaaaacaaacaacctacaagttaattaaggctccagtaggattgatgtcaagattgagcctagaaagtacatacggtgacatggtcatggaggaggagagctgcgtaagtgcaagctagctcaccggtggccattgtaggctagctcgcgtcccacgaaagatctacaaaaccatcaatagagctcatcgattcataatctgaacttcaagtgaaacataaaaacaaaacgtgtagagtctctgaatcgaacctgtaaccaaacagaagattaggggttaacgtacgaggtcactatttatttcgatagagttattagggtttctagaggattattaatgtttcgaaatgggcacgtgaatatcatgtgcggcccagagaaaatttaggactggaatttcatggcctatatagataaccaaaattgttcttattaagcctcagaagcccaataaaaggcccaattggacaacgacaaagcagaacccgagtcgttaccacacacacagtcgtcactcaccacctcaccgttccttatccatttggctgacgcaaaatcgaatcggaaccctaaaatctctccgaaagccatg

SEQ ID NO: 29460 - DNA, 3003 bp, Unknown; identical to SEQ ID NO: 29459
  misc_feature (1)..( 3003): 2750-1469P.txt file - cDNA_ID_3017649; gDNA_ID_2684126; Annot_ID_191094

SEQ ID NO: 29461 - DNA, 3003 bp, Unknown; identical to SEQ ID NO: 29459
  misc_feature (1)..( 3003): 2750-1469P.txt file - cDNA_ID_3017649; gDNA_ID_2684126; Annot_ID_137187

SEQ ID NO: 29462 - DNA, 3003 bp, Unknown; identical to SEQ ID NO: 29459
  misc_feature (1)..( 3003): 2750-1469P.txt file - cDNA_ID_3017649; gDNA_ID_2684226; Annot_ID_137586

SEQ ID NO: 29463 - DNA, 3003 bp, Unknown
  misc_feature (1)..( 3003): 2750-1469P.txt file - cDNA_ID_3017665; gDNA_ID_2684126; Annot_ID_191116
ccagaggctagacttcacttgtgacgatgtcttggactctctcaaggaagacaacatcatcggtaaaggcggtgctgggattgtctacaaaggcactatgcctaaaggcgacctagtcgcggtcaaacgattggctacaatgtcccatggatcttcccacgatcacgggttcaacgccgagattcagacgctaggtagaatcagacacagacacatcgtgagactgctcggtttttgctccaaccacgaaacgaatctccttgtgtacgagtacatgcctaatggtagccttggagaggttcttcatggaaagaaaggaggtcatttacattggaacacacgttataagatagctcttgaagcagccaagggtctttgctatctccaccatgattgttccccgttgatcgtccatagagatgttaaatccaacaacatcctcctcgattccaacttcgaagctcatgtcgccgactttggtctcgccaagttcctccaagattccggtacttctgaatgtatgtccgcaattgccggctcctacggctacatagctccaggtaacaaatttgcagaaaatggcatttaatcaaacacttggtggtgaaatgtaaaatctctgaacttgtttgttccttgttgagcagagtacgcgtatacattgaaggtagatgagaagagcgatgtgtatagtttcggtgttgttcttctagaactcatcaccgggaaaaaacccgtcggagaatttggcgacggcgttgatattgttcaatgggtgagaagcatgacggattcaaataaagattgtgtgctcaaagtaatcgatcttagactctcttcagttccagttcacgaggtaacacacgtcttctacgttgcgttgctctgcgttgaagaacaagcggtggagaggccgacgatgcgtgaagtcgttcagattctcactgagatcccaaaaattcctctttcgaagcagcaagcggcggaatcagacgtgactgagaaagctccggcgattaatgaatcgtcgccggattcaggaagtccaccggatcttttaagtaattagactttccggcgattgggtttggtcattgaggggcaaatttgtctttctaattttcttgtcaccgacgtctcggtagtggagttaattacttaattagcccgttgttgtctggttccggttaaggcaacaattagtggtttaactcttaaggttgttgcatttcttttttcactgctgccacaattattcgtgtaggaattttgaatatgtacattgcggttgaattttgcatgataagtggttaatttcaggaaatcgaatttcgagaacattatggcttatgcatatcagcatatatatacatgcagttatgtatatgatcaatctgcccccggttcaagtatgtcaattgtgttagaccaaaaaacacttttgccccttatattcttaagaacttcatttagtttcatactcaagcaaaaactaattttttagagttttcgttgtcttaaaatgaaactagtgtctccattatgctggaatcttgcttatgagttgttacattacatattttattctcacctttgcttttacccttttggattgtatctggttgtggtagctgttgtgtcacaacaagacattccatgtgaaaaaaacacagagagggtgaaaccaaggtatgaatgtgtttgtgtgggactgaagatgagtaacgctgagaagagagaaagtgaaagctcactcacaatttgtccaattattgcaaatgtatgggtagtgtgacactagtgtcttaatgaattcagatggtcctaagatcttttttccactctattcccttgtcttgaagcaaaaatctaattttagacgaagcatttatgacatctccctctcattaattacaagccatatattcaactttgattttgactcatcaatatcaaaaaatctttagactttaggtgttgttgctatccttggtatctagtactttcttcgataaccatgactattatattgagataagaaagatataaagaacaataagaatattagttatgatattttagatgtattatgttcaaaatttcttacgttcgaatgtacattgatgatcttgtaaacctaattaaggagtgcctaactctagaattaataagtcaggagttagttatcaagaaactagaaagacttgaagatggattaaagtggtaattaatgtttttcagaggccaagattctaattaagagatgggaaatggcatgttccattctctagcttcatatatacacttatcgggtgaaactaccagattacgaatagccattagatgactaacaattgaattcaatttaaatcatccaaagatatattttatatattgagattctttcttcatctcaaacttctaagttctaacatagtcatgtagttgaactttcgggccgaggcccataacaactccatctacttaaacgaaggttagataaagggacgaacaaaaagaatcagtctggtgtcagaaactagagtatgtacttttgtgtttgaattgtaacgtttgtttctttcttcagctcttcattggtttatcgacacagtacttatgtcactccaattgtgagaaaatcattctgcacagtcgtttcgaaatcaaggaaatcaaacaagagcaacaacaatccaaagagtaccaaaatatatttggctatagagagctatcattgtcttgtacacttgtccatgttgggctatagatccatatttgtgttgggctaggctcagtttttcttaataacacaaacttacttatcaaacacgtgttgtctttttggttatttaagtagttgacaaacaaaagtacaaataagctgttagggcaaaggagcaaaaacgaaaccacagagagaaagcctccgtctcccttatcaaagaagaagaagacgtgtataacaaaacactagacacattgtgaagatagaaaaaaatg

SEQ ID NO: 29464 - DNA, 3000 bp, Unknown; identical to SEQ ID NO: 14522
  misc_feature (1)..( 3000): 2750-1469P.txt file - cDNA_ID_3017673; gDNA_ID_2684126; Annot_ID_191112

SEQ ID NO: 29465 - DNA, 3000 bp, Unknown; identical to SEQ ID NO: 14510
  misc_feature (1)..( 3000): 2750-1469P.txt file - cDNA_ID_3017681; gDNA_ID_2684126; Annot_ID_191109

SEQ ID NO: 29466 - DNA, 3000 bp, Unknown; identical to SEQ ID NO: 14525
  misc_feature (1)..( 3000): 2750-1469P.txt file - cDNA_ID_3017734; gDNA_ID_2684127; Annot_ID_191144

SEQ ID NO: 29467 - DNA, 3000 bp, Unknown; identical to SEQ ID NO: 14523
  misc_feature (1)..( 3000): 2750-1469P.txt file - cDNA_ID_3017791; gDNA_ID_2684127; Annot_ID_191128

SEQ ID NO: 29468 - DNA, 414 bp, Unknown
  misc_feature (1)..( 414): 2750-1469P.txt file - cDNA_ID_3017814; gDNA_ID_1621090; Annot_ID_55499
ttcagttttgttttaacactctttttttttttgtaactgaaaaatttgtgttttcttcttggttttcacacaagaattctagaagattgatagataaaatcaagaatgcttaattaacggtgacttttgacttttataaccttatagtctactgtgatttgaatttgtacatagaatggtcctctttatttacttatcaaaaaaaaaaaaaaaaatcaaaaaaggtgggccaaagaatgtttatttttcaaaattttgatttttaaggtggttccaaaatttggttcaaaattttcaaaacttattcagaaacttcctctgttcaaactcttgtcattttcctctataatatcattaaccccatctctcattatttattccagctagagagacttgcaataattgtaaaacatg

SEQ ID NO: 29469 - DNA, 3003 bp, Unknown
  misc_feature (1)..( 3003): 2750-1469P.txt file - cDNA_ID_3017819; gDNA_ID_2684129; Annot_ID_191169
ctaacccgttatcaagccatttcttaatggatgttctgtcaaatgtctgtcctgaagctactattaccggatccagcatgagttctgttgacaaaggacaccggaaatacgggggtatcgagatacctttagccacttcaagaaactcagttttaagcatgtgttcacggatgcacaagacgagttctatcaactgttcggtttgttccatatcttcttctgacttactggcctgggatcttatcctctctttctccacagtaatgctttcctttaagagatcttggtttgatatcaatccaagcatttgaattatgctttccagatgattgttatccaaagaggtaatatcatctttctgattccgtaaagcattctccatgagttccattaatgtcccctcttgcttaaaactctcagtctcctgcacgcagcgctgaaaccgttccaagagattagtacaagtggctgcatataagacacagagggctaaagaaatgaagaaattctagtttacctcaacactttgtacgcttgaagtaaccggacttgactgtgataactgaagaagtatgcgactaatctccaacgaacaagtctggacctttcccaacaaaacctcgcattgaaacacctgcacaacaacgatgtagtgaataatgctgaaagctgcagaaaaactgaaatggtagcttatatcatcaacttacaccaaacaacttgctcaactttggtgaccagtcctctaagaactcccgagcctggttaacaacagaatcaaggtcttcacatcctttatataaacagtcatcagaaggtatcttgcaatcaacaacttcatcgagcaacggtttcaagagcttcaacaagagaaccatatttccaatacatgtttgaataggattaaatcttatagtctggcacgcaaccagatgaagataccgagatatactgttaagaagacatcgaacaggaacaggatccatttaactatcaagctgaagaacacaaaaaacaaaacacacacatatcaacattataatctttcatgacttttaaaaagagtgttggttccttgatagtgttatcaattggattagtaaaaatattcagacttttctgtgtattatatggaaaaaaagaaaggaacacaaagttttctgatagaacagacatagaaaagcattgactttttgacttattagtctgagaagacagacatgactagattcagtcaattcttgtggaaaactgaagaaaaggaagtaaatttaaacagagacttgacttgagcacattctctcaacagatgtttctgctttctagtttcctttttcccttatatttgattaaactaatttatccagtctaataaagtgtggagaaaacaacagagttactctgaatctgataaacctatcaaatcgaaaaagaatctcaacaaagaaataagacagaacagtgaaaacccacaagtaaggaaccctaacttagtacaaagctaatgtcgaatttggaaaaagattgtaacaaaggaatgtaagaaggtggaggtacccgagaagattgaagtgatactgaggctggaagaagaaaaggattcgaggtatcaagggaacaaggcggcgatcattcgagcttgcaagaggaataatgaagagtttcctaaattatctaaagattggttctttgcttacacaaagagaagagagaagagagagagaaagagactgatgcaagaattcaggcaacgaaacagagcagaaaaaagggaaaaataataaaatagtaatggcgaggggccccaagttggtttttttgcagatatctctactgtttctgtaatgttggagttggtacatcttaaagctgtctcttttttctttctttttatgtttctgatgatatataatattaacacttaagtaattttactcatattgttgccttgacaaaggaataagttaagggttgaaatttgtgaattttaaaaatcattacttttgagattaggaattatgtcaaaggagaagaagattcattggtccttggagattataaggtacaatgattaactttgttatgttctagttttgggtaatatatatgggtttctatctacatcaatatttcagatttgcttttttctttttgtcaacatacagaattcagatttttgggatttccctatttttcctacggcaaataaagtcaaagaaatattaggccgtatgaaacaaattgatgggttaagcccaattgataggctaggcccgttattgttttgtaaagaactgaaatctaatctgtctatggtctttctcagtttagaacaacaaattcttgtttggagatatatgctaacttgtgttaatgtgttgttctcgttggggttacttgtttctccaatagacaatgattactcggtaatgattccactaattggtcagttattcaccgtacgatttaacaacttagcttttgaacctttggaaagcagagtttaaattctataattcgtataaacaataaaaatattgaaggacataacgaatagcagagtttaaaagttctaattatagaatttaaatccggaagacagaagcgccaatcatttaacctttcacaattagcaagcaatttttaaccaacaatgttaaaaatttataaccaaaacgaaacgtaacaacaatcgaaaaaataacaggacaaaataattatttgtttttctctcttgattgagagaaaaacaaaaaaaaaatttgaaaaataattttttctttgtaactgatctttccatacttttgattctctgtttcgcttcggcggaatcagagaatcgtttcaagttacaaattcgcaacaaaaacgtgttgtgatatcgagtatttattcgtttacggggaagaaacatttcaagtggtataagcatttcctgattgtttgaaactttgaatcgtttaataaatttaaaaataagaaaaaaggatttgtagagaaatg

SEQ ID NO: 29470 - DNA, 3000 bp, Unknown; identical to SEQ ID NO: 14535
  misc_feature (1)..( 3000): 2750-1469P.txt file - cDNA_ID_3017823; gDNA_ID_2684129; Annot_ID_191168

SEQ ID NO: 29471 - DNA, 3003 bp, Unknown
  misc_feature (1)..( 3003): 2750-1469P.txt file - cDNA_ID_3017827; gDNA_ID_2684129; Annot_ID_191167
cactacacccttcaatatgtctctattcatttctcttatgcattttctcttgatacgatcgcgactaccaatcccgcaaatgaaaaacttataataacatcaccacaattttttttgcactgtcatggcccatgcatgggtttcagcaatgttgttgattgacttgtcctacagtcctagccgagccaattggtgctttagacgtcaaaatctattacaactacatggacttcattttcttagaaaaatgttttgtggagcagtaatgagatcagcttgattaatgacttcatgagatcttaacccaaattttgaaatttttttttactgttttatacatatgtttataattgatccccaaaactgtatttttgctttaggacccaacaacaccaaatactgtataaactaaaatttagataaatttcagttattctttaacctagctccaattttggtaaattaaattgtcaaaccagataaaacaaatgtctggagtgtaaatagcaaacgaacaaaagaaacgtatggagttggacagttgttgttgaacctggggtctgatttagtaaagagcttaggctgggccaagtttgggcctaacagcaacactaaaaaaagatagattcacttgtttacgtcaactatgtttcgcaaattcacagagcgtattaaatttaaagaacgggataaaaaaaaaaaagagagagaaagaaataaaaaaaaattatatggagcttttgaagttgacttagacccaaaaagtttaagaaatttagcgacactataaaggcctaaaggaatcctatcctccaccttcataaagataaaagattagctaaaagcttcttcttttccatgatgcatgatcaaaagataatttaactagttcatgcaaaaatacggaaatacccattgttgatagaaacttatgtttcataaactaataaaacatttttaaaaataactgaccaaaatgaacattttgaatgctattatccataaagttgatgtcaaaaagatttggggaaaaaggtactccatctgttcctttttgtttgattgtttagaaaaaaaaattgtttcaaaaagattgattttttagattttcaatacaatagttattagttataattgataaattgtaaacttcaatacaaattagtaaatatcattaatttagtataagataagcttaataatgtcaaaaagatttaagaaagtaacaaactttttcctctcttttcctttcttttgattgcctttagtttgtgtcttgactcttgatttttccaagttggataataatgcaggcttcatgataacattcaatattcattgccgtttacattgtacacataaacataacataacacacacaaaagatgtctccatcacatgatagatcaaattgtacgtcacacagtgttgtttactttaattttgtaccaataattataaaagctgatatatactgtatttgattattttaactaattacattttgaaaataaaatttttagaaacgtacgtataagttaagagtatgattaaaaaacaatttttgttaaaatccttttttgtgtgttaaaatatttagaactttttttttaacacatatttagaactttcttaataatgaaatggatgtataaaacgatatatcgaatctagtattaatgtgtacataatataataacacaaatatacccgaatagagggttgaaaattgaagaacacgtcaaaatatagaagccatccgagattatcgagaataatgttgggaagatgttgctaatgacaaagtttgaccgttcgagctcgtcgagcccttcggttacgtcttccaagactttgtctagttgcatggcattttccgacattcctaaaaagtaaaaactcaaacactttgaaaaactccccaacggccgatgcttgtcttatcactttcgagccaatatttgaccattctttgttttgttttgcttagtttacaagattgattgaacacagtatacaaatgataatagcgtagaagtaacaaattgtaaagaaaaatactcaaatagcatgccatcaacgaaacaaacaaaagatcatctttaagaaagaaagaaaataaaaggaaaggaaagaagattgactttttaaattttaaacttctgagggttatgacatatgccggaagaaggtgataaagtgcaccgtgcatatcatcatctcaatgtagaaatcaaagtttacatatcaatttttttctccaagaaaatataaaatgtaatccattaatttggactcatgatgccactttctcataactagcagagctcatcattccttttcatcatttacttcccttcccaacttttcttcaccaaactatgattttgcagaagaaaactcgaaagtcattgttaattaataccatttttattttactgtagacaatatttcccttataactatttatagaaatactccaaaatactactagtgtattaaaaacagataaaattcaaaagcaaaattttaccaaaaaaaagaacttaaaaagcaaatagtatcattattgtttaacaataaagtttacatttccatagaaatttcaaaaaatcggatacccataattttcgaggtggactatcataatcaactctaattattttatttttctagcattgattagtgttcacaataatggcataaagcagacgcattaacttttgtaattggggttttacctttcgttttcactttaattattttaactaatcctttttacaagacccataaagaacaaaagtcaaaataatcgatagtctcaaaaagtcaagaatctctcacacactcattatgaacacgcaccaccaaacaacacttccattgatcctcataataatctccaccaatactcatttccctcttggattcttcaaactcctctctgaaagttctcatttttggtttacatttcctttgagtccactgttacttactaaaatg

SEQ ID NO: 29472 - DNA, 3000 bp, Unknown; identical to SEQ ID NO: 14536
  misc_feature (1)..( 3000): 2750-1469P.txt file - cDNA_ID_3017835; gDNA_ID_2684129; Annot_ID_191165

SEQ ID NO: 29473 - DNA, 3000 bp, Unknown; identical to SEQ ID NO: 14537
  misc_feature (1)..( 3000): 2750-1469P.txt file - cDNA_ID_3017851; gDNA_ID_2684129; Annot_ID_191161

SEQ ID NO: 29474 - DNA, 3003 bp, Unknown
  misc_feature (1)..( 3003): 2750-1469P.txt file - cDNA_ID_3017863; gDNA_ID_2684129; Annot_ID_191158
ttgtacatgcgtctattttattggcataatatctgagaactcgttggagatgtatttttggctgcagttgctcaagtacaatgtcatttgaccttaggaactaccaagaatcgtgattggttcaacaaccctcgggggattagggtttaggtaagtataagaaccctaactttgtaagtatagcaagtactgaatgatgtttgattgttaggtttgtaatttttgtgtcacaatgttaaaaggtatttcacagtggtaaggtgctttatttgcgatttgatttggcataggaccttataagttctgacactgtagagaacctatggaaccttttcttatgtgatactataagaaactcgtgattttagctgcatctgattgacgttttatgttttgataatagtttttggagacatgttgtcaaagtagaagtaaagacaaatgtttctttaattcgtcggactagaaatcaaatcttcaaaagccatttttgtcgtcccaatcgactttcaaaaaagctttaaattagaacgacacaacaatgaatgatttaacccacaaaaagcttgaatccaaaaggtttgacttttcagaatttagtcttaaaattccgtaatcctatatattaacggataagatccaacagagcttcagaatttgtccttaactcatattcttcttattttctatattataattcgagggttacgtgtcatatgcctactactgacatcacttgcgtcttccttttctcttgtcctctttcgtaatcattaaagtaagtaccttttaaaaaaaataaagaaaccaacggtgggagaggaagcagagagagagaaaataaaaaaaacagaaaacgagaaaaccagagattcatcaattcattgattctttagttcttcttcgtccgtctaaccttagaaacttatagctacagcgagagaagacgaagaagaataagaataagaagaaagaaaattgaatggcggcaagagccaacaacaaatacacctctatcaacttcaaccacatccttcacaaagatcctccttcatcttcttcatcttcctcctctgcttcttattcctccgtcgctcgttccaatggccgtatgctcgtcctcaccaaatcttcccccaaacctctaagatctccctccgctgctcccaccaccactacgaccgcacctcctatctctacagctccgaggattccttcaaatcaagccatctctgatccagatccgagtcagatctctcttcgtcccttaggtcatacaggatctagttcctcgctttcttttccaattcggactcctgaaatcaacaaggctccggaggtaaatgctccaactccggtttcattgtccccgaaacctgatcggttcgtgccgccgcatcttaggccaggttttgttcggaaagacgagaaacctggactcaactcttctcgagttagagatccgaatccgaatctgaatcagagattgcctaaccaggaacagccacggcaggaatatttcggttatggacagcccggacggcccaaatcgggcgggtatgagaggatccgtacggatccgagaataaccggaaaccgacccggcacctccggatggtatgttcatccctctcgtaataatcgttgttctagcattactagagagtgtctaggcttcttagctctgcctcaacggaattatcttgagatttattctacgttattgatagtttttgcctttcatgctgataattaagtaaaattggaaatgagattattctggttgtttggatttttgctgaagaagtagtcatgggagccgaatccaccatgtgtctgaacattaggattcgtttgaccatagagaatgtcatcttcacgtggattcgattttgagatgagaaagtaatatgaaggtgttttttgtgtggagaagctactcttgtttgtcctttactctttttttgtgtgtttgatccaaggttgtgtacttaaagctatatatattatatgatggaatcatatctgttcattgctcatctcaactctattctgtataattttctgggggaagttgtaactaaagttcatttgtctgtgcagatgagcttgctgggatgatgcctagttaactcactcgatgatggaggtggaactttacttacttctgaacgttgaaaacagtgacttgtcatttctcacttcttttgatcaaaccagagattatcaaagaccaacccccaagattcagtagatttgtagaagaatgttgttttgggatcaggctgggtgatactatgacacaaataacacttgttctcttacttgtctcactcatgtttcaaaaactttgtttatgtaactataattctgttatagcacgtgttgtttaggtattaatctatagattctattaccatttggtttataagaaaaacatttgtttctggatgtatgtttcagcaaaagaaatttccacttttgtttatttcaccatttgcaattgcaagaaaatctaactaacaatagcaaaaatatagacaaaataagcaaaatggaaaatatgtacatacttttttgggagagatccacttgtaaaagacaaaaggtgactataattgactaattgaggactgagaacatattgggaaggattttgtggccattggtttgaagaccaatacgttatttttttttatgtcattttttcgaacgtatttgaaaacccaatttaaaatgtattttttcgtgtaaaaaatgatgctaacatacttgtttgattttcatctaaacaaattgcaaagcagttttcataagcatcacgctaataataccattgatgcaattaatgaccaccgatcgctgaatcaccgcgaaaacgaaataacccgttaaattacccatttgcccctccgtctccattaatacacactctctgctttttttgagatctctctcagcacaaagcaatcacaaatcaaagctttcagagatccaaaaatg

SEQ ID NO: 29475 - DNA, 3003 bp, Unknown
  misc_feature (1)..( 3003): 2750-1469P.txt file - cDNA_ID_3017867; gDNA_ID_2684129; Annot_ID_191157
gtctgctcgacatcttgcgtaaatgtatggttatgctacgtctgaatctaattcagaaagaaactcatatcatgataaactgcttgaggctgacagatggttgatgtaaaagttcagtatgattaattctgtagcgctgctattctcttctttgcttttgcttgtataagcataagttacagaaccatatactttgattataaccttacctgtctaatgttctttgcctagcaagaatctgcactggtatcttctttcttagagactatctaatgctcctgcttgcagagtgcaaacaaaagtcggaggagtatgagaaggaaatcctggattggaaaaagcaggcttctcaagcgacaacaagcataaccaagctcaatcgtcaaatacattcgaaggtacaatgaagattcatcaaaccctttcctaaagatctgatatgtttgagtatagatacactaaagcttccatatgctatcaggaaacacaaattgagcagctgatctcacagaaacaggaaataactgagaagtgtgagctcgaacatattacccttcctgtcttatcagatgctatggaggaagatgattcagatgggccacagtttgactttagtgagctgggtagagcttatctccaagaacggagaccatctgctcgtgaaaaagtggaggcagaatttaggcagaaaatagaatctaaaacatccgagattgaaagaacggctccaaatttgagagcgcttgaccagtatgaggctatacaagagaaagaaaaacaagttagccaggagtttgaagcggccaggaaagaggagaagcaagtagcggatgcctttaatactgttaagcagaagaggtaactcgaaatttctcttgtgaaatgatatctagagctttgaagacaattgttaccaaatatcaacgactatatggtattatggtgaaaccaaataccgaacaagtaaaagtctgaagattctagttctggggaaattacctgtcaaagttactgtttggatacaatgcacacacatgcacatgtacaaagaacatattcagttttttcccaactaatatattccattatagttttttctgctcatttcaaattgttgtgcaggtatgagctatttatggaagctttcaaccacattgctagcaacattgacaagatctataagcaactaaccaagagtaatacgcacccactgggtgggactgcttatctaaacctagaaaatgaggatgatccgtttctacatggtataaagtatactacaatgcccccaacaaagcgatttcgtgacatggaacagctctctggaggagagaaaacagttgcggccttggcgttgctcttctccatacataggtatcctcaacgacctagatatcccatttgtttcaatgttaaaagtgattttgtaggttcatattgatttatctgtggtgtttagtttcactctttgaaattggactagaagatggtgatcttgccagatgaaatttgttatttgtgtctggaaccatcagatttgtttgactccttagcattggttttaccagtctggcatcgtcttaggttttctgttcctagtaaaatacccatcttcaaaatcgctttttgtttctttacgatctgaaatttggcctacgctctcgtgtaaatatagcatggttgttctgcaaaagaagtttccatggtcagttgttatgaggatttgatgaagtttgtggtgttgattacctttccatttttcagctataggccttcaccctttttcatacttgatgaagtggatgctgcgcttgataatctaaacgtggcaaaagttgctaaattcattcgtagcaagtcatgccaagccgcacgtgacaatcaggatgcagaggatgggaatggcttccaaagcattgtaatatctctcaaggacagcttctatgacaaggcggaggctctggttggagtttacagagacaccgagaggaggtaagcagaatatccacataaatcttttgtacatgcgtctattttattggcataatatctgagaactcgttggagatgtatttttggctgcagttgctcaagtacaatgtcatttgaccttaggaactaccaagaatcgtgattggttcaacaaccctcgggggattagggtttaggtaagtataagaaccctaactttgtaagtatagcaagtactgaatgatgtttgattgttaggtttgtaatttttgtgtcacaatgttaaaaggtatttcacagtggtaaggtgctttatttgcgatttgatttggcataggaccttataagttctgacactgtagagaacctatggaaccttttcttatgtgatactataagaaactcgtgattttagctgcatctgattgacgttttatgttttgataatagtttttggagacatgttgtcaaagtagaagtaaagacaaatgtttctttaattcgtcggactagaaatcaaatcttcaaaagccatttttgtcgtcccaatcgactttcaaaaaagctttaaattagaacgacacaacaatgaatgatttaacccacaaaaagcttgaatccaaaaggtttgacttttcagaatttagtcttaaaattccgtaatcctatatattaacggataagatccaacagagcttcagaatttgtccttaactcatattcttcttattttctatattataattcgagggttacgtgtcatatgcctactactgacatcacttgcgtcttccttttctcttgtcctctttcgtaatcattaaagtaagtaccttttaaaaaaaataaagaaaccaacggtgggagaggaagcagagagagagaaaataaaaaaaacagaaaacgagaaaaccagagattcatcaattcattgattctttagttcttcttcgtccgtctaaccttagaaacttatagctacagcgagagaagacgaagaagaataagaataagaagaaagaaaattgaatg

SEQ ID NO: 29476 - DNA, 3003 bp, Unknown
  misc_feature (1)..( 3003): 2750-1469P.txt file - cDNA_ID_3017870; gDNA_ID_2684129; Annot_ID_191156
caccgatagtgaagagatcaaaatcgtagtggcggtctgattcagctccattatcggtactggcacaaacagaaaaccggcgagagtggtaatagcggtggtttgagagtagggcgatacggggacggagagaatagagagaggttagggttttaggaagcgagagaaagctagaggaagaagatgatggtagatgaattgcgattgggagttttttgcagaggaattgaagagatggagaagatgatgaaattgtactggtaagcttcggggtcgaagccatctccacgattcttcttctctctctctctttcttttttttttcttttttagtttgggtgtgtgtatttatgtaaaagctttatttcgataattctacttgtggcatttagatttatgacatgtcttattgttttttaacaatttataaacatgtttttatgtgtggtcgtaaaacgctaccaaactgacaataactccacctacgcccggtttatgacacgaatacaaacttcatcaaatctaaatgatgacttagtaataccattttgatgtaatcacttatacatacaagtggaaccaaaatcttttaatttgtactattagttttatacttctacatcttacccttttttattatttttgtacggtttactattttctgtaccgttagaaagttatacgatttgtgttatcaacgtatgtacctgtaaactataaagggaaaaatatcaattaatctcctaactttcaaaaaatggtcattttatacatcaatttcgtatgcggctgtttaaaacatgaattaaatgttgactaacttttaaaacatgattattcgttgatcatgccaaaatagacatgtcgttatcagtcattaacggaacttctaacgtccgttatcatccgttaacgactttattagtcaagttttaaattgtggtcaatttaaacatcgactttatatgtggcaattttaaacatgaactaagcgttgactaccatttaaaacatgagaaattcgttgaccaagccaaaataaacatgttgtcatcattcattaaaagaacttataacattcattatcacttgttaacgactctattagtatccctaaaacgactttgttttgagaataatcaaaagaaaatcaggattgttttctaaatgaaaccccagttccccaaatctatttctacaaccgctcaaacaagacgaacaatcttataatgagtcttcaatttgcttccatgattcaatttcaaatttaaaacaaatatataaacgaaaatacctttatttgcttccaattactgacactgcgattatctctttatcaaactatgttcttgggttctacttaaaactttttgatatggagatttcatatgggaaaaatctttatgttctttcgattattctcaaacgacgttgttttggacagattaacagttattaacgggtttctaggttctactgataaagacatgtctattttggtctggtcaacgatatttttatgtcttaaatggtagtcaacgtttagttcatgttttaaatggccacataaaaagttgatgtttaaaatggccacaatttaaaacttgactaataaagttaacggatgataacggacgttagaaattccgttaatgactgataacggcatgtctattttggcctggtcaacgaaagatcatgttttaaaatttaatcaacgtttagttcatgttttaaacggccatatacgaagttgatgtataaaatggctattttttaaaagttggaggattaaatgacatttttcccaaactataaattagcaagactttttaaccacacttttgtggagcatccaccacgacttttaaactccatgaatcgttgtacaaagaccatttggctatggagaatcttcatggaagaaccagaaataactagctcaacttcccttgattcctataactcatgggataccgacttgagtgattaaactagaaaatcgtgaaaataatgtaattggctgcataatagtttttttcacactattaaaaaaaaacttgcaagtttatagtttgatccgtgcatggacgagattggatgtcattcgtggtctttttccggctatatttgactaccttcaagtttaagctacaaaatgatcatagaactaaagaatggttagcaatagcaatgatttaataaccctttgacattccttttttagttcaatggattctaagcacactatgaaacaatatttttcctaaatctttaacacgactattttttttttcttaataggatttcattgataaaaagatttaaggtgaattacaaaaagccgataagtatatgaacacttccgaaaacattagtcggcgagtacaaaaacattatgcagacaaaaaccaagcaaggtaaacaaaggggaaaaatgaacaaacatactacacaaacatccatcaatattttctggatcagaatctagaaacccataaaaagatgaacaaaacctaaactttaccaatttaacaaatcatttagaaaacacacaaacaggttacaatacaaaaatcttctttacaaagttaaaaccgaatgaaaacttgacactactaatctataaacatgagtatatatagtttttcttgcaaaatatcataaaaacttgattattttttttaaaaacataagatagaacaatttagtcgagcccatacgaaactacgccgtatcattcggcccagccctttgattaaaaaattaaacgcactgtgagtctgtgaaatctcctcggcttcaacttccggattaaggggaagagatgaaattctgaaatcccttgagagaaagatttgtttcgcctctcaaaacattttcaattcccgccaattttcttctccgagaatacccccaaccttctagaaaccctaatttggtttaatttcattctccactactttctctgaaaccaaactcgagatctctcccccaatcatg

SEQ ID NO: 29477 - DNA, 3000 bp, Unknown; identical to SEQ ID NO: 14526
  misc_feature (1)..( 3000): 2750-1469P.txt file - cDNA_ID_3017874; gDNA_ID_2684129; Annot_ID_191155

SEQ ID NO: 29478 - DNA, 3003 bp, Unknown
  misc_feature (1)..( 3003): 2750-1469P.txt file - cDNA_ID_3017899; gDNA_ID_2684130; Annot_ID_191219
caagcctcctcataagatctcctctatcccacggcctgcaaagaccagaaggcgatgttccagcaggaaccttcaaagctgaagacctatcaatggtagctaatacaatctttggctcaaccaatgctaacgcagatgaaggattttgacgcttcttgcctcttgattgttgctctacagaagaactacacaaaccaaaggatatatacataagctgacgcagaatcataacatgaacacaagctctgatgcaaatatcacaaaatcaactaacatctgaaatcaatccaaagagcaatgtatatgaacacaaatacaaaatcatctctgagattaagcaatttatccacacttcaatcagcgaaacaatggaactcagataatggagatgaatcgatgcacagtgtaaaacagtaaccagcaagaagagactgacctggtggaggaagaaggaagctgagatttcgatggggtaaagagtttatccatgatttggtggaatctcttctctgaatcttgtgccattgtttatcttccagaaaaatcgcagcttcctctagctcgtctttctgatttcgtcctcctataatcgtataaaccctaatctaatagattcgcttccaccttcttcgccgcggctcaggtgaaggagtggtgtttagatggcggtgacggaacaacacgaaaacgacgggatctgctgtcgtttagtcctcttcatatttattccgcaaatcggaagtctcgaatattttatctattttacgaatagatccctttattctcacttcatcccatgtatcacccaaacatttcaaatatgtaaaaagaatccaaaaacacaaaaaaaaatcatcaaattatttaacgctttatgatattagtcaaaattaatacgaaaaatactcacaaaaacagattttcctcaactagtcgtatttctttgaaaacaaaaattcaaatttcaaagtagcaaataataagtcaaaacaatatctattagatatccctcaagttgtggacaagcaaagccaaactagtaacaaacctagctgcactctcacactacttaaattcaaaccttaagcaccacaaagcagaaaaactaaacattttcttcgagaacaatccctcgatatcagaaattaaacaaaagaggattcaaatgggtggacaaaagattgttctgctttcgatcttcgtatgtttttacgtgttttcacttgtgtcatgtactgaatttgaagctggaggagaaaatggttggatcattccacaatctagtaaccaaagtgacatctttaaccaatgggcttccaagaaccggtttaaagttggcgacactatccgtaagtttttcttttgcttctattatgaatttatgatcatcgtaatgcatatattgagttttgttttgatttggtggaaaggtttcaagtacaagaaagactctgttttggtggtaacagaagacgaatacaagaaatgtcagacgaccaaaccggaactttactccaaccacgatgatacggttttcaaattggaccgtcccggtttgttttatttcattagtggtgtctcaggccactgtgaacaaggtcagaaaatgattattaaagtcatggaggtggaatctacgccgcaatctcctccaccttcctcgtctctacccgcttcagctcacaagaaaaaccacgccgtgaggaaaacgagtcggttcttaggtgccggtttagttacaatttcgattctggttattacggtttttagtcttgtgtagtatggaaaacaataccactcggttatggcggttcagccgtcgagttttattccggtttaggttttgttgcttagtttatttaaggtttttttattcatttgataggttgatttgattttggtttttggtcacttcagagctttaaaataattgaactcatgtcttattttataagtttagtatccattttaattctattaaattctaggtttattgaaatacaatgttttttacctttatctaattataaacaaacaactttcaattttctataacaaaacaaaatcaaatattttgacaaattttctaaatatacactttttagaaacatctaatattttttttagaaattcaataaccctactcaaagaatcaaatccaataatggaacacgaaattattttgttatataaatttttataacaaattatgaaatttataactcattcaaccgagattgggtcaaccctataaccttataaaatttccaattagcattttgctctagctataaaaacattgtcaaaacatgatcaagtgatgcatcaaaatacatagtttgtagtccggtctaatcgcccgaacctagtttacctatacatggactttctgttaaaataaaccgacaaaagaaaactataagttatggtcttatggacatatcagaacacaaatcaatcgagcgacaaatgaattttttttgcaagaagtggataccacgaatggattacttgtccgttcacaccttatcaaaaatcaaccaaatattattctttgtaccatttttaaaattttaaaacaagatacattcatctgtttctatcaaatgcattagtcaataacgcttccatccaacggcgaataagaggtatacacgtggtgaggcatagttgattcagcttttatacacaaaagtctcgaggaacaacgtgagaagctctaacaaaacgtgaaggccacaactattatcaaaggcacataaaacacacgaacacaaaaaaagacaaagacaatgattattcagacaagtttcgtacctatttgattctctacattcctctctctcacacaccaaactcacatacacaatctctctctctttctcaacatgtctatataaatacacccacgtctatactaactcacatcatagattcacaattttgaacaaagaaaatttctttggagagaaaacttagaacttagattgacatagagaaatg

SEQ ID NO: 29479 - DNA, 3000 bp, Unknown; identical to SEQ ID NO: 14544
  misc_feature (1)..( 3000): 2750-1469P.txt file - cDNA_ID_3017905; gDNA_ID_2684130; Annot_ID_191217

SEQ ID NO: 29480 - DNA, 3003 bp, Unknown
  misc_feature (1)..( 3003): 2750-1469P.txt file - cDNA_ID_3017938; gDNA_ID_2684130; Annot_ID_191207
agatattccgtaacagaatcacaaattgttaacggagaatgatatttacccgaaaactatatctgactcggctagtgatccgttatggagtttgagatgaaacttatctttggtgagaactcccatggagtagctatgatcagcatattcaatctcgtagtcacattgatgacaattttcacaatgttctgtcagttgattcctttggacttctacacaaaaggcctctgaagatctcactaagttatcttttctaggcttatatagttgatttgctccctaaaaccaaaatccagaaagttcatcactaaattcacagagagattctcctaaaatctaaaaaaacttgatctttattctttaccttagcacaactagtacaaggagcatcacattggatccaagtcaattcacttcccgtatcaatatcaagatgatagtattgtccatcttcaggctttccaacaagaatgcgtgtataatacagcctgcaacaaaagcaaaaaaagacaatctttgtttacttgtgctttaagaaacaaaccacacattcagattacagagtattagatacaatgcatacatacccatctggatacacattaccaccgacgggaaaaatcgtagtggaggagtcaatagaaccggcacttgtagataaaacatcgttgacttttacagggttgaccagctctaaatccattgattccacaaagttttcattctctaaacctaaatcttcctctaagatccgctcgtggaactctcgagctctcaatttgtgatatacagggaaaacaaacgacgccgtttcacggagattatcgtcgtcgtcacggttcctctcatcaggagaaaccctaaacatttgaacagagttgggaaaaacagaggcgtagaaagcaaccgcgagaagcgagattccgagaagacccagaactaatctcggcgaattcattgagagatccgagaacaagaggcgagattgttggtttcggtgaagtgggtcgggttgaaaactcgggtttgggttatcctcgggtgggatttcgagtgggtaatcgtggtcagtgagagtgaaagcagagattgttttgccttgtgaaggatcatcagatggtgggagagtgattatgactacgctgtggactcgttgttgttgttgctggtcatgaagatctggttccattctgtgatgtctccgatcgaattgggctggttttgatcggagagagaatggaaacaggacgagaaagaaaaatggcagactaggagtggtcaagagtcaagaggctttcgttatacgagacggaagctgcgaggaaggagagggttattttatttgaagtaaatgtttgaaaaatatgaattacacttaccaaaaaaaaaaaaaaaaaaaaatgaattttacttacacataaaattcatttttattaaaccctccctataaatgttctttttaaaaaaaaaagtatatatggaggacaataaaaatagcttttagtaaaaaactttaatagttttaacaaattttataatttcttgctttacatttatttttcctttttcctgtcaatttgatttcttttatttaactcaataaaaatatatgatacaactttaatttacatgataaaaatttagaaataaataaatatgtaatcataaaataactatacaacatacatttcaaaaacattatgtcaaacaagatatgttaggaaaaacaaaattttttacatgctatacaaaaatatatataaattagaaaagaaacataaaataaaacttgtgtgttcatgtatttattaactattgtaatgttaattttatgtgtgttaaatttctaaatataatattattgctgtataaaattgtttttaaatgtaatgtttttttattttaataatttcaattttgatgttaatgtatttaaatttatatgaatataattgaaataattgaatttaatagaattattgtgagatatatgcaagctataaggactcaatgaaaatatgtgaaagattttaagggtgttatgcaccctcaaaaataaaggttttaaggtttgttggagttaaaaaacttcaaaatttaaaagtttgaggtttgatggagatgttctaatcctctcgtttttttctcttcgatatatgaactgaaaaagtatgaggaccccgaaaaaatcttggactttctttcttgtcatataatataaacaacaacctgcattactatttactagtttgaagaatatctgagatgtagtatttatactatggggttaatgctaataaagagatggatcagtggcaagagcaaagaagcaccacccttgtagtttcaaatatttgttgagttttgctttataatttggtcatcttagtaacaaataaaattgaatatcagaattcaaaagttaagaaaaacatattaattgacgaaaataatatatatatatatatatatatatatattaattagttcgtaaagttccaaaaaataactgtaaaaacaagaaattaagaagataaagtataaaagaccgaaatgggtgcaattttagttagttttagagtttggttattggttttactattttttcagttttaatttttgttatatattaaaagcttaaataaaattaaacatatgaacacatttaaaaaaatgtaacctaaaaaataaagttaatagtattattattttttaactctaaaattaatattattagtttgctactttgcaaactttaaaataaaataaaatctacaaaaatttgattgttgtaatttgtgtgaaatggaaaacaaattgcgttcgacccgtaggattattttcccacgaacgacttggccaaaaaaacaaaggaggccgaattgaagcaactacttttctccatcatcatcaccatcggcgaaatccgccaaaaattgatctccatttggaaatccagatcatgctctagagccctagtttagatctcgaaggaagacaatg

SEQ ID NO: 29481 - DNA, 3003 bp, Unknown
  misc_feature (1)..( 3003): 2750-1469P.txt file - cDNA_ID_3017958; gDNA_ID_2684130; Annot_ID_191201
aaaaaaaatagaaagtattttctaatggtaattgggatttacattatataaagcactaattgctgagataaaaccattcatcaggtatatatgtaaaactattctcgagataaaacaagaaagtgaatacacaattttcttgcctctattcataagaaataaacctgttttcattgtgtttatttaacaccaaaagcactcaaaattgaggcttaacattcagacaaaccgtaactatagaacataagaaaaacctaactattgaagaggttgcattatatcacaagtttaaaacaccaaagctcaagctgagtagcaaaaataggtctcttcttccgccaccaaaacctcaacaggaacgtctacaaaagccttgaccgccacaacgaccaccggaaaaacgaccaccgacgaaaagaccacgaccaccaccaggaccaaagacaggagtaccaaaacggctataaggttcctcatcagaagatgatccatccacagacatgctctctgcctgggctttacagagccaattttaacttcattatttgacctaaacaatgagatcaacagatccatcttctcttccattttatgaagacgaataccaaatccttccaacatctccatcgcatcagatattttcatctcagtcgtcatgtctttcttatctttctccaaattgtctgtaggcgtcgtgtccttaatcacagaaggagatgcttcagctttggttgcggatttattgtccatggagaagatgattagtagaacaacgcactagagctaggttaaaagagagaaattggagatcggcaaaaacccctaatcagctgcttaggaagaaaggtatttataagagtcttttatattctggcttggggcacaagagtcctttccttttattttatttacttttcccgttgttcattttttcaactaagcaagctttatctgggccgaggtgaggcccattaattgaattaaaagcccaaaataacaacaaaacattacctgattgtcggaaaatcagacggaaacaaaagaaatcaaaaatccgatggggaggaagaagggattgccggagttcgaagagtcggcgccggatggattcgatcctgagaatccgtacaaggatccggttgcgatggtggagatgagagaacacattgttcgtgagaaatggatccatatcgagaaggctaagatcttacgtgagaaggtcaaatggtgttaccgcgtcgaaggcgttaaccattaccagaagtgtcgtcatcttgttcagcagtatctcgatgccactcgcggcgttggttggggcaaagaccaccgtcctatctctcttcacggtgagtttttttcccggcgttctctctcacactggtgaaaatgcttagattgaaattcttagggtttcgtgtttttttccttagcctttgaattttgaattcagttactctttagtgtgtttgattgaatttgatttgaatttgatgtagagtggtctcaaaattcttcatgaatacctttgtgaaattgattcttcctttagatatatgtattgaattttttttgtttgtattgattttgtcaaaccaggtcctaagccagtagctgttgaagaagctgaatgatgttgtgtgcgtgattgatctttggtaagtaactggtgttgattagttatatagtgtgtattgcttagaagaggagaaaggttagactttctagcatgctttgtgtagacactatcttataactggacatgttatgtgaatctgtttgtggtaggagaaaattggaatatggatgtttggatagttatatgtatgaactgatcaggtcttagagtgacttagttttgcggaagttgtggatacactggttaattattgatatcaatctgactgcaatcacaaaggttaaagcttagtcatggactttcttcggtggttttagaaacaggacatgttttggaatgtatagaaatgaaattgatagatcttggagtgactcaattttggagacatatgggccgatattatagataccaatccgcttgcaattgcgtccatctttaatctgcaacagagctaaacctagtcacagaatttcattgatgaattaattatttgagatatgagatgttgtggactgtatgaagaaggatagagctccaacatttaggttttgattggtttaaacaatagttccaatagggttaaggcatatagtcaaaatctcaagttcaaattggattgatgatttttgtatttggttcaaagattttaaaggttttttcttgctccaatgacacaggtgagtgagagctttgattaccatacatgaatggagtctctgttgcaagttaatgctccacatcaaggttgttacttgatttatgcttttctgtttcgtaaaacatatattactaattggacttgggagttccaattggttaagctcagcttcgtttttcaaatgatttatatatatttttggcttgttgtacattgcgtccctgtttgtcgaaataatgaaattcccaagtacctttttgcatgcttgcaacttagtatatgtttttaagactttatctgataaaactaagaaagagttaactctaaaaacatcatactttccctttatttcaaaactgtaggaacatctttacttctttagtgttgtctaaatggattcatttctgaaatagttcatgaaatttttattaacctttaagtagtagttcaaacatctacggagtctattaccatatgttaaatggtgacaaagacaggtaaggaccacagacaaaatgagtcagaaaacaaaagactaacaaacaaaaagataaaacttagagatgggtaaggaaaagaagccataaaagacccaaaaacataatccaagtctaaccaataagatcgcaaagatatggatcaacttcggtacatgatgccaaatcatcactacagtgtcttttttccttgtacaacccaaccaaaaatg

SEQ ID NO: 29482 - DNA, 3003 bp, Unknown
  misc_feature (1)..( 3003): 2750-1469P.txt file - cDNA_ID_3017966; gDNA_ID_2684130; Annot_ID_191198
ctccaatgatatatattcacactgttaacttcaaaatggtaaatcaggttttagaagcaagaactggtttctacgagccaattgctactctggattttgcttcgttgtactcgtaaatcatgatagcatataatctatggtactgcagcttagtattccatcaaacgcttttttttcttcttatatttattttccaacgtttgttgatgttatccatctattgttcaaagagcttattactgccatcttctcgtctttgaaggtgaaacctgaggatgcaaaaaaataaattcgacttacaccaaaattatgctaatcttaagaattattcactttttcattccaaagcccaaaccaaacccaaaagggccttttatcaaaagcctatttacaacatataaacccaaaaaggcctttcgtcgagaaaactaaaatggctccgacgaagaaaggaaagaagaccaaatcggcggcggaatcaacgacggtcacagaatcttcaagctttccgacgtgtttgcgtctccttacaccttcctccgtcgctatcaccatccatgcgaagccaggttccaaagccgcctccatcaccggtatatctcctcttccattcatcggttttgattttgtgtaaagtctcggattttattgattttggtttcctctctatgatctggagatgtgagcgacgaagcggtaggcgttcaaatcgacgcgccggctagagatggtgaagctaacgcagctcttctcgagtacatgagctctgtaaagtttctctttcttcgcagataaattttcacttttcaagttctttgaaattgtttatactctgttttgctctcatatctggatttggttctcagatagtttgataatgtcatgtagaattgtgtctctgtaatctttgatgaatttgattagctcttgttgagccactagtcataaaaaatatgcacttgtgagcttccgtggactaaaggaatcaaaccttaacttggaggatctttgttaagatatatgtaacatagttgttgctctgatttggattgctatggtttatatgctgctttaagtagtgagaattgtttgctgctgattttgagagataagattaagagatgaattctatcatcatattcatatcctgacttctaaaatgttatctttgataggtattgggggtgaaaagaagacaagtctctctcggttcgggatcgaagtctcgagataaagttgtgattgttgaggatatgacccaacagagtgtttttcaagctttgtcccaagcatcaaaacctacctaaagatctccaagcctgtaactaactatatggagaaactaaatcatcaaaagctaaatggttcatgttcacttaaggtacgaatggtttgaagagtttcaggatttgtgatagagatcattggtctgatattactatgagtccatgattaatgtcatgtaaatctatagactattgcttattatataacaaagctgtgtttagtctagtccccaattgatctgaagtcatggatggttttttgatgtgtttgttaatccttattttcatgtaaagtatttaggatggttttcttttctctcttgatccttatttgtctttgtatatttcaaccgtttttgacttttgaaccaatcaaaagagaagaaacaataatgggccaaaagaagataaaaatgggctatggagaatcacaagtccaatttctctgctcacaacttgaacaacaatattttttttttcctaaaaaacttgtacaacaaacttaaaaaacaataatatgagaattggaacaaaatccttttaagtttgtaagtctaatttcaagaaccaaaatacaaaagtaatatcaatttctcaatacagttataaaactacttgatttgtggattttatacgttttaaataataatggttggatattccttacgatttttttaattgattagttatgcgacgacccgtgccatgcaggttgaagtcactttcaatgatcgttgtctcataaattacaaagaacacagctattttgtttctatttcataatgaaaagcgaatatttgtctgttcagataccgatcaggtaagcgatgcttaaagccaccaaaagggattctaaagtaatcaatgatttgattaagaaaaaagtcagaaaacaatatccatttgagtatttccatgtcaccaattggtttataacttccaatgatcacatgccgcttgtaatatacatcacctaaccaagcgatcgactccaaaaacgaaaccgtatttattattatcttaagactatagtctatacaatatacattacataatcaagatgcccaattagatgttttaaaacaacaaaaagatcaataggcccaattatatcttatcttaataaaatgaaaaagcaattgcatgaggaattatggatatatataaattacatgggctaggttttttttatatacatataaatagtttggagagataaatcaggtggaaccaagtttgttgtttgtgtttcgattgaacaacactttaattatttaatctttccattgtctttgcgtcttcttcgatcaatttatcaaattagggttccaaccttttttcttttttttccccgttgtgtgttaagtcggcggaaaaacttagaacagaacaaaccatcatttttccaggtaaattatattctaatctcatgttcttgttaatatctgatttttgatgatcttcctatgcatgtttgtcattgcgtctttctcttacgtgatagatgttcgttgacgcgatttgaggtttatttaggttccttaatagatttaacaaaaagaaattctcggtcaataatatttatttgagctgatcaatcatttgctggagttagtttgtgttgtcgtcttcatatgaatctaaagggtatatatatgttttgcattctttgttatagaaatttgaagaatagataaaaaaagattaataagatatg

SEQ ID NO: 29483 - DNA, 3003 bp, Unknown
  misc_feature (1)..( 3003): 2750-1469P.txt file - cDNA_ID_3017970; gDNA_ID_2684130; Annot_ID_191197
ttgatgattacatagcgaaatcgaagctcagtgagagtttaacctctacggtttggttagcgaagcacaagttaaccggcgaagaagcagtgatgaagtgtttcgacctctcgaagctcaatcgcaatctccgagactgtttaaacaacgaactggagtttctatcttctgttgatcatcccaatatcattcgtctcctccatgtttctcaagtactaacccaaaactgagtttttcaatatttcttgagtctatgaagaatatgattgatttgttttcttcaattttgcaggatgatgattttctcgttatggttttggaatattgtgatggaggaactttatcatcgtatattcaacgttatggtagagttgaagaagatatcgccaagagatttatgaagcaaattggtatctattgttatataggagaatgatttcactgcatttgcttcttcttgacttaatagtgtcatcaatgttttgatgaaggagctggtttggaaattattcatgataatcacattatccatagagacttgaaacctgaggtacttctagaattatagatactctggattcaagtttggttgtgaattgtgacaatagtatttgattggaacagaatattttaattgacggatctggtgatgatttggtgttgaagattgccgattttagtcttgcaaggtaaagttttttgaggaggaaagacatgcttatagtataaagatctttatatgtttcatgttcgtaagcagaaaactacatccgggcaagtatcttgaaacagtgtgtggttctccgttttacatggctcctgaagttcttcagtttcagagatacaatgaaaaggtgtgatattgtttttatgcagctccattgaatgataaggttttccagttttaaattcactgagaaacattgcaggctgatatgtggagtgtaggagcaatccttttcgagctacttcacgggtatccaccattccgtggtaataacaatgttcaggtgagatcttgaattagttagtagtattcttttatcaaaaagctccaatgcctttaacttaaaaaccttttaccactaaccataggttctaaggaacatcaaatctagtacagctcttccattctctcggcttattcttcaacagatgcatcctgattgcatcgacgtctgctcaagattgctttctattaacccaggtacagaaaaatctcatctgtttgcggctacactatgtacacatatcgctatatatattcagttcttggttaccattttctgcagttactcgtctctctttcgatgaattctacaaacacaagttcttgaggctatgattgatttgtccttgaggtaaaaagatgaagtcgtcttaaaacttctgttgaatccttgtatagattctcgtgcctgtatccatgtatataatttagttgaagcatgcattatatttgtatttcagctgagctagactgacatttaacctagcaaatatgtttttgattctcagagagctgccacactgggcatagaagattttccttttcttggccgtataaagaacagtagggtttgggtcaaggacacaacattttcttcaaggtatcttgaaatttatgtttccattatatccatagaagtggtggctcatatctaaattatactgcctttttttttttttttttctttcagatttgcggatctagttaattgattgtattattcatcagtattgggatacatccaataatattgagtcgtcttgtttcagacaacatggaacaagggaaagaaaagtggctacaattaacggaagacttcaatttgacctttcacaggttttttttgtccctaaccagtttaaatattgttggagtcatcattatattagatgctttattttcaaattaattgcaaaaccatcagccttcttcttcttttatatttttaggcaatgctaagagatcaatagttaagttcatactattgagtgtagaagattatagtttacaccattatgtttccatggtttctcagaattttgattttgttctattggtcacttctttcttgcagtaattgttctgtttctatttggtttcaactgttctttttctctgtttctagtccagtattagaatcttataaaaagataaaaacttaaattgcattcgtatttgctgttacaggatgcatacctcccacagaggcttcttgaaaacctgatgtatatttacaatactattgaaatggctcgtgtaactggagtccctacctcctaccttatttcaagaggagagagcatcaaggtaggtttcactaaattctgtcgcagcacactttctttgactaaggctgtctgagaagttatatatcttgggtctaggttctatctcaactacttaggaaagctaaacagaaaacctggttcttccaaatgctgagaagttggaacctgaacaaggaacttatgaaggtgcaactgtacgttggtggttttatatcccctacttacagttttacttattcttcgatcacttctaatattttgataaacatctccaatgatatatattcacactgttaacttcaaaatggtaaatcaggttttagaagcaagaactggtttctacgagccaattgctactctggattttgcttcgttgtactcgtaaatcatgatagcatataatctatggtactgcagcttagtattccatcaaacgcttttttttcttcttatatttattttccaacgtttgttgatgttatccatctattgttcaaagagcttattactgccatcttctcgtctttgaaggtgaaacctgaggatgcaaaaaaataaattcgacttacaccaaaattatgctaatcttaagaattattcactttttcattccaaagcccaaaccaaacccaaaagggccttttatcaaaagcctatttacaacatataaacccaaaaaggcctttcgtcgagaaaactaaaatg

SEQ ID NO: 29484 - DNA, 3000 bp, Unknown; identical to SEQ ID NO: 14538
  misc_feature (1)..( 3000): 2750-1469P.txt file - cDNA_ID_3018002; gDNA_ID_2684130; Annot_ID_191188

SEQ ID NO: 29485 - DNA, 3003 bp, Unknown
  misc_feature (1)..( 3003): 2750-1469P.txt file - cDNA_ID_3018027; gDNA_ID_2684202; Annot_ID_191233
gctgagttcggtaattctgcctaaacctctctacctagttagatgttattgttaatatggcctttgaccaagaacaacttcagccgtgttaaaaaacattgaaaccaaaatcaatggttatataagattaacttgcactactaggatttgatcacagaagaaagaaaggggtttattaatttggttactgtatcttactctttttactttcggataacttcaattggcaatggcggttcgtaaagagaaagtccaaccattccgcgaatgtggaattgcgatcgccgtcctggttggaatctttatcgggtgcgtctgcactattttgatacccaatgatttcgtcaacttcagatcatcaaaggtaaacttagttcttatactctaatcatgtacagtcggtttgttttttgaaattctgtggtctagagctctagagttgtgttctgaattataagatgtcctctggaagctagccattatggcatttgagttgatttataatgctggacatggtgttgttctctttgttgtagattatatatgtcaaaatgttgatgaatgaagtttgaatactatagtaaattttagaaccaaatttggcgggagatggattttagaatttaagtctcttactgagttcgtttgttttgaggttcataatttttgagtaagaaacactacatgtttaatcatcatcatcgtggatcttactcaagactgataatttggacatcaaaaccaaagtttaaatggtgaacttcatcctttctctgtttatctttttcaggttgcatcggcttcatgtgaatcgcctgaacgggtcaagatgttcaaagcagaattcgcaatcatctccgaaaagaatggcgagttaaggaagcaggtcagtgacctaacagaaaaggtacggttggcggaacaaaaagaagtgatcaaggcagggccttttggcactgtcacgggtctgcaaactaatccaactgtggctcccgacgagtctgctaaccccagattagctaagcttttagagaaagtagctgtcaataaagagatcattgtagttcttgcaaataacaatgtgaaaccaatgttggaggtgcagattgctagcgtaaagagagtgggtattcaaaactacttggtcgtcccgttggatgattccttagaaagcttttgtaaatcgaatgaagtcgcatattacaagagagatccagataacgcgatagatgtggttgggaaaagcagaaggagttctgatgtatctggactgaaattccgcgtcttaagggagttcttgcagcttggttatggtgttcttctatcggatgtggacattgtattcttgcagaacccttttggtcatctgtacagagactctgatgtggagtccatgagcgatggtcatgacaataacacagcttatggcttcaacgatgtgtttgatgacccaaccatgacacggtctcggactgtctacacaaacaggatatgggttttcaattcagggtttttctatctaagaccaactcttccttcaatcgagctactagatcgggtgacagatacactctctaagtcggggggatgggaccaagcagttttcaatcagcacctcttttacccttcgcatcctggatacactggcttatacgcttccaagagagtcatggatgtgtacgagttcatgaacagtagggtcctcttcaaaacggtgagaaaggatgaggaaatgaagaagctgaagccggtgattattcatatgaattaccattcagataaactcgaaagaatgcaagctgcagtggagttctacgttaatggcaagcaagatgcgcttgataggttccgtgatggttcatagaggagtatatgcttgttaagcaagatatcgaaagaaccaaacttcttcttcttctgatgtttaggttattaaaccgcttttttgttttgtcaaacttggaagttggttgaggaaaattggaaccatttcttttcgtttcgatcgaaaaattaaacaacttctctctttctctgtcagtatgttatgggcttgatcacagaagacgaaagtgttcactaataagatgatgtttgttatttaagtttgaatactatagccgaatctagaaatacttggcgggagatggaattgattggggcgaacaagcacattatatttttaagggtttccttcgacttctcttttatattttagggctaaacgaaagctctgattccttaaggccgtcagccaccgccgaagaggagcttcgttggtctcttaagaaagaaaagaaggggagaatatggcttatcaagaagcaatgaagcccaatcccacgaaggctggtttggaagaagtgatggcatctctgacatcagttcgatacttgtaaaaagtgtgaagctatccaaatccattacaaaactgtttcattacggcgatttttggagatagcttttctcgttttttgcatgttgatctgactgatctcagatatctcatcggaaccgtagtaaatacatcatcatctacttgcaagaagtgcatttatcctgtttgtatgaatccatgtctttcccctacttgtgatggtgtctagctcaacttaattactctttagccttaataatgaacagtcttatcgatcctgcttaattaaatattgaatggaagtttggtttgtggtaggttcggcaaattttgcctaactagtacataaatgattgatcaagtccactctttatagactgtagtatataaattattataattttgttaaccttgtaacatgattttaaaaattagaacccacttatttatttctctatcaggatggtatgttaatagaatgaactatagaacagatcaacagacagtaaatgaaacttaaagaaaaaaatacaaatggctcatataaaatgaacttgcagaaatacagtttgatcacagaataagagagggtttatcaatttggcttctgcgtcatttcggcaatg

SEQ ID NO: 29486 - DNA, 3003 bp, Unknown; identical to SEQ ID NO: 29485
  misc_feature (1)..( 3003): 2750-1469P.txt file - cDNA_ID_3018027; gDNA_ID_2684202; Annot_ID_137209

SEQ ID NO: 29487 - DNA, 2427 bp, Unknown; identical to SEQ ID NO: 27107
  misc_feature (1)..( 2427): 2750-1469P.txt file - cDNA_ID_3018032; gDNA_ID_2684202; Annot_ID_191263

SEQ ID NO: 29488 - DNA, 3003 bp, Unknown; identical to SEQ ID NO: 27113
  misc_feature (1)..( 3003): 2750-1469P.txt file - cDNA_ID_3018048; gDNA_ID_2684202; Annot_ID_191234

SEQ ID NO: 29489 - DNA, 3003 bp, Unknown; identical to SEQ ID NO: 27116
  misc_feature (1)..( 3003): 2750-1469P.txt file - cDNA_ID_3018077; gDNA_ID_2684203; Annot_ID_191312

SEQ ID NO: 29490 - DNA, 3003 bp, Unknown; identical to SEQ ID NO: 27117
  misc_feature (1)..( 3003): 2750-1469P.txt file - cDNA_ID_3018081; gDNA_ID_2684203; Annot_ID_191311

SEQ ID NO: 29491 - DNA, 3000 bp, Unknown; identical to SEQ ID NO: 24881
  misc_feature (1)..( 3000): 2750-1469P.txt file - cDNA_ID_3018095; gDNA_ID_2684203; Annot_ID_191302

SEQ ID NO: 29492 - DNA, 3000 bp, Unknown; identical to SEQ ID NO: 14580
  misc_feature (1)..( 3000): 2750-1469P.txt file - cDNA_ID_3018101; gDNA_ID_2684203; Annot_ID_191296

SEQ ID NO: 29493 - DNA, 627 bp, Unknown; identical to SEQ ID NO: 14620
  misc_feature (1)..( 627): 2750-1469P.txt file - cDNA_ID_3018164; gDNA_ID_2684204; Annot_ID_191364

SEQ ID NO: 29494 - DNA, 3003 bp, Unknown; identical to SEQ ID NO: 27132
  misc_feature (1)..( 3003): 2750-1469P.txt file - cDNA_ID_3018168; gDNA_ID_2684204; Annot_ID_191361

SEQ ID NO: 29495 - DNA, 3000 bp, Unknown; identical to SEQ ID NO: 14615
  misc_feature (1)..( 3000): 2750-1469P.txt file - cDNA_ID_3018172; gDNA_ID_2684204; Annot_ID_191358

SEQ ID NO: 29496 - DNA, 3003 bp, Unknown; identical to SEQ ID NO: 27143
  misc_feature (1)..( 3003): 2750-1469P.txt file - cDNA_ID_3018192; gDNA_ID_2684204; Annot_ID_191346

SEQ ID NO: 29497 - DNA, 3000 bp, Unknown; identical to SEQ ID NO: 14609
  misc_feature (1)..( 3000): 2750-1469P.txt file - cDNA_ID_3018196; gDNA_ID_2684204; Annot_ID_191345

SEQ ID NO: 29498 - DNA, 3000 bp, Unknown; identical to SEQ ID NO: 14609
  misc_feature (1)..( 3000): 2750-1469P.txt file - cDNA_ID_3018196; gDNA_ID_2684204; Annot_ID_137284

SEQ ID NO: 29499 - DNA, 3003 bp, Unknown; identical to SEQ ID NO: 27772
  misc_feature (1)..( 3003): 2750-1469P.txt file - cDNA_ID_3018200; gDNA_ID_2684204; Annot_ID_191341

SEQ ID NO: 29500 - DNA, 3003 bp, Unknown; identical to SEQ ID NO: 27150
  misc_feature (1)..( 3003): 2750-1469P.txt file - cDNA_ID_3018210; gDNA_ID_2684204; Annot_ID_191336

SEQ ID NO: 29501 - DNA, 3000 bp, Unknown; identical to SEQ ID NO: 9936
  misc_feature (1)..( 3000): 2750-1469P.txt file - cDNA_ID_3018217; gDNA_ID_2684204; Annot_ID_191331

SEQ ID NO: 29502 - DNA, 3000 bp, Unknown; identical to SEQ ID NO: 14644
  misc_feature (1)..( 3000): 2750-1469P.txt file - cDNA_ID_3018282; gDNA_ID_2684206; Annot_ID_191399

SEQ ID NO: 29503 - DNA, 3003 bp, Unknown
  misc_feature (1)..( 3003): 2750-1469P.txt file - cDNA_ID_3018389; gDNA_ID_2684208; Annot_ID_191479
ctgtaattacattgaaatcgtagtggcagaaccggggtcacaaaaaaaccaacagtaaccacctgtattacattacatattgtaaatagtaagtgtactagttttataattatgttctgtaaacgtactactttgcaaacaaactcatagaaatatctcaaaaatttcaaacttacaatttgttctcctcgcgtgtaatggctcgttccacccaagttgtgcgtagctattcctttcctgcctcgatcgcttttgcgatttttggagttagtcttggatattgcttgggtctccggtttcacccaatgtagttgcaacccttcaaaaactttatcattcacccctctaggttttttatctttgacccacctttgcttccactcattgattgtgccacgataacgagaagatatgtctttgtcaaacgctttacgaacctctagcgtcaaattccgatcccaattaaactcttgctacaaaataaaaaaagtacgttgagtaatacataattaaagaacaaaaatacaagcatcatcttcaaaaaaataactaaccgcgaattgtttcaaccacaaatcttgttctttcgccggcattgacgagtaagttggatatggatccttgagtagtccttgcatcatcttcaaaacagatttgcttatcccgtttcccgaactctcaaacctacaaaagtttgaattttataaatttatattaataattcaaaaagatagaaaatgtgaattaaaattccaacacttaccatgtttcatgatcgattctatcgggatggagctttgtgagtcgttctcttcctggttgagagatgaagtcctcaatgctcatcaccatgggagtctctgacgttggcgactccggactaagactaggggttcgtgaatttgaacgggacggttcttcacaatcttgagtagatcttgattggttatgacgacggtagttaccataattcctaaaacaaatgtaaaaagaacattggttatttatgaattaagtcatcaaatttatgaaaaagaaaagtagataaataaaactcctcacaataaaccaaaacaagaaataaaaataacgtttatacttaggaaaatatagctttcaacaattcaacaattgattcacaaaatcaatagattcacaaaaattggaaaactaattcaacaattccacatcactaacacatatatgactaaattcaacaaaatctaacacatatgtgtttaacccataactatccaccgaagcatataaaaatccaattgaaaaagctttaatctaaagaacaactgtatatagaaaaagataaactaattacacaaggtccatttgaacaagaagattacacgatgacatggtacccacggtattgacaattacaattcatgccaataattgaaacagctttgtacgcttggaattttattttattagttaaaaagtaattagagaaatcacttacatgttagatgtgacgaaggtgctgctctaagggaaataggaggagagaattggcggaaagaagaaggagggtttgagagagatgaagttaaaaaagaaaatggagaagagggattaaataaggaccactggttttcccattattatgatataaccgacagattttttgtcggtttacgagaaaactaaataaaatattaaagggcgcgctattcgatagttttgggaaaactttatttggcgggttcaattttgagatgcgttggtaatccatcggttaaaacaacggtttatcaattaatttcgaaatttttatgctcttcttataatgatcaattaaacgattacaattctgaatttattcttccgtcaggaaaccgtcggtttatattatgtattaaccggttccggttaggataagtttagggtcaagagttaaaatttcatataaacaaaatgaaatgatcaatacaattaatgataacattaaaataaaactatattaagtgtatatatgtctctattttactctcatttacaaaaaaaatgtataatgaaaaaataaaaatgtcatctacttaagacaattacataagttaccttagaagtttaagagtacttgtgttaaaacaatttcgaatctagaaaatcaacaaataggaatcaattgaaaatagtttctagactctaagttatttagaaatcatcaatgaacatttgcaagcatgttaggctaattaatttgtactttcgataccctaaaacaaaagtcgttgggtaaccgtcggtaatccgtcggctaaaactaacggttaaccgacggaatttttggataatctacttaacatttttgaagtacaacttaacccatcaatcttgggtcggtttttttttatgggtttaaccctcttttttttggattttcggccaaacacatgatttgagatgatatttggcccgtaaagaaatcttaccaaaatttacaaatcgctttaaatactaatcaattacaattaatgatttcccttattatcgaccaaattgaattcgtaatatatgagaatatttcaaaaatctcgctaaacaattccctaatatctcgctaatcaaatcatggatagagattgtgattattttgatttgttaccaaaaatctctcaaaacaattccataaaatctcgataatcattatatattatctatttaaagtaaagaatttgaattgaatttctatgctaaactatttgccatataaatctccacagaatattgaaactatattattgtattacaaacggatttggtgcatattccttaaaaatttgattacaaatatttgattctcatttagttaagactggaataaattttattggccaccaacctaatcggaactcgcctatatatactttctacctctcatcacaatatcaaacacacaaacaaatttcatcacatatctttggattcgagacaaaaaatgaaagaaatgattcatgttaagagattagctgaattcatcatatg

SEQ ID NO: 29504 - DNA, 972 bp, Unknown
  misc_feature (1)..( 972): 2750-1469P.txt file - cDNA_ID_3018467; gDNA_ID_2213627; Annot_ID_195929
ttctttattaatttcttataaaattattgtttataactataactttcttatttataatatctttaaaataaattgatttagaaattccgaaaaacataatcaggaagagttttaaactgttagtattaaatttcattttactattttataaaataatagaaatgaaatctatgaaagtaatatttacagatttattctttatcaaaaaggaaaagaaaaggatattttattaaaaaaacagtgataggacgaaactgttaaatgggctggagagatataaaactgttagccactacctggcccataatatatcacatcgtctctttcgctgcacttggtggttctccaattccgtatcgaaaatcttcttcgggtcagacgatctgaagccgatcgctgtagaatcagtttcgtgctccgcagtttctcgagtttcctctcacttcaggtagtcttcgacaccctaatcatgttagattgatattaatgttgaattttagctgatattcaatggttattgatccagatcttcataagagaattcacttacggagagggactttttcgtagacgattctcactggatatctatcacccggtaagatcgtcttgctcgaaaagaattgaaaagtttttaagtaattgaataaggaactgtgaatcggagaggcttacttttttgaaaagatctaaaccatcgtagaagatcgtcctcaaatatctcacagaagttaccaattttgaaagatcactagagatagctacggattttgagaggcggatctgtccaggtcggcactgtgaaagagaactacactggttttttccagatgatatgaagcttccgtgaacgaatctgattctaaggtactcatcgaagagaatctgggattgtattgatctggtcccttagcttccagtttggctataactctgacaactgttgtaagtgataagttgtgatcaataatg

SEQ ID NO: 29505 - DNA, 3003 bp, Unknown; identical to SEQ ID NO: 27156
  misc_feature (1)..( 3003): 2750-1469P.txt file - cDNA_ID_3018467; gDNA_ID_2684211; Annot_ID_191532

SEQ ID NO: 29506 - DNA, 3003 bp, Unknown; identical to SEQ ID NO: 27159
  misc_feature (1)..( 3003): 2750-1469P.txt file - cDNA_ID_3018473; gDNA_ID_2684211; Annot_ID_191528

SEQ ID NO: 29507 - DNA, 3000 bp, Unknown; identical to SEQ ID NO: 14673
  misc_feature (1)..( 3000): 2750-1469P.txt file - cDNA_ID_3018483; gDNA_ID_2684211; Annot_ID_191524

SEQ ID NO: 29508 - DNA, 3003 bp, Unknown
  misc_feature (1)..( 3003): 2750-1469P.txt file - cDNA_ID_3018489; gDNA_ID_2684211; Annot_ID_191522
cttgatcatactttaattgatcgataaactgtgcttacgctgtaaatggaattttgcgtttcctcccccttttcctctttggtccttctattttgttatatggaatgaccactttgttctttatttatgcaggaaatttactccataaagttgcctggggacccgaaacttggcgaaggcaaacctgagaatcaaaaccacgccattgtgtttactcgcggaaatgctatccaaactattgatatgaatcaggttagtatgcaattcttctttcgtctcttggcatctctttgtttcaaatgtcgtctttcgcgatcttgtgtgggtttgtaatgattaagtttctggggaagttcaatcaagtaaatttgaaatgcataggctttataaaaaatagtaagaataatagtttcaaatttagatcttaagaattaaaaatagggcgtgagaaaaacagtgcttcatagcttatgcacatgtctagtggagacatgtggctgtagattgatttggttagccgagtttcatccaataccttgtccaatctatgtaatttggattaattgactagaattcctcttggtactagaaaaccttaggtgccactatgtagacttttacttgagcataatttgagctcatgcgacattcaaattagatttaacaaatttcgctttccaaaagaataaagtgaaaattttgccaaatctagatacataattttaccaagtacattcaatatgggtttcactgaggaagagtggttcctagctttgtttctatgtttgaagctcaaaattaaacacatgtggagtaggaatggttcttaactgaaaagcacttactgattacatttgagtttggagtgggacatctcattacatgaatgattgtacctgaatcttctgtcatgtgtacatgtgtgctttacatcctttacgtttgagacaagagctaaatgcatccccaacctctagcatcatgttctaatttttttcatttcgttatttgttaggataattattttgaagaagccttaaagatgagaaatcttttggaggaatttgaccgggaccatggaattcgaccacctactattcttggagttagggaacatgtctttactggaaggtctgaaccagacatgcgtatatctatttacttattttctatcattaccttacatacttgttctgcgataatatgcagtgtctcctccttggcatctttcatgtccaatcaagaaaccagctttgtaactctaggtcaacgagtattggcaaaacccttaaagtaagttactaccaataatttttatcttccgtgaacaacttgaactcagatggaatccttattctattatttctgaattctaggatccgcatgcattatggtcatccagatgtctttgacagagtatttcatattacacgtggtggtatcagcaaggcctctcgggtcatcaatattagtgaagatatatttgctggtaaatttgattttttaattgacagttaccttcaaaactgttcgatgttttaagaatataaaaacacatgaataatgaaaagtgcaattctgagccattttttaataccaatttcttccacacatgatggacgttgattatatgcctctacggtttccaggtttcaacacaactctacgtcaagggaatgttactcatcatgagtatattcaggtccgtactttttaactctttacaattaaaataataaaaatatatatatgcattaattctgtttacaggtgggcaaagggcgagatgttgggctcaatcaaatagctctgtttgaagggaaggttgctggtgggaatggtgaacaggttcttagtcgagatgtatacagacttggccagctccttgatttcttccgtatgatgtcattcttctttacaaccgttggcttctatctatgtacaatggtatgtggaccctctttcgaatcacagtgattttatttgcctcttaccattgtattcaagttgatacctgcatccaattcctgaatgtttaccttcatatcaatacttagcagttagcaggcgatattagaaaagaagtttacaacaagtcttgcattactagtttctgtcggtcactttattttttaccttttatctggagctataactgatatgttctaagtttctccaagtatattttccaggaaatcatgctgatttattgacatttacatggccttttgcagttgacggtgcttactgtgtatattttcttatatgggagggcatatctggtaagcctggtgaactaatgttggttgtgacgcatgtgctatcttcatcagtgattattgtacgattaattcttgcatattagtactggattaaggtctttataaccctgcttgtgtttggtttatgctaggcactttctggagttggagctactattcgagaaagagctattcttctggacgatactgcacttagcgccgccttgaatgctcagtttctgtttcagattggtgtcttcactgctgtgccaatggttttgggatttattttggaacagggttttctccaggtactggttcctcaccattttagtcatatcatattgtaatgccatattttctgatatgattgacagggagactgacacgtatactgagttagctctttcatttacttgattatctacagtatacttttattggattataagtcgacttatggtcacccatttacatgttttctttctgatgttttgttgttagttagaaatttgtctctgtttaggccatctttcgtggcgcattgtcacttacagctatgcactgtattctggagatgaacttttgtaatctgaatgatcatatttgtttgttcgattatctgaaggatatccttacatttggtcaaaacgaataatttactttttgtgttttgcttgttaatagaacttaatcttctccatcttccattgtgtaggccatcgtcagtttcataacaatg

SEQ ID NO: 29509 - DNA, 3003 bp, Unknown; identical to SEQ ID NO: 24904
  misc_feature (1)..( 3003): 2750-1469P.txt file - cDNA_ID_3018493; gDNA_ID_2684211; Annot_ID_191521

SEQ ID NO: 29510 - DNA, 859 bp, Unknown; identical to SEQ ID NO: 27168
  misc_feature (1)..( 859): 2750-1469P.txt file - cDNA_ID_3018528; gDNA_ID_2684211; Annot_ID_191500

SEQ ID NO: 29511 - DNA, 3003 bp, Unknown
  misc_feature (1)..( 3003): 2750-1469P.txt file - cDNA_ID_3018551; gDNA_ID_2684212; Annot_ID_191573
aaagacgggcgggctagttgataaaagctcaataaatatgggctggtttagggttaaacagcgaggcccatttgtacaaaatattgacatcgattatttttgttttgcatttgtggatccccaggctgagattacaactcagaaaattacaaaaaaaaaatagataataataaacaacgattataatgatgattctttcaatttgttatgttagagaatcacaatgcttccacacgtgcattttatatcacaatttagattatgataatttgaacaatctgacaaataaggattatttaaataattgacttgttatgttattacaaaataggtactatgagttagacaaaaaaaaagaaatctggtggaatggcactgaatcttagatagcacgtgtcacgtcgaaatattgcgtgcaagtatacatgcgccgttactaacgctgttatagacttatagtacactgaaactgttcatatagtgctgtaatattttcgtgaacttatgaaataggttcaatttcttttgttaaaatttgggtgtcaaagcgggttaatatattttatgaattttaatagatagtgctaaaaattggggtcttaaaatagtaactataatgtcgtcgtaccattgcggagtttgcaagccgatctgcaaactcttcaaatttaaattatttttcaaattttttttcctgcttagttctttatcaaagtactaggattaatgagatcgattattaatacttattagtacagaagtataaactagtactgagtgattaaggagatcgagtgggaattggcggtttatattaataaactagtactgagtgattaaggagatcgagtatacaaattactagtgagctatttttaagatgctagtataactttatagtatatcataactgttttttcatacgaacatcggtttaaatgaagtaagttactcaaggctggcctttcatgtgtttaatagtactaaataagatagtaccagtggccggtaaaattagctagctgttatcaattgttatataatatacatgttcatttattttatgtattattagactatgagatgatatgagtacagaaaaaaaatccaataaatatgtatataaatatctagaaatgggtagataaactatttaaatgagtcactcaacgtgcctgagtttccttttcgatttaattgtcctcattgtgaattggcataaaagtcggtgcgaaggaaagccccaaattatttaacttgaaaacgaaagtttggtccacctctctatattcatttttctgaaatgaaattaatactcaaatcaattttgtcataaaaattgtccaattattaaagtattcagtcgtgtttctatatatatcactgtctttagtcagctagtctaatattgcatatttgcattcacctctatatatgtacacacacatctacgtatggagaaaacattgtacattcactacattcgtgatctcatttatctttagatggctaaaaaaaactcagatagaatatcacacttacccaaaatatactattctttcgtacgaaatcttattactagcacatgacgtgtgtgagaaaaagtacactcattggacattcaaaggtgttaatgttaaaattaacaattgggttttctaactatgagccactaaatcatcttctaaagtcaattataaattatacgtgacgttacttaatattggaaataaatattggagaacaattataagtttgaaatagaaatcataattaactattttactactccaaccatttataactacgaagctaccttaaaaaagagaatgacatgggtatgactttgcccgttttttcttaatgaatttgttactctaaagtcataagtctctaatccgtattaatagcagtaattaatggatacaaaaaaaaatcaaaaagaaagaaaaatagacagggtggcatcataatttatggggacagctgtcgaggtgatgcatttatgaccactaacatgcaatggcacggatgcaaattttaattgttagattcttctacaaaatttacttaattcaatacttctgttttcttcttcttcttcttcgtaatttaatagattctgcatattgtttaatatttattttacatgccagtgatgggttgtcattattctgattcatttttctataaaatcattataaaagtattttcaacttcttgacaaaaataggtgtttaattattactacaaagttcaggtcgattgttatttcgggctacataaaaaaggtttgatttctcgtatgggagtgattacaacatatttattggtattttatgaccccatgtcaactcttatgtagtaatttgtccccacttattgaattgttattagctcaaaggcattaattgcacggtttctaacttttcttctatagtagtatgtttttcacatttgaaaaacactaatcattttcattttgcatggaaataagaccaaatattttcattaatccactaaattgcatttgcaacacaagcccaaatcattatatatataaatataatatattattgtgatgagtaaaatatagacatgcaaagtgactatgaactactgtaattatacactgcaagaaaaacattgccataaatatgaaaacagaagacattgacagatagtaataaaaataatactatatctctaaatataattcagatgttaacgaaagtcttgtggagtaaaaactgggtttcacacacttcacttgcctctcaatacccgggaaaacaaaatgtcggtttcacttgctacttttcccggaaagttacaaagtcattcccttttcaggttgtgaagtcacattaacataagagaagaagcaaaaaggcttggagctttattttttgcttttttttttctttcttctagaaaacatgatcttgagtttccgagtaagattcttttaaaaagagtttgcaaagaacgagaaaaatgatg

SEQ ID NO: 29512 - DNA, 3003 bp, Unknown
  misc_feature (1)..( 3003): 2750-1469P.txt file - cDNA_ID_3018559; gDNA_ID_2684212; Annot_ID_191569
tatatttagaatccacttcttgattatttttatttatcattaacccaagttttcactttgtttcagattggattatcttgctggaataccctagtcgatgcaaccgggcaaactccctttagctacgctgcaatgagagacaaccacagttacaacaccttggtggctcgtaaacttgcagataaaagaaacggtcaaatatctctgaacattgaaaatgggatcgatcagattggcctgagtaagagactaagctcagagctaaagagatcttgcaacacatgtgcaagtgtggctctaaagtatcagaggaaggtttcgggttcacgtcgattgttcccaactccgatcattcactcgatgcttgcggttgcgacagtatgtgtttgcgtctgcgtgtttatgcatgctttcccaatggtcagacaaggctctcacttcagttggggtggtcttgattatggctcaatctaaggtttgttatataactaagtgttgttaattcttttggttcgataccaaaagggaaaaaaaaagtgcgatgaaggaaactgagaatgagaggcatagtgagaaaacccaaagacatgtggatcttggacattgcagagatggaatcactcactggtctttggtgagccagagagtacagagaaactggttcaggtcagagcagacatagcttcaacacaacacccaagtttttatatatttggctaattatgttttattcttgcatatgttaatttcccattctcccttaattacagtttttagttgcttaacacaaaagctgttgctattttactgaagctgttttctcctgtgtgtttattgtatctctgtagagttgtgaacgtagttgaacattgttgtaaaattgtaatgtaatacctttttggttaatcctacgtaaaagtagtattagccactacttgctaaacattttaaagggacatcttaaaaagtgaagatgattcttcacaaataaaccacaacggtcacgtgagtctcgtgctattgactactattgttgaggtcggtcaacagtgcattgccccatctttaccttcttcttcccacatttgtttgggatatttttcaatttactcactttatgaatacaaacaaaacaataaaactaatctcttttgtgtgtagttgaaagagataagatcgcagaaaagaagacgatgattcgtcgacttttctcccaacattttgaacaattagttgttatgtgtaattttctatagatagctactatctgattacgtggatcacacttctctttttattattatctctttaggtttcttatcccatataatatgatatcaggtctctttctcgagtaatacattatatatctatgttgattatttactacttgtcatttaagataagatacttaaaaatacttgttattggattttgccggaagacttaactttcaaactctattatatgtagaagatagcggactgaaaaatacgtcgaagacagatacttctattgcataatttttgggtagggactagaaaacttactcgtagtttcgacatatcatccgcaatctcaaattaattgcaaactttttgatcatatctattgaaactatctttctagcttcattaattcgttaccagcccccaatataagctatcaagtatgaatattaagatggatttaacggtgataatagtagtatgtacagtttcttttgtcaacagctgataaaaaaaatgaaagcttctaacagtttgagcctaaagagatcatatatgtgaacagtttcacacacacataagccgtacaactaatatagatatcactttgaccgtaaaaatctaacagtttagatcacacacacacaatcttgaaactagtttaaagcactttcagcgaaaagtactcactagatgataagaactctttggcacgtaacagacgctttcgaaccctacgatttcaagaggtggcttatgtacggtccactcaacttcttcatccgacggtctaagattggtcatgtgggttgaactaccaaaagggccaaaagcgtgagccacgttacattataaaagattttgtctttttaatccaacggttcacaccagaatctccaattcggttctgtctcctctcgtgtcggtccatctctctggctcttcacctctagccacgtgtttctaattttgaccttttaaaattttaagaaaaaaacaaattatttcttgtagctaaaatttagcatccaaattccaaactcagagttctcttctatggccgtatgatacttccaataatccgtatgtatgtgaatatcataatctatcacaaacataatgaatagtagtagatattaagacaatcaaatttggtagaaaaaatatcttcctacgttgggaattatgtaggaccgaataatatagtcggctaattcgatattttgtcgcgaaccacgacataaaattatttatcatcatttgtgaacaataatgattcaaaattatcaataacaccaccttttttttttaagttcctttacttctggggtctctagagacccacacatgtgcacaaaatatacgtgtgtctctcatagactttaaagcaaaattagagaacacttatttttagccaaaaaaagtaattaaagaaaaaactatataaaaacagtttaaaaaggggatgatattaaatgattttcatgtgaattataaaacgtattgagtattatcgtgaccgacttcaaaaaacaagaaaaacctcaacttctctttttcagctatagccgccgcctcctcccactaaactcaaatcctctcatagtcttttcaatcaaatctgctcttcttcactgttgaagctggctatcaaaactcacaataactatggtgattgattgattctctttcttacttaactctgttttagtttctttgcaaattcttatattaaccatttggaactggtctaaacattcttcagggaccgatg

SEQ ID NO: 29513 - DNA, 3003 bp, Unknown; identical to SEQ ID NO: 29512
  misc_feature (1)..( 3003): 2750-1469P.txt file - cDNA_ID_3018559; gDNA_ID_2684212; Annot_ID_137372

SEQ ID NO: 29514 - DNA, 3003 bp, Unknown; identical to SEQ ID NO: 27169
  misc_feature (1)..( 3003): 2750-1469P.txt file - cDNA_ID_3018563; gDNA_ID_2684212; Annot_ID_191568

SEQ ID NO: 29515 - DNA, 3000 bp, Unknown; identical to SEQ ID NO: 14701
  misc_feature (1)..( 3000): 2750-1469P.txt file - cDNA_ID_3018571; gDNA_ID_2684212; Annot_ID_191565

SEQ ID NO: 29516 - DNA, 3003 bp, Unknown; identical to SEQ ID NO: 27174
  misc_feature (1)..( 3003): 2750-1469P.txt file - cDNA_ID_3018575; gDNA_ID_2684212; Annot_ID_191563

SEQ ID NO: 29517 - DNA, 3000 bp, Unknown; identical to SEQ ID NO: 14690
  misc_feature (1)..( 3000): 2750-1469P.txt file - cDNA_ID_3018579; gDNA_ID_2684212; Annot_ID_191562

SEQ ID NO: 29518 - DNA, 3000 bp, Unknown; identical to SEQ ID NO: 14684
  misc_feature (1)..( 3000): 2750-1469P.txt file - cDNA_ID_3018588; gDNA_ID_2684212; Annot_ID_191556

SEQ ID NO: 29519 - DNA, 3003 bp, Unknown
  misc_feature (1)..( 3003): 2750-1469P.txt file - cDNA_ID_3018634; gDNA_ID_2684215; Annot_ID_191656
gaagctgtggctttagttgaacggatggttgtgaaaggttgtcaaccagatctggttacttatggtgcggtaattaatggattatgtaagagaggtgaacctgatttggctttaaatctgctcaacaagatggagaaagggaaaatagaggctgatgttgtgatctacagcacagtcatagatagtctctgcaaatatagacatgtggatgatgcactcaatctgttcactgaaatggataacaaaggtattagaccagatgtttttacctacagctccctcataagttgcctttgtaattacggaagatggagtgatgcttctcgactactcagtgatatgcttgagaggaaaatcaatccaaatgtagtcactttcaactcattgatcgatgcgtttgcgaaggaggggaagcttatagaggctgagaaattgtttgatgagatgatccaaaggtctatagatcctaatattgtcacttacaattcattgatcaacgggttttgtatgcatgatcgtctagatgaggcccagcagatttttactttgatggttagcaaagattgtctgccagacgtagtaacttataatacacttataaatggattttgtaaggctaagaaagtggtggatggtatggaacttttccgggacatgtctcgaagaggattggttggcaacacagtcacttacaccactcttatccatggattttttcaagctagtgattgtgataatgcccaaatggttttcaaacagatggtttctgatggtgtgcatcccaatattatgacatacaacactctgttagatggactttgtaaaaatgggaagctagagaaagcaatggttgtattcgagtatctgcaaaagagtaaaatggaacctgatatttacacatataatattatgagtgaagggatgtgcaaggcagggaaggtggaagatgggtgggatctattttgtagcctcagccttaaaggagtgaaacctgatgttatagcctacaatacaatgatctcaggattctgtaagaaaggtttaaaggaggaagcatataccttgttcataaagatgaaagaagacgggcctcttccagatagtggtacatataatacgcttatcagggcacatctgagagatggtgacaaagcagcatcagctgaactcatcaaagaaatgaggagttgcaggtttgctggcgatgcttcaacttatggcttggtcacagatatgttgcatgatgggagattggacaaaggatttttggaagtgctttcttaaggtcgatcagcttttcatgttacttttatattggttatttctaaacgcagtcattatgttctcatgttacatgtgtatgtagatttgaatagcagtagctattgtgtataagcttcttgaacatgactgaagttgtttgtcatttacctgctaggttgcaaacatgagttgatctaaacgctcattgatgcaagttcaaggttaattcccggccgggatttgtatttttgtatgttcattgcatttgcacacggaaacatacaagaagacagggatattgtgggtttagtttcattttagaaggttacatatgtgtttccttagctgacagatactatattgcagcaaatttggtgacattccaaagaaaatatgacaaagaatctgtcagttttcggagtaattagtcaatgtttgtctcatttctatgttgttcttgatctacacaaaagaatcaactttcatggatagaagaaagtctttcaaaataatcacggaagtcgggaagaaagagatctagtacagtaactcatcctcggaaattccggtcactggaaaaagtttgggattggtacaatgccttctgaaactttcttcaaagactgaaagttccgagattgggttgctatgttggatctctgtcttctcaacttcatgtgatcattttatacctcacaagcattgagaaatatgaaagatatatacttactattttcttctgttttcatgaaagttattggtttttgtgttgactaagaacattgaggcaaccattgcctgatattaaagacagatagattcttttttctccttttttgaccgaacacgcttcagaagttttagtagcagcaacaacggaggattctttttgatgtagctgacaactttgtttcttttagtattgagctctttcgtttatgtctttgttttcttattgatgggtttttgatggtacagttctcctccctttccttccactattgattgatttcagtatacatacggttgctgttctgtgtaagcttcatgaagatgactaatattgtgcatttgtgtatttcattgtcaggttaacacaagatcagtggtgagcatcataagaagctcttcccttcatgaagatctcagacttggtttgacatatgattattgttctacagtagatttgttttttaaccacagttggttctgtttcttgtacacaaactttttgcatctgtttctagtagtaatataaatgaaacatgtaaaccagctttagttcggtaaaaattagtgaatgacactatttttggacaccttttagtttggtaacaatctaaaagtcgaagcgaggttctaagtaagttggtagcattgatgtcttcatgtagtgttttagatctcatccttaatggtttaatttaggttcaattcacggggcacatagttcatcgatttgttgattaactaactagggtgaaaatgctaccaaaacacagctctggtggtttgatcatagtgctctcgatgtttttttttcccctgaaagtcaatctccggtttatctataaaagagaaaaaagttatgaccggtttaagaaaaccagctgtaaccgaatcgacattgaaccaactgctctcgattatagggtttactggattctgcgattttgctgttagtgtagtagtctcaactcattgcatggggaagccattttcgaagcaaccaagaagatg

SEQ ID NO: 29520 - DNA, 3003 bp, Unknown
  misc_feature (1)..( 3003): 2750-1469P.txt file - cDNA_ID_3018638; gDNA_ID_2684215; Annot_ID_191653
gtatttgatatgatcttgttaaggtttggttccggtttgattttttcggtttatgatccatttataattcggtttgattaatgtaactctatatcggttcggttcggtttttgtttgatgcatttcggtttcgtgtttgtgtgataaacatttttccaatgtaaaatatcatatgaagaataatcatatatttacttttttatcttgttgtaattttgaagagaacactaaatacatatattatgcttcgttaaatacttatgtgcttattaactttttatgtttacttaattacgttggtacgttgtgtgaactgctctctcctgcttcgttctttgctttcttctttacttcctctttccttgcttcttcttcttcctttattgcttcatctctagctttcttcctttcctttgcatcaacaaccgcttttcgcattatgtctagggcagtttttgatttctcaaagacatcatcccccatcttgtctacctcgtcaagatctcgaagaaaattaggatctgaatttgtacttcgtataactcccacgcgatatgcaacatgtttagctgtgttgatgatttcctccatttgtgaaaggatcgggtttgtcacggctttaaacgcttcgtctcccaaatctgtgttagtggctttcatgtaagctgtatagaaatagtctacattcgtccttgctttcttggctttggtgtttatctctgtataaatagattgcatcttaagaaccaaaaacaaaaaagagttattgagttttttatataatacgaataagagctagctagagagaattgtgatgatgcacatcctatatatatacacacgtttaacaacttgattagcaagttcaataactatcgcaaaagtgctttattcgctcataagtcataatcaacctcccaatttttttttaacaaagtatagtttatgtgtacacgcttaattaagccaccctcccaagcttagtgtttttttcttactttttattcatcaaactcaaaggaaatgaatgatctaattcaaaactaattatacaaatggaattccacaatgcacaatgaatggttaacgtgggagggaattatgtacctttatatcgtttaagaacaatccttttaagatacaattattttcttatttgcatttggtttagctttcatgcaaagtttattttctttttttggataacgacttttatgcaaagttctctattaatatagctcttatcctgttatatcatctgtatattgtagcatgatttcttacagagcacatgataacaatccaaaataaatatatgtgtatatttgtgctaagtgtatctatatataattatatattattcattaatatatatgttaatatctacttttatgtgtatagtttagattttgtacatagattcagatttgatttttagtctagtgattaactagattatgttcatactattttagtgtttcctagaaaatcattacaacccaaatacttatctaaacatcttaagatagagttttaagatgttaaacctaaaaggtcctagtgttaatgaatgaaaaatatcaattattagggaaaagatactagaaattatatacatcttgaattaatcattaccattagattaaaatgtatttctaaatagtttccaaatatttaccctatttcttattcttatttatcagtaaaattagacaacattttgatacaaaaagaaacacattttgcccatctttattaataggcttattaaaaaaaggtttattaaaaagcccattatatttgctagtaaagcccattagttttgaaattttgtaagctctttatgtttgtgaaatcttgcttatttgtttcatagctattctttggttgcgaattttgttgaaccttaacctagtgtggaagcaatgccggaacctctaattttttgttaacgcaattcaagaaactctaggaaggccagaaactctaatttcttgtgaatgcaattttacacaagtttcaataaaaaaaaattgatgcttagtttcgatttctggtatgttccatgaatattgggttttttttagacgttataaaatgtaaaacttcaaaaaacattgacatacgacaattgaataaattgaattagtattggggaagtattttgcgtagaaaaatggtacatgtaaattattggtataataaaacaattataaaaagatttaaggggatgcgtaagaaaatcataaacaatcattcttactaatatagagaaggaattagtaaatatatttcacaaaactggcaatatttattaatgacagataaatttagtaccctaaatagttatttggactttgtacaatgatcatttgtttttttactgcgaatgtgtcatagtctaaaaaaaaacaatgtcattttttggtgggtgtattaaaaaaagtcgttgttggctttcccaatcagaagtcattgatgtccgtacacacccaacactctcttctttcttcctctctcccaacggtcatatttctccgacaattcacaaacggtcaccaattttctaccgtttgattttaaagatccaacggctcagatagattcagatccctcgtgtaccactcactctgcccaactctaaaaaacaattactgtaaaaagaaaagtcgccaacttcaattctcgaagacccaacaagaaaacaaactctaaaaagttgcctccactatggtatttgtagaagctgtatagtatctcttaacccctgtagagagttagagagagagagagagagagagaaaccaaaagtgagtgagagaaacagatagaagtgagagtgagagtgagagagagagtgaagaaagtaacaatctttgagagtttttggatcttgatcttgtgtttcagtaatctcctagtgattgtctgatctgggttcttgttgattttgggtttctggatgttctgagagatttttcttgatttggcaaaaccagaatg

SEQ ID NO: 29521 - DNA, 3000 bp, Unknown
  misc_feature (1)..( 3000): 2750-1469P.txt file - cDNA_ID_3018646; gDNA_ID_2684215; Annot_ID_191651
acaatcactaggagattactgaaacacaagatcaagatccaaaaactctcaaagattgttactttcttcactctctctctcactctcactctcacttctatctgtttctctcactcacttttggtttctctctctctctctctctctctaactctctacaggggttaagagatactatacagcttctacaaataccatagtggaggcaactttttagagtttgttttcttgttgggtcttcgagaattgaagttggcgacttttctttttacagtaattgttttttagagttgggcagagtgagtggtacacgagggatctgaatctatctgagccgttggatctttaaaatcaaacggtagaaaattggtgaccgtttgtgaattgtcggagaaatatgaccgttgggagagaggaagaaagaagagagtgttgggtgtgtacggacatcaatgacttctgattgggaaagccaacaacgactttttttaatacacccaccaaaaaatgacattgtttttttttagactatgacacattcgcagtaaaaaaacaaatgatcattgtacaaagtccaaataactatttagggtactaaatttatctgtcattaataaatattgccagttttgtgaaatatatttactaattccttctctatattagtaagaatgattgtttatgattttcttacgcatccccttaaatctttttataattgttttattataccaataatttacatgtaccatttttctacgcaaaatacttccccaatactaattcaatttattcaattgtcgtatgtcaatgttttttgaagttttacattttataacgtctaaaaaaaacccaatattcatggaacataccagaaatcgaaactaagcatcaatttttttttattgaaacttgtgtaaaattgcattcacaagaaattagagtttctggccttcctagagtttcttgaattgcgttaacaaaaaattagaggttccggcattgcttccacactaggttaaggttcaacaaaattcgcaaccaaagaatagctatgaaacaaataagcaagatttcacaaacataaagagcttacaaaatttcaaaactaatgggctttactagcaaatataatgggctttttaataaacctttttttaataagcctattaataaagatgggcaaaatgtgtttctttttgtatcaaaatgttgtctaattttactgataaataagaataagaaatagggtaaatatttggaaactatttagaaatacattttaatctaatggtaatgattaattcaagatgtatataatttctagtatcttttccctaataattgatatttttcattcattaacactaggaccttttaggtttaacatcttaaaactctatcttaagatgtttagataagtatttgggttgtaatgattttctaggaaacactaaaatagtatgaacataatctagttaatcactagactaaaaatcaaatctgaatctatgtacaaaatctaaactatacacataaaagtagatattaacatatatattaatgaataatatataattatatatagatacacttagcacaaatatacacatatatttattttggattgttatcatgtgctctgtaagaaatcatgctacaatatacagatgatataacaggataagagctatattaatagagaactttgcataaaagtcgttatccaaaaaaagaaaataaactttgcatgaaagctaaaccaaatgcaaataagaaaataattgtatcttaaaaggattgttcttaaacgatataaaggtacataattccctcccacgttaaccattcattgtgcattgtggaattccatttgtataattagttttgaattagatcattcatttcctttgagtttgatgaataaaaagtaagaaaaaaacactaagcttgggagggtggcttaattaagcgtgtacacataaactatactttgttaaaaaaaaattgggaggttgattatgacttatgagcgaataaagcacttttgcgatagttattgaacttgctaatcaagttgttaaacgtgtgtatatatataggatgtgcatcatcacaattctctctagctagctcttattcgtattatataaaaaactcaataactcttttttgtttttggttcttaagatgcaatctatttatacagagataaacaccaaagccaagaaagcaaggacgaatgtagactatttctatacagcttacatgaaagccactaacacagatttgggagacgaagcgtttaaagccgtgacaaacccgatcctttcacaaatggaggaaatcatcaacacagctaaacatgttgcatatcgcgtgggagttatacgaagtacaaattcagatcctaattttcttcgagatcttgacgaggtagacaagatgggggatgatgtctttgagaaatcaaaaactgccctagacataatgcgaaaagcggttgttgatgcaaaggaaaggaagaaagctagagatgaagcaataaaggaagaagaagaagcaaggaaagaggaagtaaagaagaaagcaaagaacgaagcaggagagagcagttcacacaacgtaccaacgtaattaagtaaacataaaaagttaataagcacataagtatttaacgaagcataatatatgtatttagtgttctcttcaaaattacaacaagataaaaaagtaaatatatgattattcttcatatgatattttacattggaaaaatgtttatcacacaaacacgaaaccgaaatgcatcaaacaaaaaccgaaccgaaccgatatagagttacattaatcaaaccgaattataaatggatcataaaccgaaaaaatcaaaccggaaccaaaccttaacaagatcatatcaaatacgtcgtcgtttcatctgagtcgtctctcttcactcgccggagagagagaagaagaaaagacgacggagaaatg

SEQ ID NO: 29522 - DNA, 3000 bp, Unknown; identical to SEQ ID NO: 14707
  misc_feature (1)..( 3000): 2750-1469P.txt file - cDNA_ID_3018678; gDNA_ID_2684216; Annot_ID_191688

SEQ ID NO: 29523 - DNA, 3000 bp, Unknown; identical to SEQ ID NO: 27195
  misc_feature (1)..( 3000): 2750-1469P.txt file - cDNA_ID_3018701; gDNA_ID_2684216; Annot_ID_191680

SEQ ID NO: 29524 - DNA, 3000 bp, Unknown; identical to SEQ ID NO: 14715
  misc_feature (1)..( 3000): 2750-1469P.txt file - cDNA_ID_3018719; gDNA_ID_2685560; Annot_ID_193456

SEQ ID NO: 29525 - DNA, 3000 bp, Unknown; identical to SEQ ID NO: 14715
  misc_feature (1)..( 3000): 2750-1469P.txt file - cDNA_ID_3018719; gDNA_ID_2684219; Annot_ID_191770

SEQ ID NO: 29526 - DNA, 3000 bp, Unknown; identical to SEQ ID NO: 14716
  misc_feature (1)..( 3000): 2750-1469P.txt file - cDNA_ID_3018727; gDNA_ID_2684219; Annot_ID_191768

SEQ ID NO: 29527 - DNA, 3000 bp, Unknown; identical to SEQ ID NO: 14717
  misc_feature (1)..( 3000): 2750-1469P.txt file - cDNA_ID_3018731; gDNA_ID_2684219; Annot_ID_191767

SEQ ID NO: 29528 - DNA, 3000 bp, Unknown; identical to SEQ ID NO: 14718
  misc_feature (1)..( 3000): 2750-1469P.txt file - cDNA_ID_3018735; gDNA_ID_2684219; Annot_ID_191766

SEQ ID NO: 29529 - DNA, 3003 bp, Unknown
  misc_feature (1)..( 3003): 2750-1469P.txt file - cDNA_ID_3018739; gDNA_ID_2684219; Annot_ID_191763
ccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgcatggacggaagagaagcaatggcatttccaggctcgcattctcagtactatcttcaaagaggagcctttactaatctcgcaccttcccaagtcgcgagtgggcttcacgcgccgccgccacatacgggattgaggccaatgtctaaccctaacattcatcaccctcaggctaacaatccaggacctcctttctcggattttggacacaccattcacatgggagtggtctcctctgcttctgatgctgatgtgcaaccgccaccgccaccgccaccaccagaggaaccgatggttaagaggaaacgtggacggccaagaaagtatggagaaccgatggttagtaataagtctagggactcttctccaatgtctgatcctaatgaacctaaacgggccagaggtcgacctcctggaactggaaggaagcaacgcttggctaatcttggtgagatctcgagttttctattctgtgtactttgtcaagttaagtttttgctttagctctgttagctagtcttgaaggacatgagcttgaatcttatggatgctagaagctttgaatgattctatagttaagttaggttttgttactttgtcgttactgatactcaatattgattgttggctattagtttgacggatctatgtgtggtacaatgctaggtgagaggagtaattggttattagtagatgtggacgaaatcgacttcttgatttaagttattgatttaggtttttaagctgtgaaagagtaatcttactaatccattcatgtttaagtaattggtcatcataatgtgattaatcaaactttaagtaatagcaaactcttgactctgataatttctttaggtgagtggatgaatacttcagctggacttgcttttgcacctcatgtgatcagcattggagcaggagaagtaaactgaccaaaactcctttatatattaatgatcatttatgcagcttttcattgtatcaatttccttttatttttctttgcaggacattgctgcgaaagttttgtcattttcacaacaaagacctcgggctctttgtataatgtcaggcactggaaccatttcttcagtcactctgtgcaaacccggttcaaccgatcgtcacttaacatacgaggtttcaaagtcgttcattcagttaatcgaaaaagaaaaacctgaaaagatttcttatttaatcctctttctgtgtttcttagggaccttttgagattataagttttggtggatcttatttggtgaatgaagaaggtggatccagaagtcgaacaggcggattgagtgtctctctttctcgtcccgatggtagtattattgccggtggagttgacatgcttatcgcagccaaccttgttcaggtatattaaattcttcttcttaatggttgtaaagtgaagctaaaacgaggcgaaactaactacgaatgttagcctttgatatgtttgtgctgtcactttctttcctcttcaagatatcatgtggtagtgtttgaaaaacttgtttgttattcaggtggtggcatgtagttttgtatacggagcaagggcaaagactcataataacaataacaagaccatcagacaagaaaaggaaccaaatgaagaggacaacaatagtgaaatggagaccacaccgggtagtgcagctgaaccagcagcatctgcgggtcagcagacgccacagaacttctcttctcagggaataagggggtggcccggttcaggctcaggctctggcagatcacttgacatttgcagaaacccactcactgattttgatttgactcgtggatgatatacactattagtctttgaagcagcagcatacaaaatgtgattgctgtacatatgttattgtagatttctctctgggaatgttgaaatcagacatttaaggattgatactagatctctcagctccttctaacattgttaatgtaacagaaccctcccactttcatgctattttaggagatttttttaactcttttatgatctcattgtggtcatcaagaacttggtttctttactagttcactatttttctttcaggttctttaacatatttagtaaacttgattcctcttatttggtagacaatgtgtaattcaacacacacaagatttaggatccttaatttataggaagatgacaagctcataatttatacatgaaaagcattaaatattaatgaatatatatcctcaaattgacttaaatttctttttcagtcagaaatctaatgagacattagattttgttataaaccattgaagaaagtctatatcctttttaataaaaaaaattcttaaacaacccaatttattttttttgtaaaccaattgaatatttttttttgacaaaattaattaaagaaatagtatataaatagaaacaatggtcttcacttcctttctcttctttttttttctttccttttttttttctgagatttgctttctctaccagagagactgtaacagtagtagtagctacttttgcttgttgtcttcatttcaaatctgcaattttactttctttttgagttctaagtgaactcaacatttagcttctttttcttttctaggtttcataaaaacagtttggatcttaagctcacagctgaaaataacccgactttgattactgggtatataaaagccgccattgttgttcttttcactctttgggttattagggtttacgatttctgggtggtagataaatttgttcttcaaaaaagtttccttttttaaaaaatctcttagattcttaaagaattgtaatttagggttttaaatgcatg

SEQ ID NO: 29530 - DNA, 3003 bp, Unknown
  misc_feature (1)..( 3003): 2750-1469P.txt file - cDNA_ID_3018743; gDNA_ID_2684219; Annot_ID_191762
ggagatattagcttagatcttagatttaaagcttgtttcattctttgatgttttattcaagtttaacacatttaccattgaaatttgtattcttattcaattatagatttatagtatgtatttgttgatatctctcactttttaaactcaacaaactctaccaaaatcaaactaccagcagctattagaattttgaactattgttggaccaccaatgtgtgaagagaatcatatctcttaatccccacaaattcatgagaaggaaaataaaaaagcaacagttgagatcactttccttacaagaatcagaaagagacccacttttgatgacatcatgtttcagagacccacaatcatatctctctatatatgtatgtatcataatgtgtgtatatgtgttgtgaagtaataagtaagggactttcatagaaacagagccttattgtaccttttgagacaccatcctcaagctgaaagcttccttcaacactcttcttccatttttgaaaatctatctagtacatttattgtgaatttcacactgtccatatcttgtttatttattaaagttattaatgttacatgtagatgaaatggactgatttgtgtatgtttatagctatttatgtaagaagaacaagtaaaatattgtataagttcagtaatggtcggcctcaaatttttcctatcatgaaatttctaagtaaaaaaagacaagtcacattactttaggtaaaaagttggcaaaacaaaaagtgaaagaaggaaagtcaaaactctttattttattgtcaaaagtcaaatgtgtgcaaatgtaatattgttgacattaaacaaaacaaattaatgtaaagattattcataatggagtagcaaaacaaatctaattaaacccaaaatatataatatatgatatatctctagaaaacttttatttatatctagcaccaaattttgactatttggattttttggtcgggtactttagccaccggatattaaatgcatcatacaaactttcaaattaggtggaaacaaaatatatgtacgtatatatatatatatatatattaataaatcactttcaaaacttttaaaagaaaataaaaaaaaagaattttagataaaaagtaaaagagaaaaaggggaatataaaaatggaaaacaaataaagttaggagagagggctcactgtccgaagcaaagaaagaaatagcaaagtgagttagacatgtgagagagaagagattcaagtgtgtccccattctctttcctatcctttagtcaacaacacatctctctcatatttggatatttctaatcaagatcaaactttttacaacaagatttgattttttttgttcttttaaaatcttaatttgaattaagatgatatgaagtcatttcatactagtcttgcctcttgtcaaagtgtaactgaatgaaatttcaagattatatatttataagaaaacctaaaatttttagatatattttgaaataatcttataattatctatactaattaaaaataaattataaatatattatagagcagttgaccaaaaaaaattacagataactattgaagatatatagacatgattagttgaggtgtagaaagtttgtaaagccactaaaatagctccaaaattgaaataatcatgttgtagttttttcttttttctagcaagaataatatatttttgattattttaaaaggtttgtacatttttctctttttattttcactttatttttttagtttctttagaaacattattatacttttcatatatatatattgaatttatcttcaaattttgcatacatattttacccactaaacatgattccatataaaaacggaaaaagtgtgtcacagaagaaataatatattacatgatataataatctaaaatgtcaactgttttctttagaatatgttagaaaagattttttttttaaatctttattggtagcaatgtttatgagaataaagcacataattgtctctcaatgactaataaatttcggtttcagtcaaagatctaacgagatattagatttgtaataatcatcaaagaaagtctatcctttttattaaaaacaaatattcttaaacaaactaatactttaaataaactattcttaaacaaactaatacattaaatattcttaaacaaactaatacattaaatattcttaaacaaatattcttaaacaaactatgcttaaatctttcataataatctttctctcaattgaatttatctttcacaaaattaaataacaaatcaattaaagagatatataaatacgaaaaacaatggtcgtcactctcgttcagcttctttagttttcttctaactttcagagaaagacctctctcaattcaaaagttcacaatattaaaagtataaatcagaatcattaaactgttagtctctctctctctctctctctctctctctctctctctctctctctctctctctctctctctctctctctctttttctcttcttctccctgaattgtctcatctgtcttcttcctttgtctctcctctgatatacattgtgttctccttctcagaaaccctagatttctctcaatcaaatctagcttttctcttagggggagatttgatttttttctctgcaagactgtaacagtaggagaagctactttcctctgttttcttaatttcaaatctgcaatcgtactttttcgagttctataagtgaactcagattttagctttttttttttagggttcataagaacaaattggattttgagctcacagtataaataacccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgcatg

SEQ ID NO: 29531 - DNA, 3000 bp, Unknown; identical to SEQ ID NO: 14713
  misc_feature (1)..( 3000): 2750-1469P.txt file - cDNA_ID_3018751; gDNA_ID_2684219; Annot_ID_191760

SEQ ID NO: 29532 - DNA, 3000 bp, Unknown; identical to SEQ ID NO: 14723
  misc_feature (1)..( 3000): 2750-1469P.txt file - cDNA_ID_3018768; gDNA_ID_2684219; Annot_ID_191755

SEQ ID NO: 29533 - DNA, 3003 bp, Unknown; identical to SEQ ID NO: 24799
  misc_feature (1)..( 3003): 2750-1469P.txt file - cDNA_ID_3018790; gDNA_ID_2684219; Annot_ID_191748

SEQ ID NO: 29534 - DNA, 1696 bp, Unknown; identical to SEQ ID NO: 14712
  misc_feature (1)..( 1696): 2750-1469P.txt file - cDNA_ID_3018798; gDNA_ID_2684219; Annot_ID_191746

SEQ ID NO: 29535 - DNA, 3003 bp, Unknown
  misc_feature (1)..( 3003): 2750-1469P.txt file - cDNA_ID_3018798; gDNA_ID_1974096; Annot_ID_180710
tgattcataaaacataataacctgataaatgaagatttgtacatttatatcaacgtgaacgtctgtgttttcagtaatttcttaaatagtttttctttgctgattatttttttcgttactttcctaaaagatatgtcatctagttacactgtggtcatcgtgaacacacgcaaacattagattctgtagcctatagtctccggctctcagctcaaaaagggtcattttgacttttgcttaatatatataatttgactataaaaatgtagtgaaatactacaattctggacagtacttctaatgcattggacaaaaaacaaaaaaacaaaaaaacaaactaaatatacacctcattttgttacacatatgacatattaaccattagctagtacacaactaataaatctttcattataatatctaacgccgcagatgatgatgcattgttttatcgagactgaaaatataaataaattcttcacacaatagaaataaaaacaaaatattgaaaaagtaaaatgaaagagatgctcgcattaattgcacggaacagagtctactgttgataaaaaaaaaaaagagtgatcgaacagtccattttttggggtccagtttatttaatttagcattaataactttgtcagcgcgagccactctctatgattttgattccatcataaattataaaaccaaccaaaattcatatctaaattaattcctttaacccattcaataagctttgcttataattctgagacctgtataaattcgaattattgaaagtgcctaagaattcagagtcactttgaatgggacctctcacgtaatgcctgtatgttggatcttctgtcattgtcttatatatattgtctttttccatcataaaatagattgtctttttacgtatacgtacacaaacaatagatttccatttgaattcacatattacatatatatatatatatatacgtgtttaacttagattctattcagtagtttcggatttttagctatgttccatcaaccaaacattttgatttacggtagttagataaaattgacacacacacacacaaaaaaaaaacaagaaactgatcaaaatatgaaaatgtaagcacaatgtaactaaaattcgtttatacgtctaaaacaagcaatagatactaaaatacaacttgttcgttatcaaatgttttttttgcataagagatatatgcaactatttaattaactcaatctttttcactagaatgaattaaggatattgaaaaacagctaggtacgtagtcagggttgtttgacaaattgaattccgttaaaattattgaccacgtgtatggtcataaacaaattatgaattcatgattcgatcaatattacgacctactacatatgatatgatgttgtaattaaccacattctcttgctttttatctcattaaaatttatttattttaattcattattttataccaccactattttccacgttctatggatgatcatagtggagccacgcatgaacatggcaaaaatagaaatatgcacatggcaatatatatacactatctacgtatgtgtcaatcagggcaatccaactttgttgtggtataaactctaagctcgaacagatccgaagatattctttcgttctctgacctgattaatgatcacgaagctaaaattgattatcttttatttttgtttataaattattagttatccttaatctgaaatcattttaacaaaaattttactgaatttaatcataaaaataggcttatgtataagctaacacatattttccaatgtccattattatttaatggtggaattcgatgtttaacgatatgattcaagttataaaaaaaccgaattaagtatctatttgtttctataataaaattctgaaatccaacatctctaaactatatactgcattatataataaacagatcatatttatttgaatagagtagctaagattaggcatactagttcaaatgtttgatggacatccgatccagttagtccgggccttcaatatttgggctcaaatgggccgaaactatattgggtcgtatatgaaaagttgaaatatctccaaactgaattttggatgggaaaaagcgggaagtcgagagagtaccttatttctaattttctataacgagggtagggcccaccaagaccatatagcgtaaagcaaaatcaaaatcaaacaattaggaaaaaaacataattttctcttttttcgaaattcgaaccgtaattagccttttgtttttcttggaatctaaaagaaataaaagagaggaaaaaaaggaggaacagtgagcaaaatcgtgcgactgggaaaaatttcgaatttttttctcttccggcgagggattcaaacttccgcctccaatttctcgccgtgaatctgagttttttttttccgtagcatttcaataggagcagtcttcattctccgtcgtctacactatagagaggtttatctacaagcttcttcttctccttatggcgttttaggttcgtatcgttttttttttttttggccttcgtctctgtgttacaaaagcgttgttggcttcttagggtttttgactggatctgcgtgattttggtggaatatagagctgattttatgggttgatttggtcgacattgtggatatttgctaagcgagatgttgaaatgtttgaacaaacttcatcattgtttacaatttaaagcaaattttggctgtttatctctttaattggggaactagtcttatctgaaattgaaagcatttgataggtattttaccatatgaggatttggtgtagaatgatgaagtaaggtctttcatgatttaaccatggattaggaattaggaagtatatgtgaaaccaattaacattgatgctaactttgttgttggctaattggttcatttgctttagggtcttctcgctactataattctgggagtcgcgtaatctctgagttgaaatg

SEQ ID NO: 29536 - DNA, 3003 bp, Unknown
  misc_feature (1)..( 3003): 2750-1469P.txt file - cDNA_ID_3018826; gDNA_ID_2684220; Annot_ID_191825
cttacagaattcagttacgacttagacaggtccaatgcacagacattcgacattgcagactctgctcactcaggacttgtcaacactgtcaggctagacttcaattccaaccatggaagctcttcacacacttgcatctaccgcttcagggttcatggccgtgaactagactcagtctctgttgctcatgcttgatctgaaagtccacgtcaaacttttcttctctttgtaacattccctctaatagatatctctcttctttttttgtgttagtttatgtggtgggaaagcttctcttagtctgtaatcagaatcatttggttgtattcgtgattattagcttcaaatctgttttggttcggtttatttggtcagggtatgtatcctccgaattgaataatatagatcttagtttgatgtccggttttggttttgtaacagagtttcaatttaagctttcacctaaaacaaatcatacaaattctaatagagtatacatatttcattagttgaaacaaatattgaatttggattattaatggttaccttgggtacttggtattacaacgatatgtgatgaataggaagagtgtgtatatagatggaccataacttgttagtgtgaattgcgtaatcgacaaagtgacgacttcttcttctaggctgcaccgtcttgccttgtctaaaagcttcccaacacatcacatgcaaaatctacggtcaaataatagatatgaaaccctcttccaagtcaacacagcttgtttgattataaattaaattaaatacaaattcatctttgacatgtctgattaatgttaattttttacagtgtcaactggcataacaaattgagctaaacaaaattaagctctaaaaatagccattttttacggttaaatcacatgaagaaacctttcctaaccaagtcaacccatgtttggtcgtcgtgacggtggaccaccggctccaaaaaaactcttcatttgaccaaaacgagtataacccttaattattagaccaacatgcattacataaatgataaattcagtttccctcgagcccatgcattcattaaatagcagaaagctcctcgtatagtctatatatatagcagattttagatccaaaataacaaacaccatcaatacacaaacaaaacaaaaaggatgaaaatgcaaacactaaacttcacttcttctctcttgttcttgtcttttatcttcctctcatgtgctctgcttatctcatcacaacaatctccatcacagccacattctgagcctccgtcacagctaccttttgagcctccggtagagtcaccattcttccctccgtcacagccaccaatattcgtgccaccgtcacagccaccttctttgcctccgtcacagtctcagtcaccttctctcgcttgcaagtcaactccataccctaagctttgccgtacgatcctcaacgctgtcaaatcctcaccgtcagatccttaccgttacggcaaattcactataaagcaatgcctcaagcaagcaagccgtctatccaaagtcatcaccagttacgcgcggcgcgtggaaagcaaaccaggctcggccacggccgaggaaataggggcggtggcggactgcggcgagttatcggagctgagtgtgaactaccttgaaaccgtcacgacggagcttaagacggcgcaggtgatgacggcagctctcgtcgagcatgtgaacagtcttctcagtggtgtagtgacgaatcagcagacgtgtcttgacggactcgtggaggctaagagtggtttcgccgccgcgattggttcgccgatggggaatctcactcgcctttacagtatctcgttaggacttgtgagccacgcacttaaccgtaacctgaagaggtttaaagcctccaaagggaagattcttggtggtgggaactcaacctatcgcgaaccgctcgagactttgattaaggtaattaattaaaacttgtttctaattcttttcttttttcgtttttgtttgtttgtttatactagcttttatacattcctttacatattattataaagttgttaataatctagttgtaaagacattacatatttttgaaatggttggcatagagatataagaataggaatttggggaaataccaaaaacattatatatatatatatatatatatgccttcttatcataaatccttagaaaaaatcaaaacagagtttttaaatcgatgatttataataatttttgtatggtcaccactcaccacaattcaaacatgaataatgaaaggttatgcaaaagcctttttggacatacatgtatgaatagataagcatcgtaggaggacatatactaagttaaatatggtatgaatttactactttggacgcacggaatgatttaatattcgtgcatatctaaaattttctagatcgagtcataaatggatgtgctcttgttttgtgtgtgtgagccagaacacgcgtaagagagtaaatggcacatggcctacgcacattttagtacaactcaacaatgatcaaatgagtcctatctttgactttaacaaaagaaatcaatttggtccccattcggatccaactgtattcacgtgcataagagtgtcccggtcatttcatgtgtggctacaatgaacattgattttaaaaaggcatgagtctacaagctaatcatgtactaagcacattttctttttctggtatagggtttacgtaaaacatgcgacaacgacaaagattgccggaaaactagccggaacttaggggagctaggtgagaccagcggcggttccatcctcgtgagtaaagcagtgatcgtcggtccgttcaaatccgacaacttcacaaccatcaccgatgctattgcagccgcacctaataacactagaccagaggatggttactttgttatctacgcaagagaaggtgtctatgaagaatatattgttgttcccatcaacaaaaagaacttaatg

SEQ ID NO: 29537 - DNA, 3003 bp, Unknown; identical to SEQ ID NO: 24918
  misc_feature (1)..( 3003): 2750-1469P.txt file - cDNA_ID_3018830; gDNA_ID_2684220; Annot_ID_191824

SEQ ID NO: 29538 - DNA, 3000 bp, Unknown; identical to SEQ ID NO: 14735
  misc_feature (1)..( 3000): 2750-1469P.txt file - cDNA_ID_3018838; gDNA_ID_2684220; Annot_ID_191818

SEQ ID NO: 29539 - DNA, 3000 bp, Unknown; identical to SEQ ID NO: 14724
  misc_feature (1)..( 3000): 2750-1469P.txt file - cDNA_ID_3018846; gDNA_ID_2684220; Annot_ID_191814

SEQ ID NO: 29540 - DNA, 3003 bp, Unknown; identical to SEQ ID NO: 27209
  misc_feature (1)..( 3003): 2750-1469P.txt file - cDNA_ID_3018863; gDNA_ID_2684220; Annot_ID_191806

SEQ ID NO: 29541 - DNA, 3003 bp, Unknown
  misc_feature (1)..( 3003): 2750-1469P.txt file - cDNA_ID_3018873; gDNA_ID_2684223; Annot_ID_191855
aatttgcttgtaccaggcggcacaggcaaaaggtatctttcttgaccactttgttgttgttcagtgcaaagttttttgcaagcatcctcgcacattataggagtagcgtttttaacttctttcaagcattggtttgagacacaatgtttaatacacatatttacattattcgaatgtgagatttgtgccgaaaacatcattgcgagcaaagttgtaatgatcagaagatcgcatgttttcttcaaactttgagctgccataatgtatataaatgtattgatattgattagaacaaatattattagtaaacaagatgatttggtgatgaatattgggttttgtttagatgatttatatagtgaaagtaatgtttcctatttttagaagttggttttttgttattgtttctttctctagaagttacatacatctctgtgatttagtgttacgctgatccaaacaactttattgttatgaataaaacaataactatcgtttaaatgttacaaattaaactcaaattggctacgtcatagtggaacttaattcgaggttcaagtcgttttgaacgaaaaccatgaaattaactaaacataacttaattatatgttcttacttgttccatacaaaatctatttttaacaaaaggatgcaatgtctctaaaagtatttgtcgtttgtatgtataacagtatctctcatgaaaagtaataactaagtgctaaaagactctattgcatggtttagtatctagttttggtcgcaaatgaggagaacacaatgtcaacatatacccttatttttaagctagtttctgatattttcaagtttcaacccaattggttttcgttgtttgaactgttttaatatgacatataccgcaagagggaaataaagagcacaactaagtcattgcaatttgatgaatgaaagagattaattaaaaagaaaaattgtaattttataattactttattttggtttgtttaatttttatttttgattaagaatgtgattagctcttgtgcaaatgctaaaataactctcaaaaaagattgttcttcatttttgttgctcttcgatgccaccaaagcgtctcatatcaatggatttcattgaatcgaacctgaatactgcagacaattcaatttgagaaaacacattttatcttcataaagtttttagttgtaattttggtgaaatttgatgaactcacaatttgatgtaaactaggaaatttttgatgtaaagaatcttaattgattagattgatgcacaacttcgtcgagtctagttgaacggaataagtctagactcttaaagacgttgattgcaagttgagagaatgaatatgcataaaattaatatgaagtcggtagtagattcaaaatgatataataataataatactatgtagtttaaaaatgatttgtttaatgtaattttttttaatcgtaaacaaaccaaacggtttttatttgcatttgtattttattctatgtatttgaatctattgaaatggattcaaatctaggagataatgagtttttccttttctttttttataataatgaatgtgaattaaatttatattatttaaattccttttgctggaagattaattgaaaatacgcgacaacatccatatattacttcaagacacttgacatgagaacaataaacaacatcatataagaagtggattaacatatatatggagaaacaaacaatgagagcttttgcgattataggttaaaaagaccacacgctttaggaaacatcctgcaaaacttgcttgtaccaggtggcacaggcacaaggtatctttcttgaccactttgttgttgttcagtgcaaagttttttgcaagcatcctcgcacattataggagtagcgtttttaacttctttcaagcattggtttgagacacaatgtttaatacacatatttacattattcgaatgtgagatttgtgccgaaaacatcattgcgaacaaagttgtaatgattagaagatcgcatgttttcttcaaactttgagctgccataatgtatataaatgtagtgatattgattagaacaaatgttattagaaaacaagatgaattggtgatggatattgggttttgtttagatgatttatatagtgaagataatatttcctatttttaaaaattggtttttctgtttcttgtttctttcacgacggttaagattgcatttctgtgatttagtgttatggtaatccaaacaactttattgttatgaataaacaataataatgttacaaatccttgtaatttaaccataatcagagaacgactaaaaccgtgaaattaaccgaacagaaattaacgattggctaaacgatttcggttcggttagtttccggttaacaaaattaatccgaagtcactcctaggcctttggtcaatcttcgtttctcgtttctctgttgagtaacgacaatcgacaaaggaactttgctcaatcttcgtttcttcgttaggtaatcttcgtttctaagaattggaatgttctttttcataggattcatgatagtttttggctgcaattttgaatctttattctgactatgtgaggaatttgattttgttatcgttgtcgttgtttcgtcttaggatttgtgagaatcattgaacaatttttcaactttgacaattaataacacgagaggagcttcagatttatgtgtttgagtattcaaagatatagcttttatatttgcctttctgggtttcatggagatgaatctgtatacttatagctcattaattagtcaactctgttgttgcttctggtttgacattgtattgagtagtcaaagatttgagctttctaactccacatgaagatatagcgtgtttacatttcatttgtgaaaagtacttcagtccatttgggtttctatctggtttagaagatatttctggtgaaaactttatttgggcattgcttcttttcagtgactgatcaaagatg

SEQ ID NO: 29542 - DNA, 3003 bp, Unknown; identical to SEQ ID NO: 27210
  misc_feature (1)..( 3003): 2750-1469P.txt file - cDNA_ID_3018893; gDNA_ID_2684223; Annot_ID_191859

SEQ ID NO: 29543 - DNA, 3000 bp, Unknown; identical to SEQ ID NO: 14747
  misc_feature (1)..( 3000): 2750-1469P.txt file - cDNA_ID_3018908; gDNA_ID_2684223; Annot_ID_191853

SEQ ID NO: 29544 - DNA, 3000 bp, Unknown; identical to SEQ ID NO: 14742
  misc_feature (1)..( 3000): 2750-1469P.txt file - cDNA_ID_3018908; gDNA_ID_2684223; Annot_ID_137502

SEQ ID NO: 29545 - DNA, 3000 bp, Unknown; identical to SEQ ID NO: 14741
  misc_feature (1)..( 3000): 2750-1469P.txt file - cDNA_ID_3018919; gDNA_ID_2684223; Annot_ID_191849

SEQ ID NO: 29546 - DNA, 3003 bp, Unknown; identical to SEQ ID NO: 27212
  misc_feature (1)..( 3003): 2750-1469P.txt file - cDNA_ID_3018925; gDNA_ID_2684223; Annot_ID_191846

SEQ ID NO: 29547 - DNA, 3000 bp, Unknown; identical to SEQ ID NO: 14763
  misc_feature (1)..( 3000): 2750-1469P.txt file - cDNA_ID_3018971; gDNA_ID_2684224; Annot_ID_191889

SEQ ID NO: 29548 - DNA, 3000 bp, Unknown; identical to SEQ ID NO: 14761
  misc_feature (1)..( 3000): 2750-1469P.txt file - cDNA_ID_3018975; gDNA_ID_2684224; Annot_ID_191887

SEQ ID NO: 29549 - DNA, 3003 bp, Unknown
  misc_feature (1)..( 3003): 2750-1469P.txt file - cDNA_ID_3018979; gDNA_ID_2684224; Annot_ID_191881
acgtatgattggacggtgacataagcgactgtaaacggcacgtgagggaagcagagattcaccgcttcgtgtccttaaaaacgtcacagaaagagaaatggaacaaggaagagaagactgacacacaaagtctgatgaatctgttggacaaaaatatgcctaagcaaagtttcttgatatgaccttaacactattcgacctcactccttacctctgtttttatcgtttcatcttttttttattaaaaacaatgatctgtatttcaataaaagatacgaaaagagtcattattatgtaactttaatatctatctcatttgccaactactactcctgtgcttcttttaataccataatttactttaatcatttttttttttacaacgtttggagattctttaagcgaatctgaagtaaaaaattgctaagcacggaaatagaatcttctaaagcagttgtcagattttcccaaaaagaggctttacttaacgcgaaataagcaaaaacaaactatacgatatactcatttactttactaaattacgatttttgtataaatgaatacaaaataataagacatgatgctctaagttgttgtactgatattgatatagcttttattgaatatttgtatcatgtaacttaaaatgactagatatatttcattcagaaaactgtataaatccaaaagagcatatcattgattcgtggcgaagcagtgtacatggtgacgcattaatggcttcttttccagtaacttcgcgtgtacgtaaaaatcgatatttacatctatctatagcattcataaattacattaatgggttatgtagtcgtcaataaaggtgcatacttaaatgcgcttgtttaatttatacgagaagttaggtcaaaactttcatatcgatcccacaagaaaacttgaatacacataattgcaaaccctttattaaaaaacttaaatacccagagaactgtataaacaaaaaagaaaaaaagaactttcggcacgttttgttttgtcatttttcttcagtgttttcaaataaacctattaattcatattgtaaatattataaaacgactaactaaaaagaaaaataatatatataaaaaagaattatgaattttatatatacatttttttacatatataattagatctggtcaactatatacaataaatcatacttgtcaagtcaaaaagcaccgtaatgtgaaataattcaagatctgattatttcttcacaagatatgatagaaattgagtatcataaacttggaaaagaaatctattacaacttataatacaaatggaggaatttattgtaatggcctatgaaaagatggtcaaagttgtaggtattttatcagtagaaagagacaatactttttagtttcccctataacatcgagacatcaatttcttgcatgggtccaattccaactatctttgtaaaagaccagttttatacatttatatgtttatgtaatttttattcactaaaagattgtaaaaagtcatatttaacttggatgtttggagtcgtgatatttaattcaatataatcccctggccggaatttatttaatatatagtgcaaaatgactcttttgatacagctgattgcacaaatatctttagtagttttagctcagattttgtttttgttttcgttcctatgtcttatgtatttaataaaattaatttggtttcttcaatcaatttcgcattggataagcatcgaagtgttaaataaagtaaagttttgtctcttttccttcaactcggttttaaaaatagctatctctcaagcctatttctaaggccatcaatgtagtctttcagaattcaagtgatgtcaagaacattggatagtttaattccttctgtaggttcaattgaaaaccttgcttttgtgttgcagcatacaatgcacaaaggcttgttcagagaccaattggcatgcctaaggagaaatacacgcactttacaaatatggttatttagaggattaagagtttcacaatgactatagaaccccataatccaaggcgaagacatctaattcatatcacaagagaaatgtttattgcaaaatgttatgacctaatgtagcacctatgctttacctacttttaagttatttcttgtttatattttggaaattatcagtttactagcattttcgatcatatcgttttaagacactgtaaccacacatttcttggagtatttgtaatatgtgtgtgtacatgcatgtggtgtatgtatatatggacactcacgattgatttaatgctctgtcatatcaaataacgtatttactattacaagctggtggtgtcattgaagtcatcattgtatcttcttccaaattcataaagttactgtcactgatactattggtgggccattttttaccatcacccatttttcactactatttatcttttcttcaaaaatgttttcagcataaaaaaacatatttggaaagatagacgcaaacctacgccaagaaaagagaactccaagtctccaacctaataattagcattagcatttaaaaacaaaaccgcgtgtccatttcatgtttttatgctgtgtaataacatattgctgcgaagtacaagctatgcaaattggtattacatgagtttgagttaggatacaagttttttagtcaattgtactaatcaaactgccaaaacaattagttccccagctctaattttttttgttacctttccattattttcgagtaaatatgatactgaataacttattatacatagtttcagtttgtttatcataatttgtttttttttttgaatttatatcataaaatatttcaatgtcatttaaatattatcctgatttcgtctatctctctctctctctctctctctctctatttaagacaagctaaaggtagaactgtagaggccaatctcaaaaagtctccgacactctctagatttcctttgctccttcgttctggccatg

SEQ ID NO: 29550 - DNA, 3003 bp, Unknown; identical to SEQ ID NO: 29549
  misc_feature (1)..( 3003): 2750-1469P.txt file - cDNA_ID_3018979; gDNA_ID_2684224; Annot_ID_137517

SEQ ID NO: 29551 - DNA, 3003 bp, Unknown; identical to SEQ ID NO: 27223
  misc_feature (1)..( 3003): 2750-1469P.txt file - cDNA_ID_3019029; gDNA_ID_2684225; Annot_ID_191958

SEQ ID NO: 29552 - DNA, 3000 bp, Unknown; identical to SEQ ID NO: 14797
  misc_feature (1)..( 3000): 2750-1469P.txt file - cDNA_ID_3019033; gDNA_ID_2684225; Annot_ID_191956

SEQ ID NO: 29553 - DNA, 3003 bp, Unknown; identical to SEQ ID NO: 27225
  misc_feature (1)..( 3003): 2750-1469P.txt file - cDNA_ID_3019044; gDNA_ID_2684225; Annot_ID_191950

SEQ ID NO: 29554 - DNA, 3003 bp, Unknown; identical to SEQ ID NO: 27226
  misc_feature (1)..( 3003): 2750-1469P.txt file - cDNA_ID_3019048; gDNA_ID_2684225; Annot_ID_191947

SEQ ID NO: 29555 - DNA, 3000 bp, Unknown; identical to SEQ ID NO: 14789
  misc_feature (1)..( 3000): 2750-1469P.txt file - cDNA_ID_3019052; gDNA_ID_2684225; Annot_ID_191941

SEQ ID NO: 29556 - DNA, 3003 bp, Unknown; identical to SEQ ID NO: 27235
  misc_feature (1)..( 3003): 2750-1469P.txt file - cDNA_ID_3019060; gDNA_ID_2684225; Annot_ID_191936

SEQ ID NO: 29557 - DNA, 3000 bp, Unknown
  misc_feature (1)..( 3000): 2750-1469P.txt file - cDNA_ID_3019115; gDNA_ID_2684226; Annot_ID_191997
tctttgcatacacgaaactacaaatgtgagaacgaacaaggccaatgattaatatgattaatattcaatgacatttctaaagaacactatctggaaaattaagtaatgattgatgacgaacaaaactctaaaagccgagctacactggtgagaaaagagggaggaatcaaaagcaccttgagcatcgtcgtcttcctcttcttcgtcatcatcatcatcgtcttcatcatctttaacatcttctacaatcggttcatcagtctgcaaaaacaaatcctcgagcgtgagactaagaagtaaaaaccgtgacaaatctacgtaaaatcgtcttaacctgaagctttttctccagctcttcagcaatggcggtaaccggtggttgctcaggttgtccatcggcagattcagtgactacagcaggaggaggagacatggctttcggagagattttagggttccgattcgattttgcgtcagccaaatggataaggaacggtgaggtggtgagtgacgactgtgtgtgtggtaacgactcgggttctgctttgtcgttgtccaattgggccttttattgggcttctgaggcttaataagaacaattttggttatctatataggccatgaaattccagtcctaaattttctctgggccgcacatgatattcacgtgcccatttcgaaacattaataatcctctagaaaccctaataactctatcgaaataaatagtgacctcgtacgttaacccctaatcttctgtttggttacaggttcgattcagagactctacacgttttgtttttatgtttcacttgaagttcagattatgaatcgatgagctctattgatggttttgtagatctttcgtgggacgcgagctagcctacaatggccaccggtgagctagcttgcacttacgcagctctcctcctccatgaccatgtcaccgtatgtactttctaggctcaatcttgacatcaatcctactggagccttaattaacttgtaggttgtttgttttaattaacatgtactcaaactattttgtttacttgtaaactaggctgagaaagatgtcaacattggtgaaaacagccaatttgaacattgaatcatactggcctagtcttccgccagaacaaaaacatggatgatctcatcatgaatgctggtgccggtggatctgctgcttctcccatggccgttttttcttctgcactttcatctggaagtgccactcaagctgccccagtagctgaagagaaaaataaggtatcgtattcttctctccttgaacccttttactaattaatatactatactcataaattcataattgtaattactgttgatattcaatataaatatctaatttcttggtttaatttgttcttgtgatgaatcatctttaggaggacgtgaagggagagagtgacgatgattttgtatccggattgttgactaatagatttaacctatcttttgaaggcaattgatgtttagtcgactcaattttttgagatttattttattcttaggaaagcctagtaattttacttggaacatgtctttttttggcaaacacttgggacaggttttatcatgagttttgagctataatcaatgcaacaatgttgggctataacactttttcggttaatttcgctcgcttacctaaacagtaaaccctacatatgactaagtttggattgtatttagataccgaaacgcctgtttccgaggtttactgacagatttgtccctgagaaattaataggctgtttacttgtaggacatcattctttaatttgaaactattgcactaatcgctattctcagttaagttgatatatatctgatatgcggagaattattttgaggaagaatgtttcctaaaacacaagaaaaccctaggtgataggcattcattcgtcaaaaatgtagagaccataatgaaattgttaagcacgttatatcacggacaaacgagtatgcccccccagcaacgccatctgccactatacttagcttctctctctctactggcgtcaataaacgccaaatttactagccttttcaaatgctgcaccaactgaggcttctttctatggttgatactccttcatctgtggacaccctatttattcctacccaacgaggttcattggcaaatgaaaatctagttaatgtttttgaaagcaatatttttgcttccttaaactcaggatttggtgatacttgttttgagatgggtgactcctctctaaaagcccaaggaggaaggccaatcaagcctacgcaaaaatatcaagagaatcaatgtactacgatttggccgtggtggtcgcggttcatcgacctaatccattgcttttctttctctaatctaaaacctacttttactgtatgttattctctttcatctactttcataaaactatatgatcccctcatagtcatatccttttcatattttttatgcatataataaattgaactcaaaatttattcaatttgattaaatagaaatttgatatcttttcaagataatcacactcaatattttagtaagtcattttaaaaatatacaaaaaggcgtgaaagcaacggtatgattgggtaattagtatagtgtatgtatgtatatatacattaaaaagtactacctaattatagataaataatttgtataataactttgtaatctcgattggtatcaatgaatttagaaggaaaagaagaaaaattatagataaaattatctatatatgtaatggtatctaataaggatgctacaaaaaggaaattaaagaaaaaaagataaggttagaaaaagggagaaagataaaaaaaaaaaatgtggtaggtagacataatccgaaaggtggcaaaatcgtgtctgtctagtggatctgtaagggtttcatttataaggtcgtcttgtgtttgtctatcggtactcagaactctaagggtttcatttctttttcatgtgcaatg

SEQ ID NO: 29558 - DNA, 3000 bp, Unknown; identical to SEQ ID NO: 29557
  misc_feature (1)..( 3000): 2750-1469P.txt file - cDNA_ID_3019115; gDNA_ID_2684126; Annot_ID_191092

SEQ ID NO: 29559 - DNA, 3003 bp, Unknown; identical to SEQ ID NO: 27105
  misc_feature (1)..( 3003): 2750-1469P.txt file - cDNA_ID_3019119; gDNA_ID_2684226; Annot_ID_191995

SEQ ID NO: 29560 - DNA, 3003 bp, Unknown; identical to SEQ ID NO: 27105
  misc_feature (1)..( 3003): 2750-1469P.txt file - cDNA_ID_3019119; gDNA_ID_2684126; Annot_ID_191090

SEQ ID NO: 29561 - DNA, 3003 bp, Unknown; identical to SEQ ID NO: 27242
  misc_feature (1)..( 3003): 2750-1469P.txt file - cDNA_ID_3019126; gDNA_ID_2684226; Annot_ID_191993

SEQ ID NO: 29562 - DNA, 669 bp, Unknown; identical to SEQ ID NO: 14503
  misc_feature (1)..( 669): 2750-1469P.txt file - cDNA_ID_3019126; gDNA_ID_2684126; Annot_ID_191088

SEQ ID NO: 29563 - DNA, 3000 bp, Unknown; identical to SEQ ID NO: 14829
  misc_feature (1)..( 3000): 2750-1469P.txt file - cDNA_ID_3019147; gDNA_ID_2684227; Annot_ID_192027

SEQ ID NO: 29564 - DNA, 3000 bp, Unknown; identical to SEQ ID NO: 14827
  misc_feature (1)..( 3000): 2750-1469P.txt file - cDNA_ID_3019147; gDNA_ID_2684227; Annot_ID_137599

SEQ ID NO: 29565 - DNA, 3000 bp, Unknown; identical to SEQ ID NO: 14828
  misc_feature (1)..( 3000): 2750-1469P.txt file - cDNA_ID_3019172; gDNA_ID_2684227; Annot_ID_192029

SEQ ID NO: 29566 - DNA, 3000 bp, Unknown; identical to SEQ ID NO: 14828
  misc_feature (1)..( 3000): 2750-1469P.txt file - cDNA_ID_3019172; gDNA_ID_2684227; Annot_ID_137600

SEQ ID NO: 29567 - DNA, 3000 bp, Unknown; identical to SEQ ID NO: 14826
  misc_feature (1)..( 3000): 2750-1469P.txt file - cDNA_ID_3019189; gDNA_ID_2684227; Annot_ID_192020

SEQ ID NO: 29568 - DNA, 3003 bp, Unknown
  misc_feature (1)..( 3003): 2750-1469P.txt file - cDNA_ID_3019210; gDNA_ID_2684228; Annot_ID_192145
tctaactttttcataatcataccaacaggttgtgagctccttgaattctcatacagattcagttgaatgtgtgaagttttcaccaagctccgcaaccatccctttggctgcaacaggtggaatggacaagaagcttataatctgggatctgcagcattccactcccaggttcatctgcgagcacgaggtataaacccttatagtttctctgagatagcatcaaaacagatattgaaactaaaacaactcctctcttcttcttttttcgattacaggaaggtgtgacatctctgacttggataggaacctccaagtacttagccactggctgtgccaatggtacagtgagcatttgggacagcttattaggcaactgcgtccatacctaccatggtcaccaagatgcggtccaggccatctcagtctctaccaacacggacttcattgtttcggtatctgtcgataacactgctagagtctttgagtcatctgagttccaaaacaaagtgacataggcaagtgaggagaatacttgcagatactatccagacatgttgctatctgtgttcgttgttgtggtcttaattctatgctttgtgggggaaaattttgacaagaaagttatcaatgtctaaaattccatatgtacacggcttaatttattgataaatgtagtctctgtttggaatttgtccttcattttacagttcttatggttcgaatgagattgataaatgttactccttacattgatatcgttaatgaatgagattcatgctaatgttccactagcaattgaactacttgatatcatgagtctgccaaatcgactggagaagtcagatttagggtctgagcatcaccatggaattataaccgaactctttataaaaactcttctcccttgagaagtaagaatgaaacgggcaagctatagagtgagattactacacaggagaagaaacgaatctgctgaaaatgcagccaccggtaaagttggattaagtctctaatacatccgactcctcttcttctcagtctttaaactgatcttgctccgcctcgattgtgccttatctcttgaacctgagtttccaaaactcctcctaccagatcttggacttgaatttctacgaccacgctccagatcctggttttgatccacttcatcatcgtcctcgtcatcatcaacaaagtctccttgacgatcatcctcgacatcagaaccagaaatgtcatcattctcagccttcgcatcagtatcacaaacttccccttccactttccccttatcttctttcttgctgctcgaagaaactgccttgttatctttcttaactgtattcatgagtttcatgtaacggttcctgcttgtcaccaattcattactctctatcaacatccccctcttgtaaccatctctaagaaccacagtgtgagtcctaagcttactagacaagtaaaagataccaggatgattatggagaactctcttaaacctcgatctcaatcccataaactcaccaagatgcaaaatagcatctttctcaaccttcttcgacacaaaaaggttcatgatctcgtgcaaaacagccgccgcccacttatcagactcatcgctagtcgcagacagatgaagtgcattctcataaggagaaatatacggcaacttctgccaatcatcaatccatttcttcatcttcttatcaaccacaaaaccattcgaaaacttcatcggaaaagcaatcgccgatcctttcgtatactctcctttacgtaatgttctagctttcttctccaacacagatacagcatgctcattgctccaacaaaccagctctagctcaccactacatcctcttaacttcgatttgataactctaaagtaatcaggaaactcaggtaccatagtttcaacataatccttaggtaaacctaaatcccatttcaacaaatctagaatctctaatggaattttgttaatcctattaatcatcagcaatttcaaaagcctatcagctaatccttgcttataagtctcactaccgtaaaccaattgctcatcggcatcgtggtttagaatctccggcgtgaggctgatgtgaggatgaataccaattcctccggggagaaactcttggaaaacggaagggaagctacgtatgaactcgattggacgaagaggaactcgtagtgaatctttctgtgaggtgataactgagatcggaactgattttgctggctccgatctgattaggtctttgatactgagaagtggtctgagattcttctctctttctaccgcgtggtcgagtcctctgtctcttacgaatttgtaggtatcttccaccgccgacgtatcggcgaaggttcggtggccggaatgacggcggatagaaatggaacggaaaatggatttcatcggcgatttgattttttagggtttaagagggttttggctcatcaatggtgtttcgaagacattgatgtggagctgtgtgtgtcactcgagactcggaagtgaagagtttttattattggttatgggcttttaagttgggcgttttaggcccactgtagttttttctgtgacgttgcccatctttttttttataatgatgagcccatctaaaatgttattctacaaaacaataaaagaaagaccaggattcctttgcttaaaagaccagggtcctttgctaaaactatattataatgaccaatgaaatcataattaataatgaccaattaaaatgatgacaaaaaaaaaaaaaacccaattaaaatagtaaatttatattatagtcatcaactttaatactttgttgcaaaataaaaggaaacagtcgcataataatccactaatcacaaacctttaccctttcttctcggggccaatcaaaaacttcaattaaccagaaaaggtcagattctccgccgcctcacacgacgggcaacttcagttcctgccgtcgcgttagatcccgccgtcaatcggtcatg

SEQ ID NO: 29569 - DNA, 3003 bp, Unknown
  misc_feature (1)..( 3003): 2750-1469P.txt file - cDNA_ID_3019218; gDNA_ID_2684228; Annot_ID_192143
ttaagatatggtcttctgtccaacttaattctcagtgagatcactaattttacttgatacgtgttcttgacttgttcctcctatggtaatgtaaataacctagctattttactttatagaatggtgcgagggacaggttaccgagtacctcgtggcaactttcggtgattatttcacagatgtgaaaatgtaagtttttctttcccccttttgtttaacaagagccaaaaatgctacaagtctattgaagatgtcgtggtgaatactggatgcaggtatgtcgaagaaagatcatttagaagatttgtcgaagcatgtttggaagaaacagtcgttgtctatgttgaccatctcctaactcaggttcccccatttattctcaagcatttttaccttttatatttcatcagcatacacaaacactgaacctttggggttgacgtgtgtaattccagaaaaactacatcaaggaagaaactattgaacggatgaggctagatgaagaggttctcatggatttctttagggagtatataagtgcatctgtaagttggtttcagcacttaactcatttttaacctgaataattttatatttctttgaagtattgcttaatatttccactggaactgtgttacagaaagtggagagcagaatcagaataatgagcgatctgagagaacttgcatctgcagagagtctagatgcatttacactcgtgtactcgaatattctagagcaccagcctgactgcccggtaaatattatctaaacaaagcctgctctggctttttacaatatcagtatacacagaatctctaatatatggtatgcaggccgaggtcgtagagaagcttgttagtctgcgtgaaggcataccacggaaggacacaaaagaggtaaacataccaaactctcttttttggaaaatgctgggttataattgtagcgaatcacatggatttttaaactatggttacgagacttcaaatggcgaagaattcttaaattgacgaaatggttatggtgatgaaaacaggtggtacaagagtgcaaagagatatatgagaacacactggtagatggtaatcctccaaagacaggatttgtattcccgagagtcaagtgcttaactgcttccaaaggatctatgtggcgaaaactcacttaatctgtaaaacagcgttcagcgtttgcgtccgtaactgcttttctagttgagatgatgttctttctccaaattatggcgtttgcgtccatgtcttctttttctttgcatggtatctttcctctgtaaattctgtgttttctcttgttttgttctttttcttacctttattcctggatttgaaagttgaaacgctcggtggccacttgcactaggatattatcccgttgtatttaggaggcgtatttttttgtcgcaaattttaattctactgtttcatttaattttgataaaatcttcttaaagttcgtttctctttcataacaaggtagctcttattgtttttagaattatttctgatttgtgaaattttgaatttgaagcatatttttatcatgaatataaaaaatgttggggattataaaaaagtttgtaaattcactcattggcagctgatttagccactcacaatatctaaataaataattgtaagcattatcttgaaatattttctgaaatgactgtttcttttttactttaattaaattttgttctagaaaccttttgatcataatgaaaataaagagtccatccaccacatggggtaagcataatgtgtgatatttaaagggtaacaaatgtaatctgctttttattttactttttacctctactcaaattgtatgggcagttttttttttttttttaaatgataagacaagtatctgtttaatggtattgtgatgaaacagtagtaaagtcatatcgggcacgccatactacttccacagtggaacttggccaaattttgtctttgccgtctctacagtttcttccaccaaattttttgttgacaaaactcaaatctttcaatctcatctctgccaaagttgggtttagaaagaatatcagcaaacactaatatctttattgttgcatggtttatcaatcacaaaattcacaaccattgtaaaaaaaaattcacatttttggtatgagattgctcacatgatagtgaacctctttaacattttaactttactttcataaatacgggattacgaatcttacttgcattaaaaatttagaaaaggtttttctacttaaagaaaaaagggacccaacagagagaggtttgaccaggagaaacgggtgcatagccttaagagctttcaactactttaccccaaacccaaagcgatgtcactttcaaccatctcttctctcccccgaacccgtttttttgaccggtcagttcgggcagcagcaccgttacgggcagcttatattcctcgtcttcctcctctacaccactgcatgcccataaataaagcccgttgagatctttaaaaatattaaataatatatcaacgaaaaagctattttattcataagaagaaaaagagaggaacaacaacaacacactaatcatagtttctctggcaggcttgttgttgcggcttaataaaaagctcttttgttattattacttcacgtagattttccccaaaaagctcttatttttttgtttaaaaaaaaaagtttcatctttattcaacttttgttttacagtgtgtgtgtgagagagagagtgtggtttgattgaggaaagacgacgacgagaacgccggagaattaggattttgattttattttttactctttgtttgttttaatgctaatgggtttttaaaagggttatcgaaaaaatgagtgagtttgtgttgaggttgtctctgtaaagtgttaatggtggtgattttcggaagttagggttttctcggatctgaagagatcaaatcaagattcgaaatttagcattgttgtttgaaatg

SEQ ID NO: 29570 - DNA, 3003 bp, Unknown
  misc_feature (1)..( 3003): 2750-1469P.txt file - cDNA_ID_3019222; gDNA_ID_2684228; Annot_ID_192142
taggatcagctttagaccatcaagaacatgctttcccacgtacctgtccaagggacgctgcagcaacaggctcaggagaaatctcagagaaaagctcatctataggaagaccaagttcatcctcaatcatattgaaagcaacttcggttgaaaacggagttatttgatcttgtagcagggagagttcatccaagtatataggaggtatcaaatcctagtttcgtgaataaagctagttcagaaaccataatcttcatagcaataacaatcacaaagctccagaaaataagaatcaaacatgttaagaaagacgcttacaggacgagatgaaacagcttgagcgattttgacgtacgcctaaaaacaaggtcaagacatgataagaacactagcattgagcaaattgatggactgatgatgaaatctcaaagaacacgtgagagataaccataccggacctagctccacaagcaatttcctaagctccgctgctcgtacctaatgataccaattcgtgaaatcgaaaacgaagcatgagaacacaaaatcatcattatcattgaagagcaaatcacgaaattggaaaaaagaccttgaacatttgatcagagcgttccaaagcctcatcagctaagcgaagcccaaaccaataactaaacgtagttccgatctgagctaatctacgaagcagaatcagaggtttcttcttatacatcccatcaatcctgggaaaattgtactccgacaaagaatcagcctcatcggcactgagactgaacaaataaccggatttactagtgaaactatctacatctctagacgcagcggagacaacaacggcggagtttcctcttcgcgacggccaagatggttgtggattaatcagcagattgggattggcgggaaaagaaacgattggcatagaagaaggaagccgaagcatctctttcaaaatctacagagttatcttctttttcttttcttcttcgccaatggttgttggtgagattttgaatatcatgcagtggattcttctaagaaatggcaaataatatggttctctactgttttatctcttttttgccggtcacattctttatactttctctctctctcgacatttgctgggattttctgtgtcacacaaatggcaccaatctttttgtacgttttttaagtatttatatgtcatataaatgtactttatttagctactaatcatattttttggttagtgactaaaactgtatcattccaaactattcataataattacgtttaaaacttaagaaaaacatatgaaaaagtttgtagattgtctgtttatttatctgtccttggatgcttcctttgaagaaaaagaaatttagtgtatatataaaagagataaagaatatatcacatccacatatttggtaattgatatataactctgtagatcttattccttttagataccaatgactcttctttttatgtaaaccatcaaaatctgaaacaagctgaataatgaaatacacatatcttaaaatatatttttactagtagtagtaattagtaaatatcataatatcagtttgtggagtattttagaaagaattcgaacataatatattttcgattttttcctaaatgtaaactttcgaattttctctagtatgttcttaatgaaaaaatgtaaacttaccaaatgttgctgatatatttacaaaaatgtaaagttagtgtcgacgatacatgtatataaatataatcagtacacgaaaaaaaaggttaagaaagattagagattggtggtgtggtgaacaagaagatggacatgtatcatttgacagaatacatcggcgtggtatcgggcgtccttatggtagctcttgcttcgtgcttgtatggccattacctacgtcgcatggtatgtccatgttgtgaacctagactacctagtgactctaatgcctaactattatcattttgctactgattatatttatataaatgtattgtcgaaaattgtgcgtccgtttatcctctacgctaaacggactctagatgaataattatttgtttcaaaatattgtaactctattctattgatatttatgagattttacaaatttcttttcaaatagtttgtacttggaagctgtcattttcttaggctttgtttttctttttcgtcgagttcaatattccatccatctcatcgatttatttcttatatattacatgtactacgttatgtgcaaaactttgatgatatcacaactaatatatcacatccaagttttgcaaagcatgtcgtcaaattataaacttatcaaaacatatgcaaccccattaatatcaaacgtatgtaacatcgctagataaccaatcagacccctacgactaatattttcgaattcgatacgttatggtaagatttaaaatcgatgatattttagtgacatttcaaatgattaaacatataacaaaaaataaaaaataacacgaacccgagcatggggttaagatttgcgttttgctcaacgaattagcgttagcgtttgcaaaaaaaaaaaaaaaaaaaataggtttgcatcaacagctggcaaaaaagaaaaagaaaaatcaaaaccggcgagacggaaaatttcagcgtttccgaactttccattagagtcgcgagacgatagatgagactcgttccagaaatttaatcgttgcttctcttcccagctgatctgcgtccaacatcactgtttccaggatcttcagaatcagcgaaggaagaagataagaggacgacgaagtaattgaagttggagaatcgcacatttggctctcgatatttgctcaatgacttcttattcggttgcgtccatttttcctctacgtttctgtttccagatctcttgattctcctctgcgttatcgtaattgtgctggaattttgaataactttgcagaggtagccttcaatttaggatcggagttcgtaaataaggtgatttagcgaagatg

SEQ ID NO: 29571 - DNA, 3000 bp, Unknown; identical to SEQ ID NO: 14833
  misc_feature (1)..( 3000): 2750-1469P.txt file - cDNA_ID_3019226; gDNA_ID_2684228; Annot_ID_192141

SEQ ID NO: 29572 - DNA, 3003 bp, Unknown
  misc_feature (1)..( 3003): 2750-1469P.txt file - cDNA_ID_3019234; gDNA_ID_2684228; Annot_ID_192139
ttatatgatatataaccatccaaatacaacaatcattaaaacaaataaagaaaactgaacacaattttgacgaagaagtagaagggatcatgcgttctaaacggaagccgcaaccgaatgaatctgttaagtctgctcttcatatactcgcaaaaaactacgactaacgtcttatagatgagatctagtgccacatagatatttatgttttttcttaacatcttattactctactttttttttttttttttccgtctacttctccttcttaattattttgttgttatcgtcatgtctgttttttttgttaaaagaggctttattggttcataatttacacgaaattttgatgactttaataatatcatagaaagtaaataaatgaaagattataaactattgctagagagttttttataatcttgttgatttgtttttcacaatctcgtaaaaaaatttaaacaatctctcgattttgatgatactttcatgattttattttgtgaagaaaaatgtaaaaaatcataaaccattaacagaataatttaattcattaacaatcatagattattttgttttaattgaataacgcaaaatatttaataattttataaaaatataaatcaaataacttcagatttatgaagattttatattactttttacaaattctaaactaataacatctacaatagtttagaatctttcatttattcactttcaataatattattaaaatcatcaaaattcttagtaaattaggaattccagatagtgtcaagcaggatgttatcagcaacgtcaacgcagccgcgataaactcaattttatacattaaatcaatatcaacatatttccatagaattgtttaaaacatgagacagatttttggtatgccacaaggctaatctatagaattcatggacaatattttgtggatgagacaattttgatctttaaaaaattccatcatcaataaatacaacagttgaaatctattgaacagagattgctaagtactcgtgattaatagagtaaaatgtcagactctagtcgactaaatattttctaccaccaaaaagtaagttcgatatgggtgatgttgtcattcattttagatatttctgaaacactatctgacatatgtacgaaactgagcatgtcatgcgttacaagactaaattttcatattatcagggaggaatgtagagattaaatatggacaggcttgttgccaaactattgggttttagaaaataagtatcagtttccatcaaaatggcaaaaaccaaatcgcattacacatggaaatgcataaaactataaacttcaacaaaatgcaaatgaagaaaatgattgctctctcttagttctgaaagcaagcaatttggcgcctcaaggcgtatcaaagacgaagagtcttgccaaggaagggaacttgttgggttaaggcaagagaacctctatatatatggtcgatgaaagactacaaatttcgaccacattttaagcgagacgagtgttagggtctgcgaaactaccagccatacttcttgaagaagtccctggttctctttctagctcgagtgaaaactataactatgcatgcgagcacccatggaggaaaggtcccaatggagatgttgttcttgatccaagctggagggtctttcaatagaaatgttattaagagcgtaacaatcacaactccgagaatgattctggtgatgggtttgagcagggaatcctgaaaacaaaaggtgttcaaattaatagtgttatcagatgaatcacccaattaaagctgcatgttttaatgctttttttttctgttcttgcaacaatattatccaaagactttttacgccccaacgaagtcagaataccatgacatccattctagtttctacatgcgtattctaaatctatgagccataggagtgattccaagaaattgtttactttaagtaagaatacaagctttgacctaaacctaaggttccatgagacaccgaatccacgttaattgatattccagggcaattgaagagtaaagaagcctagaaagtctagagacatgtatgaggtttatgagcacaatcaaaagaaaaccatcaacttatctaaatgcagaacgccaatgtagagtaattctacaatccaagggtatgaagaacatgtaaaggagacaagaagcagattgggtcctatcctattccttaatcatgcgttcagagaaggtccaacagatgcaatgcaacaatattcaccgtgagtttattcattcaagcatcagtagggaactataactaagctaaggagatcgttctctgtccttttttcctattgcgtaagtgaaaactcaaaatcaaaacaatcagattacctgaggttcaccgtcgatgtaaatgacggcaccatccctataaggcaacacagaccgaccattcctagggtgaaatctgatcggaacagcacgacctttctcaacgttgaaagcgaagattgctttcaagccatatttctcaagaatagatcgaacctcgagctgatcctgctcataaccgccgagatttgacttgaacacatcgatcggaccttttccacacttatacagatgaatctccacctcaggaaccttcgccgccgcggtcgtcgatctcaattcactttccggttgagaattttcgagcaacggagtagtctcttcaatctcttgatgtggtggtggtggatctctctccttctccttctccgtcatcgatgacatgactaacaattcaccgtccgatggaaaaaaagatttataatcccaggaaagcaaaaaataaatattctgttcataacgacgtcgcttagtaaaaggcctcgtaatgtttgggccttatgatgggcctaaagggtataatagacaataagagattggttattcggttgttaccttttagttcgtcttctcagaggagaagtgttttttttctccggcgaggttggaaaaaaatg

SEQ ID NO: 29573 - DNA, 3 bp, Unknown
  misc_feature (1)..( 3): 2750-1469P.txt file - cDNA_ID_3019256; gDNA_ID_2214475; Annot_ID_133108
gaa

SEQ ID NO: 29574 - DNA, 3000 bp, Unknown; identical to SEQ ID NO: 14838
  misc_feature (1)..( 3000): 2750-1469P.txt file - cDNA_ID_3019256; gDNA_ID_2684228; Annot_ID_192130

SEQ ID NO: 29575 - DNA, 3003 bp, Unknown
  misc_feature (1)..( 3003): 2750-1469P.txt file - cDNA_ID_3019267; gDNA_ID_2684228; Annot_ID_192127
atctctttggtaagaaaaaaagaagcctttttctattgacaatagtaattggtacgttgaacacagggtcacaggaacgaccgaacgagaccagacgcaaagcttccacttggatattttttttcctttttgaaaagcaaagaaatatactctcctttaatcacaataaatatatagaaggaaaagacttcagtattcctttgccttttaacataagaaaaatatatatacttaaaagatagaaataagacacacaaggactgaaggaccaaaattgcctataaaagcaaagtccatctattccacaagaacaagaaaaggcagagaagagagaggctctgataaaaaaaaaaacaaaaaaaaatgacaaaggcttattcaacacgtgtcctcacgtttctgatattgatctcgctaatggcggtgacactgaacctttttcccacggtagaggcaaagaagcggagtagagatgctcctatagtgaaaggtctctcatggaacttttaccagaaagcatgtccgaaagtcgaaaacatcatcagaaaagagctcaagaaagtcttcaagcgagatattggtttagccgctgccatccttcgtatacatttccatgattgcttcgttcaggttcgatctttttcttccttttgttttgtttcttgtattaaaacctaagaaaacttaatttgattcttaaagcctagtctaaacagttctacgcatgtaaattacatattatttcattaataaaaatatcattttttaatataagaaaccatatccagttatccactcatcactcgttatacccacacacaaaaaagattctctaggcatgtccgaaatgaaaatgaaatattcataaatatcaataaacttgtgagttttcttattaaaatccgaccaaaataaccttaaaggaaaacacaaagtcgcctcaaaagtctcatgaacaagatttaagggttgtccgattcttacttcacttttgtttttttttcaaaacaaagggtttcttagtgtaaacataactaaatgacatgtattattggaatagtattgtttattacaaaattactacacttaatatacatgcaagctataaaataaaattaaaaaaatacatgcaataggacatgtcgcattaatactatacaccggctttccgtatgttagttggatctcagttatggaacgtaaacatatcttaaataattcaatatccaaccaataataaaaataatacatatccggatatgatagcatatgtgaattatttatatcaacatttaatgcatccaattttctgaataaaatatttgatatttctcaagccaaatactaaacctaattttgtttgcagcaatactttaattatgattatcagattcttagaacttgtaagttgcaacacctttatatacttaaaagtaaatattatcaataatgatgaattgtggcataatttgattagatatacaatttcggaagaaacttcaaaatgtatttttcatttttaatctttttgttatgagaaatatcttcttttttttttgtatgttatgagaaattttataaactaaaataaacagggatgtgaagcatcagtgctgctagctggatcagccagtggaccaggagaacaatcatcaatcccaaatctgacactacgacaacaagcctttgtcgtcattaataaccttcgtgccctcgtccaaaagaagtgcggtcaagtcgtctcttgctcagatatcctcgctctcgccgctcgcgattccgtcgtcctagtaaccacatctatcactttttcgtctataactcaatcacatttagtttcaactaaccttggattatgacttgcggttacatgcaataatacaaaccattagtctacaagtcacactaattctctaacatgataattatttttgtgtgtcaatgtagtcaggagggccagactatgctgtcccacttggccgacgtgactctctagcgttcgcgagccaggaaacgacgttaaataacttaccaccaccgttcttcaacgcgagtcagctcatcgccgacttcgccaacagaaacctcaacatcaccgacttagtagcactttccggtggtcacaccatcggaatcgcgcattgtccgtctttcacagaccgactctacccgaaccaagacccaaccatgaaccagttcttcgccaacagcctcaaacgcacttgtcccaccgcaaactcgagcaacacgcaagtgaatgacataaggagtcctgacgtgttcgacaacaagtactacgttgatctcatgaaccgacaagggctattcacttctgaccaggatctcttcgtggataagaggacacgtggcattgtggaaagctttgcgatcgaccagcagctgttttttgattattttactgtggcgatgatcaagatgggtcagatgagtgtcttaactggaacacaaggagagattcgttccaattgttcagccagaaacacccaaagtttcatgtccgttttggaagaaggcatagaggaagctatttccatgatctaaataaccataaatctcgacctttcctttgtcaactctgtttttatttagttcatgcacttgtggttgggttgtcgaatgcgtaaaactatctgataaataagaacgtcgcttcatcttaattaacttcatccaataccatgcactccttcattatttatgtgccaatcgagttactaaaatttaacgggctaaaagagaatttaaattaggcccactagttacaataactcacgaggctatgacccaatatttgtaactgtctaaagcccaagttttggtcaacgatctctgactctctaatgtcccttcttccttccctccccattgtacctttcacctatcccaacaatggtggaaatcagaaatcccggtattgctttaacgaatcaatcagcaaggaagtgagaacgagaaggagagatctgtgtttcattagagatg

SEQ ID NO: 29576 - DNA, 3000 bp, Unknown
  misc_feature (1)..( 3000): 2750-1469P.txt file - cDNA_ID_3019267; gDNA_ID_2214475; Annot_ID_183067
tctttggtaagaaaaaaagaagcctttttctattgacaatagtaattggtacgttgaacacagggtcacaggaacgaccgaacgagaccagacgcaaagcttccacttggatattttttttcctttttgaaaagcaaagaaatatactctcctttaatcacaataaatatatagaaggaaaagacttcagtattcctttgccttttaacataagaaaaatatatatacttaaaagatagaaataagacacacaaggactgaaggaccaaaattgcctataaaagcaaagtccatctattccacaagaacaagaaaaggcagagaagagagaggctctgataaaaaaaaaaacaaaaaaaaatgacaaaggcttattcaacacgtgtcctcacgtttctgatattgatctcgctaatggcggtgacactgaacctttttcccacggtagaggcaaagaagcggagtagagatgctcctatagtgaaaggtctctcatggaacttttaccagaaagcatgtccgaaagtcgaaaacatcatcagaaaagagctcaagaaagtcttcaagcgagatattggtttagccgctgccatccttcgtatacatttccatgattgcttcgttcaggttcgatctttttcttccttttgttttgtttcttgtattaaaacctaagaaaacttaatttgattcttaaagcctagtctaaacagttctacgcatgtaaattacatattatttcattaataaaaatatcattttttaatataagaaaccatatccagttatccactcatcactcgttatacccacacacaaaaaagattctctaggcatgtccgaaatgaaaatgaaatattcataaatatcaataaacttgtgagttttcttattaaaatccgaccaaaataaccttaaaggaaaacacaaagtcgcctcaaaagtctcatgaacaagatttaagggttgtccgattcttacttcacttttgtttttttttcaaaacaaagggtttcttagtgtaaacataactaaatgacatgtattattggaatagtattgtttattacaaaattactacacttaatatacatgcaagctataaaataaaattaaaaaaatacatgcaataggacatgtcgcattaatactatacaccggctttccgtatgttagttggatctcagttatggaacgtaaacatatcttaaataattcaatatccaaccaataataaaaataatacatatccggatatgatagcatatgtgaattatttatatcaacatttaatgcatccaattttctgaataaaatatttgatatttctcaagccaaatactaaacctaattttgtttgcagcaatactttaattatgattatcagattcttagaacttgtaagttgcaacacctttatatacttaaaagtaaatattatcaataatgatgaattgtggcataatttgattagatatacaatttcggaagaaacttcaaaatgtatttttcatttttaatctttttgttatgagaaatatcttcttttttttttgtatgttatgagaaattttataaactaaaataaacagggatgtgaagcatcagtgctgctagctggatcagccagtggaccaggagaacaatcatcaatcccaaatctgacactacgacaacaagcctttgtcgtcattaataaccttcgtgccctcgtccaaaagaagtgcggtcaagtcgtctcttgctcagatatcctcgctctcgccgctcgcgattccgtcgtcctagtaaccacatctatcactttttcgtctataactcaatcacatttagtttcaactaaccttggattatgacttgcggttacatgcaataatacaaaccattagtctacaagtcacactaattctctaacatgataattatttttgtgtgtcaatgtagtcaggagggccagactatgctgtcccacttggccgacgtgactctctagcgttcgcgagccaggaaacgacgttaaataacttaccaccaccgttcttcaacgcgagtcagctcatcgccgacttcgccaacagaaacctcaacatcaccgacttagtagcactttccggtggtcacaccatcggaatcgcgcattgtccgtctttcacagaccgactctacccgaaccaagacccaaccatgaaccagttcttcgccaacagcctcaaacgcacttgtcccaccgcaaactcgagcaacacgcaagtgaatgacataaggagtcctgacgtgttcgacaacaagtactacgttgatctcatgaaccgacaagggctattcacttctgaccaggatctcttcgtggataagaggacacgtggcattgtggaaagctttgcgatcgaccagcagctgttttttgattattttactgtggcgatgatcaagatgggtcagatgagtgtcttaactggaacacaaggagagattcgttccaattgttcagccagaaacacccaaagtttcatgtccgttttggaagaaggcatagaggaagctatttccatgatctaaataaccataaatctcgacctttcctttgtcaactctgtttttatttagttcatgcacttgtggttgggttgtcgaatgcgtaaaactatctgataaataagaacgtcgcttcatcttaattaacttcatccaataccatgcactccttcattatttatgtgccaatcgagttactaaaatttaacgggctaaaagagaatttaaattaggcccactagttacaataactcacgaggctatgacccaatatttgtaactgtctaaagcccaagttttggtcaacgatctctgactctctaatgtcccttcttccttccctccccattgtacctttcacctatcccaacaatggtggaaatcagaaatcccggtattgctttaacgaatcaatcagcaaggaagtgagaacgagaaggagagatctgtgtttcattagagatg

SEQ ID NO: 29577 - DNA, 3003 bp, Unknown
  misc_feature (1)..( 3003): 2750-1469P.txt file - cDNA_ID_3019302; gDNA_ID_2684229; Annot_ID_192164
ttgtatgtctgtcaaaatctgacctttttttttacttcaattatttggtcattgtgaaggcaagccaatcaagagagcttatgatggattgttgcttgatgctggaggaactcttttgcaattgtcgaaacctgttcatgaaacctacgcttccttgggccaaaaatatggtcactttcttacactctttgtctttgatctgttccaaaaccaatttcagatgttctcatgttggcatttgtttctagttcaggtctcaagacaactccagctgagatcaaggaaggtttcaagagagttttttctgccccttggcctgagaagttacgttaccaggtccctaaatgcatgtgtgaatctctctttgtaatagattctatctttgctcgttactgtaagcaaacgtattaaaagagaacattctttcattgttagggagatggaagaccattctggaagcttgttgtttcggaagctactggttgttctgataatgactacttcgaagacgtctaccaagtgagtatcgagtgaaagactctttctttgaggcttttgactagtctttcggttccattaacaatccatcacattgttttatctcttaagtattatgcgaatggcgaggcatggcatctcccagaaggagcttatgagacaatgtcactactgaaagatgctggaggttattattactctctccttgttaacttagataactttttgtattctttatggcggatttgtaaaattggtgttagatgattgcagttaagatggctgttgtgtctaatttcgataccaggctaagaaagctattgaaggatcttaatgtcatagatatgtaagctttgtcatgttttgttatataaaccagaagtctgagtaccaaagttaacaccatgaatggtaatcgtttataatgcttgcatctcttgcaggttcgatgctgtgattgtatccgcagaagtcggatacgagaagcctgatgaacgaatcttcaaatctgcgttaggtattggcatattgcattctaaactgaagtgttgtttcgtttaaattataagaaaggtttcagagttaacattttgtgtcaagcggagaacaaattaacgttaacattttgtgtcaagcgcagaacaaatcagcgtagatgtaaacagagcagtgcatgtcggagatgatgaaggagctgataaaggcggagcaaacgccatcggtattgcttgttggtgcgccaaatatacttttcatcttgttttttccgaggtttttaaattctcatccatcataacacatagtgctttttgtttatctgttttctttgaaaatttaggttgtggggagaagatgtgcagacattttcggacatacaaaagcggatcttggtttcagaactctaagcttcaaagattttgttctgcaatatttttcagaccctgtacacacttactcaatcaacactgtaatctgtctctttaaaaatttaattaataatgaaaaagctgcaaacttggacaacaagaatctaaaatttaaatcaaatagatggatccacgagaagcaaacaaaaagaagaaaatggtgaaagttacaatatagagattaaactctcgaaataacaaaaaacactatctccgcaacgataggtgcctatggaaactgaatcaacagatttggttttgatatcatatatcatcagctgtctactatttgatctaggacaacacaaaagcttattcttctccaaaatggctactggtaatgattgcgtaacactacgattcactatcgaatatatttgttcccaggtcttgttctctgaattgaacgaccatattatcatttgttggagaggtttactaaccgataagcacaaacggttattcaggctgcgtgtgataatgtttctatgatctgcttccgcaaaaggagctttagagataacttgaaaagtttcggtgtggagatctaacgctaaaactttaatttctttcttcccggttaaccaataaagcgatccatctacatacagagcatgcccccgagacgaggaagtattaatccgataaggagaagaaggattgatatacctccaagtgttggtgctaaaatcaaaaacttcacatgtagtagcgttttctaggccaagttcggaagagttatacataaccaaaccggtttgtatatgccactgattttgtctttgccaaatccaaatttaacgtgactaaaataacttggctgctcaagacagatttgttgcaacctggaaacagggaaacgtcgatgccatcgagtggcgggattataaacaatgttgtttaaggtttggtaatcaaagaggcaaacaagaccgtcacaactattgtggaaaagttggtaaatatgatatcgttctgatgatatcaacaacacgttagttttaagtggaggagaatcagcagtaacatgatggggcaacaccaacgtactgggtacttcagacaccaatacaagatttagatctttcccgccagctgagcagatcaactgtttcgcctggaaatattgagattcgattgtcaacttccattgtttgcaagcagacttgaatctgagcagagatttcaccggaactctctcaagaatatcctcaacggtgtcgtggggaagcaattgcattatttctctgtctattgagaggattttgttctgagtgatggataacatgaaagatatgcttatttgtatcaattcaatccaatgttgattttttccttgaggaggaagataaaaaaaaaaaaacgtatatacaatcgatgggccctaaccctatccctaacaaatctctttaatatgtaatgcgctttaatagttaaagcccattagttaaaaacccagagctatattgttgacctagcaaatttcggatctataaattgaagccattttctaggtcattagttttttcgtcgagcagccgcgctttttggccgaggaaggataaagagagacgccatg

SEQ ID NO: 29578 - DNA, 3000 bp, Unknown
  misc_feature (1)..( 3000): 2750-1469P.txt file - cDNA_ID_3019333; gDNA_ID_2684229; Annot_ID_192187
tatttgtattgctatatatccacacattcaaacttaagttgggctgaaattaaaataccttcatgataactcttagtacgtaagacatatacatatattttctttaacaaaaaaaaagaaatatacatatattttgcagagaataaaattcactccctcgtatcaaatatagatattgatacaaagcttacaaaacgaactttatttgtaaatcaaatggtgcttgtcgacgttgtcgtctttgagcctattgattagttgtccgcgagattcagtaaacatttgaattaatatatgcatttttttgggagatgggtaaaacaatagtcaaacagaaatcaagatataatcataacataatgatattttagatatttgttctatatcgttttcatctgaaagatcctgatgagaatttaagaaaatggaatggaattgaaaaaataaaaggattcaaaggtgtaaatgtaaatggaacttaatttttttaattatttactgaaacaaactaagaagcttacctaaataggaaagcaacgaacaagttaagaagcacttgtggctagtggttacggtatggacaatgttacatcacattatccttacgaaagattctttctgactattttataaaagtcaaaagtcaattttcaaaattccgcgtaagcgtaacggttttaattattaagttatggtttggtcaacgtaggccagcttcaacaaaatctaaaccaaattcggatactttattatttcagttttttcgttaatgcaaatgtcaagtaattgcaagagttgaaaatagaaagcgaaataatcaaataccccgaacaaacactcttttgttgaaaacgaatatctataatgtacaaattaagattgttcaatccaataaaagatttagttctttatcaaaataaatttttatgagagttcaataatcatcgcagaaacttattatataatttcagattgctaaatccaatatgagaatgtaatcgtttctaaaaatagttaactcttatccaataataattattatgtagacaaagatattaggtgccatattaaaggagaaaaggcaactattggaaaaggtcgtcgggtggtgtctacgcgctatcgcagaaaaaagtgaccatgattggttacttatttcgctcctatatatataagacgtatttcgtcccatttcgaaaactcacatcaagtttcttcaattcattaaatcacttctcaattagctcttacgaaattcttttcattactaaaaaaatttacaaacaaaagtctcttgtaataagctaaatggcgatcttcaagattcttgtattgttgttgagtttgtgttgtttcagtcaagcacaactttctcctactttctacgaccaaacttgtcaaaacgctctctccaccatccgatcttcaatccgaaccgcaatcagccgtgaacgtagaatggctgcttctctcatccgtctccatttccacgactgcttcgttaatgtatgtacttaaaacatttgattcaacatgtgtgtgtgtgtccatacatatatgtgttttatggactgctctaaactttatatatttttttttttttttttttaatttgtagggttgtgatgcatcggtcatgctcgtggcaactcccaccatggagagtgagagagattcattggcaaattttcaatcggcaagaggatttgaagttatcgatcaagccaaatcagctgtagagagtgtttgtcccggcgttgtttcttgcgctgatattattgccgttgctgctagagatgcttctgaatatgttagtctctatatccatctttatatacatatatcttgattattaatccaaacatgtacatatttatatattcaactactactttaaactttttcaagtaatataatatttacttctctgacgtaaaatgtcatgtaaatgttataagtttacggttgcaaatttgattaatcatagttctaattaattcttgaatatgtaaattttggtatcatcaataggtcggaggtccaagatatgatgtgaaggttggtcgaagagattccaccaacgcgtttagggctatcgcagacagggatctccccaacttcagggctagcctcaacgatctctctgaactcttccttcgaaaaggactcaacacaagagacctcgtcgctctctcaggtcagtcaccccgtaaaacacacttttggtcactaatttcttgccatttaaaacctttcttgtgacacaagttaaccctatttacaggagctcacacattagggcaagctcaatgcctcacgttcaaaggtaggctttacgataactcgagtgacattgacgcgggattctccagtacccgtaagcgtcgttgtccggtcaacggtggagatacgactctagcacctttagatcaagtgacaccaaactcgttcgacaataactattacagaaacttgatgcagaagaaaggacttttagaaagcgatcaagttttgttcggaaccggagcttctacagatagtatagtgacggagtacagcagaaatccatcacgatttgcgtctgatttctcagctgcaatgatcaaaatgggagatattcagacactcactggttcagatggacaaatccgaagaatctgcagtgccgttaattaaaagagttattacctacttgtcttcaacgagaaaagttcgaaccttgaaaattcatgttattatatttacgtgtataccccatttgattcatttttgtaattgtgtgtaactaaaattcctgcagcgataattcgtttgttatttgaatatatggaataataaatattttggaatatataaggtaccaaggaaagtgttaataattaaatccatagcattttttattagtttcgtcattgttaaattagtcacaatctctctaaagttcattaaaaagtccagctagcattaatttatccacgtatacatacacgtggaactatg

SEQ ID NO: 29579 - DNA, 3000 bp, Unknown; identical to SEQ ID NO: 29578
  misc_feature (1)..( 3000): 2750-1469P.txt file - cDNA_ID_3019333; gDNA_ID_1972118; Annot_ID_178843

SEQ ID NO: 29580 - DNA, 3003 bp, Unknown
  misc_feature (1)..( 3003): 2750-1469P.txt file - cDNA_ID_3019345; gDNA_ID_2684229; Annot_ID_192182
ttaaaagagttttgcttttgcttttttttcctctttatgatcgtgttaatatatagtacacacaaatatgtgtatttacatgcatatgaacaaagctcttgggtccttatagttttgtgttcttttaatcatgcattataataattcatacatgcaaaaacaaactaacggtgaatatgcacatgcccactattttgtatgttttcgaagttttctttctggctctcaaattgattcattagtcttgtaagcaaacgttgtctccatgttattttggataatataacatgtagtcatgtagagaatacccaaggaggaatcaaagtcaagcgacagattaataatatcatagatggtcctgttcttttttgtaattagaaggaaagagtatgtacatatcctatgaaaatatcatgattaactattagtgatactttattaattcaataattaatactacctttttcttaatgattaaccaattgattaatgtgcttaatgttgttgttacattaaccaatcgtcctacatttaatgggcctaatactaaataatgggccttaacgagcttatcatgttcagttataaactcaaatattttttaaaaaaatcttcttccacttgaatacgaaacacggaaacactaacgaggaagagaacgtgaagctatatatatatgtctcgagagctcactgtatctcttgccgccatagcttcacaagctctaacatttcctcaattaaaccaaatccatgctcagctcattgtattcaattctcttcctcgacaaagctactgggcttcgcgtataatcagctgctgcacgcgcctccgtgcgccgtcttactacacgcggctcattttcgattcagtgacattccctaatgtcttcgttgtcaattccatgtttaaatacttctcgaagatggatatggcgaatgatgttcttcgtctgtatgaacaaagatctcgttgtgggattatgcctgacgctttttctttccctgttgtgatcaaatcggctgggagattcgggattttgtttcaggcccttgttgagaagttgggattttttaaggacccttatgtgaggaatgtgataatggatatgtatgtgaagcatgagtcagtggagagtgcacgcaaagtgttcgatcaaatttctcagagaaagggttctgactggaatgtgatgatttctgggtattggaaatggggaaacaaggaggaagcttgtaagttgttcgatatgatgccagagaatgatgtggtttcttggacggtgatgattactggttttgcaaaggttaaggatttggaaaatgcgaggaagtattttgatcggatgccggagaagagtgttgtttcttggaacgctatgctttcaggttatgctcaaaatggttttacagaggatgctctgagattgtttaacgatatgttgagacttggagttaggccaaatgagaccacatgggtcattgttatttccgcatgttctttccgtgctgatccttccctcactcgttcactagtaaaactgattgatgagaagagagtccgtttgaattgctttgtgaagacagcattgcttgatatgcatgctaagtgcagagatattcaatctgctagaagaattttcaacgagttaggtacgcagaggaatcttgtgacttggaatgctatgatatctggatacactagaatcggggatatgagttcggctaggcagctttttgatacaatgcctaagcgaaatgttgtttcttggaattctctgatagctgggtatgctcacaacgggcaagctgcactagccattgagtttttcgaagatatgattgattatggagattccaaaccggatgaagtaacaatgattagtgttctctcggcttgtggacacatggctgatctagaattgggtgattgcattgtagattacattcgtaagaaccaaatcaagcttaatgattcaggatacaggtctttgatcttcatgtatgctaggggtggaaacctgtgggaagcaaaacgggtgtttgacgaaatgaaggaaagagatgttgtctcttataacactttattcacagcttttgcagctaacggagacggggttgaaacgctgaatttactctcaaagatgaaagacgaaggtattgagcctgaccgtgtgacttacactagtgtcttgacggcttgtaaccgtgcaggattactcaaagaaggccagagaatattcaaatcaataagaaatccactggcggatcattatgcttgtatggatttgttgcgctgagttgataagcaaatagattaatcagccaaaggtagaatgtacagtccctaagaaattgccaatggatgcacgctcctcaatgccagtcttacatcaggtgagcataatctgtatttgaattgatttaatataaagttcaaaaaaatttccttacaacctaggaaaaggatagaacccaaaattaaaactaatactaaagtcccactcttgtcaatgtaataatatggtcgtctggttagaccccactttttgcctttttttgtttctttagttgcttcttctcccatttaacattccgtgtgaataggatatccttaaagtggtttctatgtgatttcttgggtcttttctttgttatttcttacatgtgagtgcttccctaaagttcacttttgttttgtctaccattctgtgtgggttcacttatttactggtttttgcttcgaagcttcctcctgaaactcccaagcttgccactttattttgtttaagaatgtgtatataatctgaattgtgggttagggcaacgaaaccacagtagaaaaccaacatctgcagaaaggaaactatctcctgaaaagaaaaacaaacttctttgttcctgtttatattgttctctttctcaattatatcagttttgcggagtttctattatataactgtgtcttgatcactgagtttctgcctaaatttttttttctatg

SEQ ID NO: 29581 - DNA, 3003 bp, Unknown
  misc_feature (1)..( 3003): 2750-1469P.txt file - cDNA_ID_3019359; gDNA_ID_2684229; Annot_ID_192176
gctttctggaataaatccatatctactggatttgttctctgttatttcccaagtttggtctctattcagtaatttgattattgtcaatgcatattgtaatatttgcttcttccatcaacagtttgttggtcaaattttgcaactcttcaagatattgttttggtccatatagctaataacattcgagacaagataagagagctaattgatgaaagtattacgaggagattgtataattagtataaagatctaaggtattttgattttctcatttttccgtagaaaaaggaacctggatcctattaagaataataatccgaaaactgcgcattatatatgcagtcttagttacaaaacaccattcatagaaaaacattctctttcgttttctctcctctctctccatattgtttttcttgaacaacaagcaaaaacagggcaaaagctttggctgtttgttggaagggggcaaaatggttatgtaatcagcaagcttcaccaagtttgcagccaagtactcctgcatccatggtaagtttccggaccatcgttcccggtttaggtcgaattgtaaacttgtttgggagcggggttttcggtttagagctccacgcatttgcttttccggattgcacaaaataagctccgttgagaaagtaatctccttctgattgccaattccaagatttccattcaccgtatggtgtgtactctctttttgtaatctgtttggcttcttcattaggaggagcaatgaaacgattgccttgactaataattgtagggttcatgttcccaccaattgcatacatttcccaatgtgtgtagtcattgttcaccacatgtatcgttccgtatctgcaacgaggcattctctgttccaatcgcttaccgaagtggttaaacgcaaccgttatctgcattttcttgtcgatcacgtgttcgtccctcgccccaaacaacatcacctgttctctcacaaaatttaaaacaagactctaaattagaggtcttgattgtttcatatgcaacttcacatgagcgaaaacaaaggaatctttttacctcttggtggtcggtgaaatgactgttggaaatagttacagcagtggagccgtcaatagcatcgatcataccatctgcacatcttgtcattgagacatggtcgatccaaatattggttgctccaaacaaactgattccatcaccatcactttttgtcctaagccctatgtgagcctcagagtctctgatcaacccaccgttcccaggaacaatgtgcttgacataaatattgtgaatgatcacattattcacaaattgcaacgttaatccagcaccttccatgatgtaaaccctagctcctcttccatcgattgttttgtcgctcgttatcatcagttcttgttgcagttttatgatcatgcttcttgcgaatatgatccaaagcggtccgtctcgagtcactgcatgccttaacgttcctggtttagggttgataagatcgttgtcagacgcgtctttgacgacgtatatcggtccgtcttttcctccggtggttctccggccgaatccgagcacacagtcggctagtttcttccggttattagcccagttacgatcgcatcgccagcagttgtctatcgggttataagctaggcattttccgctgcttttgtgcgttttacgaccacttctcacctgagtaagctctctccttgtatcgttccttgattccgatgcatccactgctctgttaaaaaaaataaaaagtgtttaattagtacttgtttaggaagttaggttaaacatttgacctaacaaagacaaaaactcacatattgacatggtaattaaaatggttggtgacgttaagtggatgaggatcgtaagagccgatggtttgtttcaatgcatcactttgtcgttgcgtccagtagctatcaaagacagcaacattgcctcgaacctgtggggccactatagctaagaacgaagagaagaaaacgaaaacatagccgccaagattcaagaaagctgctgccattttaaatatattgcaaatgcagagaccaaagcctgtgaactttatattttcccggcaaaacctcaaacggaggttgttgtttcagataggcctgccgggattaaaagattaaagatttgaatcacctgattgctttaataaccaggaactggggagagagaaaaggagatgagaagagtcaatagaggattgagaattaacatagattagacaaccattgatttaaatctctatggtcatttctccaaaaaacccaattatagattttggatgcctttgtttaatccttcttttctggatattttcagttatttttgccttgatctaatattatttttactgagataattacccaatagcacctttaaaacttgaggtaactatttttgtatttacttaattaatcatacatactacatatgattattaaacgtagtatatatcaagtctctaggtctattgaaaataattatcatacaagtaattaaaaaaattccccatggggtcagaagctaattaatggcgggactctctgttcccccaaaagaatttgaagacatgactataaaaaaaaaagaatgaaacaattttattttggactcctgatctgtgaaagactgaaacagttcatacgcaaactgatataaaatccaaaatgttatctctaagaatatggtccgtgatcaataatacagatctaaaattcaccaacttatatgcaaattgcaaaatgcaataaataaatcttgaccatatgttacaaatctaccagatcattatgtacagagagcactgcgagtcttgatcacacatttcaccagaaaagtaaaacaatacaacaccataaatgtttcttctcctaccgatttcaagaaagacactaataattactcaaagaagctttaaatgttaaatctctttcaccggagaaagaagattcttagctgaaaataatg

SEQ ID NO: 29582 - DNA, 3000 bp, Unknown; identical to SEQ ID NO: 14850
  misc_feature (1)..( 3000): 2750-1469P.txt file - cDNA_ID_3019363; gDNA_ID_2684229; Annot_ID_192174

SEQ ID NO: 29583 - DNA, 3000 bp, Unknown; identical to SEQ ID NO: 14853
  misc_feature (1)..( 3000): 2750-1469P.txt file - cDNA_ID_3019368; gDNA_ID_2684229; Annot_ID_192171

SEQ ID NO: 29584 - DNA, 3003 bp, Unknown
  misc_feature (1)..( 3003): 2750-1469P.txt file - cDNA_ID_3019372; gDNA_ID_2684229; Annot_ID_192170
tcgagagaaaataatcaacgagctaaaataagattgatcgatttcgaccctaacgagttttacttacaaggtctcttgaagaatgccttggtatatgtaagctgcccagatcccagcgacacagaacgacaataacagaactcgccggagaccggaaccgtgagattccatcgccgcacgtcgcttattgttttatccgacggagctccggcgaaaatttgaatttcaattttacgctatttgatcagttttgcgatcaaattatgagatcggtctgaagtggaaacgaaagttattagagagagtgtaggaggcgcgagaaagacgtagattttccacgtgtaactgtgtcattggcttaataatctgacatgacacttctgattggctataggacgtggatttatttctggaatccaagtcatatgcacattcatgtctgagataggaatgggaactatgtgccgttttattgtcatgaaaacgtcacgcagtttcctagaacttgtaaacggatgttctttttacagcttgggccttaatttgattaagcaaacttgcacacagctaatcatgtcagtttgactaactgatgaattcatacaaatctaagatcacttgtggtaagaaaatgaaagaaaaaggcgtatatacacaaatggaggaaagttgccaacatgatttaattgattaaaatttagtgatgacccattgttaagattactaaaacaaaatatgatatatcttaaagtaaatgtgacaataacgtcaacatagcgagaaaagtttgaaatatcgaatttccattatattaaaacaaggtatcacatgcatgcactcatgcatagttcattatgatttgagtaattttctatacgaataatattatactatatctcaatgaaaatagaagttatatatattgggaaacggaatttatatgacatacttaatcctcatgggagaaccaattatacattttgaagagtcaaaagtcaaaactcaaaagagtgactcttaccggatacaaaatgaaaatagaagtcttggtgagataacaaattaatgtgtaacataacaatataatatcataaaagattccaaatggggcttttgtccacacgtgatatgcaatatgcaaaagaaaaaagaactctctttcgatctgccggtcaataacaatgtgaatatagattaactgattaataagtagtttcttgggtcaatgcatgggatattatatttaagaaatacaccaaaaatgtattcgacgttagccaccacgttccattaaaaattcaaatctaaatgatgattaccgtcgtctacatctatgattacaaattttttgtctactatgcgtttagttatttaccatggtttgacgattatatatataacacacataaattatgacggtttaacgttgtctcttaactcaaaacttaattttacaaaaatattatttaagagttgaatctcatactttaattattcatttggtcaactagaatgcgaaaaatccacaatacttcgtaactaatttcgggtcctttaaatcttgatcacctgttgatcaacaaaagatctacacataaagattgattcatccattgactaaacttttatttatcgaagaaagactatatatatctaatgcatgcatgccatatgcacaataatctaatagtaaatccaatacgtctcagaaagataaaatcgtccataataccaaattttattctaaggttttgatatctctcataatttggaagtgtatgtaaaagtttcttaaacataaatataacatccaaagaaaagttgtaaacacttaacatcttgattgaaggggaatctcgctaataattgtgactgaacgatagtaagtattattgtaaaatatcgatcaaaatttcaacgatatgggcgatccagacccaccactttgttgtcccttagcagacgtcaaccatgaccataattagttaaaaaaaacaccaaacaaaaaccacaacttccttttaattctttttaaattctaaatttcagactaacaaaaagtattcataagctgtttcatgtatgaatttaatatcatgaatactaataacttgagccattaactttaaccaaaaaaaaaaacttgaacaatctaatataattccctgtaacatttaaaagatggagatgggaaaacaagaattctaaagaaacattgtaaaaatgaaacagagacaaatattttcaagcaagtcttgtttcatttcatttctgtttgaaaaatgacaagtttaaagtcatgtctcatatgtgtaatattattaactttaaaatataacaaaataaatatctttgattactttttgaaatgttttttatctcaagaatttggaaattttcgttgattgatacattataaaatctgaaaattagatgtgaaacacgactttttgtccaccaccaatcctcctagaaattatcagtttatcactcgattactgaatgaatgaatgagttatctctgaaaagttgtcgtaccatttattatcccacgcggatttactgccgtgagcatgacgttaccgtatctatctcaaattactaaaattgtcctttccgatggccgtctaaaggaactaactcgagggcattttgtcattttgagaaattgttatgagtttgagtacaaaacaaaaggacacgacgactttgtattatttgcttcaaatcctctgttcttcaccttccttgttccttcttctctccttcttttttatatagattttcctttcatgttgtaatacttttattctattagcgttcatattcagctaaacagacattgcgccgccgttaagtcgaaaggatagaaagaaattaaagaaagaagaagcttgttgtctttgcttcttgaggctctcttcttgtcttgatcatctgttacgttgttccacgaaaagaacagtagctttgtctctccatatagggttattatctgaaatg

SEQ ID NO: 29585 - DNA, 3000 bp, Unknown; identical to SEQ ID NO: 14858
  misc_feature (1)..( 3000): 2750-1469P.txt file - cDNA_ID_3019376; gDNA_ID_2684229; Annot_ID_192169

SEQ ID NO: 29586 - DNA, 3003 bp, Unknown
  misc_feature (1)..( 3003): 2750-1469P.txt file - cDNA_ID_3019388; gDNA_ID_2684229; Annot_ID_192166
agaatccccaaaattttgtttgtatttattttcgagtagttgatataccttctcatgtgagttacattactttacgagccattatccgacgcgtgaaagcccaggctacatctgtattcacaactgaggaaaaagacaaaattgccaacaaaagtattaggttgaaaattgatcattacaagttgcaagttgcagcacattacaatattttcttctcattacaaaaaatatcgaaaaagattttttgtgtgtgtatttgaatagctgttataccagctaattgttttgaattatccgtcgtaaggagataacgtggtggctcctaatacctttacttcttcttttcttctcttttggcaatgccttgtcattcaagtcaacgtcgaatttcaacacgtgctcttcgtaaactcaagattacatagatttgaatgtaactaacttatcacatcttatatctagtcttctaaattttgctgtctatggataatataacataatatatggtatataaacaacacattatgataaatatcttaaatacattcactttaatgggatcgtatgaaaacattttgtgtttcttttggtcataattgcaagttgaagtattggttaatgctgaccatcaggcaaatacgaagagtaaacaatacatgattaacatctaagaattgtttgttctggtttcggccgttttagttttcggtggatatggaaaaatgtgtagaacaaaaaggttcagaactccagaattctaccacacaaaagaaattgtttcaggtttgacgcttataatttatgatttgtggaacaatgacaaagattatcatcgactaatcttagaagacacttattaagaatcacatatgaaaaaagcttactagatacaaataatataataacaataaacaaactctattaacaatagaggaaaattgggagatatcaacttggaatgtgatatttgaatcgactaatcgagtcaattaaagacaaagaaaattatgatttaagaaaaacaggtgagtttgataaaacacgttgtagtcttgttgtagatctccgaattgacgtcaactcaatatcaaaatctttcactatgaaattcaaaatccgaatcaaaacgtctaacctagctatagaatatatacattagtcaatggtcaaccttttatattttattgttataatcatatatggtgaagataattgtatttggaggaccaatattcaactatttcctgtaatttagaacatttatttttttcttaaatatatgttttttgcttatatatagtcgcaatttttagaagttccataatccatatacttgaacttctaaagctatagtcgcaagcaccttattgttgttgtttaataaaagttctaattttggtagacaagtgaaaaaacaaaattaaactatctggtgtttacatatatgaaaaatatacatttccagcagtgaattttggttttgcatgaaaaatacataaatagcaattcactgcagcaggggtcagaatatagaaacatgaaccacacacataaaaaaaaagtagattctgactagatcaatctgaattaaaaactagtaaattttgacagacggacgtggccgtggaaagaagtagaaagagacaatgagagatggagaaagagagacgtaagtattgatttggccaacggctcatatgcaaagaatattaataataataatgttctttgcgtttttttaccaattacatcaaacatttgttaggcacacgtcttttctttttctcctttttagttaagggcatctccatccatgaaaaacccacaaagtttctcaaacaaaaaaaaattaatattatattataatttgattttttgattaaaaaaatatttttattaaaaagttgaatcaataattaaaagggaattatcatgatggattgtagagaatatctcagagtttctcaagtaagaaactttctactctctctccttcatttttattatttttattttttaattgtgagaaactcttataaaaaacccccaatgaaaatggtctaactttcttttccgttgaatttctctcatgtattaacagtaacataagtatttatatcacatacacttgtcaaatttgtctctttagagattttaaaaagttatcacttagagaacttttacctgtttggactttggacggttagacagataatatctaaaattactccaatttttatatatacatgcaatactaaggtataaaaaaggttctagaatgttaaaatcgttgctgaaaaaaaacaaaatcgtctatagattgttaatttttgcttcttgtacaaacacttagtaatgattaatgatttaattttaatatgtaaagactgatttttaaaataaaaaatagcataagatgaaaatttatgtttcaaaaaatatttgtgattatgggttgtttgagactggaaaataatcaaacaacattgggcctttcatgtagaattttttattacatttagaaccgttaacgatatgggctaactcaagacattaaaggcccaacattgagttactaaacggcgcagtttttagctttttaaaattgcgtctttttcgttcactgaaaaggtagtccttctctttcccactcacatcatcaacttcatcaattcatcacctttgtctctctttcaagcttctctgtgtgtgatctccgttggtcaacaacaactacaacaggtaacttctattcttcgattccttaaatttcttctctagagcttagtgaatcaacgatttaggtctgaacatatttggcaatctgtccttgctcaaatttcgcttgaaaatttcaatcccaaatcatgtaaagctaaatcggaaagttctatgtagttcccaaagttgaatcacgaactggaagtaatttaatttattgacttaggatatgttgaaatttttaggttttttgttttgtttttagcttattgagcagagatg

SEQ ID NO: 29587 - DNA, 3000 bp, Unknown; identical to SEQ ID NO: 14842
  misc_feature (1)..( 3000): 2750-1469P.txt file - cDNA_ID_3019400; gDNA_ID_2684229; Annot_ID_192161

SEQ ID NO: 29588 - DNA, 3000 bp, Unknown
  misc_feature (1)..( 3000): 2750-1469P.txt file - cDNA_ID_3019404; gDNA_ID_2684229; Annot_ID_192160
gaaaattcttcctcggagatatggtgacggagctggaagagcttgtcgaatttttgtcatctccttcaccgcctgtaagctttttggtttcatctgtttctgagctatggggatgcattgataattttagattctagggtttttgttaccgatgagtctgattgaatgaagaaacaaacttgtaggtgaagaaagctgcggtggaaattgttagtggtttaactggttccgaggaaggtttacaatctctatcaaagtattccgagattcttcttccatcattgtctcagcttctaaatgaaagcaaggtcattgaatcaactcttaagaagcactaattgtttcctgaatttggattgagagatattgaaatgttgttttgaattcaattttgcaggaggtatcagagccagcagctcaagctcttgttaatctttctcagaagtgtgaattggcaaagaagatgattcaaatgggtttgattaaagtggccatggacatgttgtataagccagagtcttgtattaccagattacttgttatgcttctagtgaatcttactcagttggatgatggggtttcttctttgcttcaggtcgtttatcataagttaaatttgtgtaatatatagtggggattatcttttggtagtctaatggtgacgtagctaatcgtgtaaaactttatgcctttgttagattgacgatgagaagatgcatggactacatatcatgaagcttgttaggtcattttgcaggtcttctggtgaaactgctggtatgtacttcccactttagtattgtaatataatttgtccaagtttatatatatatatatctacttctagatatgatagtttggaatttccttttcatatatcacgtttttgtttcatatatctaaatctaatcctcggtaggacagtctagaattttaatgtttgcattggcaccattgaatattatgcgtagttacttactggtagtttttttagtttgcaatcaagtttcatagctactgtataaaaagaggaatgaattactgaatattgttcttatttgcgcaccagatgatcagtttgagcatgttggttcgatccttgtcaacatatcaaaaacagaagatgggaggaaattgttactggagccaaagagacgactattaaaacagatcattaggcagtttgattcaacaaatcaattgcgaaagaaaggggtacgtttaaaaggagtttggcagattactctttaatgaacatgttgcttagtctataccctttgaacaatttaacatggattatgcttatcggctttcaggttgctgggactattcgtaactgttgttttgaagccaaaaaccaactccagaatatactcttgatatcagagtttctttggcccgctctgctcctaccagttgcaggcagcaaggtttgttgattttgctttatagctgctacgttgttgcttacaaaggttttcttcttttatgagaaaatagtttctgattattgggttttactttccttagacatacagtgagcaagatgtcgcaaaaatgccacctgagcttggaagtgcactgtccattgagcgagaaccagttactgatcctgacattcgcgttcagacactcgaagctatatatttgatcatcttagaggtaaaacatttctctgtctcgctttcccttcttgtgaactcttgtgaaggaccaatcaaacccaaaacttacaaaaggtcctctgttatgtcaaaactacttttgatgttgcaggaggcaggtcgaagggcattttggtcagtcaacggcccacggattctacaattgggatacgaatatgaagaagatccgaaagcaatgagagcctatgagcaagtcggttctttggtatgttcactccctctaatctcactcactgactaactctacaggacttaagatagcatctttctcactattaaccgttatttgctgtgccgtttttaaccagcttgttgaggaagctggaggtccggaagagtcgttggagccaacaaaagcagagtcttgaagttcattatttgttgttctccgactctagtccccattattggctgccctcgcaaagtaagttacttatcctgttatgaaagagttactactacatcttgtgcactactagttgtaacactagattcgttattgacttacgcgatcttattagtgctccattttctatttttggttgtaattttattttatattagacattatagtatgttatcttcgttagacaatatatttgtgtattcttacacacattttttgctacttctctaattgttttgaatctgaatcggaaatcaagcagagaagatctaattaaactactaatgagttaatgttttttacatattttatagaaatatcaattaataaacgataaacaccacattattgccaaccccacgaggtagccaccaaatgtgtccacaattgtacagataagagaacagagaggcaaaatcaaatcaatgattttgtttttagacttttatgttttttggcatgtgtttctaatcatattttcaccattcgtatattaaatttttaatatgtagagattgtaattaattagcacacattaaaattgaaaccagttggcgccttgaccattcgtttaaagccacgtggaaaattccgaatagttgggtcccacctgaaaaatcacgttagatctcttcatcatctcctcctctgcattttcttctcctattcttctcgacgacgaaagaaaacaccgaagcaacgaggaagaagaagattataatctaatctctccttcgtgtagtttagcgaagagtgatgcgattttcttctggcggtgtttgatttcgtattctcgagttgttgtgggggagagattgattagaattagagatgatgagtttcgtgatttcagatgaatttctggggacatttgtgccgattctggtgtattgggtgtattcagggatg

SEQ ID NO: 29589 - DNA, 3000 bp, Unknown
  misc_feature (1)..( 3000): 2750-1469P.txt file - cDNA_ID_3019412; gDNA_ID_2684229; Annot_ID_192158
cagtaaatttatcttgtaatagccaaaacttcagatcttctctgttattattatctgctttataattccaggttttgagacctgtgagagtctcattgatctcctttgttacgaattgacatacgcagagtcgttgattctttcttttatgcaaagggcttctcgcttttgttgttcttatcctctccaaacatggcagcaacggggtagtttttctctatatagttagtttcatagactaaatgaagtcactgttcaattatttcaaaagtggacctttgaaaaggatacaatacttatcttcaagatctattgatactttgtgacatggttgattgggtttaatatcaaaaggttgtttcttgattagatccagctgtaagatctgaatcttgaactaaaactttaaactgtatgacaaatcaatctttttcccaaaacctaacattcctcctgagttggttacagagacatatcatcatcaatgacacaattaaggttttgtcgacgtctactttatctcattatcatcacatggtcttgacactggagatgagttctggaccagaagactctggagtggcttttaagacatgttaggtgaaaggacactatcattgtttgattgagtttcctcattaaaggctcttttaggcaactcgtacggtctttgattaaaccgttaaatctaagcctaatgaggttatctttctattcttgagacaagcacatgaaaatgaggtggaccaaatgtgttttgtgtctagtctacgtgctgcatttaattatgtctcctaagtcaacaaaaggttacaatcacatcttaatatttcacatggaattgcactcttggttatgtcttatttgcggattagacccaagtgtctattgttcacatggtgcagttccttataatctctggcaacaatagatgagttcttggcatcacatttcatcttttactcatttgtggtcagcagataagtattgattgatgatacagattgatttacacttctctatcgacattcttccttaataaaccagttaaatcaaaaactactgttttcaggtacaacaatatgaagatggtattagcaaatcaaatattttccactcaatagacattttacatgtaaaacgaaaggagctcaggtttttggcataattaagtatacaaaaaaggcgattgcgtgtgagaaacagaactactgctgatcctccttcttgtttcagtgcttgttggattagcttctacagggaatcttggaacatagctcggtgttctgttcatgcttgtgtatgaatcaccagaaactctgacagatttatgactcttgcatcccattaataaaccgctactgctagatttccgtctctgaggcgcgatttctcggtttgattttgccatgatagggattcgaggaatctgaaaagaccggttctttttgacgggactcgtagcacattcagacataacagagaaatctgctacacttgctgtcactacactccattgtatgcttacctcacttggtgcataaccatctggtgagtctggatcactacttccttgccttgcaagaaaagggtttgccttccctgttaagctctcaatctcaaaaagatccgtacttacatcgctcacactcccatcttcttcttcttcatacttcacagagaatccatgttcttcttttttcgcagagctcgagtattcccatggaaatttcttctgaatgattctcttctcaataagaggagatccaaatatttccagagacttcctctgctctagcattgcttcttgttgttgttgatgaatcttcatctccgagcttagatctccagagaaactcaattgagtcttgatcttcttcagaccagagcttcttctcttgtcgtcgacgacatccactgaactccagttcgaacacacgcatctgcagccaagagtagcgagaaaactcttcttattactcaccttgtgattgctactcatatccttctcctgaaagtaactgttgcaactagagtttttcttgatgttcttcttcttctctacatatttgctctgaagcaacaaactctggctattccaactggattcagaccgaagactaggagtttccgaggaattcttcgagctttgcttcggaccaacaaagattctctctattggaacttctggatctggcagaggagacacaagtctaggactgtggtcagaatccatatctccattgaagtacttctcagctccaaacacactgatctccaaatcttcagaagctttcttgttaattccaagaacatcattggtgataccactcattaggttcttctgggtgagagcatcttccttgcttgtcaagtaagagaaagaagtagaagaagaagagaaaggaccatagagattgttactgttattattattgttcatcatgaaatcaaaagatacgtttggagttgaagaagatgaagttaaggtcaccattttgtttctttttgtgtattactatttcttagggatgatttagatttgagtaatataaatagaagaaatgaggaagttccttgttttttttttgaagctatgtcgtgtgggttccattactgggacaagactgcctatttgccagtgattttgtgctaatgtataaacaaaatattaattatattttgtcttggttataaggaaaatgaaaaaagaaaaatagtggacatgattctcccaaggaacaaaattacaaattagaagacacgagggatgtacgtattttgtgatatactgacaaagacttgtcgtcgagttagttggtcgttaatgggctttgggcctatactgacataaatgggccttaaacaacgttattttaagtaagtaacggtttttttctacccgctcgttttagtcggatcttatcctcttcctcaatctgataatcgtgttggttcatgtgtggaagttctctaagaacaacagaaaatttcaaaatg

SEQ ID NO: 29590 - DNA, 1604 bp, Unknown
  misc_feature (1)..( 1604): 2750-1469P.txt file - cDNA_ID_3019423; gDNA_ID_2684230; Annot_ID_192211
ccaataccaaagatgtacatacctagtactgagaaaataggctttgatagggattttgcctagtgcttcctctgcctctgttccaaattcatagttttgatatgcatcattcgacccagaatcagagtcattgttgtaaatcgaaatcggagaagggaacgctgaaaagtgtcggaaattgagaaagcgagaagctaaaccaatcgttgggtgtttcgaaacacatggagaagaagaaaggtttagtctttttgaagaattgagtaattgattacgaagaagaagagcagctactgctctccatttacccattcaatgaaatcaaaattgaaattttttgtcctctgcaccagaatctctcgacttattatattagtcaatttgtattttggagagattgtcttttgatatcgaaagatatttggttacgaagaagccttggttctcgccgccggtgaccacagtcccctaatcaaatgatcgttttacttgtttcaaaacgactgtgttttttgtttaattaactaaaacgacagcggttcgtttaataaacttgtttcaaaaagtttaaaaccctcttgtagcattttcatattaagccaaaacaaaaacctaaaaccctatcttggaaaaatgttaagttagaaaagccctaatcttgtagccttggtttttgaagtttagaagaatgacgaatgtctagtccttaccaagtgttatgggattggaaaattctctagggtttcaatttttttccgagatcaatgcgatttatttgtaaaagttggaacaagtttatcaaaaagatcataattattgataaaacaccaataaccccgcatatagtcaattttgcagatttcttataaattaaactttaaaaaataattttataatccatcaaatttaaatactatttttttagaaggtccaatatatagtcaaactctactatatagggtaacgcgacttagtggaatcgaacctcgatagaaagacgaaatcaaatgaacttaaccacttgactaaaagcacatctctcaaatctaaaaactacttattcgtggtttatctataaaacttgaaatatttttgtcaaaagatcatatttttaataaaacagcaagaatgcaaatagtcatctttacggatattttgttagattgaagtttaaagaacaaatattacaatccatcaaatctgaaaactacttattagttatttgtggttgcctacagctttaccaataatgtgattttttataaagcttacattttgcttatagaaaacctttgaatgagttatagaaaacctttgaatgagttggtactattgtcgtcattcttctaatttctaaacttcaaacaccaaaagttgcaaagtagtttttttttgttgttttggtttaatattaaaatagatgatacgacatcggttaggcagttgttaaaacgctgtgtttcaagcctttaaacgacagcgtttcttaaagtgctcgatagccttttactttgtaagaagagtcgtcgtaatctcatttctcttttaactgagacgaaaaagattcacttctccggcgagcaatttcaagtttctcggtaatg

SEQ ID NO: 29591 - DNA, 3003 bp, Unknown
  misc_feature (1)..( 3003): 2750-1469P.txt file - cDNA_ID_3019433; gDNA_ID_2684230; Annot_ID_192218
  misc_feature (1945)..(1945): n is a, c, g, or t
atgtatctttttgaatattttgttcgaaagaaagcagaagcttctcgatcttaatattctgaaaagaataatattcgtataatggaattaagaaaaagtcatgactttttaacatcaaactagtgttcttttataaaataaggagaagtcatgggaggatataatttgtatattggtcataggcatatgattttaatgctcagtgtatatagaaacattttttattccaatcagggaaaattgaaaacaaatagacaaatagttgtcacatttgtctaaccggtatttaaagaaatcgcaagacaatttcagatacatgcggacaaagatgaatttcatctattttaatttttggaccatatattatctcgtggtttcggatttcatattgtttttaagcaaagttaaatattggcatatttttaacttttgtttatcagaacatcaagtgaatataatagaattttaaaagtacactaggcgttaaagtaaaacgatggattcttaaatgtaacgtttaaagcttatacaaaaaatttgttattttctaatagcatcttttaggattgtctaatagcaaaatttctaatgaacctaataactttttttgtttacattattaaatacctaattcacttttggcaagatggtataatggtttatggattatagaaatctaaatacgatatacggctagaacaagtgtgatggtttaatcgttttgggcgtgggaggtgaactacgaattgtcgtaagttacataattgcattcatcaaaatgtatggttttggatcattgagatatgaagtgaaccattatttttttttgtgaaataaatatttttttagtttatcatcaattccatgttcaaatgtttatctctttggagttttcaagaagttgttaagaaacatgttttctaatttgtggataaaatttgaacatcaatgctaaaacttagcattaactttttttaataggtaatgcaagtacaaattaaaggagaaagatatgatttgtccaattaatgaaacaacgcgttttatgtttagcaaacaaatggagacgtaaactcgatctattgtactccgtaaaagtaaatgtttttttttacagcatacataaatgtttttctaaagttaataatgaagaaaatgattattctttgatcgtgtagctttctccattctaaaattaatgtcccaaatgatcgagtctagggggtaaaattgtacttgtgatttggaatttactccactctaacttcaacacccgcacaaatatcacaaattttaactcaaacctacaataaaaggtaaaaaataataaattacaagatgattttttaaataaatatcttttatcaatatttaaaggtatgtattattaaaaaaatattaaaaggtaataaatcatatctttttgttttgtgcacaccaaatatacaaagcaactgaattatataaaacgagacaaaattatccagcttcctatttgattcgcctagaatattttgacgtttcttaggtcaaagagatggaaagatctaaccatagctatataaataattattttctcaaaagaaaataaaaaagctatacatgatgaaaattacagtctatttacatggaaaacacaatttaatgttgaaaataaattttacctaaactcaaattgtaggtacgaaacttttcagtttttttgtttgtttgtttgttttcacagcaagtgtgtgaaatagaacaaaatctaatgattactattttactcatgaatcatgatatacatctgcaaacccaatttatttaaatttttcatacgattttaatgaaaagattagaagaacaatacattgaaattaagttgcatttaaagctaaaactcatgagaaaagtcacttttaatttttaacgaagagaaaaaaaaaaaaaaaaaaaaaaaaangaataacagatgttgacaaaaatatatcgagtctctctctgttgtgagaagcgtcgtcgtgtaattttctcatttagtataattttaattaaaatatatatattttacgggatctctctcctttctctctctacaccgaactactctctctctctctctctcttcactctaatagaaagagagaaaaaaaggaaaaaaaaaaagaaaagaataaaaaaggtgtgattcttttgtttatatttgctttctccgttttaagaatcagaagtagatagagagaaaaataaagaagaagacagatgatacagagagagagagagagagatagttggcccagcggatcgacgtcgacgatgatgatgatgatgatcatttgattcttaagctaaaagctttcttcttcttctctctcccatcccatggagttcgtgatttagtctctcctcttagatttttctctctttccgctccttatttttagtattattatctcagcagaaaaacaaaaacacttttcatttctttatttttctttctcatttcgcataaatctttgtcgccgagacgatttgtgtctgagaaactgagaagaggtatatcaaaactctcattatgacatttaatcgaagctgattatgattttatatagtatctgatcaattttaatggttttaagcattttgactgaaatcaatcacagccttctcttctcttctcttctctttttactgttcatcgtacgcttcatgaatattttttttttttttttttttttttttggtttattgaattagtttttggagtaaactttgagtttttaatgaacgatcggtttcaattcagcttcttcaccttcaatggaggctccaattttctgggaattttttttgctacatctacttgtgaattttagagctaaattcagctcagatgttatagtttcattcattttattgaattgattgattgatcaaatcatataagattattatgttcgtcggtgactttctggatttgttaattgctgtttttactacttaagttgatttgaatctatg

SEQ ID NO: 29592 - DNA, 3003 bp, Unknown
  misc_feature (1)..( 3003): 2750-1469P.txt file - cDNA_ID_3019444; gDNA_ID_2684230; Annot_ID_192234
ctagcctcgctcaatacgtcaaaccactcctccatttctttgacacccttaaacccaccgagaaggtctgatcattttcatattatcacaatgttcgttttggtctaattattaatagtataaattatactttaatttaccaacgagtttaggatataaattaattaatgggtgtgtgcaggtgatattagtggggcatgattttggaggagcttgtatgtcttatgccatggagatgtacccttctaagatcgctaaggctattttcatatctgctgctatgttggctaatgcccaaagcactctcgatctctttaaccaacaggtttttttttcttcaaacattttaattctattttttttttaatacactaagcagccaaattttgacatttaattgccaatatgatgaaccagcaaaattgaaaaataagtgatagtgtttcttatgtgttagaaaccgtcgttaaaatctaatcgcaaccaattgattcgcagcctgactcaaattatgatctgatggaacaagtccatctatttctgtacgccaacggcaaaaagaaccctccaacagccgttgatttcgacagatcattgcttagagattttttctttaatcagagccctccaaaggtacacaacacattaggctaataaatagctgaaccggtacaattcggtttaactaaacccgacttgttttcgttactataggacgttgcattagcgtcggtatcgatgagaccaatcccgttcgcaccagtggtcgaaaagctccacgtgtcggagaaaaattacggttcaatccgacggttctacatcaaaaccatggaggatgattacgctgtaccggtttctctccaagatgcaatgatcaaatcaaaccctccagaacaagtttttcatctcaaaggctctgaccatgcacctttcttctctcgtcctcagtctttgaaccggatactcgttgagatttctcaattacctcccaagaaatcttcttgatcaatgttaccggttatgtaaactgaaccggacataggatcctgtaaaacataaagttagagataattgtccgatttgtttgcccttttaatttggagagatatgaaccaaaaacatatttcggaatgggtccctttttcatcgtgtgtaacagttttaccaaacagtaatactttgtgaaagttttgattaattaatgcaaaaagattagaaaaaagcgaaactaatttttggattacactagaaaaaggttaaaatcaataaccaaaaaaagaaaaaggttaaagttacaaaacacaccggtttatagagtgaaatgattattgttctgttgaattgacgtgccagcttagcatcaccttactattatcagtcacctatatatcacaattcacaggcttcttgctttctctcattggctcgtcttcttccctttcttctccaatcaccttagcttgctgatcaggtaaactagattggtgtttcgtgttgttttcttctcaacttaggtgtttgatttgagaagtttttctatgtatgttggcatgttgcgttcgtagcattgcatatcaacggataggtttgaataggtagaattaatttgattgatatatgaaagaatgtttgtatatatactctaggtctaggttattgaatattgagaaatttattttgttaggtttagatgaattattcttcgatgagtggttcaaagttcaattggcaagtcttttcaatgattgtagtattttggtgatgataagtaagttgttaatgactctcaagtctgaattcatgttttggttttgtttccttgtaaaaatgtgaacgtttttcttacagaagctttcacaaacaaagtatggttaattgagtgactaatccactaattctcttttgttgttttatatcgtttattaggtaatgttttttttttttgggtgtgtaaaatatgatactgactcaagattttatcatatttctgaatccataagctaaagtacatttgagagaagcaagagagatagaatggggcgtggagttagtgcaggtggaggacaaagttctttgggatatctttttgggagcggagaggctccaaagctagcagccgttaacaaaactccagctgaaactgagtcttctgctcatgctccacctactcaagctgctgctgcaaacgctgttgatagcatcaaacaagttcctgctggtctcaatagcaactctgcaaacaattacatgcgtgcagaaggacaaaacacaggcaatttcatcacggtatgtctttaattctttcgctgaatcgagtcctgtgtgctggttatcggatagcaaaaacatctgtatctttacttttcttagattagttgtctgaaaatgaaagaagatcaaatagactgatgggttttgctttgtgctaacaacgcaataatcgtctaaaacttatggtacagttactaaaacatcttgtttggttgttgttcgcaggaccgaccatcgaccaaggttcactcagctccaggaggtggctcgtctcttgattacctctttggtggtggtagcaactagctactgaggccaacttggtcactctatcttctttatcccacgtcacacttctatcattttgtgaaacctcttgttccctagcaaaaaataaaatctgtataatctctaaatttctacgcatatgtgcttcaattgttgtatgtctttcgaacgataacagtctctgatatcgttagtttttttttaccgatttatttcaccaatcgaatcctatacagattatgcaagaaacagtaatgtctttagaggtcatagacaaaacagagaattaaattaatattccagcttgcaaaatattttagttggcccattcctaatttttaaaaattatttgtcatcattaattttaacgacgagacgtattactctttgcctgactctctttctctctctcccggcgacgacggtttagagtcgccatagatg

SEQ ID NO: 29593 - DNA, 3000 bp, Unknown
  misc_feature (1)..( 3000): 2750-1469P.txt file - cDNA_ID_3019448; gDNA_ID_2684230; Annot_ID_192230
acatattggatgcaatgaaaaggtctaaataaacaaaatcacaatctatcttcacaacaatttcttagaaattcaaacttcacataagttgtttgaatccttttttaattaaaaggatatattttaatatgagttaactaaaataattagacacttaaaccaaattaaaagtaataaattctttacttaccaatccggtggagacacgtgagcccctatggcaataaacttataaccttcttccgccactgcctatcacaacacctattagctttgatgtgtggtggacagtggacttgtaatgatggtgagtggcctatattcattattctttttagaatcatacaagagtttttgcttaaaatgtttatcgagtcacggctattatattttttctgttactattgtattcattttattcttaaagacaaaattaaaatgactctggccctctctctcttctctctctcaaaattttcagagagagaatcaaaccaaaattttcgacgacggtaaattgatgtcgtcggtgatggttgaattgccgtccggtgtagtatccggctttcgtctgacatatattggcttccacagcagtacatggtcggcccttgtctagcatcatcggctctttcagcggtgatggctagctcacggtgttaatccggcgtagttcggttttcttttccttttggtttatatcacggttacgtttcgaccgttgattgtctttagatcagaattcattgggtatgtgtgttggtgatggcgttggttttcagtccaagcttgcttaattagatctaattccaacctatcctttgagtttaaggtttacggataataattaggcagtttgcgtttttgagatgaagattcaaagctctttcctcagcttattatgattgcctttagctgtatctcttatattcaagcttcgattgggtctaagtaacagaggtggttaatcgaagatcttttttctcttttgagattaatagatccgtattagatccttacttctgttttgtagttgttggaaaaattcagatgaagctaatcttcgagtttcattcgacttagtttcagtttccggcagaatcgatggcttcacggcgaaggatgatagatggaaaactttcgtctcctcaggttacatgtgtattcgatgctaacacgtgtctgagatatattagcttgatccaatcttcttctctaaatgtaatgttgggccagttggacttaaaatagtctctgtaaaccgttttatgttgttgggcttttgctcgttcgttgtatgttatgttcatcttaataaaatcgtcacttgtgaaaaaaataaaatgactctggcctttctagtttctacaattagactctctctactcaataatttataatctggttcaaaaggatcctctgagtgtaaaagcatgattcacgttctaacatgtagatgatttgggaataatacaacaagtgtggatcggaggatgttattagacacgcaagaggatccacacacccactaggacacgtgtttacaagtccgagctctgacatgcttcacgttcccgcgacagttcgttgtcaccgtgtaagaggaggtctctcagatctctgagctggccggggaggaccacgtaccttacccgttagccaattggtaacacttacgattataaaataaattactttgttatgataaaaataatattggttcatgcgatgaagatatatcacgttcgattaaggttacagaggaaattgaattttcaagaattgattctttttttgtttgtcaatatataatttggatatctagatttgccatggaatataaaatcattaatttgagtttggaggaggacgtcgacagaaaaaaaactaactattaataattttgagttcctccattttgagttgtcaagtaaatatgaagtcttattttataacaatcagttgaaactattactaattgaatacttggtcgattatcaatgattttaatttaatttctctcaaaatagacacattatttctattttgaaaagaatagaaccaatcatgaataacaacacactatagaacaagttataaaaatgataaatacgtattggaatgtttacgcattgtaggacctgagacaaagaaccataagcccattcctctgaacttaaaccgaaacagagcaacacgtgtctcctccgacacatgtcaccttctccgtttttaacgctgatgctaacacgtaacttgccagcgaatattataacaatttatttcataataagaaaaaactgaattctgtttttttaaatactagtagtaggagcaaagaaagaagcaataatagtggcaaaaagtaaggagacaaagaaattaaaataaaaaaatacaaagccgtacaaaaaacgtgtcgactcgagggatcatctgattgccacttggcacttttcacacattggctattctcgtcgctttcttttcttctacgtgcccaaaacccaacatttattttattcttactcaactttattttattaattttcctcaacaacataataattaattaattaatagataaacttttttatattatttttttgatataggaaagaatctaatttgattacaattccattttttggtgaatatttttaagagtaaatagaaaataataattacagggatttcgtttttaattgtacatgttaatgatgaagaactaaataaggtattgtcaagtaaatggtagtgaatattccgacttgtgctcaaatttgagttctctttctctgtctcatccatttaaacttttttttcttctgtctcccccatttgtaatcaatagtaacgaaacgtgtctcgtcaatttttgtcaatggactaaagagaaacttttttttcagttcttgtgaaaatattggattattatggatcgtggcataaaaatctgattactgtttcataagcttccagtattcttttttgttaatg

SEQ ID NO: 29594 - DNA, 3003 bp, Unknown
  misc_feature (1)..( 3003): 2750-1469P.txt file - cDNA_ID_3019448; gDNA_ID_1971826; Annot_ID_176317
taaacatattggatgcaatgaaaaggtctaaataaacaaaatcacaatctatcttcacaacaatttcttagaaattcaaacttcacataagttgtttgaatccttttttaattaaaaggatatattttaatatgagttaactaaaataattagacacttaaaccaaattaaaagtaataaattctttacttaccaatccggtggagacacgtgagcccctatggcaataaacttataaccttcttccgccactgcctatcacaacacctattagctttgatgtgtggtggacagtggacttgtaatgatggtgagtggcctatattcattattctttttagaatcatacaagagtttttgcttaaaatgtttatcgagtcacggctattatattttttctgttactattgtattcattttattcttaaagacaaaattaaaatgactctggccctctctctcttctctctctcaaaattttcagagagagaatcaaaccaaaattttcgacgacggtaaattgatgtcgtcggtgatggttgaattgccgtccggtgtagtatccggctttcgtctgacatatattggcttccacagcagtacatggtcggcccttgtctagcatcatcggctctttcagcggtgatggctagctcacggtgttaatccggcgtagttcggttttcttttccttttggtttatatcacggttacgtttcgaccgttgattgtctttagatcagaattcattgggtatgtgtgttggtgatggcgttggttttcagtccaagcttgcttaattagatctaattccaacctatcctttgagtttaaggtttacggataataattaggcagtttgcgtttttgagatgaagattcaaagctctttcctcagcttattatgattgcctttagctgtatctcttatattcaagcttcgattgggtctaagtaacagaggtggttaatcgaagatcttttttctcttttgagattaatagatccgtattagatccttacttctgttttgtagttgttggaaaaattcagatgaagctaatcttcgagtttcattcgacttagtttcagtttccggcagaatcgatggcttcacggcgaaggatgatagatggaaaactttcgtctcctcaggttacatgtgtattcgatgctaacacgtgtctgagatatattagcttgatccaatcttcttctctaaatgtaatgttgggccagttggacttaaaatagtctctgtaaaccgttttatgttgttgggcttttgctcgttcgttgtatgttatgttcatcttaataaaatcgtcacttgtgaaaaaaataaaatgactctggcctttctagtttctacaattagactctctctactcaataatttataatctggttcaaaaggatcctctgagtgtaaaagcatgattcacgttctaacatgtagatgatttgggaataatacaacaagtgtggatcggaggatgttattagacacgcaagaggatccacacacccactaggacacgtgtttacaagtccgagctctgacatgcttcacgttcccgcgacagttcgttgtcaccgtgtaagaggaggtctctcagatctctgagctggccggggaggaccacgtaccttacccgttagccaattggtaacacttacgattataaaataaattactttgttatgataaaaataatattggttcatgcgatgaagatatatcacgttcgattaaggttacagaggaaattgaattttcaagaattgattctttttttgtttgtcaatatataatttggatatctagatttgccatggaatataaaatcattaatttgagtttggaggaggacgtcgacagaaaaaaaactaactattaataattttgagttcctccattttgagttgtcaagtaaatatgaagtcttattttataacaatcagttgaaactattactaattgaatacttggtcgattatcaatgattttaatttaatttctctcaaaatagacacattatttctattttgaaaagaatagaaccaatcatgaataacaacacactatagaacaagttataaaaatgataaatacgtattggaatgtttacgcattgtaggacctgagacaaagaaccataagcccattcctctgaacttaaaccgaaacagagcaacacgtgtctcctccgacacatgtcaccttctccgtttttaacgctgatgctaacacgtaacttgccagcgaatattataacaatttatttcataataagaaaaaactgaattctgtttttttaaatactagtagtaggagcaaagaaagaagcaataatagtggcaaaaagtaaggagacaaagaaattaaaataaaaaaatacaaagccgtacaaaaaacgtgtcgactcgagggatcatctgattgccacttggcacttttcacacattggctattctcgtcgctttcttttcttctacgtgcccaaaacccaacatttattttattcttactcaactttattttattaattttcctcaacaacataataattaattaattaatagataaacttttttatattatttttttgatataggaaagaatctaatttgattacaattccattttttggtgaatatttttaagagtaaatagaaaataataattacagggatttcgtttttaattgtacatgttaatgatgaagaactaaataaggtattgtcaagtaaatggtagtgaatattccgacttgtgctcaaatttgagttctctttctctgtctcatccatttaaacttttttttcttctgtctcccccatttgtaatcaatagtaacgaaacgtgtctcgtcaatttttgtcaatggactaaagagaaacttttttttcagttcttgtgaaaatattggattattatggatcgtggcataaaaatctgattactgtttcataagcttccagtattcttttttgttaatg

SEQ ID NO: 29595 - DNA, 3003 bp, Unknown
  misc_feature (1)..( 3003): 2750-1469P.txt file - cDNA_ID_3019458; gDNA_ID_2684230; Annot_ID_192225
gtataacaatatggcgttgtaacaatggatctatatattacctcattgttgatcaatagcacaccaccggtacgtttgcaatttcttcatgtatatttcttgttatatatgtagttatatatccaggtataattttgatgtaacacaacattaatcttaatcgtggatccatcccacatttgatgcatgtatgtgcacttaagaaaaagaacatggaggaaataacgttattttttattattcttttcatcaattttacaattattttatacttttatctttataactttagggcgatatatatctatatgaactttacagattgcaagaatatccccaattcatattggagaacagaattcgcgatgcgtaatttataaaaagagattatcaattgctttggtgaaaatatcttataacgtggtcaaggcatggataatccgaacagcatcgacttatatgacatgccattgtgaatgtggtgataatctattcatgtaactaacatgttttgtacgttggtaaaaaagacgaaatttgtggtaatcatcaatcatgtttgacttttacccattttgatctagactatatattatggttttatcatcgttttttggtttggaacggaatttcgtttacgtgatgaaaacgataaccattgcggtgcctcgttgtctcccaaaaggccaaaatataaaagagacgtaaacgatcattaaatcagaagacaaaccagtctaatgatcagaattactcagtttacatattttaaaaattacaatcctatttatgctaaaaaaaaatgttttgatccgaacaaattaaatctttccaaagacattcaaagtcttgcttttcaatgaaccgttcaaagttaatgaatgtattgaagtgacgtacatatcaacttctagctacgccaagcaaatgtgtaaaaaccgttccgttttggtaaattaagttcacattttaaatcaagaaaataaatgtcgacttgtgaactaaatatatgtcaacatgctaattgtcgacattaattgttcttaatcagccaaaactccacttaaaagtatttgcaaaacgcacaattatgttcacattaaaatataaaattccggttttgaaccaagacaaccacaatcaacaacaaggtcaatgtttatttcatgtttctgttgagacaacactatgtcttatgattccgagtcattaccggagataaaaagaagaagaaggattacgaattatctctgtgactaaaaactatttagtccatggtcgttcgtataaaaactgttttacataccggtcttgaaattggttactacctatgatcaatgatttgggggtggtaaaagatcatatatgaaatatgtatgatatctggatgaatattacgaacgttacggcccaaaatattttccatgggcttgggagtaacaaaacaacccataaacaagtaacgttcgaaaatgtttgaaattgaaaaagaaataaaaatctgataagtatgtttagctgaaaagctgaggcaccgactaacaacagctcaactttcaagaatgtccacaaaaataaacagaaaaaaattagctaaaaaacaagaaaataaaaaaaagaaactgtaccattttttagtgtgcaaatgtgtgttgtgtgtggcacatcacacgtgtcgtagcatgacggcaaaggttgtcttgtgcacatggctcggttcgctcccaaatataatccccaacccatcctttttttggtgttaccgttagctcctcttacacaagatcgaaaaaacaaaagctatttttatattgaaatgtgttcttcaagaatccagtctaaaaagagtgggtgaattgaatttgtacgtgttgttttgtagatgaaaaagtataaatcaagtttgtataaaaagttgaaaaaactatattttagtttacttggtattaataataaataaaagtacattgttagttctaagttatatagttatgcattgcattctcactaaaccatatttttgggcgaaatttttggaccgttgataaaaaaaacagggtttattttgggtcccaaaaaagagtttattattttaggacaggtgtttaaaaggaagagagaactcatctgaaatacgtaaatcgaggaggtggcaaaattggtaaataaagaagcattttagtccacttttactataatctttcggtgcgccgaataagtctctcacaaacagatactagaagacaacaatgcaattgcttttagttcttttctgcaacatttgttcgtgtaaggctttttttactatctcttctatttactcaatttcttcttacacatttgttatacgtaaaaggaacatttctttgattctttttttgttgtcactaccaaaacgtactgatttgttttttgaataggtgggttcctagagtaaaaaagagaccgatatttaaacttttgtcccttgactaaaactcaaaacatttctgtttgttttttgttagttaaatatgtttaaaataaataaataatcatatagctatttatgaaagtattaatatacaaataactttcaaaagttattaattaaatttcaaacaataatcctgtgtttcaatatctacttttgcaattgttatttccataattccattaatacaaatttttagatattgatagctacctaactcacactttttaaattttagttatgtcgacaagttttttttttgttacatgatgttaattacgactaatcaggtttttaaagtaataaatcaatattaaaaagtgcctcaacaaagaaaaagtgttggaccatggtcgtctataattatttatcaaaacatagtcacacacacccttgccgttattgtctagaactctctctcgctctcccaaaaactcatctctcaccaccgtctcaaaccaagttcgatctaaaagccttttcctttagattctctccaacaacaaatctctttgaatcactcagtcatg

SEQ ID NO: 29596 - DNA, 3003 bp, Unknown
  misc_feature (1)..( 3003): 2750-1469P.txt file - cDNA_ID_3019465; gDNA_ID_2684230; Annot_ID_192222
gtgagtgtcgttttcgagaaaggagcaaacgtggtccgttttagaatcatgaatcatggatgattcgcaatctagtactatctctcttttagctagatttgcaataatgattatgatttcttgaaaacatggaatttgattttataatgttaaatagaatgatgattagatgttaattaagagaaaatttaatttgcgttagaaaattccatgaaattttgtgatggaattcggagttcaaggttcatcgctcctgacttgacttatgtcactttatgactcgatcttgcaccatggcccccactcttgtcgacgcgtactgatctcattatttagaaagtatcgcgtagtcatttgtgtatatgtgattacgggtagattttacaaaaaaaaaaaaacgtttataaaatttggattcatccattaacttttgcaaaagaaaattctatgaaaaaaagtcttgtaatagtgttttcgataaaaaaaaggcttgtaatagtgtttgaagtctaaccaaaatgtgaaacacaaacaaacagaacaattaattattttcttttttgatacaaaatagtcgaataacaaattgctcgcatttgatgtattcatttataaataatgatttcattcatgttcaattaggtttacactttatgaagaatgatatgaggaaacgtagtttttgtagctgctagtgacgggggcttgtagccgcaacactatttatcacaatttgaattccaacttattaatatgcgtgtataagttataaatcagaaatgataaaaaaaaaaactgagcatataagattatgaagtataaatcaatggaaattaatcggtaaaaaaaatgtttaacaataagagattgcatctatactattaatcggtaagagatatagtagtgagaaatagtggtacaaaaacaaataatggtctgtttttggtaagaaacagtgatatgtaaatagatgacaataccatattttctatgcgttgtaccggttttgttgaatcattttattttcctttttacatatatcacattagaactgagaacaaatttaaatgatatataaaaaacataggtcagtctttttatagctaaactaaaaaacttactccatttaattagtaatcaagttaacggtttatatcatataataaatttacaaatcaatatttatgttgatttgatttctaacatgatttgctcccattattgatacctttttttttttagagaggaccattattgatacttcctattcataatccactatttataatttatcgaggatatgtatatcgaatcaaagggcctacgaggatatagatggattgtgcaaatacaagtaggtgtccctcttgcgtgtacgcacaaacgattctcgacgtagatgctagcgttataatagcaccgagatcgatagaccaaacccaaaaatggtaaagaataatgttgctatttagatgtgtattgatacttaattctttgattaaaaaacacatgtgaacctaaattattcatatccacatatcttcacaaaagtgtatatggacaaagttaactgtttttctataatcataattttaaaacacaacttgtattacagctgtatctatgattctatatatacgttgttagcgtagtagcgtgtggtacatatgttacatgatttcaacaatattctaataatggttagacatcacgtagacatgtgtctcgttttaatccgtgcatgtatttaaacaaaaatcgattcatctgctgattttatagacacttttttatttaaaagacgatgttgtttagtttttccacagggaacgtttacatgaatctcgaagatatggttgtttgagtctgagtgcgaccggaaacgtttgtttgatggattgcaattatgggaatataaataaggaataacatgtgaatatgattataagataattatcatatatgacttatgaggattaagaatttccacgtggccggttaattgtttgtggtttacattcgctagattcttgtcatatccaacacggacaacacgcagaaaccaattatttactttctaactaattttcaatcaaaatttaaatatactttattcattttcaattatacctcatttcataaaaaaaaaaaaaaaaaattatgcttttttatcctcgcatcatcagtcatccgaaccacaaacaagtaggtggtatttttaagttgaagcttcttttcttccacaaaaaggaatcccatggactcatacaacaaaaattataccagatcgaactagggttctgatagtatgtttgtttcgtaatcgctcacgagtcacgacatcaacaatgaccaataactcaattaggtttgtttcatagttgcaacagtaacatcgactaatagtagtagatacataaaaacaaaagtctcgatgaaccaacaactataaaacgaacaaatcttgctaatcgtccttctttggacaattggattagtggtaccaatttcaatagtgaaagaagtctcatcatctatgttaattgaagagtaaatgcaaatccgagtctaaaaataggcgtcgatctataggactcaaaaagtagacgtgggcctctcactttctccgctactagcagcctcccgttccgtttcacttgacccttttgacgttgacgttccattttttcaactttctcttcttttttttccctctctctcttgaattattattaatatattttgtgtttacgcaatttccaaaaattaaataaattaaaagaatctctcgtatagacaaagagagagagagtctgagatcggtccttgacgagacactgcactttaacgggtttcaaagtttttttttcactctcttttctttctttctttctttctttctcttccaatcaagaacaaaccctagctcctctctttttctctctctacctctctttctctatcttctcttatcactacttctctcgccgatcaatcatcatg

SEQ ID NO: 29597 - DNA, 3000 bp, Unknown
  misc_feature (1)..( 3000): 2750-1469P.txt file - cDNA_ID_3019476; gDNA_ID_2684230; Annot_ID_192219
tgtgtgttatgttttctttcttggttgtcctgtttaaatgttgctaagaggctaatgggtttaagattttttcaggtacgagaagctaagtgagaagattgtgtcatgggaagataagaagaggaaaaaggcaaagagaaaacttcatagaacagaggtgcctcttcttttctttttcctccactttcctttggttccaaaaactaatccttaaataactatacaaccaatcaatgtggtgaatgtgcagagaagtgtagagaaaacaaagttgaaggcgacccagaggttcagggacgaaaatgaacgtattgagattatcgttgcaagtgcaagagcacatgcgtatgagagtcgaataaaagaagagttgaaggttaaggagaaagcaaacctcatgagaacaactggtaggaaaccctctacatgcctctgaatcctgcaagttgcaggaaatgtaaaaccaaacattctttactgctgataactattgtcgaacatgtaaaatgcagacacaaatataaggtgtttttatctatttaagtataagagagataacacacatgtgatccattatggcacaaatctgaaaaccaaaactttagacagttgcacaacaatactaaaaccaagagttcaaaatcacaaatacaatgctcaatcttgcaataaacaatattataagaaatgtgcagaactaccaaaaatcataaaaacttcttctgagttctgaccatcaaaggctccaaagtgctaaaaaagggttccatagtgaactacaatcacccagaatgggccgagcaaccaataataggagttatgagttcagcaccagtctcatgatgatgttatttcatttaccaacctttctagaataggataagcaaaatatagtacaagaccagctggaactgcgaaaagtattgtgaggaggaagtaaagggcaagaattatgaggctaccaggtatagcaaagaatacgatcagaaggaagatgatcacaaacggaaacttggaggtgaaagagatgaaaaaatcaagagatttgtgaaaggagaagagttgtctgcttggttggttactgtggtcatgatgtggcaaaaggtctgtagactggttacgcaataaaggcctcgcaaccagattgttgttgctgctgtggtttcccagagacatgctacacctcggagtcggagccgattgctggttatcagtgaccaaggaaccatgacttgtcctgtcaccatgacttgtcctgtcaccattcagactctcaaccatccagagaaggaagaaattcttccgagggaactttagattacccttgtaaacaatcctgaacgaaagcaactgacaccacgggcacgagacgaaaaacggaatccgaatatcttggcttgagagtctcaagacagcagattggagaccaaagacacaattctggcaaagagtatgaccacaccataacacataaggaacattctcaacaatgttgaaagattcccaacatatgggacattctaatccctcttcatccctgctaatatttgaaacctcatcatctgagcattgagaggatgcttgagctgaatctttaggggacttctttaaccccatacttccaatgacattcgacgcaaagccccacattttgatcaaacttgaaactgagaatgatcaccaaactttataaaacctgagccaatgtaccaacatttacccagtaaccttcccagattgaaaagagcttctttgaccaatacccatcattttaaagaacctggataacaagtgcaaaaatcatagatagtttagcaaacattatatatgaaaaaattcacaaaaacacaaactttcatgttattgggacatgaacaagattacagatcagaagaatggcaaaacaaaatgtgcccacgaaagctcaatgtacaatacatggtaactccccaatcaaaatcaaaacaaaggttaatgaaacctataaataaacaggcatctagatgcagaagacgcaagagatcaatctaggtttaaaaattcgatttttaagttccgtaacagatgaaaataatcggagattgaagtttacttaccgttaaatctttcaaaatcagatacgcagatgcattaaagaggagatcgaaacggggaagagaagaataaagcctctctctttttctctctctcgttgatccgccgtgttagctttttaatggcaaaacgctaaagaaaatatcggagcaaacgacgaaaacgacaacgtttagttggtagctcagactcagagagtattgaccaatgtgcacgtgccatcggtgtgacctccgtgacggttaaatatttttcacggctctgacttgttttaattattcttttcttaaaccttcttgatgatttagaaggtttcgaggtttgaggtatattcgcttaaacgacaactcaattttttgtcgtcgtagctggttttgatgtttccgatacttcatcgatccacagttgtagaaaattcttcgacatgaagttgaaattctgattagggtcttcctcgattcgcttttggtgaatcaaatttctttaatttcaggtgaatccttaaaaatctcacgacctctccgtttcttaattttttggtttttgtgataaaagctcaaggctttagattagaattatctgaaagttttcatctttttttttctttagctcttgtttttgtaacactttctggtttgtagactatggttgattttggaatttttagatttttgattgcattagtacgatctgattatctaatttcgatgattgtcgacgtaatttgacttgggcattgagaatttccaaactttctctgactgaaatttcatttttccttcatggaaatgattcttcctagttacttgttttgtctgtcttccatttccagtgaatacgcttttgacaggaggaccatactaagtcttgggaaaaccctcttcatagtgggtttgatctacaatg

SEQ ID NO: 29598 - DNA, 3000 bp, Unknown
  misc_feature (1)..( 3000): 2750-1469P.txt file - cDNA_ID_3019480; gDNA_ID_2684230; Annot_ID_192217
aaagatatttatttaaaaaatcatcttgtaatttattattttttaccttttattgtaggtttgagttaaaatttgtgatatttgtgcgggtgttgaagttagagtggagtaaattccaaatcacaagtacaattttaccccctagactcgatcatttgggacattaattttagaatggagaaagctacacgatcaaagaataatcattttcttcattattaactttagaaaaacatttatgtatgctgtaaaaaaaaacatttacttttacggagtacaatagatcgagtttacgtctccatttgtttgctaaacataaaacgcgttgtttcattaattggacaaatcatatctttctcctttaatttgtacttgcattacctattaaaaaaagttaatgctaagttttagcattgatgttcaaattttatccacaaattagaaaacatgtttcttaacaacttcttgaaaactccaaagagataaacatttgaacatggaattgatgataaactaaaaaaatatttatttcacaaaaaaaaataatggttcacttcatatctcaatgatccaaaaccatacattttgatgaatgcaattatgtaacttacgacaattcgtagttcacctcccacgcccaaaacgattaaaccatcacacttgttctagccgtatatcgtatttagatttctataatccataaaccattataccatcttgccaaaagtgaattaggtatttaataatgtaaacaaaaaaagttattaggttcattagaaattttgctattagacaatcctaaaagatgctattagaaaataacaaattttttgtataagctttaaacgttacatttaagaatccatcgttttactttaacgcctagtgtacttttaaaattctattatattcacttgatgttctgataaacaaaagttaaaaatatgccaatatttaactttgcttaaaaacaatatgaaatccgaaaccacgagataatatatggtccaaaaattaaaatagatgaaattcatctttgtccgcatgtatctgaaattgtcttgcgatttctttaaataccggttagacaaatgtgacaactatttgtctatttgttttcaattttccctgattggaataaaaaatgtttctatatacactgagcattaaaatcatatgcctatgaccaatatacaaattatatcctcccatgacttctccttattttataaaagaacactagtttgatgttaaaaagtcatgactttttcttaattccattatacgaatattattcttttcagaatattaagatcgagaagcttctgctttctttcgaacaaaatattcaaaaagatacataattggctaacaaatttagtgtaatcagaaactatatgtggtaattgaatattgtctccatgctttgtctcatgtacactaacacaagacttgaaatcttagttaacctctcctaaatgaagtaagaaaggataattaaagtaatgatagcaaaacccgaaaaagattagcttaacaaactcaatgacgttttaaaaagcttagacacttgataagattaagaccaacaagttaccctaaattacaagtttgatgataacaatacttaatttctaaatgaagcatcaattgtttaatgtttataaattaggttagatttaaagcttgaggggtccgaatgtcgacgcaactttgaggtttataagtttgaatgtggggtcaggaatttaatgaccttaattttgaagataattacggttttgggattgattttgtctacttttgtagttttgtttcttctgttcgttacagattggttgattttctacttaaacaaaatatcattaaaaaggcttcattgttgagattattacataaataggatcattcttctgaggaagcatattttctttcgaatttcgttacgtgtcataggtttgttggatatgaagatattattcaatctagatgttacatttgttatatagttttttaaaaaatcatcgaccgatagaatcatataagtcaacttggaatgtttaatgattatttaaacccatgtaccagttgtacaactacaaaccactggtatcaaacaaccatataaataaaacatatgtaattaaaatgattataaacactaacactaacggtaacgtgtttatgcattattaacacgttagaaaccgtatgaatttaatattttctctcttgtgtaaaataatcacaatgaccaaactttttcaagtacaaaatttattgtatctaacaaatggaataatgttattatgattgaaaagaaagattggctagatctagtggagaaaaagtagtaataagaagagataagactttaagtgcttcgtcttgtaaaccacaagtacatcatcatgtctttgagagagccgatgcaataattgattaaatgtttcgatggctctgatttattcgtttgactttacaaaaatgtaattagtttcgagcagagttacttgttctataatcgctaaataaccaataaaccaaggtgaaactcggtagcaccaacaccacgtccaactccgatgataacaataggtctttcgttactgttccaatccgacacgagcgatataattagagttatcgattcccaccactaatctgaaggcaacatcggaatcgacaagaactttttaacatttcatagcatagatagcaaattcagataatagcaaataagtaaaataaaaataaaaataaattatatataacaccaaaaacattttatttatttatgattgataacaaaattgtagaaacattaaacacgtgatattcttccacctatcctttctcgaccagataattttgtaacggattggatttttttgtgtcactatccgatttttatttttcctaactccgccgaatccgttcctctgtccttttctttctccactctctgtctctgtctcttcctcttttgattctccgatg

SEQ ID NO: 29599 - DNA, 3003 bp, Unknown
  misc_feature (1)..( 3003): 2750-1469P.txt file - cDNA_ID_3019482; gDNA_ID_2684230; Annot_ID_192216
tttattctttcccttttttggtatcctcttagagactgcctaagacagtgacatctttttttcagattacgtgtgtggttggactgtatatatggtgtgcggcttcagatcctgcagaccgtggagttttccggtctaagaagtaccttaaaattcctgaaaatgggaaatttcctctagcaaaggatataaaagatggatgtggatcagctacaggtggtgctaaatctcatgatggcacgtgtgtagaggatacagaaaatggaagtaacaagaaattggagtcatcagaaagatcttctctcctgcgtttgctctgctctccttgtgcattgctatgtagttgttgcagtggaaaagatgaatcttctgagcagatgagtgaggatgggatgttttattgcagtctgtgtgaagttgaggtgcggggaacatttataaacacagacatgtcttttcattggctttagagttttcttgtgacaagaaagcttcacatattctcaggagtagtcaacaattattgtcttccttttgcaggtcttcaaatacagcaagcattgcagagtttgtgacaaatgtgtggaccgttttgatcatcactgcagggtattcaaaggatttgcttaaaaatttcatggtttatcttaaatggttaaacccttccttctgttttaattattttatctttgtttttgtatgacttttgtagtggctaaacaactgcattggcaagcggaattaccgaaaattcttcagtcttatggtatcagctatttttttggtaaggttgtgttgatctttcatgatgtcctgaaagaatatcttctgtctatctttctgtcatgaaatgttctgaataattattccttggtgggtgaaatgaagagttagttctcataaagttagatgtattattaaccggtggaaacatcgttttttcccctgtggtttgaaattgcagctcattatgcaatggtcaactgggatttttgtgctggtattatgtttactccgaagaaaccaatttaatgcagacattgccctgaagttgggaagcagcttctcgctaattccatttgttatagttgttgtaagttaccttctcatacagttgatcttcccttatctcacctgaaagcaagatttgaaggtttcttctgtctcttgcagggtgtctgtacagtattagcaatgctggcaacgttaccacttgctcagcttttcttcttccacattcttctcattaagaaggtttgtttcccatgctcagttgctcacagacatgccaagctttgtcctttaactattcaattaaccaaagtaaattttctctaacagggaatcagtacatacgactacatagttgcgcttagggagcaagagcaagaactagaagctggaggcggtcaacagagtcctcaaatgtcaatgatcagctcatttactggactaagcagtgcaagctccttcaatacatttcatcgtggggcatggtgcacaccaccacgtttgtttcttgaggatcaggtaccattattcaccagtttcttctaccttgttgactatgatttgctctaatgcgtgtgcatatctgtatccagtttgacgtagtccctccagagaatgcttctgtaagttcatatgggaagaagtctgttgtagaggaacgtgtcaagaagaagccccaacctgtgaagattagtccttggactctagctcgtctcaatgcagaagaagtttcaaaagcagcagcagaagcaagaaagaaatccaaaataatccagcctgtggcgagacgggaaaatccatttgttggcttagaagcaagcagcagcttcggaagcagtggccgtagaatgttcccaacaaaatatgaaggtgttaataataacgggaagcagcgaaggcaatcaaagcgcatacggttaccagcagaactacctctagaaccgctgatgaatgttcagacaaaagcagcaatggagacatcaactagttcagggctagctccacttcagctagaagcaagaagcgcgtttcagacaagccgggcaatgtcagggtctggtaatgttatggtgacatcttcaccagagagcagcttagactcgcatgacattcacccgtttagagtttcgtctgaagcagaggatgcagcgcagcttaatgggttctcttctgctgttggtctgatgggtcaacagagaggacaacaacaacaacaacaactatcaatgatgatgatgccattgtcaaggtctacaagtgatggctatgatgcatctggtggagaagacagtgatcaggttccttctagaaacatccacaaatcaagatgagaagcatgatagaataattctagttttggcttcttcgaatcttcggaggtattctttgtgtaatggctgctgccttctatcaggaagaagtcaacatttgaggatcttgaaggtataaaaatgcctgccaaaagctcttaggagaagagcaccagagacttttgagaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatg

SEQ ID NO: 29600 - DNA, 3003 bp, Unknown
  misc_feature (1)..( 3003): 2750-1469P.txt file - cDNA_ID_3019486; gDNA_ID_2684230; Annot_ID_192215
tagtctactattgaaccaaaagcgttttccactgattaccttttgattattatagcacactaaattagtcaagagtaaaaaaaatgaaacatataaacaaaaaaatactcatcaaattattttctccataaccaatcaagtattaattgcccccacatcttataattgcttccattacccacagttcacatttcacagcctcacaattatcttgagttatatgtccataaactttacactactattaaacatttattttgtggggaataatggttttatattaatgaaagctacaaaaactaaaatagaaatagaagaagggtatagtgagtcacgggtatgggtagagagacagagaggggcacgtgcctgaaagaaaagaaccaagcaaatgagaacaaagtcactctctgtatgtccccatctaccattttgtagtattccttggtttggcattggatcatttgatatatatccctcgttttttcgacatttgctacatatcctttattcttcaaaatttgaacaatattacaattcattatcaaatttaatatttagtttgtcctgcccaaaagctgttaatattgtcctatctttttgtttatattgactttgttgctaccacggttttgacttctttttattacgtacgatggtttcgaagacatgtttcttaccgaagcgccattgttttcatacaaaatatagattatggtagatggatgtcgcgccaaaattgtaaatggtattggcttttagtatttcaaagattttagccaatcattattagctcaagcttggtaattcatacatgaacaacactcgttattggtgtatatctgtaaagctcgatacttataatctaatagcgctttagaatgtggtatgggttctcgattggcctatgtttgctgatgtgtatatctggtatattatatacatcggaatcgttcaacgttggttgcaaccggatatctcgataaacgagcacccgtattcaccgggcgtagcattcttattttattttaacaaagactattttttaaaactattcgtagattagtagtttagtactcaaaaaaccataaatactcaattacgtttttaggatttttataagaatgcttgtctctacctcatcggttttctacttttacgataaaactattaaattgcaatctcttataccaagaaaaaaaaagaatatgaagaaggaaaacgacatacataaagaggtccttcgaatttaatgcttcacatttactccttcacccacacaccttttgtcccttttttttaatgatcttattcagttttaaaataatttcttagtttaacggaaaatattcaaatagaatttcagcttatacattaaattatatttaaatttattatttttcatactcttttttttgtgattttacaaaatcttgtgtacgaatgagttttttttttttgctaagtttagagagaaagagtacaaataacataagcaatcgaaatttagcatgtataactttatttgcaaagaaaagattcatcaaaacatagcattgtcttcggccgttactttcatggtgttgtgtcagaaggatcgatacatgtttataagaatttctcaatcaattcaatgaggacagcaaaaacaattccacttctctttaaataaaccatgtatctgcatgcaaagtcgacgtatattaaactttttttttaactttatataatacacaaaagacatgtaatgtaagacattggctttcgatccaaatgaccctttttaagagaaatagcaagaaaaaggtaactaaaaacgcaaaccaattacaaacaaaaaaaaagttttatctttttttcttacaaaaagtccatttatctgacaatagagagatcataagagacatatcaccagctaccaaagcttttaaaaattcaaacaaataccataagattttagaaatacaaaaacaaatcctaaacccttataggaaaatttattaatctttcccggaccgtcgttttcttggtgctttgttctgtcactctcgaaccctcgaatattgaaaatcaagagctacttctattatattcctttcatttaaataatttctttggaagttcaaaattctctttaaccaaatcggctttgattcttgtaacatatttgaactttgtgcagagtagttaccagtttggaagactcaacatttaagacaaaatagtcatttggtacaacaaaacatttaatgtgtgatatgagacaatttattacacaaggacacattgtaattaagttaaatagagacatgtttaggctacctaatcacaattaaacctagttttactcattttatctctacaaattgaaacatgtcatgtgggatttgaagtaagaaaagatttagggtgaaaacaaaaaggcaacaaaaatcagtgggggtaaaaaagcaaaagagagtaaaatactgggagaaagacagagagagagagaagagtgattgcaatttaacaaaggagaaagaaaacaagtgttactggatttgccagcaacaggactgtgacacatgatttggccataggaaaaaggtaactgctttttcatctcttaattataactcctttcctctcttctctctctctcttccatggtgggttcttcttttagtagatctctgcaccacccaaagcccaaagctcaaagctttgcacagaagatacagagagaaagaaccacatacaaaaaaaaagagtctacttttctttttgtttctacttgctatttattacttttcacaccacaccctctggtcaaatgtctttctctctactcttctttcctttggtctgagacaacagtagcaagagtccgtgaaagaagaaaacaaaatgttagaattttgaagaagatgagggaaaaggaagcaactttatctgtttatttgacttgagtctcttcgatctacatctggattttgcagcatttcttcttgaggaaaaatg

SEQ ID NO: 29601 - DNA, 3003 bp, Unknown
  misc_feature (1)..( 3003): 2750-1469P.txt file - cDNA_ID_3019493; gDNA_ID_2684230; Annot_ID_192213
tagatttatttgctggatagtatcttgtctgttatgttgatgttcttcaagtttagtctggagggaacaaagacagtttcttgacactccccatgtatatatatatatgcaacttctcttttcttataagtttttttactgtgtttgacacgagctggtcggctcaacctattttagtttcacattctgtgaagttaatcatattcaattgcaatactttaaccacaaactatataagttaaactcaatcaaaatatggtgcaatggttcccatcacaaaaatagaaatggactattgaatctcttacctgttcgactaaaataaatattttcaaacaagaactgttatagaacaagattttttacctacagatacagaacgcaaccgatccgaaatggacatgcctaaaattaaattataactttaactaaatcccaaaacacaaaccgaaaacgaaccaaaaatccggatttatcatctacgactacaaacattcaaagtagtatgtacaatagatattgggccataagcccattaacccgtttgtgaattttgaaagagctcaggtattggggaaagctctagtctacaaatttgaaattcggaattcgaaattggggaaagtcttcttcatctgtctagagagtggcgtttgatttgagataacgttcttctccaaaattgcttgaggaagtggttttgttgtgtctctctgggtttgaaatatgagcggagatagacttgaatttgaaaaccctatagaggatgcggtttcgaggctcagattctcccctcaatcaaacaatctcctcgttgcttcttgggattctgtgagtttcttctcttctcttcttttttctcggatcgataccgtattggtctcagagatagtgacgaattgttgcttgcttgtgtaaatgtgtagtatctgagattgtatgatgtggagagctcttcgctaagtcttgaattaaactctcaagctgctcttcttgattgttgtttcgagaatgaatcaacttcatttacctctggttctgatggattcatccgaaggtttgcaattttcgcttttctattgtatgaagatagcaaatttaccttttcaatgaaaaagatctgatcttgtatagaatgataacaccttgcttgttaggtatgatttaaacgctggaacagttgatacaattggaaggcatgatgacatttcaacatccattgtctactcttatgaaaaaggtcagctttttacatttttaagtaagtggtgatgactgtttttacataagttgatttggtatcaggttttgagttttgaatctaagactttggtaacgttatgtatactgtcttatactaaactctaagtggtttgatgcggctcaggtgaagttatctcgactgggtttgatgagaagatcaaattctgggatacaagacaaagagaaagtcttgtgttttcgactgatgctggtggagcagtgggatgtgtcactgtatctggaaacaacttagttgtttgtgtggacgcatcgatgcatatatacgatttacgtaacttagatgaagcttttcaatcgtatgcatcccaagtggaggtgccaatcagatgtatcacctctgtaccttattccagaggtaaacatatatagttacaagaatctgtctttggtgttatttggccatagtttacatttccactgagaaaagatttatattttacattgatcaggtttcatgtttggtttggtttctaagatgtttattgttggtattgagcaggatatgcagttgggtcagtagacggacgagtagctgtggatttccccaatacatcatgctccagtgagattaagtaagtccacaatatgaaagttatcatttggctatccactggtttgtattcaatcttttctcttaagatgtgtaccataaattcatggcagatacagtttccgatgccatcccaagagtaggaatggaagacttgatggtgtatgcataaatgcaatcgaattcagtccatggtatatgtctctcattcaccatctaatggtacacatgattgatcatcaaactaactcttttcttgttgccacagtgggtcagggacttttgtaacaggtgacaatgaaggatacgtgatctcatggaatgctaaaagcagaagaagactcaatgaggttcaaacactaaacatgacttgttctctctagattccttcttgttcttattctcctctataataatttgtgttttttataaaagttgccaaggtactcaaatagcatcgcgtctttagcatttgaccacactggagaactcttggccattgcatcaagccacacttaccaagatgctaaagagaagtaagtcccacactcttctcaattcgtttcatcatcacaaacactctcacaatacatcattaaaacatttgtatcaatatatctccaaatgttttgcagggaagaagctcctcaagtgttcatacacaggctttgaaagattcgtaagcttcttgaatctcagtgtctacttgtatctatctagttatttttttgtgtgtttttggtagcacgttttagcttgatctcagaactgactcgtgtcaaccaacatgtaatgattgtatctctcacgtctctttatactacttgttctctaaactttgttttgactttttagtcaactatatgctttgactttaaaataaacagtagaataatcaaattatttaagagttgattaattaaatagagaatctcagaggccgcgtaagatttacgatctgacttttatttctttaagaaaaaacaaaaaaacgccgcacgtgtagggtcgcgtcagttgcacgcgacacgtcaaataaatctgaaccctagatcgctttcttcagtgttctataaaaactaaactccattcgctgacttcgcaaagaagaacactttctctctgaaatctcaaattcatctcttctcttccgatttcgctgaatcatg

SEQ ID NO: 29602 - DNA, 3003 bp, Unknown; identical to SEQ ID NO: 27178
  misc_feature (1)..( 3003): 2750-1469P.txt file - cDNA_ID_3019499; gDNA_ID_2684212; Annot_ID_191555

SEQ ID NO: 29603 - DNA, 3000 bp, Unknown; identical to SEQ ID NO: 14861
  misc_feature (1)..( 3000): 2750-1469P.txt file - cDNA_ID_3019499; gDNA_ID_2684231; Annot_ID_192258

SEQ ID NO: 29604 - DNA, 3003 bp, Unknown; identical to SEQ ID NO: 27177
  misc_feature (1)..( 3003): 2750-1469P.txt file - cDNA_ID_3019503; gDNA_ID_2684231; Annot_ID_192257

SEQ ID NO: 29605 - DNA, 3003 bp, Unknown
  misc_feature (1)..( 3003): 2750-1469P.txt file - cDNA_ID_3019521; gDNA_ID_2684231; Annot_ID_192277
gcctataaatactccacaatttttatatgattttagtagctcaatagagaataacaatagaaaagaaatggaaggaacaatgaggtgctcagcgaattacgtcccgctttctccgatcagctttctcgagagagctgctgtcgtcttcggctccagaacctctgtcgtgtatggtgatattcagtacacgtggcaccaaacacgtgaccgttgcgtccgccttgcatctgctctctctgaccttggtctctctcgccatgacgttgtaagtggttaaacgacttttatatattggtcatacttttttcttttgtttaaactatttcttttatcaggtggctgctttagcgccaaatgttcctgcgttatgcgagctttattttggagctccgatggctggagcagtactttgcgtgttgaacacgacattcgattctcagatgcttgcgatggcgctggagaaaacgaagccaaaagtattcttcgttgactctgagttcctctctgtcgctgaagaatctctcagtctcctctcaaacattgaagaaaaacctctcatcatcacaatcacagaaaatccaacagagcaatcaaaatatgaacaatacgaggattttctctccactggaaaccctaatttcaaaccaatacgaccagttgacgaatgtgatccaatcgccctcaacttcacatctggaaccacatcgactcccaaatgtgtcgtctatagtcatcgcggtgcctatctgaacgcaactgctgttggtgttatgaatgagatgaaaccaatgccggtttatctatgtacagttcctatgtatcattgtagcgggtggtgctatatttggacagttacggcttttggaggagtcatcgtctgtctcagggaagtcaacgacgaagttatatttgatagtatcgtgaagcacaaggtaactaactttggtggctcgcctccggttctcaacatgattgctaatgcaagagactcggtcaagaagtcgtttccatggaccgtacaggttatgagcggaggatcctctcctcctgaggtaaaactaactatcacagagttttgaattacatgtttgttcaatcaggcttatttggttgaacttccatattttgaggttatatataatcaatcccttgctttatacgttagctccgtcacagtacattaatatttaacatagaatcatagtaaagatattaatttatttggacaggtcatgttgaaactcaagaagctaggattcaaagtgatgatggcttatggatgctcggaggtgtatggactaggaacagcttgtttgtggatgcccgagtgggagactctacctgaagaggagagtttaaggctcaaggcaagagatggtctcaaccatttcgccaaggaagctgtcgatgtattggacccaaccaccatgaaatcggttccacacgacggaaagactatcagggtaattgctctccggggaaatacagtcatgagcggttacttcaaggacaaggaagccactgaagcggcttttcgaggtggatggtactggagtcgcgacatgggtgttatagatcctgatgggtaagtaaatgaatcatgcattactttgaatgtattactttgaatttatttatgcttatgatgtttccacatgcgaagctacatacaatttaaagataggtcacaagatgttataacatgcggaggagaaatcgtgggatcaaaggagatcgaagggattctctatagtcacccggcggtttatgacgcaggggtcgtgggtcgaccggacgaaactttaggagaatcgatgtgtgctttcgtgaagctcaaagaaggagctgaagcgagagaggaagagatcattgagttctgcaagagaaagcttgggaataagaacatgaagatgattccaaagacagtagtcttctcggatgttcctaagactcccactgggaagattcgaaagaatgttctgagaaagatggccaaggatatgggttatgttcaattgagagctgtggagtaaatgaaatgataatttatcaatgcatctaataaagttataaaaaaaaaaaaaagtgtaaactttaagctttagtttatatgttctgatgttctatgttattttgacatttataaaaaataatgaagtctcatttctagtagactgatcttaacataagacaaaaatatatatatcagtagatgataatgggtatgactcggcaagtattattctcttgatactattatgtagtttcattgtttaagcacactgatagtttaatactattatgtcgtttcattgtttaagcacactgatagtttgatatttttgtatcaggtgctgttgattgaattatgtttttttttgttcttgatttactttttattggggtagtattcatgatgattaatggagactatgttatgtatataatgttagaaacctggaaatatctttcacaagttttcacctttaagcaattcattttgatagaaaaataaatattatgagattaatctttcttccatggatcaaggcaagctaatagctatcatacaaacttataccagcccagatcaaattaaaccggagagaaattggaatgcccaatcagaaatgcataaatgggccaaatgtgaagaatacggcccaataattgttttttccatcagaatgataaacctgaaatgttttcttttcggcaagcttctctcctcttctaacatggtcgcatctgctagaaccagatacacataattgaaacgagtttcgataaatggaaatgttcgcttactgatttagagtttagatttttagtttgtgaagtaagttttcgccttttctaatctcgaagaacctcagaatcgagcctggaaagccatgtacagagctctgtaagttgttttggcaatttttttttttttttttgtgttgcctactatttcaataaatgttcattgacttgcttcgtgtttgtgcaatgaagatg

SEQ ID NO: 29606 - DNA, 3000 bp, Unknown; identical to SEQ ID NO: 9569
  misc_feature (1)..( 3000): 2750-1469P.txt file - cDNA_ID_3019521; gDNA_ID_1972155; Annot_ID_179467

SEQ ID NO: 29607 - DNA, 3003 bp, Unknown
  misc_feature (1)..( 3003): 2750-1469P.txt file - cDNA_ID_3019521; gDNA_ID_2684231; Annot_ID_137623
gaaatacagtcatgagcggttacttcaaggacaaggaagccactgaagcggcttttcgaggtggatggtactggagtcgcgacatgggtgttatagatcctgatgggtaagtaaatgaatcatgcattactttgaatgtattactttgaatttatttatgcttatgatgtttccacatgcgaagctacatacaatttaaagataggtcacaagatgttataacatgcggaggagaaatcgtgggatcaaaggagatcgaagggattctctatagtcacccggcggtttatgacgcaggggtcgtgggtcgaccggacgaaactttaggagaatcgatgtgtgctttcgtgaagctcaaagaaggagctgaagcgagagaggaagagatcattgagttctgcaagagaaagcttgggaataagaacatgaagatgattccaaagacagtagtcttctcggatgttcctaagactcccactgggaagattcgaaagaatgttctgagaaagatggccaaggatatgggttatgttcaattgagagctgtggagtaaatgaaatgataatttatcaatgcatctaataaagttataaaaaaaaaaaaaagtgtaaactttaagctttagtttatatgttctgatgttctatgttattttgacatttataaaaaataatgaagtctcatttctagtagactgatcttaacataagacaaaaatatatatatcagtagatgataatgggtatgactcggcaagtattattctcttgatactattatgtagtttcattgtttaagcacactgatagtttaatactattatgtcgtttcattgtttaagcacactgatagtttgatatttttgtatcaggtgctgttgattgaattatgtttttttttgttcttgatttactttttattggggtagtattcatgatgattaatggagactatgttatgtatataatgttagaaacctggaaatatctttcacaagttttcacctttaagcaattcattttgatagaaaaataaatattatgagattaatctttcttccatggatcaaggcaagctaatagctatcatacaaacttataccagcccagatcaaattaaaccggagagaaattggaatgcccaatcagaaatgcataaatgggccaaatgtgaagaatacggcccaataattgttttttccatcagaatgataaacctgaaatgttttcttttcggcaagcttctctcctcttctaacatggtcgcatctgctagaaccagatacacataattgaaacgagtttcgataaatggaaatgttcgcttactgatttagagtttagatttttagtttgtgaagtaagttttcgccttttctaatctcgaagaacctcagaatcgagcctggaaagccatgtacagagctctgtaagttgttttggcaatttttttttttttttttgtgttgcctactatttcaataaatgttcattgacttgcttcgtgtttgtgcaatgaagatggctttctccattgcgatttattgtgagctcgtcgtcgtcaaagttaacgccttacgtatctcgagttagttatctgttccctgtgtttcttcaattaaatttgaagacttattgcaatttgattaaatgggtatttgattatagggacgaggactaagtggaattgataatggggctggttgttcttgttctcgtagtgtcacgacaatgattggtatgtctgattttagcctcttcgtatggtctatttgtctcaatatctatttgatgttacttggattatgaaagacgagatttttttgacttaagagtgcatgtttccatatgcaggtaatgaattcattcgatgccaagatgagtcaaagatcttacagttgcagattgttgatgcccttcgttcaggagagaggcaaggagcgtcagcattgctttttaagttaatacaggggaattattcacttagtgctgatgattttcatgatattctatattattgtgctcgatcaccggatcctgtggtaagtttgatatatgacaaagtctccctttggctttgtttaatcttcgtttatctttcacaagttatatttcaatgaaattttggtagggctgagatgtaaatctgtaatttgtttctcataatacagtactcttgttgtctctgacctcaaggcagtaatttgttcctgtagtttgtcatggagacttacagtgtaatgtgcaagaaggaaattagtctggacagcagatctttgttgttcatagtaaaatccctttgtaatgggggacacttagataaggtataattattccactcgaaagccagtatttccttacataatgcgactaaaagagatgagtaaatagttttgggcatacttgttcaggcatcagagtttattcacgctgtcagagaagatgatcgtatatctcctcttctgcctatctataacttttttcttggagcctgtgcacgaacgagaagcgtatatcacgctagtaaatgtttggaattgatggatcaacggagagtggggaagaatggaataacttatgtagcacttctcaaggttagttaagaacatatcatttttcagtgccttaatctttttgtttttttcaagagctggtcgtatgccaactttaaaatttggagtgtagaagatctggagaggacttatctttttgttattgtctccatttctgtcttagctttgctgtcccttaaggactttcgtttgttccttgacatggaggtttcattttcattgatctgcataattatcttctttttctttgttatctgattaatattattttcagcttgcagtttttcagcgcaatctatcaactgtcaatgatatctggaaacactatgtcaaccactataacctggatatactttctctcagaagattcatatggtcctttacaaggctaggggatttgaaatcagcatatgaattattgcaacacatg

SEQ ID NO: 29608 - DNA, 3003 bp, Unknown
  misc_feature (1)..( 3003): 2750-1469P.txt file - cDNA_ID_3019525; gDNA_ID_2684231; Annot_ID_192270
taatcaccccaaaatcaaagagtttgtattaataaaccgctctcattcttgttgttgtttgaaacagatcttgagcctgatcagactccactaagctggtatactcggatgaaaatcgcggttggtgcagctcgtgggatagagtatctccactgtaaaataagcccgtctgtgatttaccgtgatttgaaatccgcaaacattttgttagataaagaatttagcgtcaagctctctgattttggactcgctaaggttggtcctgtggggaaccggacacatgtgtcgactcgagtcatgggtacttacggatactgtgctccagaatacgcaatgagcggaagattgactataaaatcggatatctatagctttggtgtagtgttgcttgagcttatttctggcaggaaggccattgatttgagtaaaccaaacggagagcagtaccttgttgcttgggtaagtaagattaacaattgtaaccagattaaaccggaacttaatctctcgtttaatttaaccgtgttttttttttcattttcgcgttaatgcaggctagaccgtatctcaaagatcctaagaaatttggacttctagttgacccgttgctacggggaaagttctcgaagaggtgtcttaactacgcgatttctataaccgagatgtgcctaaacgacgaagcgaatcaccggccaaaaataggagatgtggtggtggcatttgagtacatagcctctcagagcaaatcttatgaagatcgaagaacggctcgcaagtctacggactctaaccggttaagacgggaaacaaaacagagttattaattaaattgtatgagtcctaagtgaaacctctgctagaatcagaaggttcctgataaggccgcataattaatgtttgtactttttttccgggtgtttttgtttagtcagatttaagaatgggatttggtcggataaagaggtttttttttttggcttgaggtaaatggtgctttgtaaaaaaacttaaaaataaaaatgaactcttacgtttaaatatatattataggtatatactatatacgatgttattggtgggtcattaatacaaatacatatgcgtacactgtacacaagtgatagttttgataaataatatttcaagtgagctagttagattttaatacaaataatttcaaaatatatcttcaaattttaaacgtcgatttcagagtagatcaagattgtgacatcgtcaagggctaatcttttgattctttcttgcaaagaagaggacatgaaatcataaatgcaagtaggtgactaactgatttacgcggacgtcgaattatcgattatactatatatttatgtcaacttgcattataccacttaatccgatttacacatactatttcccatgtctacattacatagatatataatattcgcatattgcaggtttatgattgaagaagaataaaataacatctccccacgttttacatcggtctacgttatacatcggtctagtattactactataatatgcaatgtttcaaactttacgtggaccgttagtaaatgtgtttgtgaaagaaagaaagtcacacacatgtgtaatcgactgtttttttgtcttttgctacaaatgttaatattcattggaatgaaagttgaggtgctacaaaacagttagacctatgtatatttgttttttggcaaaaaaaacaaacaataaaacaatggagttgggacaaataaagttgttttcatcggagagccaaaaagccattaaagttgtaatcgactgttaaacgaaatgttttgttttaaccaaatatcaacatatcttatcttgctcagtgaattcacatatatagttgttagcaaaacaaaagatcataagataccacatacttttgaattttcttagatttatcatatatttttaaaattttctaataaagtttccatatgctgtcacgtttatatactcggacccgccattgctaaacactgttcttcttgtttgacctcttcccactgatatttttttagtttcttctaataaatgataccgtatatcatgataataaagattttcatatatttccgatactatttactgttttgtttttccacacaagataagaaagaaatttgttcactattatcttgcatcactcgatatctacatttttgtgagttctcttgttacgtcattgaggtgacgtatatgatcgttataatagtctatattgatcatgaacgaatgtgaatggtaatttggtatacgaggaaaaagaagtatggtacgaccgtacgagcacaagttgtaactttttttttgtttaaaaagaaacaatacagtagttacctacgaacataactttaatgttatgatactttttatttgtaaaaacagttaaaggaacttaaaaactatggttcatcgtatatattttcgatctgccacccaatgagtgagcacggcctttgactctggactaaaattatattgaatattcatatacttgatatccaagtaaatatgaaattatatacatgtcaagaaaattgtttatcgtttttggattatttatgttatcatctagtagttttattgaaatagtaaaactcgagatacacaaatgagaaaatgtaaataagtagtctgaatcaaggactaattgacgttgaaatttttggaaataaatgtatatttcaacatcaaccaatcaataatcacgacgatatcaaatacacatatccttttataaaattaataatgaatatttccccaaataaagagttttgcttggtctttcctctcttcttctcagcttcttcctcctcaatctttcaattaaaatccccagaaaagaaagaaaaaagggacagttggagaaaaagattctctcaatcttatgatcgttaagggtgaaacaaagattactaaaaacagaggaaaaacagagtaaagattactcaagagtcaagagctggtttgatcttaatg

SEQ ID NO: 29609 - DNA, 3003 bp, Unknown
  misc_feature (1)..( 3003): 2750-1469P.txt file - cDNA_ID_3019525; gDNA_ID_2684231; Annot_ID_137616
atttgagtaaaccaaacggagagcagtaccttgttgcttgggtaagtaagattaacaattgtaaccagattaaaccggaacttaatctctcgtttaatttaaccgtgttttttttttcattttcgcgttaatgcaggctagaccgtatctcaaagatcctaagaaatttggacttctagttgacccgttgctacggggaaagttctcgaagaggtgtcttaactacgcgatttctataaccgagatgtgcctaaacgacgaagcgaatcaccggccaaaaataggagatgtggtggtggcatttgagtacatagcctctcagagcaaatcttatgaagatcgaagaacggctcgcaagtctacggactctaaccggttaagacgggaaacaaaacagagttattaattaaattgtatgagtcctaagtgaaacctctgctagaatcagaaggttcctgataaggccgcataattaatgtttgtactttttttccgggtgtttttgtttagtcagatttaagaatgggatttggtcggataaagaggtttttttttttggcttgaggtaaatggtgctttgtaaaaaaacttaaaaataaaaatgaactcttacgtttaaatatatattataggtatatactatatacgatgttattggtgggtcattaatacaaatacatatgcgtacactgtacacaagtgatagttttgataaataatatttcaagtgagctagttagattttaatacaaataatttcaaaatatatcttcaaattttaaacgtcgatttcagagtagatcaagattgtgacatcgtcaagggctaatcttttgattctttcttgcaaagaagaggacatgaaatcataaatgcaagtaggtgactaactgatttacgcggacgtcgaattatcgattatactatatatttatgtcaacttgcattataccacttaatccgatttacacatactatttcccatgtctacattacatagatatataatattcgcatattgcaggtttatgattgaagaagaataaaataacatctccccacgttttacatcggtctacgttatacatcggtctagtattactactataatatgcaatgtttcaaactttacgtggaccgttagtaaatgtgtttgtgaaagaaagaaagtcacacacatgtgtaatcgactgtttttttgtcttttgctacaaatgttaatattcattggaatgaaagttgaggtgctacaaaacagttagacctatgtatatttgttttttggcaaaaaaaacaaacaataaaacaatggagttgggacaaataaagttgttttcatcggagagccaaaaagccattaaagttgtaatcgactgttaaacgaaatgttttgttttaaccaaatatcaacatatcttatcttgctcagtgaattcacatatatagttgttagcaaaacaaaagatcataagataccacatacttttgaattttcttagatttatcatatatttttaaaattttctaataaagtttccatatgctgtcacgtttatatactcggacccgccattgctaaacactgttcttcttgtttgacctcttcccactgatatttttttagtttcttctaataaatgataccgtatatcatgataataaagattttcatatatttccgatactatttactgttttgtttttccacacaagataagaaagaaatttgttcactattatcttgcatcactcgatatctacatttttgtgagttctcttgttacgtcattgaggtgacgtatatgatcgttataatagtctatattgatcatgaacgaatgtgaatggtaatttggtatacgaggaaaaagaagtatggtacgaccgtacgagcacaagttgtaactttttttttgtttaaaaagaaacaatacagtagttacctacgaacataactttaatgttatgatactttttatttgtaaaaacagttaaaggaacttaaaaactatggttcatcgtatatattttcgatctgccacccaatgagtgagcacggcctttgactctggactaaaattatattgaatattcatatacttgatatccaagtaaatatgaaattatatacatgtcaagaaaattgtttatcgtttttggattatttatgttatcatctagtagttttattgaaatagtaaaactcgagatacacaaatgagaaaatgtaaataagtagtctgaatcaaggactaattgacgttgaaatttttggaaataaatgtatatttcaacatcaaccaatcaataatcacgacgatatcaaatacacatatccttttataaaattaataatgaatatttccccaaataaagagttttgcttggtctttcctctcttcttctcagcttcttcctcctcaatctttcaattaaaatccccagaaaagaaagaaaaaagggacagttggagaaaaagattctctcaatcttatgatcgttaagggtgaaacaaagattactaaaaacagaggaaaaacagagtaaagattactcaagagtcaagagctggtttgatcttaatgggaaacatctgtcctggctctggatcttccactgttaaccacgaacctgtctccaccaaacccctcccaggttcatacacacatctctctgcttttttctttttttttggggccgaatccaaatactttagatctatttaccttttttttttctttggtatttttgacgattcttgagtttctttaagttcttgcattaaccccccaaaaaaaaaaaacgctttcctggatttttttgtttgtttcattgtgccttttcaattatgaaaatgtcaatgcttgctctgttttaacttttctgttaaagtctcaatgtttttattttcattaaatcaaactttcgtgtgtatcaatctatacagtgagacgtgtgcagaccccagagaataaaaagtttcctccgccgctggtggcgatg

SEQ ID NO: 29610 - DNA, 3003 bp, Unknown; identical to SEQ ID NO: 27259
  misc_feature (1)..( 3003): 2750-1469P.txt file - cDNA_ID_3019529; gDNA_ID_2684231; Annot_ID_192268

SEQ ID NO: 29611 - DNA, 3000 bp, Unknown; identical to SEQ ID NO: 14877
  misc_feature (1)..( 3000): 2750-1469P.txt file - cDNA_ID_3019533; gDNA_ID_2684231; Annot_ID_192267

SEQ ID NO: 29612 - DNA, 3000 bp, Unknown
  misc_feature (1)..( 3000): 2750-1469P.txt file - cDNA_ID_3019537; gDNA_ID_2684231; Annot_ID_192265
tgtgagaggctgatgggaaagactgtaagaaacccagcaacggtttcagttctttcgaaagatctttcagtaaactgtcagtggatttgcgagctgctttgcaggtttgaatgtcaccagttcttgagagatcacgcagcgatgcttcaagcttatcatgtgtggctaagcatttttggacgatgctttggacttcctggagtgttgctaggacctgataaacaaatggagccgtttaaatatcaaccattcagagaaagagaatatcagtaaatcgcttgaaaatatacatgagaaaaggttccaatgtacctcatcccattgaagtttcgccaaataactcggagaggacttggagattgagatgtcagcccgtgtgtatatgatgcaagtgatgaacaaaatgaaaaatccagagattaacatcaatggctcactcagcagattgatgttgctgaacttatagtagacctgtacagaaaacaaatatcataatcaattaaagtaggaatattgtggatgtagaatgacagcatttctgacgtataatataattacctggatatgctgattgtgatcagggacaacgttgttcttttcgagcacaacaactggtctaccagctatatctaaatgtgaatatttgatctgcaaatgaacaggattgcaacatgaagaattaaaatatcagaatcaaaatcagggaaagacttataatcaccagagatagtatccagacaggataaatcaggaacagataaagccaagactttgttacctcttgagactgcttgacggcgaatggagtggtaactgatatatcctttgacccctcaggtaaaaccacctacaatggaagaagaacacacaaaagaacatcaagctacgacaaggaaactttcactcaatgttggcgcatgagatcatccatattggtttatcatttggtcaatccagtcacgataaaaggatactgcttcgattgatttgattccacatcattctaaagctaaagaaaatcaaactaagaaaggtaaacacacttataagttgaaagtgtataagaccgacctgtacaataagtttttcagtgacaaggtcaagtataggggagccaaaggagatattaaggaatcgctttccttccgaagcaaacaagaagtcggtaagtggcaaaccataacctatcgtgaaaaaagttttccacccaccaaacaaaggaaacctaggctcaattagtagctctgtctgcaaccaaaccagcaaaaagatcaaaacacatacaacagaatatttggaagaccaaatctcgttaatccaaaaataccaacctttttcgaatcacttttcatctcagacgtggagatatttccaatatcatccctgtaatatatggaatgggctctggggggtaatctagcaagtaaatgcctaaaggcagatgctccacggggattaggtctggcttgaaaatctaacctgcggttggaatataatgagaatgaagcaatcaatttgtgcgttagaatagtgattaaaacgaagattaaagctttagtacgaatattaaccttgaaaactcgcccttgagttgagccccacggtggacaacattgtaattctccgtgacctgcacattcccccaatgagacacttctatctctcgcacaagcttctcagccacagcaaatgcagccttgctttcaaagtggacaacaattggagagtatgaatacgactggagattcttgtaaggaccatatttgagctctgatccctggagctttgtattctcgaatttggtgtaagattcgattctggcattcggtagtttgatagacaatgactgagactcaaccgcgtaaggagagagatattgtgcgctttcttggagcataacaagatggatttcaccctgagttatcttttcaggaaatggctgaagtacattggtgaatgcagcaactacctccagcgtcaaagtatcgcctttactcagtggtttgggtaatgcaactgagtaaacactaattgaatcaggtaaacctttctgatcagcttctctcacagagagattcactaaagttcgtttagatttcccctttccctcactaggagcaaccgatagataagccaagttgttaccaagaaactttgggaatgtcaaagcaaactcagaaactgattcagagccagaatttacaacctaataccaaatttgaaaccaggacttagagacaccaacacaacatataacttcgtgactaagatagtctcatagaaattaccttaagggtcttagtaacacgagcaatctgtgaagtcacatcgatctgcaaaaaagcaacaaactttgatgaataaagcatgaaatgaagctaaaagactctcgaaaatgatttcaattctaacgagattataagaattccatataaaggttatatcttttgaactgatttcgaagtgttaaagcacagatcaacaaatgcaaattgtgggacttgattcaggaacctcatgaatccaaaaccagatcgaagatattatgtggtgagagattgagagacttacacgacgttcgactttggataaaaccagatcggagaacgccggcgtcgcaagaagagcgatcgccaggagaagaagtaacagatcgacgacacttgattgcttcatccttgtcagatttttcggaccagtcttcgaactagcttactcactcagagaaccagagaccttaacaaaatattggctatttccccgggtcggatctagtcgaagcccatatatattgggccctaaacatgggcttaagggactagattggctcttttactaataggacagctggcggtgagttattggttggattatggtgaaccttggtgcagaggatgatacagtagtcgaagtgtgcaaaaactaggtgaggttttggttttgttgactcagtgaggattttctaggcgattttctcgagaaaatcgtttgaggaaaatg

SEQ ID NO: 29613 - DNA, 3000 bp, Unknown; identical to SEQ ID NO: 14889
  misc_feature (1)..( 3000): 2750-1469P.txt file - cDNA_ID_3019558; gDNA_ID_2684232; Annot_ID_192309

SEQ ID NO: 29614 - DNA, 3003 bp, Unknown; identical to SEQ ID NO: 28315
  misc_feature (1)..( 3003): 2750-1469P.txt file - cDNA_ID_3019565; gDNA_ID_2684232; Annot_ID_192307

SEQ ID NO: 29615 - DNA, 3003 bp, Unknown
  misc_feature (1)..( 3003): 2750-1469P.txt file - cDNA_ID_3019569; gDNA_ID_2684232; Annot_ID_192306
taagaaaaatttcaaataaattatatagtaactaactaaaaaatcacgaagaaaaaggaaaagaaacattcaaatcgttatatgtttcttcttgttaattagagatcacacatttctgaatgtagaattttcaaatattataaattaaaaaacgatgtaacaaaaagaatgattgcatcgaaatagacatgatatatacttccctaacgatcttttcaagtccaaacacaatatcttttgcaaataatgcgatttaacttttggtatttgatattttctttattcatttgcgaacataaaacaagcaacaaagagaatgaagagataattattcattgattaaaccttaacaaaagatccgttcatcagatatgaacggcaacaaatatcgcatgactaaacgaaccaaaacgaaaaacaaataatcaaagaaaaaaaccctaattaatcaagaacaaacaaagaagaagagaaactagcaggtgacatggcaagtgtaacgaacaagaggaacaaagaaagggtcgttgaagaatccccaagcgacgtcgtcacattcacttttcatgttgacaacaaggttgcaacaatagtcactaacttgaaacaacctcgtgtagaaactgacttccatctgcatccgacacatcccaacaggtcccatgtttatcatacatctctcgatgtgttcccatggattctgttgatgatgaggtggatttgatggagatgatgagtgatgacttggtggcggaggtggagacttcttgggtgttggaggtggaagagacggtgttgaaggagacttcttgggcgctggaggtggaagagacggtgttggaggcggagatggagacttcttgggcgttggatggggaacaaacggtgttaatgaaggcggagatggagacttctttggcgttggcggtgggggagactttttaggagctggaggaggaggagacggtgttgatggagttgacggaatcggcgttgatggagaaatagaaatggcaggagcagatccgttgctataagtacatttccagactttggaatctccatagccgaaactatggccagtgttcaaaagcatcagttcgtttctagtgatttcagacgggtttggccatccttcgatttttggccagtattttccgacggttgtggtcggaaaagccacaagacaaagaaaagctgccgctacaagcacgatggaggttttcattcttaaagggaagatttgtgagtgtatacaaagaaatggactaactcgttctttatatatagaaggatttaacttcttttttttggttggttacaaatatatcaaagatctttttaacaaccaaaaaaatatgaaaaaatccatatctcgtaactattattttttaaaatttaaactgttgtaaatattatctcttggaaactcgaaaagaatatatttttttattttttttatctaacaactttctttcaaaactcaaaacatatccttgtttacaaatgggattaaaaagtatggacaaaaatgtataaacaccacggggtcatgggcgtaggcagtgtgtaattagggggtcaattgacccctatgaattttaaaatttctactatattttattaagagtaattataatgaccccaatgcattatagtttttgatccccatatcaaactaattcaactaaaacgacaaaaaagccaaataagtttggttcattagaattttaaaccaaattgtaatgtaataaaattaaaaatccttgacttatttaaacttaagttcaactaatgatctaatgttataattatatatataaaaaaaacacaatttgtttttgcttttcttagtctttgtggaccataacaaaaagttgtaattattaatttagttgattttcagatatttttctcaggtgtagattatttctaaacaaaataataataaattttatataatatactatttttattaaaattctgatccttataacaaaattttctagctccgccactgcacgggatgttacatcgaattgaatttttggcgtagagcatctgcacaagtattctgctcacgatgtttgaaaacaaaactttggtgacttgaaacttcgcgtccatccacttatcgtagttagatagtgttgcagtcgtggtgatgatccattgttgtttttgagactaattcggttttttatatatagaaggatttaacttctgttttttgttggttaaaaatataataaagatctttttaacaaacgaataaatatgataaaattccatatctcgcaactattatctcttaaaacttaaactgttgtaaatattatttcttggaaactcgaaaatgaatattcttaacgagaaaaaaaaaacataacgaaaatatgtatattgcaattataagacttaaaaaaataaaaaatattaaatgcagattaacaaaaagaaattattagatgcagatttgtgtagatctttgaaaagacctattaaagcccatttaggcccattaaacgacaacctattaaacccatttaggcccataataacggcgtagtttcagaattagacagtgaggcaatggagcataaagtaacacccgaaagatccgacccggagaagagagatccggacaacccgacccaaatatttgacatttttggttcgatgttcttcttcttcctctattgatttttctgatcttcccgttcgatctcactctgtttcccaaaaaccttcgtgtaccttcgtattctctgcattggatttgaagcaaattgatgaactagtaatctcacacggatctaagagcaggtaaaaccaaaaatgaacactacaaagctatcaacgaattttccatttttttttgaaattttattttctttcgaagatcagatcagtaatcttattatcagcttctctcgttctcttgatcgatctgaatcgaaattgtgacaatgatcagccgtattttgtctttcagaagttatg

SEQ ID NO: 29616 - DNA, 3003 bp, Unknown; identical to SEQ ID NO: 27269
  misc_feature (1)..( 3003): 2750-1469P.txt file - cDNA_ID_3019578; gDNA_ID_2684232; Annot_ID_192298

SEQ ID NO: 29617 - DNA, 3003 bp, Unknown; identical to SEQ ID NO: 27275
  misc_feature (1)..( 3003): 2750-1469P.txt file - cDNA_ID_3019626; gDNA_ID_2684233; Annot_ID_192341

SEQ ID NO: 29618 - DNA, 3000 bp, Unknown; identical to SEQ ID NO: 767
  misc_feature (1)..( 3000): 2750-1469P.txt file - cDNA_ID_3019639; gDNA_ID_2684233; Annot_ID_192318

SEQ ID NO: 29619 - DNA, 2479 bp, Unknown; identical to SEQ ID NO: 14945
  misc_feature (1)..( 2479): 2750-1469P.txt file - cDNA_ID_3019670; gDNA_ID_2684234; Annot_ID_192384

SEQ ID NO: 29620 - DNA, 3003 bp, Unknown; identical to SEQ ID NO: 27287
  misc_feature (1)..( 3003): 2750-1469P.txt file - cDNA_ID_3019687; gDNA_ID_2684234; Annot_ID_192374

SEQ ID NO: 29621 - DNA, 3000 bp, Unknown; identical to SEQ ID NO: 14929
  misc_feature (1)..( 3000): 2750-1469P.txt file - cDNA_ID_3019691; gDNA_ID_2684234; Annot_ID_192373

SEQ ID NO: 29622 - DNA, 3000 bp, Unknown
  misc_feature (1)..( 3000): 2750-1469P.txt file - cDNA_ID_3019695; gDNA_ID_2684234; Annot_ID_192368
tagtctcatagtagtcgtctaaaccaaagctctagtcttgaaagcttatctttcccatcttcacgttgttcattcacttcatgggagattcgaattacattcttttaagaggatattagtttacgctctaatcgtactatattcatggattaagaaaacatctacaatctccaacatattttaaacagaggaccaatgcagacaaggaaaccttcaaggtctcaaaaaaaagtcaagaaaatttgaattcgtgccaactaataaaacggacatacctttgattttaggtgtccgaccaggtcgcacttatttgagtgatggatatagtttgattagaataaaatctagtaactattttgttaagtcagggtattgggttgcgcaagaactttctcgccctacttgtgactacccttttcagggaccaggaatcactccctttttggcacaagtatggaagttaaaaaccacaagaaagcttaagcattttgtggtaatgtttatcagggtacttggcaacaaaccatacactattctaccgacacatcggtaaggaaaagcattgtcctagatgtggtgctcaggaggagacagttaatcacctcttttttgaatgcccaccagtgcttcaaacttgggctctttcaccaattccatcactgccttcctccttttctgattagtccttattctccaatttggattttctttctcgaaagtgaaaggaatgatgaatggtaaagaaattggacaccttttcccatggatactatggtatgtatagaaggctcaaaatagctttatacagtagaaactctataaattagtaatgttgggatcatgaaattttattaatttataatgatattaatttatcctataaattaatatttattaacttatacgataagttaataaatattaatttatagaaatatttacataaaatacaatattatattctttttaaaatgtttcttaatttaagtttttatatgttttgttgtttgcatatataattatgttagttttagttttttttttacttctttaatttatttttcagcaagatattgtgtctatatatctacgccattaacgtcaatgtaaacgtaaacatgaagcttaatccaatttctctttactcaaatcttagcaatgctttctcaaaaagattttacaaaatcaactatgacggatcaaatacgcaaatagttaattatatgagtataacaaagatcataccagttgtattttaaaaagagttgtaattgtagcttgaataaaaatttcatataaaaattagtcttaaaatatatacttaagatctatgattattaatttataatattattggattttgaaattttgaattttttttcattttttatttatttattttacattaggtttcttccctcttgtaacaatatttgtgctgattgtctagctaaaaaggtaagagcatgagggtctcttttctcccatgtaaacacatctgcttaggattgtctttctttagaagaaaaattccgtccgataacttagtaaaatggtgttcgactaaaaagaaaaaaaaaacatttaaaacaagaaagtcaaataattatttgatataaaattttaatgacatatttataattaaaatataatttaacagaaatatagttatatactagataaaaaaacatatttctttgaaaattaaaacagatgaaatatatgaaattaatcatttctaaaaagctttctaagtaagctgtttcgttcctttacatctgtctttttcatttactttttgggttgagattattagtttcttgttcatgaagcttcgcatctccatcgaggatcatgtgtacggacccgagtgcttacccaaataaaccgaattaccatagcatttacaaaaaaaacatttggagagttggttgtaccattctaattatatatagttcgtcttttaatattgtggttagctaagaaaattcaatattaggtctactttaagacacagattgagaaaaaatatatataagttaataacttttggtgaagaatctgttgtcaacgagccaaaatatgagaatttttgggtataggttacttgcttaacacgagagtttgttctgtgcgtgaagatatggtcttattgcttcaccaagttggtccaacatatatatatgatctaacatttatctatgagatctctttatctattgtatatttcgtaaatgaatcctactatacatacatgaaatattgatagtcgggcataacttaacgttttccattgcataattcatcacacgatctttttcttggattttttttatatatataaaatataatctgttaaaggatcaatcaagatcatgttatggcatatgatatattgaatagaaaataaataaaactggcaaaactttaaatagtttggaaaagaaaatgagtttgaataacgacactccatctctcgtcacctttcttgattttgaagagattagttttctctattttttttcgttttttcttttataaactccatatcctgatttagtttaatgatctcttgaaggggttttcctaagtgtggttggataccattagttaaacattttcacacaactctagctataacacattcaatatttcaactgtgaatactagaaaaaggttaaaatggttcaaattaaaatagtcataatcaaaatgttgaaaaatgcatttaaaagttatttgttgcaaacgtatgtacatacaccattcataaacttgacgtccacgcaacctcccaaaaatattattttattacaccattttaatttaatatactataattaaattttagttccaaaacttaacattcacttgcccctctttctatatcacctcctcatctttagctccctctctctcgttttatcttttgatagttctgattgtaattagattttggtaggtcacttgtatagagagatcagtaaaataagaaggatg

SEQ ID NO: 29623 - DNA, 3000 bp, Unknown
  misc_feature (1)..( 3000): 2750-1469P.txt file - cDNA_ID_3019698; gDNA_ID_2684234; Annot_ID_192363
aaaatgggctaactccttcagctaaagtaatttatgaattagcttagtacacttcgtttataataactcgaatttaaatcatacaaagagttaaatgattttatcttactatttaatattaaaaaagtgatacatttaccagacgttatagttaaaacaaaatctaaataaaatagttttggaattctaaatttacaccaatgcacaacaataaattatattgatctaaaatcatggaatgatcatagtctaaatttatcccatttgagagatttaagaataaaaaatttacacacattagtaataagtagttaagtatatttattcgggacaaattttcgaatttaccagacggttaaatcgttatggtgatgttcttcgaagcatacaattttcgtagataatttaacctcgagagtgtaacaatttgataaacatcattttgttcgttttttccaacatgggatacatgctttcttctaccattaaagtatgggctcgacgttaagcatcatctagttgagccactcttatccctagcttattttgaatttgagttggatgttttgtcacatatgatatagaaatctattatggtgacattgaattcaccttggagaccttaaagaaaagaaaaagaaggaaaaaaacttctccactgtcactaatttggtccggatcaaagataaagtgtagtggtggaccgatctatattccaaccagggatatataagatgtaaggtgcatactcaaagaaaatattgtcaataattggctgtttaactgtgattaatatataatcgtactcagtcaagaattggttgtttaaaattagtggagatattatttcttataacctagttaaaagttgaatttgaatatttttttagagttcatacgacgaacattatgtatttgaaatgagaataataagcaataatagataaagaacgatagaatatgaccattgaagaaattgaaagtagatggtatgatgaaaattgatgagcatcacaagataggaatatggaaaacatagtggagaaaagctaagttatattccttccttgccaatatctccttcttttacaccttcttgtatcttaaaagaaaataataataacttagtattcacgacacttgtccaaattctttacccaagattcctttgttatgcttgtttgttttttcctccaaaagtaatgcaaatttacattaggtacaaacaatctcattgttaaaactcattgaaaggatataagaaaacaaatgggtccaaattattttaagaaatgaccaattgtcaagcgcaaccaaaattacggttatcaatctaattgacttatcttgaaaatataatacgttacatttccaatattccttttttattatcaaattacgttacatgtagtcgtagacttgagcactaattagccgttgaatcaaaatctttaacgtggttctactacgatgctatcataaagtctatgtcaatttatcaacaaaatatacattctcgaaagaaatgttatcatgaatcgttttttagtttttttttcctacgactacaagtacagctacgcaaagttgcaaaccactcccctccatacacattaacttggactaaacccgatgatcatacaatgtcacaaattttagcgttactacattagtcttaacattttctaatatttgcaaatgttccatccctaaaatggatggtagttttaatttcaaagcctttttttacacttttttgtttggtatttgttttaattttctcgtatgtataaaatttgcttagctttagcctatcttgaattctatcatcgcatattcgcatggttatattatatcttacaaatcgtgtgacccaaactctgattttggaaaaattcttggcgacttccctaatgtattacatagtctaaagaaaaacttaaatttctaactcaaatagtatttaaatttcctcaaataaggagcaagtagtgtatggagccaatagcattgaagaaaatgcctaattttctaaagcatatgtgcaacaaaaaaaaaaaaaaaacataattgaactctggttagtttagaaaacaaaacaaaaaaaaaagattatttacacaacaaatagtaaattttaaatgctcatttaatatttcttaatataaataaatgctataaagagaaaaaatgaacaataaaaagaaaagaatccataataaacagtccaaatggcatttttttccaaaataatcattaaattccttaaacatttccccacaatttgataatttttaaatttttatattttctcataaattagtacattgaatttagctcataaaaaaggaaaaagaaaagtggagggtgaagagaagaagagaatccagcaacgtttctttatttcctttgtgtttttttttcttcataatctctctctttttatttattcataatttttactctctccatttcttcattactcttctttttattttccggagatttttctctttgcctttgttatttgctgcttttgctgcagctacagtgtaagtttgattttctgggttccttcaaactccaaaatctcgcgtcgctttttgcttcagaatcgatttgttcttgttacttcgatctgttgttctttttaactctgtgcatgattcaatttcgtgttcgtaacctgttttttgctgcttgtttagttcgacaattaggtaaaaaaatgacgatccctaaaacttatgatccttttaatcttcgtttagctacttcgttcgagatcatctagggcttttgttgcttcatcgattttgggttttgatttactgtaaatgttttggttttgtttatgtaatctaagcatgtaccaatgattcatgagtgatcatgtttgttataggagcagaactgatgtgaagtgtgtattttgaatgtgtttttggttttgtacagagaatcttgtgtttttgtggtggggaggtgagatttcttatg

SEQ ID NO: 29624 - DNA, 3000 bp, Unknown; identical to SEQ ID NO: 29623
  misc_feature (1)..( 3000): 2750-1469P.txt file - cDNA_ID_3019698; gDNA_ID_2684234; Annot_ID_137675

SEQ ID NO: 29625 - DNA, 1118 bp, Unknown; identical to SEQ ID NO: 14924
  misc_feature (1)..( 1118): 2750-1469P.txt file - cDNA_ID_3019704; gDNA_ID_2684234; Annot_ID_192358

SEQ ID NO: 29626 - DNA, 3003 bp, Unknown; identical to SEQ ID NO: 21808
  misc_feature (1)..( 3003): 2750-1469P.txt file - cDNA_ID_3019743; gDNA_ID_2684236; Annot_ID_192431

SEQ ID NO: 29627 - DNA, 3000 bp, Unknown; identical to SEQ ID NO: 9729
  misc_feature (1)..( 3000): 2750-1469P.txt file - cDNA_ID_3019747; gDNA_ID_2684236; Annot_ID_192428

SEQ ID NO: 29628 - DNA, 3000 bp, Unknown; identical to SEQ ID NO: 9729
  misc_feature (1)..( 3000): 2750-1469P.txt file - cDNA_ID_3019747; gDNA_ID_2684236; Annot_ID_137718

SEQ ID NO: 29629 - DNA, 3000 bp, Unknown
  misc_feature (1)..( 3000): 2750-1469P.txt file - cDNA_ID_3019759; gDNA_ID_2684236; Annot_ID_192421
agatggactcactccaagtgctgtgttttctcagatcatgaatccaaagggacgttagagaagtcttataacacggtacaacactactacctttctaaaccggctccatccaaaggagaccggttcgtttctcttttttatattttttttcctcttaactatttattattattctctttgctgttatttatttagaattttggatttgtgtatttgatgccacgatggagagtgtaaaaaataatgtatttttttttcttctttctacaaaaacattaaacatgaatcgcgtcaatgtactatttggtttgttatctataacgtttttggtaattgttgcatctttactctattacacgtcgtactcttatgaacaaactagtacccatttattacaaagtcgtactcttatgaacataaacggaagtacatcaatcacttctctgttttactatatagacgcattttaacggaatcctaccaatagtgtcttttcttgcaaatattttgatttaaacaagaagggtcaaagttgtatatttctgctgatcaatacaaacaaacactttgaaagaaaaaaacaacgagtagaagaactatgtgtaatgtttttctcttgattgcataagaatttaaaaagagtgaaacaggattatttttccaagcagctctcttgtttttaactacaacaaacaggaaagaaaactcaaaaggagtcagagtctcagagaggagagaatagatcaggaggagagtcaaaagcattgtcgaagatgagagattgaggagattcatcatcaatgttaagtagccagtttgtatccttgacatctttaacattcaagagtgcgtcgtaacgagcactatcgttcttgttctctgtgttgttcccttctttcgttaagcttcttccatcttcctcttcatggttgctgctgctgcagctgccttcactactaccacacggttttcttagacccgaagaagaagatctgatgctgtgtggatacaacattgggcttgaaaacgtatgtgtactaactttaccatttcgtgccaagtcctgcatttgaagtgacactattatcgtcaagcaaaacctcataaaaaacgttactatactattgaccacgataaacgttataaatgacaaaaatatttagctataatcaaataatgacaagagaacgttattaccaagtgattgatagccatttgaacagaagctcttgacaacttccttcctggcctagttgaatcggcaacagtggcagatggctttatagacttgggagttgttgttgtatgtgaggtgcctgaaaaagtcggaatcagagaaggagaagcagagcgtcctttaggcctcgttcttgtaacatccggtgaggtgtttcgttttggcgagttaacatgacccactggtctaccaaacgctagagtgactgtttcttttagtcttggcggtgtccgaggtgttgctgaaactgttgtgcttctatcaggacgtgatgttacagacgaagaacgcacattggtcctactacttgcatttgctgcaatctgaggctttgctcttggagtcaacgatcttgatctttgagcatctccagctgttttgaaggaaggagtggttgaagtagttgtactgattcttgaaggagttgaggttggtgatggtgttttgcgtgatgagggagtcaaagatcgagagacagttctttttggagaagaaaccgaagctgaagcttgaatttgtgttgttgttgtcttcttggggaccgaagaggatctgatagtgggaatgttggagggacgaattgttgaaccgcttctcgttggtcttgaagatggatcactctcgctctacatgaaaaaatataaaaatattacatgagcatatatgatacatgaaattatagcgagcttgttgcatcatacccttaaaggaacccttgtagtggttatggactgaagcttggaagttgtgtttctagcttctagaaccaatctagaaagatctcctaatggaacttctgcaatggtataaagcctaaggaacaaagattataaattataataacttgtttgcattgtctatttcaggtttattattgcgtataaattcaaatgagggattacataaattcttacggttcatttgcatgtatattgtgattattgtcatcatcaggtccatgcttagcaactttagcttgttggaaagaatgtcttcctggtttaatcaaaactgcataccatatagatcaacatgctagatcacattaatatggatgacttattggaagacgaattattgtatacaaagattggcaaaaaaaactagcaaattgaaatgagaatagcatgaaagcgatcttagaatgcaaaacgtgatagcaatctaaacacaactggaagaacaataacaatgtgtgttggtgtagaaaagcaaaagataagtcaaatggaccaaataatagatgatgataccatccaaagaagttccacggttgactgagaagagatccaaattctcatccgcctggcgattgcttttaccggggagagactttttcagactccgatcactcatcgacggtttaaaaacacacgatcaaagaacagggaaataaaacagaagtcatataaagacaaaagagagatagagatagagaatgtttcaaaatttggttaaataaaataaaacaaaggcattttccattcccgtgtggttttggttttcatgtcattttcttccattttttataaagcatgagaggaagataatgtgaacatagaaacttaagattagctgattatattatgacgtgtaaatagacgtgtcacaatatatgctgcacggaaataaagtagttatctacatgtgtgtgttacatttatttgataatctaatttattcggtttgctttgattcggccaatttctgtttaccaatttttcaaaaatacaactataccgcggatttatttcacaaagatg

SEQ ID NO: 29630 - DNA, 3003 bp, Unknown; identical to SEQ ID NO: 27300
  misc_feature (1)..( 3003): 2750-1469P.txt file - cDNA_ID_3019763; gDNA_ID_2684236; Annot_ID_192416

SEQ ID NO: 29631 - DNA, 3003 bp, Unknown; identical to SEQ ID NO: 27301
  misc_feature (1)..( 3003): 2750-1469P.txt file - cDNA_ID_3019767; gDNA_ID_2684236; Annot_ID_192414

SEQ ID NO: 29632 - DNA, 3003 bp, Unknown; identical to SEQ ID NO: 27305
  misc_feature (1)..( 3003): 2750-1469P.txt file - cDNA_ID_3019771; gDNA_ID_2684236; Annot_ID_192412

SEQ ID NO: 29633 - DNA, 3003 bp, Unknown
  misc_feature (1)..( 3003): 2750-1469P.txt file - cDNA_ID_3019774; gDNA_ID_2684236; Annot_ID_192408
acagaggaggagacaaagaagtataggttcacattgcatagccagtttagttttgaaggatggatatatgaaaaaaatatgaagagagagaagagagaagaagaggaggattaaagagggtgaggccagcttttgtgctttggtagtagatgaggtttaaatgctccataccttccatttccttctctcttaccctaatttaattcttcctctcctttataactccccacagacattctcacttctcctcctcacacttcacatcaacacttctttcttgttttttcattttacaatgtttcctttgatatccgcactttaagcatgagagagtccctttgatattggcctggttcactcagatcttacctgaccacacacgtagatatacattattctctctagattatctgattgagccgcgccaatatctcagtactctctcgtctctattttggactttgtggtcttgtagatcgatttgtatgtgtgtgttgaaatggagacaagtacttgtaacttctttgttgttatattgtttacctataggctgatgtcataaactcttttgatcttgtttctaacttccagattcttgaaaaatcaagtcgtgtgtgtgtctccatggaagccttttccatttcttcttttccaaggtatccccttaatcagcttccttgccaagtataaatctgttgtagggttttgcttcaaataatctatatggatccttttagaatgcatattgtgttgataccaattttgagacagaatgtgtcagcgaaactgatcttgtttattagtacaaatgcaggatgttagagagttagctaataacatatacaacaaaatcacaaaaccggtgaagcaatgtaaaatgtcacaatcacaagatgtttttttcaaaaacaggggaaaaagcagagttaatgagagagaagctgacgagcacgaaccctaacctgcaagcgagcaagagcatgcatacaatgtaaagcaattcgtgcttgtctcctcacaagcactcctctagccaccgcctgtaacttcaccagactcttcaatgctttaaacgctcttcttgcctgcaaaacactttaatggttttaccaattttgttttttcaggttttcaaaatctacagagatagaaaatgtaaattaccaggtgccctctgaaaaaggcttggattttaacggcggcaatctcttctcgagttgtttctggagctgaagagcgaatgattgtgattctgctttgagatcgtcggagaagtttccttcttacaacaccaaacaaacgtttggagttggccatgtttatgggtggatcttgtcttcttttggttttggttttggttttaaaagaggacgtctaaggaaacgtaaaatgtgaataaaaagtgaagacggtggctttaagggatatatggaacatgatgtgctctcctcatttctaactaacgaacgtgctcgcatgctcctctctttacacttggtttcgttttgtttattagtagttttcaagacacacgagtctttggtcttttttacatttagttattgaattatagttatgttatgcctaactcaataaaaagaagcttattgagattttgaaaaggttattataaagggtgattgttgcatttcaatgctcaaaattaccatgttatgatatatcttataatcacatgtgaaatctacactatttttaaaatttatgatttagacaattttttcgaaaatgtcactctatttttcaacaagaaaataaaattaggtcattggtattgtggtttgtaatatactaatgacccccactacaatcctaccgacaaagcgtccactctttgtaatgaagttctttgatcatttctctattcaatcttgacactatgaatgtaatcgcgcagcggaagaatggttcatcatactcttacactgttacacaggtccagccctgaactaaagtgtttgtgtttttgtatcggatatgattagcaattgtgcatcaagttagttacggtctcttctcaaatccagtaaaccaaaaaatatataaaaaaatcatactctataataaacttacatcaaatgtcctttttttaacgtttatgttgggagtacgtagtgagatttttcagatatgataaatgtttatgtttgaagttctattttgagtatcatcattttacacgtctcctatcttttcttcaatcaataaagcctttgagcccacaacttcgtaataccgttaaacccaattgttattgggcatgaaaacaaggcccaactcaagtctatctcccccacttgttcatcttctattgtcttgttgcgagtttgcgacttaaacagtaattaaattactaattacgcaataatggcggattaatcgaacctactctctctctctctctctctctctctctctctctctctctctctctctctctctctctctctcgtgcatctccataaactatcttcaaagattaaattttgaagatcttctttttggcttattacccgattctgtcactgtctcttcttcttctccaatcccaatgtttgcttgagagaaagagagagagtcaaaccaaaacatgggcgtttgttgccctttccttcaaccctgggatcgagctcgtgatcaatgtctcctcaacctcccttgtctctccgatcctggtaccaatttcctctctttttaccctaatctatctcacgatccggtgtttcattaggttcttatgattctgtatctaattgctatcttcttcatctacccagttcgaagatcttctctacttctgaaattggcactagtagctctccacctcgtctttatcggctttctcttccttttcgatgctgaatttattgagaaaactaaacgagatccatggttattactccttatctctctctgcttattcaattactgtatccttgagcttaatgttgattactctgtgattctttctctgataggtatatg

SEQ ID NO: 29634 - DNA, 3000 bp, Unknown
  misc_feature (1)..( 3000): 2750-1469P.txt file - cDNA_ID_3019837; gDNA_ID_2684237; Annot_ID_192452
cgtcgtggataagaggcttggataggcggcggtgggcggcggaggagtcgtcatataggaggttaaagttgttgatgagaagaatggatggacggttgggatcgtcggaggtggcaccggacggagatgaagagggcttggtgagatttgatgggaagcaaagatggaagtttttccacatgactcttggcattgtttttgtttttgtgagaaagagagtgagagaatatgtattgagcatgtggatttagctaggttgtcttaatttgttttgatactattattgtatcatgcttgtatttatatgtacaaatatttatattatatacgtaccaccatgtatttgtataatgtattatatttacacaatgcatcgtgctttgctgtgaatcttaagaccaaaataattttaattcttatttttacttattttgtttgtataatatacagatctacaaaagtatcttattattaacggtcatcttagttttttgtctgttcgtttgaaggttttaagttataccaactttcagtaattcatacacttttttttttatagatttgttttcttgaaaatggttatatatcacttaaaactaaatttttaacatatttgatataaaattcatatttattgttgacaatgaaaatttctattttattattaatatacaatcttgataaaataaattaaaatattaatatcttaaatgtgaattagaaatttcaattaattaaatacaataagagggtaatttacgagtttttgtcgtatatagtataaggtaaaatgactcaaaaagcaaatcttgatggtaatcgaaactttaaacatgaaaaagcgcctacgcgtaaagtatttgttttttttcttagatttgatagaagggaaataaggttatatacggacatgcaaatatttatatgttttctccattatcaacatatacaaattatatgagtaaacttcaacaatataatccaaaattgtactgtttatctttatattttcacgctttttttttcttaatgtcataggcaaaaattctgcggggagagcaaaacctttattgtttagtaaataattttcttcaattcatttacgaactctagacataataaataaattaacgccaaataagaggaattattgtccttgcaaatatatacagcaagaactcacgaggaggcaatgtttggactaacctaaactggccatctcatgactcaaagacgaaagatcgatgtttgtgcaaagtacactgactcacttcacttctcattgatcaatcttaactaatatttgttctcttccctttttcagtttatcttagaccattgtttctcctagcaacaaattcaccgaatgatcatgtcgcgattagttttgggataaaatcataaaattgcttctcatcaagaattgctccgcaaaatcaatgttcaagcagattactagaccaaaatttatgatcgagtagtccgaatataatcttttgcatttaaagcctctaaaatttacaaatatctaaccaatgttacaacatggcatgtacctagtacaagctactaggttacaacttcagagcgaagaattaaaaaatgagaatcctatattaatgaatattctcgcttgagaaatctatgcatgacaactttctatcatcaacaataataattagatttgatcaatctctgtcgacgagaacccgccaaaagtggtgactgagagacatgtcacacaacatcgccctatttatacgtagaaatatcgatctatatatatatatatactagatcgacaataatatggtaagtttttttattttaaatatggtaagtaataaatgcttgtaatacgaaaggcctttatgctctactcattgtttggtgtataaaaaaaaaatggaatcaaggtgtcagatatgatggtacagcaatttttagccccacacgttgtcatttttctttggaaggtacattgagatcaatttctatttttgtattattttgaaatcatcatatagtttcattggatttatcacaagaggaatcttataaaaatgcgaatgggtatatctatctctctttcaatatctatgtcacacaagtgttgttgctatattgtagggacatgtcaaaacttgtcgacaaaagctccatgaatgggaaacattgacatcaagatacaaaatcacatgattcttcaacttgtgaaagttttcgagtgtgaacatcagactcacataaaactccattgtagatatctcttgtcataagacactgtcacattcaatatcgttttcaaactctccaaaatactgcctgattgcaatgttacaattttgtcatggacccaccaatccctgtgaaccaagccggttactgtttattactccgacccgacccgggctttttaaagataggcccaagaaggcccaatgattgaaatgtgaaatgtttgatacattgatgtttttgatcttcgctcaaaccctacaataaaactttggttcctccgaatttcgagttcttgttcttcccaaggcccctacttcggccctagcatcaaccattgtcgttttaaagctccaggttttcatggccaagaaagaagtaactatcgttgagatcttctgaaattaatcagtcttgaagtctctggagattgtacgtttctcttcttcctttcctcgtcggttttaatggattccgtttgcctgatttgcagtttctgcttcaccgtgaaatcgaaactcgttttgctcttaaacaaatattatgcatgcgtttcaatttgggtctttttcttgacaatattggttctgtttggattaagaaattgaaaattagttttgtagctgagccttttctcttgtgtgtataggaactgagctatatcagtagtgtatctagcatatttgattaatgttccttcatgttgttcttattgaagctgcttccattggttttgtgattgagtgcaggtcttataacatg

SEQ ID NO: 29635 - DNA, 3003 bp, Unknown
  misc_feature (1)..( 3003): 2750-1469P.txt file - cDNA_ID_3019855; gDNA_ID_2684238; Annot_ID_192504
agctgagaacaatgaagagaagaggagaagaagaagtgtttggaaacggcctggagctccatcggatcacgaagcccatctcggcccattatcactctatgggtcgggcgattaggttactggcccgtctattatcatttaatttcgttttgtataaataggtgtctgggagttttgtcctgagacatctagtcgacattgattgatcatctttatatttttaatatgtctaatttgaaaaccattttggttttattcgccaactttatgataacgatttttaatttagttttcatataagtataccaagagttattgatatgtaatatatttttcattcaaataattttgagttattactatatgatattgaaagtttttaatcaataattttagtagtaagaaaacaatataacagtgaaaataaccaaaaaataaatttacttttaaaagataatttacacttacaattttgttaagtattatttttggtaaatttgattttagttataagaatataaatcgatccatcggacgggtccttatctagtaaacacataaactgttttcttcaaaagaaaataaagagttttaagcataattataagacataagcagaagtgtaggagaataagaggatcttaggcagcaatggtagagccacaagattgacgtctaagcatccaagtcattctcaaatttgaggtctccaacaacaagaacatctatctgcactctttgttcataaataaatccatcgcaaacatgtaaagatcactacctttctcaacctcttccatggagttcaaacacttcatgcattccctaaccaatgcacttgatggaatcttctccaccacctcgatattgatcctttgacatggcgcaggagttacagttttcacatcttgtgactcttcaacaccaacaccgttaaataccacgtaatgcagagtaggctcaagattgtcatcatcatcagctccaccttcaatccatgtgactagctcgtttaggtctagtgttaatcaaatatattttcctatgaatatttcttcttttttagaagataagaagattaacaaataaaaataataatataagtttaatatatttcatatattattttccaaaaatttacatttctatttttcatatattgtttttttcctttttacaaatatctttgtacataaaataataataaaaattaaaatattaattaatgagatgactaaaatattcaatgtgattgctaactttaattggtcgttttaaatcccatgtagacggccttaaaagctcatcacttcgacttttataattaaagttggaataagaaatttttgtaagactaataatgatgtttttataataaatatcctattttctaaagtaataaaatttacaaataaatttacattttgttattttcatttttatgaatttcataacaaaattatattcagaattatttcatatttttagatttttggtttataaatttaataatctttacaatattaaaactttacatttgattacttttatattacatttttaataacacaacatcatagttagaaatgtatccatatttcaaatatttcttttattgtctttttttttttttaattttttacaaaaaattaagagattatttttagacgtcttacgttttttttttttttacatatgtttttctttaaaaatttacattttttcatatctattggtatttttgctttttaaaagtatcttaattaagtaatttataacttttaaaatgtcagttgatgcaatggctaatccggattggtagttttaaatctcatgacagcctaaggagcttataggctcgacttttaaaccatacataatgaatctatgaaagtaatgattatcgagctaaacgtattttatatatctagatgccttctatgatattgaacttctttctatttaggtcatgaggattactcctttcacgctgcaagtaacaacaaaactcaagaaatcaaagaagtgaagaacaaagagaaaaatgaaatttgtatcataaaactgatcaatgtgtaaatttcacatataaactacaattcaagtaaggaaacgattgttaagcttgcgaaattttaatcaaatccaaaagcagtccatgcaaatcaaagacgaattgtaatggtataacacatttgctaaacacacttgcaaaagctcatcttccatccatggcaagctttccaatgctcatactaaaaaaaattggcattgtatagtcataagtgtaacacccgtaaatagaaaaatcggttagggtttatacttaaatcgtccggtttaatcggttgggttaattggaaatcctagagtgtgcctataaaagaaagaaactcaaaattagggctttagttagccacttttcgttttataaaagagaaaaatagagagaaagagaagaaccagaatcattagggtttgggaggaaacggttgcgacatatcaaatcgttttcaaaggtaacgaaatttagtagagttattcccaagtattttatcgatattctccagtttacagaagtggatttggattataattggttgagttattcgcagtttcgtgagacacgttttctcagacgcgaattaggaccagcaaggattgtaactaacatcgtaatatcatctggtttccgatcggcacgagttttcgtgagaagctttgtaacgtctaaagctagcgtttcaccagagggatttaatagttaacgactggtttgtagtttagggttttgtctttgagactgtttgtttctgtttttcatgtccagtttgcttcaaggttgcttttggttgtgatttattgtaggacgtttctggactgtttcagacgcaagaaatgtctctcctgggtttaattgttgttagaatcaatttgttaaggtgaatgcgtgaccatgagcttatctaagcgatcggattgtgtgatttgttttgtgtgatg

SEQ ID NO: 29636 - DNA, 3003 bp, Unknown
  misc_feature (1)..( 3003): 2750-1469P.txt file - cDNA_ID_3019948; gDNA_ID_2684239; Annot_ID_192534
aaacaccaactggaagaagcatagttcttcgagagcaatacgatagcgatccttgattctctaatcgcttccgtgagagctggggcgatgatttggcttctctcgatcctttgatcatcgaacattgtaattccattgtagttaaattgtttgcgtaaatgactgagaaatgttttgcggacgtctggtccatggaaactcgtgaagacattgtatctccaggtgcgacgtgaagaagaagaagaagaagaagccatgagaggttcaaaatcacagattcccagagagcgtgaaatgtttctttggaacgtaaacgaaagtagagaagaaaaattcaaagtcaacgtgacttcgaagaaatgggaatgtgggctccggtaataatgcaaacgcgcaatggaaggtttcttgttgggaagattaatgcatgctatgtgacatatgtgtaaaacagatttatcgttagaaaaaaaaaaaaaaaaacagattttaatctatttagaaatacagctcacaagtggtgaactcgtaaacaccaagttctcttttcaatctcttctttcaccttggctcggtgtgaagaggtgattcagtttcttacaacgagctcaaattcttgtgattcacgtgttgtttctaggttgatattttgaatttgcgttatcaaaactgaacacagagtcacatagaagttctcattatatactgtctagctattgttgatatatatggaatatggttacatgcacaattgatggctcagatgatatatattagagatgggcttatttacttgtacattaggtcaagcctaatatttaaagttttagaagaagattattaagaacacaaaaatttaagaataactctcatattagatatcaaatctaatatgtttattgtgactggtcatttttttctaaaatttataagggtgatttgcatgaataacactttttgagagaaaaattaagaatatagcactatatatgtaattattaagtaattaacttaaggggtaggtaaaatgatctaaggtggtggtggtggtggttccagcgacgatggcggtggtggttccggcgacggcggcgacggtgattccggcgacggcggcggtagtgattccggcggtggtgattccggtggaggtggttgtccggcgatggtggtagttccggcggcggcggttgtccggcgatggtgcggtggttgtccggcaacggcggcggtggttgtccggcgatggtgacggtggttgtccggcgatggtgacggtggttgtccggcggtggcggcgcggttttccggcaacggcggtggttgccggcgatggtcgttatggtggtgattccggcggcggcggttttccggcgacggtggttgtggttgtccggcgacggcggtggttgtccggcgacggaggtggttggccggcggtggaggtggttggccggcggcggtggttagccgccggcggtggttgtagtggtggttaatggtgttagtagtggggataaaactgtaataatatatattacatatgttatattgttaggttgtttttattggttagtttgttaatttataaaaattttaaggttatatctgcaaattatccaattaataatgtatttttgtttttataatttaattaaagttgtatattatttttggaaagatatctttttgttaatttcttttttataagatgaaaataacttggtaattcgatttgaatacgaaagtaacggtatattgaaattagtgacacccatacccgatccaaacctgatgggtggttatccgaatccgatccgagatctataaatatccgaacggatcctatacgtctacacccgaatatccaaaaacctaaaatatccgaaccgaattcgaatgggtatccgaacatccatgcctatttgttacttttgatattttattgacgtttagaagaaaaagaaatattagtagaactggaatttggtaatttgattaggagaaggaaatagtggtattcaattgtaaaaatataaaatcttacatttttaaataaggaattttagtagactcgtaaattgactatataacacttctttttccaaaggcattgtaacgtaatatcttacaaaaaccaagattgtttttaattaggtacttccctaacattaatatagagatttaagaaaaatcaaaaactgccagttaaattcaaaacatatcaacatatcaaaatgtctagagtttctttttgtatattatatgggtcgagacataagatatccagcatgccatcttatgtgtgtacgccgtttgccaaataatcaacctagacaacacttgaatcaaaagaaaatcacataatcgcaccgagtaaggacgaatgaagaggttgagaacagaggttggtgtttatgataatgagttctatcaagatagcttccacgcatgcattaatcttcctaacattttgttaaaaactttcccaaggaaaaaaacattttcgaaccatttaggaagttaagaatataatacctaatatggttgtggtttactctgtaaatgacaaaaattcttcaaaatctcttcgcaatttcttctctcaaaccccacttgttttctaaaaccacatttaactcttctgaaatttcttttactttgcaaagaaacttcacatccatgtctctcttaacaagtgaactcagctttgctagctattttctcgtccgcataatggtaaaagaatgatcctaaacacatctggccaagaatggacagtatatatacaaattgttatgtacgcttcattatgacttttcttttctttctttttgtttttctccatattcgtttgtaataatacatttaaactttcgaaatttctttaactttgcaaagaaacttcccatttctctctctctattaagtgaacactattttcccattcttatccaagactcaaaatctgtgattttgaaccactcaagatcatctctcatg

SEQ ID NO: 29637 - DNA, 3000 bp, Unknown
  misc_feature (1)..( 3000): 2750-1469P.txt file - cDNA_ID_3019955; gDNA_ID_2684239; Annot_ID_192532
tccaaagaccaactggaagaagcatagttcttcgagagcaataagatcgcgatcctcgattctccaatggcttttttgagagctggagcgataatttggcttctttcgatcccgttgtcatcgaacatagtaattccattgtaaataaactgttgacgtaaatgactgagaaatttaatacggacgtctggtccatggaagctcgtgaagacattgtatctccagttgcgaggtgaggaagaagaagaagccatgagagatgatcttgagtggttcaaaatcacagattttgagtcttggataagaatgggaaaatagtgttcacttaatagagagagagaaatgggaagtttctttgcaaagttaaagaaatttcgaaagtttaaatgtattattacaaacgaatatggagaaaaacaaaaagaaagaaaagaaaagtcataatgaagcgtacataacaatttgtatatatactgtccattcttggccagatgtgtttaggatcattcttttaccattatgcggacgagaaaatagctagcaaagctgagttcacttgttaagagagacatggatgtgaagtttctttgcaaagtaaaagaaatttcagaagagttaaatgtggttttagaaaacaagtggggtttgagagaagaaattgcgaagagattttgaagaatttttgtcatttacagagtaaaccacaaccatattaggtattatattcttaacttcctaaatggttcgaaaatgtttttttccttgggaaagtttttaacaaaatgttaggaagattaatgcatgcgtggaagctatcttgatagaactcattatcataaacaccaacctctgttctcaacctcttcattcgtccttactcggtgcgattatgtgattttcttttgattcaagtgttgtctaggttgattatttggcaaacggcgtacacacataagatggcatgctggatatcttatgtctcgacccatataatatacaaaaagaaactctagacattttgatatgttgatatgttttgaatttaactggcagtttttgatttttcttaaatctctatattaatgttagggaagtacctaattaaaaacaatcttggtttttgtaagatattacgttacaatgcctttggaaaaagaagtgttatatagtcaatttacgagtctactaaaattccttatttaaaaatgtaagattttatatttttacaattgaataccactatttccttctcctaatcaaattaccaaattccagttctactaatatttctttttcttctaaacgtcaataaaatatcaaaagtaacaaataggcatggatgttcggatacccattcgaattcggttcggatattttaggtttttggatattcgggtgtagacgtataggatccgttcggatatttatagatctcggatcggattcggataaccacccatcaggtttggatcgggtatgggtgtcactaatttcaatataccgttactttcgtattcaaatcgaattaccaagttattttcatcttataaaaaagaaattaacaaaaagatatctttccaaaaataatatacaactttaattaaattataaaaacaaaaatacattattaattggataatttgcagatataaccttaaaatttttataaattaacaaactaaccaataaaaacaacctaacaatataacatatgtaatatatattattacagttttatccccactactaacaccattaaccaccactacaaccaccgccggcggctaaccaccgccgccggccaaccacctccaccgccggccaaccacctccgtcgccggacaaccaccgccgtcgccggacaaccacaaccaccgtcgccggaaaaccgccgccgccggaatcaccaccataacgaccatcgccggcaaccaccgccgttgccggaaaaccgcgccgccaccgccggacaaccaccgtcaccatcgccggacaaccaccgtcaccatcgccggacaaccaccgccgccgttgccggacaaccaccgcaccatcgccggacaaccgccgccgccggaactaccaccatcgccggacaaccacctccaccggaatcaccaccgccggaatcactaccgccgccgtcgccggaatcaccgtcgccgccgtcgccggaaccaccaccgccatcgtcgctggaaccaccaccaccaccaccttagatcattttacctaccccttaagttaattacttaataattacatatatagtgctatattcttaatttttctctcaaaaagtgttattcatgcaaatcacccttataaattttagaaaaaaatgaccagtcacaataaacatattagatttgatatctaatatgagagttattcttaaatttttgtgttcttaataatcttcttctaaaactttaaatattaggcttgacctaatgtacaagtaaataagcccatctctaatatatatcatctgagccatcaattgtgcatgtaaccatattccatatatatcaacaatagctagacagtatataatgagaacttctatgtgactctgtgttcagttttgataacgcaaattcaaaatatcaacctagaaacaacacgtgaatcacaagaatttgagctcgttgtaagaaactgaatcacctcttcacaccgagccaaggtgaaagaagagattgaaaagagaacttggtgtttacgagttcaccacttgtgagctgtatttctaaatagattaaaatctgtttttttttttttttttctaacgataaatctgttttacacatatgtcacatagcatgcattaatcttcccaacaagaaaccttccattgcgcgtttgcattattaccggagcccacattcccatttcttcgaagtcacgttgactttgaatttttcttctctactttcgtttacgttccaaagaaacatttcacgctctctgggaatctgtgattttgaacctctcatg

SEQ ID NO: 29638 - DNA, 3003 bp, Unknown
  misc_feature (1)..( 3003): 2750-1469P.txt file - cDNA_ID_3019959; gDNA_ID_2684239; Annot_ID_192531
taattatgtcgtgattgatatgtaaaattaaaaatttacatactatcccatgcacgtatgcatgggtttaagtaaaactttttaaagtgtaagataaattagattttttttaaaattattgttgatatttaatcaatattttggttttggggacttttttagtttttaggcttataaataatagtgttcaatgtcaattataataatttaatatggacgttttggtatatatatatatttttttttcagctcagattcgtatttaatcaactacgtaaaaataactaatcaaagacacaaactcaagtatcgatctccggttcggtatgcttgtccgacctctctggttacatgcgttgaaactcatcccctaagatttgacgttttcaaaactaaaaagactcattatcatcacagctgactagtattagcacatatcctcaacaacgtttgacatgttcattacgtctatacattcattctccttcttactcaaaaatatgtaccaataataatacgaattttgttaatttgacatagatccaattctttgatttctttaattatttaattttaacttcaaactttccaggctctaccattcctccatgatggttttctcttcaaagttttgataagcataacctcttcaatagggaaaagtacccagagacaataatacctcgaattgtgtttcagtcagatcatattccaaatagctcctcagctcacatggcaaggtatcttcataatcgggaaaggtaatgattgaccggtgttgtggttaaatagctatccgttaaccaataagacagacgaagctgttgataggatataagatttcatattggacttggggaattttgcaagatgactagcagacgaatatatattaagtcttaaaacttttgcatgtttattattgaaggaaataccgatacatttgattagattaattcatcttggacacatatttatcttttaaacatttatatgacagcaacatgcgtagatcttatcacatacgccaaaatcatatttgtttggcaagcttctacaaaaggtagtgcacttgtcgttcccaccaccacgaggacaatattcaaatcctccctcgcaagccacggagtcaaataacattccataacctgtttataattaaacaataaatcattaaaccaatatgcacattaattaattatatcaacaaaatcaaattaaacccataattaaaaagtgaggtataaaaataaagcagcacctgaagttgttgtacgactgtgaacaaaagatatgatgaaaaagatagtgaaaacaaatgccactaaagttctcatggttatggccatttttatgatatttgttcttaagattggtttaatgaatttttctagcttagatgactgattatatatataacacaaacatatgtaaaaaggtaatttttctggtaaaaaataaaaaggaacatgaactttcaatttatttccttatagatatatagtcaaaagaaaatattgtagaattgatttcttacgaaattagtcggtcaatgaccaaaatatattcaatgaatatttcagtagacaaatataatgttcgatggaagaaaaacaattcgaaatattgaaagtgatacatattaaatggttcagtttgaggttgctagagacatctataaatcttggtttctcaaaattagtcattaacataatcacaacatatgttaaacttaaattataacattatatactgtcatttctcaagtctacatttgttaataaatttggcagaaaacacataattacgttttggcgtagaatctctctataaaatagctattgccgtaaaatctcttatatatatgttcactttagctgtagatctttttgctagctttgttggttgtgacttagctattttatccaaaaaagaactatgttagttgtagatgtagatgttatttttttcctttaaatttcaaaattttttaaaaaatatatgattaagagagattaaggattaactgtatatgtaaaaattgttatatatatatatatattttttttttgcatttcatttattaccataaaagttttctcttttaaaggatttttacaaaaactaacatttacaatcccatacgacatttttttgtcagtgtcgtacaactaaaaagtcatttcggaaaaccgatccaaaacttgaagatgatgcatgtacagatgtactcatcaagaacttgtattcgacatctggatcaatactgcaagatgatcaagaaatatggttctgtcaatctgcacgagtgataccaaaaaaaaaagaaaaaaaaacaaagttttgcagtaagattttgacttgaagttaattaaaaaaattaaataatgaactctagtgttacttgtttctttattttgtaataagaatctaattgggttaaataatgaactctaatgttatctttttcattattttgtaataagagtctaattgggatgttgatcttactgccaaggtccgagaggcgttccacaaagaggaggcaaaccactactccccatccatgatcaacgagtggagcagttatgggtcaaatgaaataagctaaatggcgcaaacgaagatatttttgaaagttttaaaatggatatttccgatgcattaaataatgcgggttccgatgagttgtaaaagaaatcggaaaactgattattgtaacattttttttttgtatcaaattgtaatgctttatgattcgatctacacaacataaaacatgataactaattctgaccaaacacatatataataatgtaggttacctcttcacgttgttatagtttaaacaaaacaataacgtagattgagtatctctacacgttgtcattcctgaagagtgtcgttgactttttagttttttgttcttttcctcatattttccaatttttgaatccgatcaaacaacttgtgaaaacttttctttccaaatttgtttccatg

SEQ ID NO: 29639 - DNA, 3000 bp, Unknown
  misc_feature (1)..( 3000): 2750-1469P.txt file - cDNA_ID_3019966; gDNA_ID_2684239; Annot_ID_192529
gttcatgttcctttttattttttaccagaaaaattacctttttacatatgtttgtgttatatatataatcagtcatctaagctagaaaaattcattaaaccaatcttaagaacaaatatcataaaaatggccataaccatgagaactttagtggcatttgttttcactatctttttcatcatatcttttgttcacagtcgtacaacaacttcaggtgctgctttatttttatacctcactttttaattatgggtttaatttgattttgttgatataattaattaatgtgcatattggtttaatgatttattgtttaattataaacaggttatggaatgttatttgactccgtggcttgcgagggaggatttgaatattgtcctcgtggtggtgggaacgacaagtgcactaccttttgtagaagcttgccaaacaaatatgattttggcgtatgtgataagatctacgcatgttgctgtcatataaatgtttaaaagataaatatgtgtccaagatgaattaatctaatcaaatgtatcggtatttccttcaataataaacatgcaaaagttttaagacttaatatatattcgtctgctagtcatcttgcaaaattccccaagtccaatatgaaatcttatatcctatcaacagcttcgtctgtcttattggttaacggatagctatttaaccacaacaccggtcaatcattacctttcccgattatgaagataccttgccatgtgagctgaggagctatttggaatatgatctgactgaaacacaattcgaggtattattgtctctgggtacttttccctattgaagaggttatgcttatcaaaactttgaagagaaaaccatcatggaggaatggtagagcctggaaagtttgaagttaaaattaaataattaaagaaatcaaagaattggatctatgtcaaattaacaaaattcgtattattattggtacatatttttgagtaagaaggagaatgaatgtatagacgtaatgaacatgtcaaacgttgttgaggatatgtgctaatactagtcagctgtgatgataatgagtctttttagttttgaaaacgtcaaatcttaggggatgagtttcaacgcatgtaaccagagaggtcggacaagcataccgaaccggagatcgatacttgagtttgtgtctttgattagttatttttacgtagttgattaaatacgaatctgagctgaaaaaaaaatatatatatataccaaaacgtccatattaaattattataattgacattgaacactattatttataagcctaaaaactaaaaaagtccccaaaaccaaaatattgattaaatatcaacaataattttaaaaaaaatctaatttatcttacactttaaaaagttttacttaaacccatgcatacgtgcatgggatagtatgtaaatttttaattttacatatcaatcacgacataattacgtaacttacatacggaattttaatttcttaaaacagatccaatatgtaatcatggatctttgcttactcctgaatcctttcttagaatcgacttcaatggtttcaaagacataacctcatgctcatcgaaggaactaaaacttcctttcgatgtcctcctcttgattctccttgaacttattcgtatctcatcaacttcatcctttatgctcacaatttttcttggagccttttctttttgtacacttaactctactagttctcgatcgactgataatgtttccttttcttccatgttttctccaacattacatgtgttattagagccaatatcagaattttcttcctttgatacaactttaccaagtttctgtggttggccaagtgttactttcttcaaggcctgtgtggctaataatttcaccaagcaatcgtagaatcgtctccagatattgataggacattgaagttctcgttctgtgtttttctttttttgatcgactaaagagaaaagcatgttttggtttttggagtttatctttggctcaaaatgtaaggaaaacaaaaaacaagcagcaatataataatccatcgtcaatgatgaagatatggttaacttgtaagagtgggcgactttagggagaagaagaagatcaagaatcagcggaagaaattaaacaagtttggaataatttgatcctttcattatacttgaagatatatatatatatatatatatatatatatatatatatatataattgaatttatgttttaagttttatcattcgcttcactccatatgttgatgtatagcctaattttgatttggaacttacattattacttattgttaaacatcatttgacatcattgctgacgtcatagaagtccaacacttggccgacgtgaaccgccagttccgttgcaagagagagaaccacccaaatggccactggcgcagcgaccacgagcgtatctgtcaaatgtgcagccgtggcgactatcctttcatcattagttttcaactcttcactttttttttatcaagtggaaataataaatcattctctagggttataacacgagacacattcgtaagctacgttctagtgaattcacaactttttgggaagcataactcattgtgtctagggttatgttggttcattgaatctcagagttcatctgatcaacctttggatccttgaatgctaattatgccaatagttttcattttgtttcgtttgattgttgtttactccaaaataataatccaaatataagaccgcttttcctaaaaaggaaagaaattaatctgtcttcttccccaatcccgaaactttaaccttaaccccattattttcccaaattgaatatactcattcccaattttatctccttcttctccatcgcttaactgatctaatcccccaatttataaaaccctaactcttcattttgattcatttctccattctccagatttccgtttccctcttcgaattctcatctctaaccatg

SEQ ID NO: 29640 - DNA, 3003 bp, Unknown
  misc_feature (1)..( 3003): 2750-1469P.txt file - cDNA_ID_3019976; gDNA_ID_2684239; Annot_ID_192525
gttaggctcgtaaacgaacataccggcgttgaagtacaaaggcggcttaggaccaagcttggcctctggccatgtcaccttgtccggacactgttggcaataaccgatcttgtactgtggcgagtgactccatgtcttctcgcaaaaacagtccataactgcatagaattggccgtttggaagatcaaacaagtgatctatgttgtcgaacacttgtatgtcaccgtccaagtatatcatcttgttgtactccacgaactgcatccatatataattttattatatataagaaattaaagatataaaaataatcactataaggtctttttttatataaatatcaacttcttttggaacaaacaatgaagtacataataatattttggtcatatatagaatttactttgctagattttatattcttataaataaaaaacttaacaaacaatacatatttatatttgtacctcccagatacgaagcttagagtagttaatgacatagtaagccatagcaaactcggtttgattctccggtggataaaccggctctatctccttaacaacacagccttgatccaccaactgtttccggtgatcctccggtacatccggcaaaaccgccaccacgagtgggtacttgctcttagctttccttagccccttagcaagacccaccacccctttcacgtagtctccagttccagcaaggaaagtcacgtacgccctcttttctccgccggttgctgagtggaccggtacggtgagtttggtattgatctcaggtgccatcttctttgtcttttagaaaatacttctgtgtttgtgtttgtgtttgtttttgtttcgtttagtttgtgtgtagtgtgctgagtatgtgggtgatgcttaatggtgctttatataagattttgtcttaattaattaaaagattaatcgctaattactttggataattaaatacgaccgactactaaacgtttccagagaaagattttgatccaacggctattcaacaatatggtggaatctaacggtttaggatacgcgcgcgaagcttcgttttgaattaactatttacagtgggtcccagtataatccaggtgctgccacggcgttacataacgacacgtgtcagtatctagactgttcgactcatcaaggtttttaaatcgagctcgtggtggttgatcggtcatttttatgtgtttatcaatgggttccacttcagatatacgacgtcgtatggggtatttaatacactatattagtgtgggattttctgattggttattatgtggacacgtgtctacgtggaacgtagtaggcggtgatgatacacgtggacaaggaaaagtcttgttgggcccatttcccgtttggtctattttccatgtttaaatttctttcctatggtagtttgtctgaccgatgaccgaccgactatttacggcatatgtggacgttaaaatcatatatattttttaattgcatgactcaaaaactcataaggttatgtttcgttatttttatttttattttattttagtttgtttctgtcaagtaggtattacttatctgcattcaacaaaaaaaaaaatttgtgttaggttccataaaaaaaaaaaaatgtgtgtagttcctctcaatttgtattttttatagctattaaattaacttttaatctaacattttatcaattatacttttaaatttttcggaaaccaatcaagtctatgaaattactcacatctcgagttttatttttttttcttctagttttcttctttttttggtaattgataggtttcttaaagccaaataaatggattttttattaaataaatgaaaaagtccccattctacatttttataaaatttgccccgatgtaccatgcatccgcaagtggcgttcactacctttaattccccaagtaatttagaaaaaaaaaaaaaaaaaaaacggaaaagtgtcgttgtgatgtaaatttctcaatgggccgaccttgtttactatacggatgacaaaatcagaaaaataggataatgttagtttattatggctttatggagtagaagttagtgtaaggtcacttcaattccttcggttagtttttgtacaaactagtctatccacgactctgagtctttgactaattcttgagtgtagaatattctatggaatcttttttttccaactcgttgtgggatctaaaaaacgaaataggcgagtaatgtcaaatgtgtatgactcttgtaatatgttttttttgtaataataatcataatattctattgaaataaaataataacaaaaataataataactgctatataaaagtttaaagctttttcaataaataaataaataaaagtttaaagcataattgtgttttactcaaaacattcaattaaatttagtagaaggttttttatatatagtagtaaatttttatttttagtattttttcttgttattttatatgatattattatcaaggcatgtatattcaaaaaaaaaaattgtttcattaagacaacatattagatcaacttaactaactaaattgtaaagccacatatggatttggtcacgacatcgaataactatgtgcgtggttctagctagctaggatcaatctatttttcaggccattaaggtagtttataatttgtttcttttccaaaattccctttatcttttgaataattgttagcttattgatccttgaatttgctgtatttgtaaattttcaatgttttatcatcccatttttttagtcttggtttggttaactttttggtcgttttcagattgtttttatctcttgattcaagtatgtgttaatgttttaacttagatgacctaactgctcgcgaaatcccaattaaacactaatgggccgtaacgtgacgctgacactcaagatgacgttgatattaggcccatttgagtgaaaagaccttatcggcgataagctatactcatcgtgacgctgacatg

SEQ ID NO: 29641 - DNA, 3000 bp, Unknown
  misc_feature (1)..( 3000): 2750-1469P.txt file - cDNA_ID_3019980; gDNA_ID_2684239; Annot_ID_192524
tctgagtctgaggacagaaatggtttgaagattcactaacccagaatcggagatgagaaagatacattgaagcatctctaacctcgatgcgtgaatctgcaattgctcagctttcttctcttcttcgtcgattttgggatttggcttggaagtacaatactctgacccagtcagaggcttcgaatactctgacccagacagaaatgatgattttatcttggctcttgggctttatttctggcgaggcccaatgaatatcatgggccttctatagtttttaacgttagttttagtttttgtaactttggcttgctataggattgaattttcatcgtgttattacgtctccgatttgcgtacctcacgactgttttataaattataccggtatggtcgatctgagatcacttgtactggtgatgaattgatataggtgtttgataggtcccaatcaaaacataaaggaacaacacaataattttttagtttgtagtttttgactctctttttattttttggatttcattgattgaataagaaaacagaaacaaagattcaggacaggtcatccgtagacacaacttgtcacacaagaaagtaaatatctagaagaaaaatcatagaaggggaatattttcctattaataagcaacgagaaactttataacaaaaacaagactttttttttttggctgataacaaaaacaaaaacaagacttagttttcgctagtcgatgtaatgcgggtcactcttcacgtgaatgagcctagtattacgtacgttgcatgtcagcgtcacgatgagtatagcttatcgccgataaggtcttttcactcaaatgggcctaatatcaacgtcatcttgagtgtcagcgtcacgttacggcccattagtgtttaattgggatttcgcgagcagttaggtcatctaagttaaaacattaacacatacttgaatcaagagataaaaacaatctgaaaacgaccaaaaagttaaccaaaccaagactaaaaaaatgggatgataaaacattgaaaatttacaaatacagcaaattcaaggatcaataagctaacaattattcaaaagataaagggaattttggaaaagaaacaaattataaactaccttaatggcctgaaaaatagattgatcctagctagctagaaccacgcacatagttattcgatgtcgtgaccaaatccatatgtggctttacaatttagttagttaagttgatctaatatgttgtcttaatgaaacaatttttttttttgaatatacatgccttgataataatatcatataaaataacaagaaaaaatactaaaaataaaaatttactactatatataaaaaaccttctactaaatttaattgaatgttttgagtaaaacacaattatgctttaaacttttatttatttatttattgaaaaagctttaaacttttatatagcagttattattatttttgttattattttatttcaatagaatattatgattattattacaaaaaaaacatattacaagagtcatacacatttgacattactcgcctatttcgttttttagatcccacaacgagttggaaaaaaaagattccatagaatattctacactcaagaattagtcaaagactcagagtcgtggatagactagtttgtacaaaaactaaccgaaggaattgaagtgaccttacactaacttctactccataaagccataataaactaacattatcctatttttctgattttgtcatccgtatagtaaacaaggtcggcccattgagaaatttacatcacaacgacacttttccgttttttttttttttttttttctaaattacttggggaattaaaggtagtgaacgccacttgcggatgcatggtacatcggggcaaattttataaaaatgtagaatggggactttttcatttatttaataaaaaatccatttatttggctttaagaaacctatcaattaccaaaaaaagaagaaaactagaagaaaaaaaaataaaactcgagatgtgagtaatttcatagacttgattggtttccgaaaaatttaaaagtataattgataaaatgttagattaaaagttaatttaatagctataaaaaatacaaattgagaggaactacacacatttttttttttttatggaacctaacacaaatttttttttttgttgaatgcagataagtaatacctacttgacagaaacaaactaaaataaaataaaaataaaaataacgaaacataaccttatgagtttttgagtcatgcaattaaaaaatatatatgattttaacgtccacatatgccgtaaatagtcggtcggtcatcggtcagacaaactaccataggaaagaaatttaaacatggaaaatagaccaaacgggaaatgggcccaacaagacttttccttgtccacgtgtatcatcaccgcctactacgttccacgtagacacgtgtccacataataaccaatcagaaaatcccacactaatatagtgtattaaataccccatacgacgtcgtatatctgaagtggaacccattgataaacacataaaaatgaccgatcaaccaccacgagctcgatttaaaaaccttgatgagtcgaacagtctagatactgacacgtgtcgttatgtaacgccgtggcagcacctggattatactgggacccactgtaaatagttaattcaaaacgaagcttcgcgcgcgtatcctaaaccgttagattccaccatattgttgaatagccgttggatcaaaatctttctctggaaacgtttagtagtcggtcgtatttaattatccaaagtaattagcgattaatcttttaattaattaagacaaaatcttatataaagcaccattaagcatcacccacatactcagcacactacacacaaactaaacgaaacaaaaacaaacacaaacacaaacacagaagtattttctaaaagacaaagaagatg

SEQ ID NO: 29642 - DNA, 3000 bp, Unknown
  misc_feature (1)..( 3000): 2750-1469P.txt file - cDNA_ID_3019984; gDNA_ID_2684239; Annot_ID_192523
accatatagttatacatatactatatgagattgtgttactattttaatttttatgggttttggaggattttttaaatttccacatccgtttttacttatcatatactagcttgttgattaggaacaatgctcccgacaatattgtaaagtatacttgtttaagttgttatccatgagaatacaaacgtatatagttcagttatatttatattcttcataagtatcttctccaactttcgaagacatggtttttataaagcacagagtattcgttctttttatgtctttctattctagccaccataaattttgtaaaaaaaaataaccttgttaaaacgctttccaaacacggattgaaacgagggtaatattagaacgtaaccatgtaaatgaaaaaaatagccgttaaagaaaaaaaaaaacgaaaaaaataaagaattgtcagtttttttattagtaaataatcatataacagtataacaaaagataaaaaggtcctgcaagttgaagtacattatttatttatttgtgtaacatctatatatatatatatatatatctatatagtgaagtatattttggaataatcattttttttgaaattcctagttctttaattagtactgatcggaatgataactttcactcttcaataatatctctttaattatttctgttaactattatcttaagaaaaaactccattatcaaaaaaaaaaaaattgtaacatctttatattaaaatttaaaatagtacacaaaagtattattaacaattaattattatttttgaacttttcattttatttcatatgatttattagtatagctacaagtaggggtgccaaaatgggtaatccaactcaactcaactcataatcaaatgagtttagggttaaatgagttatgggttgacccaacccatttaacaaaatgagttgggtcaacccataaatcatttaattattataggttgagttgttaaatgggttaacctattttagtaataatttaattaattattattataaaacaataataaataataattattattaattcattatcatcaaacttaggatatttacggattctacattttacgggtttacgtttttggcggcaaaatcacgggtttacgttttcggcgggaaaattataggtttacatttttggcggaaaaattacgggtttacgtttttggcagaaaaattacgggtttacgtttttggagggaaaatctcgggtttacatttttggtggaaaaatctcggatttacgtttttggcgggaaaatcacgggtttacgtttttggcggtaaaatcacaggtttacgtttttggaggaaaaatcacggatttacgtttttggcgggaaaattacggctttacgtttttggcggaaaaattacgagtttacgtttttggcgggaaaatcacgggtttacgatttttggcgggaaaattacgagtttacgtttttggcgggaaaatcttgggtttatgtttttggcgggaaaattacgggtttgcgtttttggcgagaaaattacgagtttactttttctcaatttcatcgcttgtatatttaagaaatttggaaaaatatttattttattaaattggtttagatgtgttggttaaacttaaattggcattggtttagagattttagttggtttaattcaattttacaaaactcgatgggttaattgtgtaaaccattgaaaccattaaccattacaacccaactcattttactcatcaaaccaattgactcatcaactcatttgacccatcaactcatttgactcaaaattttcaactcattagggtttagggttcatgggttgagttgagttgagttgacccatgaattttgacccattttgacacccctagctacaagattacaattgaaagtatattgttttgctctctatttatataacctactttaaggaattttacaaatttgttaactgattatctccctttaatcctttttatttatgcaccaattagatcaattatggattctaaaagaacaaattagcccatatgatacaataaataaattaaaaatgtaacaataaaacattgtggttttgttataacggttcaactaaatcccaagcttcaaatcatatgaaaatttagggttaaaatttttgtttgatttaagaattttagattgaatttggggatttagttaatacactattaccaaacgatatcgctctgtttttagaaacaataacgttttgaattaaaggttctctgttaaaaaaaattaactccgttaataggatatataatctacttaatagtatgcctaaatcaggtcaacaaaatttggatatttatttggaaggttaatataaatttgatatttactttgttttgtggagaattgaggatttaaatcaacgttttcattaacttgaggattttagtgatattttctccgaaaatgttttgtcccaaaaaaaaagaaaaaaaaaagtctcagtcctctcatttctccatctctttttcgatttaataaacacaaggaggcttagggtttaaatctgctcaaccacgattcacacaggtgcgttctgtttctttgttgttttggaggatttcatgcttttaatttcttaatctatagaaaaagtcatttgaaaatggaagcaaattgaaaattagttccatgagttgtgttcctaatgagaagtatcttagtagctcgaattgtcccttaacgtccttatatttttagtatgattaatggattctgcttgatttctctatgtgtgatttatgggttttgctttagttctcatatttctttttggtttctacttgttcctgatgaaaagtagctcgatttttcctcaacgtccttttacttttttgtatgatttatgggttttgcttttagttctcagatttctattttctcttatacagattttaattttgtgtttgtttaatttcaggtttgttgagatg

SEQ ID NO: 29643 - DNA, 3003 bp, Unknown
  misc_feature (1)..( 3003): 2750-1469P.txt file - cDNA_ID_3020000; gDNA_ID_2684239; Annot_ID_192519
tcaagggcactaaatcataaaaaacccaaaatctcagatctatcaagaaaacgactattccaaaaatggaaattataagaacaaaattctttggacagagatcaaacaagaaaggaacgagaaaaatgaactttaggtaccttagattatccaaatttgtagctgcaaaagttgttcctgtgttcaagaaagaaagacctgtaaaatgatctggatgtgtttggttatatatataagaagacttaaaagataatgacttaatctcgtaacgagtcacacggacgtgacgctgaaactcacacacgttggtgccacgtctttgtctttcctcttttgctctacttttttctcctcataggtgataggtcccataagcaatgaaataaaaaaaatggtaattgacttttctccaaacattttcgaatctgattttctttttcaaggttttataacctctacattccagaatatgactaatgacatcattatccaattattttttatactgtaaactcattattatgaatattctttatttcaaaaaattaccattgatttataagtttattagtataatatataacatatggaataaaacttttatttaaaaaaaaatatttttccccaaaaaaagtaggattaataacctgattaataaataaaaagtgttatatttttaagcattgtatgcatttactttatcatagttgtcttgtttttaagagttaaaaaataatgatgaacaatttcacggacaacgattccacgataaagctttccctgcaacactcagattttctaaagacggttttgcattgcgttttctgggattcgaaacccaaacatgatgtacaagtattaatgaactcttagttaaccattagattaaaaatattttcactattaattttctcttaaaaatattaataattttttgaaatcaaaaattatagttattttattttaataaacgagaaacactacaaaaaaagttaactgcatttagataatttaataaactaaaatatccacataaaaatttcaaatttatcaaaaataaaacatcaatttgttttttgttttaaattaaagatttgctattgattgcataaggaagaaaactttacaaagccgaaaggcctaagagcccaacacacacaaaagaagaaccattttggatcaagggaaccgaccatgggtattagaagtagtggtataaagcccatcatatcccaacacataacccacgaatgtttaatattaaaagtttgttgttcggctcatgattagcgatgatcatacagaaagtttgtatctaatacgtgccttgaattttatgtgtacaacaaacaaattaaattattcaaaaccataaattataaaaaataattacagaaataaaactatattaagagcgagcctaccatccggtgtgcaactttctagtttatatacagtggcggatcaacgttaatgaggcaaattggttcaaattcatctaaataagactagagttcacaggttcgattcctccttataacaatttgctcccaccaattttttttgctgggtccgcccctggttatatatatacttctacaccaggtttgggttcgagtccacacataattaacgacacaattatagtgcacgatagaatgaactaaaacagctagagcgtagagggctcattgtctataaaaatccttcgttaacttgcaagaaaccaagagtagagggctcacacttaagtctcctacatgacgattatatttcgtcaaaaagaagcaattagttagctttacagcatatcatttcgcctaggttttccatcgtacacgtaaattttcatgcaagaaagcagaaatatacaaatactaacttttagatactgaaaaatgagatcagattctagtcaaattttgttaaaagtatttataaatttaaattgcaagtcctcaaaaagtacgactaaaaatgcttttcttagaaaatgataataaaccggcgttttatatataagtgtttctttttctcttctgtccagaagtaaatcattaagaaccaatatggcttttcttaaactaatctccgtgataatcaaatctttgatcattctccacacaatcccatcaacaacatcgatctcactagatgcaccaacaatgattctaatcggcactactaactatagagatagttgtcccaaaaaaaaaaaaaaaaactaactagagagataaatcatattcaatacatgtactatttctactatacttaagaaaatttgtataccactatcttaactcttaacactgaacatactatacactatcttaactcccaactcttgtaaaagaatatctaattttaagaaaagacttcaaatgcttgttaaatttctagtgaagatgcacattctaaaaactggtaaaatggtaagaaaaaaatatataaaaaaatagccttattaaaatttatatctcctatttctctatccaaactacacggatgaagcttattgttattcatccaccctttttctcaattctgtcctatttcttgtgcatgaaacttctccatcttgtaatcggataaatcatacccaaattttttctttctgaaaacatatatacccgaacattaattactatcgtcctttctcctaattttgttaagaaacatgtttgtttgtttttagtactgaaaaaggatggagatacttgctagatcctatgaaccttttctctctaggacaaatcagtaaccaaacaataacttagcaaattaagcacgacagctaatacataaaatgtggatatcaaacatgcacgtcacttccttttttccgtcacgtgtttttataaattttctcacatactcacactctctataagacctccaatcatttgtgaaaccatactatatataccctcttccttgaccaatttacttataccttttacaatttgtttatatattttacgtatctatctttgttccatg

SEQ ID NO: 29644 - DNA, 3000 bp, Unknown
  misc_feature (1)..( 3000): 2750-1469P.txt file - cDNA_ID_3020003; gDNA_ID_2684239; Annot_ID_192518
aaacaaatacgaacagcaaaagaaattttcatgcacaacctttaatagcatgtaaaaacagcataaagaagttgtaacaatgatttgtactcatttaaacaaatttttttttttttttttaataccgggtattaatcaattttctgaatagaaaatagagagaacgaagactattggtagtgattatagatattcatatttgtgtgtgtgtgtgtcggttagtgtgtgtgtgttcgtaaataacataccagctcttacaggaacttggtgccatttgccttctccatacttattaatgcactgtctcaagagactatcttcttcagtagtccaagcaccttttcgcagccctttggacgaaccctccatggaacaaagatagatacgtaaaatatataaacaaattgtaaaaggtataagtaaattggtcaaggaagagggtatatatagtatggtttcacaaatgattggaggtcttatagagagtgtgagtatgtgagaaaatttataaaaacacgtgacggaaaaaaggaagtgacgtgcatgtttgatatccacattttatgtattagctgtcgtgcttaatttgctaagttattgtttggttactgatttgtcctagagagaaaaggttcataggatctagcaagtatctccatcctttttcagtactaaaaacaaacaaacatgtttcttaacaaaattaggagaaaggacgatagtaattaatgttcgggtatatatgttttcagaaagaaaaaatttgggtatgatttatccgattacaagatggagaagtttcatgcacaagaaataggacagaattgagaaaaagggtggatgaataacaataagcttcatccgtgtagtttggatagagaaataggagatataaattttaataaggctatttttttatatatttttttcttaccattttaccagtttttagaatgtgcatcttcactagaaatttaacaagcatttgaagtcttttcttaaaattagatattcttttacaagagttgggagttaagatagtgtatagtatgttcagtgttaagagttaagatagtggtatacaaattttcttaagtatagtagaaatagtacatgtattgaatatgatttatctctctagttagtttttttttttttttttgggacaactatctctatagttagtagtgccgattagaatcattgttggtgcatctagtgagatcgatgttgttgatgggattgtgtggagaatgatcaaagatttgattatcacggagattagtttaagaaaagccatattggttcttaatgatttacttctggacagaagagaaaaagaaacacttatatataaaacgccggtttattatcattttctaagaaaagcatttttagtcgtactttttgaggacttgcaatttaaatttataaatacttttaacaaaatttgactagaatctgatctcatttttcagtatctaaaagttagtatttgtatatttctgctttcttgcatgaaaatttacgtgtacgatggaaaacctaggcgaaatgatatgctgtaaagctaactaattgcttctttttgacgaaatataatcgtcatgtaggagacttaagtgtgagccctctactcttggtttcttgcaagttaacgaaggatttttatagacaatgagccctctacgctctagctgttttagttcattctatcgtgcactataattgtgtcgttaattatgtgtggactcgaacccaaacctggtgtagaagtatatatataaccaggggcggacccagcaaaaaaaattggtgggagcaaattgttataaggaggaatcgaacctgtgaactctagtcttatttagatgaatttgaaccaatttgcctcattaacgttgatccgccactgtatataaactagaaagttgcacaccggatggtaggctcgctcttaatatagttttatttctgtaattattttttataatttatggttttgaataatttaatttgtttgttgtacacataaaattcaaggcacgtattagatacaaactttctgtatgatcatcgctaatcatgagccgaacaacaaacttttaatattaaacattcgtgggttatgtgttgggatatgatgggctttataccactacttctaatacccatggtcggttcccttgatccaaaatggttcttcttttgtgtgtgttgggctcttaggcctttcggctttgtaaagttttcttccttatgcaatcaatagcaaatctttaatttaaaacaaaaaacaaattgatgttttatttttgataaatttgaaatttttatgtggatattttagtttattaaattatctaaatgcagttaactttttttgtagtgtttctcgtttattaaaataaaataactataatttttgatttcaaaaaattattaatatttttaagagaaaattaatagtgaaaatatttttaatctaatggttaactaagagttcattaatacttgtacatcatgtttgggtttcgaatcccagaaaacgcaatgcaaaaccgtctttagaaaatctgagtgttgcagggaaagctttatcgtggaatcgttgtccgtgaaattgttcatcattattttttaactcttaaaaacaagacaactatgataaagtaaatgcatacaatgcttaaaaatataacactttttatttattaatcaggttattaatcctactttttttggggaaaaatatttttttttaaataaaagttttattccatatgttatatattatactaataaacttataaatcaatggtaattttttgaaataaagaatattcataataatgagtttacagtataaaaaataattggataatgatgtcattagtcatattctggaatgtagaggttataaaaccttgaaaaagaaaatcagattcgaaaatgtttggagaaaagtcaattaccattttttttatttcattgcttatg

SEQ ID NO: 29645 - DNA, 3003 bp, Unknown
  misc_feature (1)..( 3003): 2750-1469P.txt file - cDNA_ID_3020022; gDNA_ID_2684239; Annot_ID_192512
atactctatcaaaataatgaatgtacatttaaaaaaaataaaagtaatattagactaaaaactcccaaattctcttcaaaattccgtttttcctcgtatgtttttttttttttaaattcataccataacaaatacacatagttaacaaacatcactgaaagcccataaggcccgtcgataccatcacaaggtaaaaaaagagttatctctacccaaaacgtatcgagagatattggagtataacaatgccaagtgttgcacaagaaagtgatatgcttttccatcatcctctgccacttggactctgattccggtgaataaaatcaataccggagaaacacgacacaaaaagaaaatattgaaaccagccaccgtctatgaaaaccgactgatggtggaaaaggaaccgggccttgtccgggcacaaagcggaaatgaaaaaccggatataaatggaattggaaattaaatagaatcaaaaatcaatttgcttagccacacttttggacttcagaggcggaagaatgggaaaaggtggactcgaccacacctataagacaagttgaaattaagagaaaagtgaagctaacatacttatcataggtttttaggggttgggactgaagagccttatacaaacaaaaaaattgtccaatacttgtgagttgtgaccacatttcacaaattcacaaaaccaagttacttcggctattttgctaatccgtcattttcatgttgttgaactctttaaaaatactaataaaattaagggctggaaaatattgtaataaaaagtagacaaccaaaattaaggaagtaatttgcaagttgcacccttatcaaaaaaggacataaatagtcttttctcttgcgaaataacattggcatcaggtaacaaattaacgccgaagtaatgtaaattcgtttatttcacttactattagcaaaaaataaaagatatcaatttattcgataacatattattttatataacatattattttatatgatatgaaattaatatatgttgacatgatgcacggtatattttcatttggtagacaaatgttactttacacgatgacgctatacctaataaaatagcaacaaccatggttaccaaatttagcttgaaagtaattaatgatatttcatgtatgaactaatataatcaaaataaaaataaaaactgctaacacttgtgtgttgagaccacttaggtaatctatcttatgaatgtaaaatatagatctacatatatagatagatgatgcataaaacgtcatatatatcaccgatgaaaacaaaaccatgcataatatatcctggctcaactcagtcaataaactatctcagtttcttttcagaaaataagaagtcttagttcgaatattttaatagtgatatcgtagaagatatgtttcctaagaatttatctctaatctcaacatccctttttaccgctacttgctagtctaaagatactatatatagttccaatatttcatttttaggctctattttttatgtgagtatgagacctcttaattcatcgcatgtgagatttggctaacctattacctataaacccctaaagtagattattgtagaatctatgtttagtacaagaatgtatctctaacctcaaaaacccttttttatcgctagcctcaagatatatatccttactagataaggcccgcctatttaggcgggtgtatccgaaattttcaaatattcgaacgggtctaaacttgaaaacccgaaaaactcgaacccgaacccgaatagatatccaaacatatctcaaatataagtataagtataactaatatatacttatacataaaaaatattaggacttttttgatattttagttatttttgtgtatttttagatatattcgagcaaaactactcgtgttgttttgggaatttttgaaattttcaagtaatttaatagatttgcacacacaatttgatatttcaatatataaataaactcgaacccgaacccgaacccgacccgaaatcttaaattacccgaacgggtcctaaacttctaaactcgaaaacccaaacccgaaatacccaacccgaatacccaaacgcctagagctaataattaatagaaaaacagaaatccacaaaaatatttagaaaccaaacattgttgaaaatataattttatatatgccgtaatcttgtaagttaattttaacatcatgcaaatattaaatgagttaaaattaataaatgaaaataattgaaaaggtaaatcctataagctaagctatttttctcaaaatgttctattttcacttatgattacatgagttaaagacaaatttgttaattttccttttattgaataaatgttaattgtttataaatatatagacatataaattagtatatgtaaatttgtttactttttaagattttctattctttttaaaaaataaaaaagttaaattttaaatgacacatgtaaacatctgatcgtttgacttgacacgtggcacgatcctatgagttagcaactttgaaaaccatactttatataataagattactagtccaaaagatagcattacctcttcattcctcgcgtgtaagacgatttggctaaacctatgaaaccctaaagtctaccacatacatacataggaataggataatgatgtccattactctttttatagtttattctctttgtataccttcaccactgatgtatatatatacacatgtatatagctcatcattcttcatctcctaagacattcacaaaaaatgtcattacctaattcactcttctatacatttttcttgatcttattctcaacgattcgaattgctcaaagcatatatttaagtccatcaccggctccaaatccggcttacaatgataacgacaatattgcgccaaccgtcttcgacgtgacttcatttggagccatcggcgattgctcgaccgacgacacgtcagcattcaaaatg

SEQ ID NO: 29646 - DNA, 3003 bp, Unknown
  misc_feature (1)..( 3003): 2750-1469P.txt file - cDNA_ID_3020026; gDNA_ID_2684239; Annot_ID_192511
gatatatttatgcatgtaatattgagattgtgcttatgattgtttatattcttgaaaataaagccaaacaaatcgtgcaacagagtgggaaagggtatttcactacccttgaaaataaacaccatattgatgagctttaaacctaagcacctctaccctacccacttgggccgggcctgattggaaatcttcaaaatacatcttggtcacgataaacaaacatgaaggatcttgcgtctgttttccgagaaccagggttgcctcttttagtgtttccactagatttcttacaccttcttacgaaaaggcatttgtaggtgttttactttctatatcttacgagctatcaggcattgacgtgcttattagtcttgtacaaacccttgacgccatatcttagtaagctggcatagtggcatgtgtcgaacttgctgatatactctatatttaccgctttatcacggtttttaatatcattttttatcgtattttattggtattttccttatgttttgtctatttagagtccaagtgagttttcttccattttagaagttctatagtgtttttgtgtgtcttttcgtgtgttttgtatgtttttgtaagttattccaggacaaaataaaaaaggacatacatttggatactatttctttaaagataataatcatcaaaaaacagtcccagactcggatgaaggtgtacccttgggatttgtttcctcgaaggtccttacgaaagtcaatagaaacttgagttagcttttcagtggaggtcattgtgggttaatccgagctgtggttaaagagttatggccggttaactgaaaatgtatcaatttgatgccagtgtcggtcttgtcatttttcggggaggctttttaaactgttaaattttctatattttgctaattgtgggttataaaaaaaaaaaattcacaatgaaacaaaatgctattttatttttactaaaatgggcttaaattctttcatttatttttaagatactcttaagacactattaatattttagacaaaatgggccacgaaattagaggcccaatacctatatgttatatgtatgtgtcaagggcaggacctgggtgtagagggacattctcacgatccaaagtccatgatcagacccagatctgttatgtgtcgatccggaaacttctctactctaaaagttgatttagatccaacctcttcttttgatatgagctttcatatctggaaggcgtttgtgaaaatagacttgttattaatgctcattgatcatatagacaaacataattagattatttgtgaagttgttagtgtcacggaagtggaattagtcatatttgtgagtttcatgttctggttaaacgtcttacttcattgcatgattgttaaattcattttcatgataataaaactcatagtttaatgcttttatcttattttacttcttgcattttctctatattagtttgaagctcgcatatttagtgttgcaatctttattcctggtgggatcgatttctaaattactataacggttgcgcttgcacttgggtgatttagagatacaaattttataacttgtgttttgaaaccaaaaatatttctacaacatttgctatgtattaggaaacctctatggctctatcgatggtaatttctctcgaggcttgtaaggtcctcgttggatgaaattcacaatgtcacaactatttaatactctccaccttctagtgattaacttttttttttttttttggggcaaaacctgtcatgcaaaattttggttttcgatcgtctatacatgttcctgtgcaaaattttggagcacagttaaaaaaaaaatatactagaatttgatttgcaattttcatctttctaagaataatataattctctatttaagactcgtctttactaattattcactacactttattctgctgttatgttttctttttttgaccatgcagtgcaataaacctgacagttacttctggtaactaaaacatcatcatcgtcctcacatgtgaaccttacacattcccatgatgttctgaataatgtaattgactaattgtaatgcaaggcaagacatctctcctttgtctctctcaccataaaaattaaagaaaacaaataaaaacacttaaaaaacctttcactacctaacacttgataactctatctcttcttcttctcttattaccttccaccagatctcactccccacatttcaaagttttctccctttttgtcgatttccttctcttactcatattaaacccaaaacttaataaattctcttaaattatctattcactggctgggccagagtgtttatttgaatatgttttattacagttttagtgtagttgttgtagttacatgacagctccttacaagcttagatctctccacagttctttcgttatcttccttccacattgacacttgccttaagaagagggccaaagaaaggtctcttgtctctttgtctgagctgttcattttcttgattttcttgcatcttggatttgcttcattacattctttctcctgaaattttatttagtgtttttctcacttctctcaaatttggttctaggatctggaattctttcttcttcaagatttgtaaatgggtgttagttcttcaaagatctaaaatatcaagatcaggtaattaaacattaaattctcatctgctttggtacttactctgtatgtgttgtctgtttatatttattttaagaccaacattattgcttgtgttctttattatgtccttgattttagctacttcagttgtcctctagtgtgttttcctgggaaatttttgtctttctatgagtaaatttcaatgtggataaacttgggaccacaaaacaaattcgagactctatcattaagctcattgcattttcatgtatcaacttggactctgtttatatcaacctgattttggagatttatttgtaaagtttaggaagaaatg

SEQ ID NO: 29647 - DNA, 3003 bp, Unknown
  misc_feature (1)..( 3003): 2750-1469P.txt file - cDNA_ID_3020032; gDNA_ID_2684239; Annot_ID_192509
gaagcatgaagtagctagacaatttatgttggttaatcggttaacaaaaaaattatgttggttaaaataaagatcgacaagacatatctcataatcaaacacaataaaaaaatagggctacttgattctattgtatgaaatcatgtaataacgaagctgcctttaaggtacttcggattaaaaattcatcaaatgattgaattatattggaaaatcatataattcattgaaaagactttcgaatcgaaattgcagacatacaagcttttaacgagtatcttttgcttatactattaaattaagtcgaacaacacgttattgaaaaaaatattatgctatatactaatattatttcctcccaaaaaaaatcatcatcctcttcatcaatcatatcataattagcatgacaatgatccgccgtaagccttccattatatgaagaaggtcggattttgaggtattgattttgattagattcgaatgatgcatgcaattataatatttttggtttatggagcaaaaactttgctttacttttttcactgttcaaaaggattcttataatgaacttcataactatttttctgagggtggaattatggtttctaacataaacctagatggtaatttgtggtgttatccatgttatatatatttgtactttaatattaggagatgataattaattattttggcttttcatttcgaatctcaattccttttgtattggttatgcaagtttgttttgcagctaccatgtaagtaaaaatgtcatacgaactttagtcaaaactacttttaaatttaagtctttgcaatttaactagttgtgtatataggaaaaaaaaacactacttaattgatactgtaaactgttttaataattgaagatatcaaaatattagtggatgttatattggccattttttttttatatccgcaaagtttggaaccaaactccgtagattttcataaaccaaagtgagtgaattcaccgcttcacaaatgaaacttaaactagagggctctaggatgaccctagtttatttgctactagaccgagcaacacttgatattgaactaaacttgataaaacagagattttgatacactcaacatatacttttatgttgagtgtatcaaaatctctgttttaagttggtgaagcgtgtacccgacagtttcatgtccacatagctcaacattgttgtatttattgatttatgtgggcgtttcaataatctgtgtaaatccaagatatcattgtcgtaaaaaaaggcgagggtcagatttgtatagcgacactccccgtgaaacagttgtgcaattttacatgtttacatagaattccaagtatttaaagaccaaccctttggccgatatatgtataattgtacataactaaattctataaaacgtagacgataaaatcataatgtggattttatgcatgtcgttaaatggtatggtgttatttaacttgttcatatatgtttttttattaacgagtttacttgataaatgttattcacttatttcacgtaatattacggttattatacaagtttaacaatcacatggaaatatgtactatttacgattttttcatcgcattttttgtcaaacaaaaaggtagaattaagttataaaaaagccctacatatcaaaaagttatattgctgaagacgaacgaatagttgccatgcttaacatgcattgcattggaatggtcaaatagagatgctatgaatatatgagctgtcctctcaagtcaattgttcaataactcgttatattatatgtaatttataagctaatcatcactgtccttttcgtttgtctttgtcataagattgacagaaccaataaaatctgaggacgattaaattaatatataaagaaactagagatttaatattttgaactgaataaaagttatatagattacatgaaggatcgttgtcattatcactaccacaaaactttaacatcattcaccgacaaatggaaaacattaagctgttcacttaattaacacgcatctcatatattatttccctcgtatatattaaactttatagatgagatttaatttctttcaactacctatgcaaaatttattttatttgatgttttgtgacaattatattaatctttgataattagttttggttaaacttttttttttattatccatttttgtcaaccacgtaattaaattaaaaaaatatatcttaatagattatctaatatgaaagaaccgagtttacgaaatttcatttttaaattagttttgactaatgggtctctaagttattacacccgactaaatatgtggagtcgataagtgatagcaagttagatttacttgttctaagctaaactaacaaatatagataagttaagtagattaaaacttacataattgaatatttacatgtttggaaaaaaaacttgagtaaaagaaaaaaaacttgataaaaatcactaaaaattatgtttacacttgagttaaaagcaaacattttatctacataagatgatactaatacaaactaatggcctatatatatttgtaatccatgaaatttaattttatttttgtaacagacattatgattgtaacattttaatttctttgcccaaaaacaaaacattttatttttaagttattcgacttcttatttgtgttcatcccatttttttgtttccaaccgatgaacaacggaaggttgcgtcaaaacgcaaagggttgtgttgtttgtgttgaagtggagctccttcattttaggaacaagcagaggacgttacacaatcaaactcagtttcttcccttatttaacgtaaccactaattctattttcttgttcttttacaaagttcataaatggaaatgaacacgtaagaagaaataaaacaaagttcaaaactaagaaacagaaaaacaaaaaaaaacataaaaaaacatataaaaaaaacataaaattacagaagaaaaaaatg

SEQ ID NO: 29648 - DNA, 3003 bp, Unknown; identical to SEQ ID NO: 27320
  misc_feature (1)..( 3003): 2750-1469P.txt file - cDNA_ID_3020087; gDNA_ID_2684240; Annot_ID_192561

SEQ ID NO: 29649 - DNA, 3003 bp, Unknown; identical to SEQ ID NO: 27321
  misc_feature (1)..( 3003): 2750-1469P.txt file - cDNA_ID_3020091; gDNA_ID_2684240; Annot_ID_192560

SEQ ID NO: 29650 - DNA, 3000 bp, Unknown; identical to SEQ ID NO: 14998
  misc_feature (1)..( 3000): 2750-1469P.txt file - cDNA_ID_3020099; gDNA_ID_2684240; Annot_ID_192558

SEQ ID NO: 29651 - DNA, 3003 bp, Unknown; identical to SEQ ID NO: 27328
  misc_feature (1)..( 3003): 2750-1469P.txt file - cDNA_ID_3020148; gDNA_ID_2684254; Annot_ID_193079

SEQ ID NO: 29652 - DNA, 3000 bp, Unknown; identical to SEQ ID NO: 15022
  misc_feature (1)..( 3000): 2750-1469P.txt file - cDNA_ID_3020164; gDNA_ID_2684254; Annot_ID_193070

SEQ ID NO: 29653 - DNA, 2931 bp, Unknown
  misc_feature (1)..( 2931): 2750-1469P.txt file - cDNA_ID_3020164; gDNA_ID_1972137; Annot_ID_179138
aagcttttctctacacatcttcttttgtattgtcaaggaattcgtacgttacaatataaaaatcgcagcttctttcttacaaaagagttcaaattatatctgaaattattgtgaaccgtgtttttgccattgctggttttggtcatgacattctaatagagtcagatagagaaagtagcatccatcaaaattttcaaatacagtatatatatatatatatacacacacatttttctcataaataaaaacctaaaaatatacacataaatacgcacacgtgcatgtatatttgagtgtatacatgtcaatttccaatgtcgtatattagacttccatctaaataaactactaataaaaatttggtaaagaggaatatttaaggtaaaaacaagaattattaaaaacacaaaattaacttagagcttttataatgaaatgaaagtgctaggaaagcaaaagggctttttgattgcaagcttgagactaaggtcatgatgatacggccagcctttcttgagtctttggtcggtccgacaatctgtgtgttttgtgttcactctctgtttttctttcatttttttcttatagtttatttacttatatttcggttatagtgtttctcaagctctagctcatatatcctataactataaggggatgtgatttaaagcaaattttggaccaatcactatgaaataaaatattactaattttgatattttatttccctgatagctacactccttagttgagctttccgtaagttgaaagcaaagacgacttgcagagcaactttccaagttgcaaaccacacatccatctatagagacatatcatataaacaaatttatttaggaaaaatcctagaaattgtcaaggtttactcattagatgatactctaaattacacccataatatattggcttgctaagttgcaaactatccatacatttatccatatacatcgtaagaataatttatataggaagacctagaagttgtaaaatgtgtatgaataaattccaaatgaagacctagagcttgtaaaatataaattttaaatctagatatatatatatatataaaatccataatataaaccttttgtaaattatgttataagttataacaattgtaactttaagacgagtttactattagcacttgacactagtattttgcaagcatttaattttatgttaaattttgtttatttataggtgacaatatgggtaatccagtccaatttgatccataatgtttatggggtgaatgttaactaggtgaacgaagaacgtaagccatttagtaaataggttgaccatataaaatgttctagtttctggtatgaggggaggtaaatgcctattaatctatctaatttgatgggtcgaaaatcaaaatgataaaatagttctacccataaaatatttttgtaataatttatcacatattttcataattaatagttattacaatcggtatcatatgtgatacgttcattgtcttcacatcatcatcgcattatcatttttatcatcatcataacataacgatcatcatttcataccatctccattatcatcataattttgaaatcacctttatggcacaaaattttggaatcgtgcttttgcaaaacaaaacaaaaatatagttttctctgcaaaaatcatgtttttacgaaacattgaatatagcggaaaattgtggatttgtgtttttagcaataattattatgaaatacttttagctggaagttgcgaaattacataattcacgattcattgaaattcagtttttgaccaaaaaaaacaaattgtgaaattatatgatcatgatgatgataatggggtatgatggtgatgatatgataatattatgatatcatgaatataataagaaacgaatatcatttacttttttttttagtttttaacaaaatgtgggtaaatattggtgaatcataaatcttttacaatctaactcatttagcccattaattccttatggtcagaactcatttgccttatcaatataatagggtcataatatttagttatgaggatttgaattcggatgatgacataaggaaacattagtatcaattattagattacatgaatttggttaatatttgttaattagtatcatggttttatatcaacgagaaaacaattgaccaaaaaaaaaagataaccaaatcactatcctacacaatgttatgtgctctcccataactagttagtggtctaatagaagacaaataatcaattttttgttgatacctacaaatttgtaacgtatattatgtggtctctaatacctagtttagtgctatagcgtagattttatttatataaatcaattaaatctgtatagtgccgactcatatattttcgatgctctgaaacaaatttaaaagatatgtattatgtgtcattttgtatatataaattctttttgtgtctttttatatatacaaattatttttctgtgtatggatatttggcgatcgcattgcttgtccatatacttattagaaatagaaatagaaatagaccgtgaagtactaaatgcgtaaattaaaagatagataatctaaagaatcttaaacccattacctttttttttttacctttttaataattccaccacaacacaaaacacaagttgcaaactccacatatcctgcaaaccattggtaacaaacaaacgcatgagtttcctatatatgtctgcgtctacaacatttgaaagcaaacttttgtctctttttaactctcttaactttcgtttcttctcctaccttcttttaccaacctttcctttctcttacacacatatatatatacatatatagagagagagaagaggacaaagagttgaaagatgaagactctcatgtcttcatagaaacaagtgatatg

SEQ ID NO: 29654 - DNA, 3003 bp, Unknown
  misc_feature (1)..( 3003): 2750-1469P.txt file - cDNA_ID_3020180; gDNA_ID_1972137; Annot_ID_179148
cacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaataccttcacatgattcttttttctaaaagaacaaatttcaatcattcaagatatgtcattatcaactttcacaaaactttcataaattactatttcacaacaggaaaagagttagagaggatcttaacctgtttgtaatattcttctccacctttcaacgcagtgagaaccatgtagcttctttcacaacagtatatagaaatgtatctatcaaacaaacgaagagtcttagaaagtcaaagctggtaatttgtatcaataatacagttaagtgttcgaaaatgaccgaaaagttttagattattgaggcataatgaattgggagcagaaaacaacaaagagttttagctggcagcttgctaggagaggaccgcactcacgtagatgtgattctcaagtcactttccacattgtaatctcaaatccaccatgcacgtgcagaagcaataaacaggtaggtgataatgaaataagggtcgtccaatctaattctatgacccacaaaatgtgagagaatgtgactcagtaaatgcacaacacattggaccttgtctaccaatttcaaattccaggaagaccgaagaaacaaacgagtaaagacgaagaaacaaacgagttaaggcaaaaaaacaaacagttctgtgaaactattagctgcacatgctcaattgataatcgaaaacgaaatccaagggaaagattaagacgagtagcaatgctttcttgaaaacaaaaaaaacaacgatcactagtaaatctctcatattgtgtgaaaacaataccattaaaaagcaacactaaccttaaacctttcatcaaaaaatctgcatcttcgagaaactggtacaatcaattaacgaaactagaattccataatcataagagaagagttataaagcttaatcagtttattaaagtaaaagctgacataattacattagattcaggtaacgaggttaaagacagaaaactctaaattccacttgttaaaactaactgaagaacctagagatacaattctaaaaacttcaagaaagtttatcgaattaccaaacaatcctgaaacctaaaagaggaagaaagtggcagcagaatttaaccccttgttgtttctcctcattattcaaagttcaaactctctcttgtagaagaccaatggacttgttcatactctggagttaaagctcttgttccagtttggaatccagagctcaagctagctgaacctgaaaccacaaaacagattatctcaacaactattgatctaaaatgtttgaactgaaaactaaattaacctgaaaacaactcagtatgccaaactaacaatatcattaatcaactccctaaatacaataccacgtcaccctatctaccaaagacaaattctcattccattgcatgataccaaatttgtttttttttttttttttgaacaacaagcatgataccaaatttaacactgaaagcaatacgaaagaaagaactcatatttgatagaaagtgtttaccaatgcgcagactccagataatgttacgccggtggtgcaatgacttactcgatcatcgactgaatctgaatttggtattcatctccgtcgggtttccgcggcgggacacggcgtagatcgatgtaggggattggtctcgagaaatcggtgactaggcaaatagtgttatgggcttagtttgggctttaataaatgatg

SEQ ID NO: 29655 - DNA, 3000 bp, Unknown
  misc_feature (1)..( 3000): 2750-1469P.txt file - cDNA_ID_3020207; gDNA_ID_2684255; Annot_ID_193103
acatcctaaactctttattgatgtattttaagagattcgatcacaaaacattgcatcatatccaatgattttcgaaagttattcggcaacatttttttttctcggacatccggccgtcctggtcgacgaatcctcggacccggtcgatgaagtctcggacctggtcgacgatttcaacccctggtcgaccattcctcgaacccgatagattttcatcgcccattcatcgtcctggtcgagggatccgccgtcctggtcgacgaattctcggtcccggtcgacgatttcaactcctggtcgacaaatcctcgaccactcctcggcctggtcgacgaattctcggacccggtcgacgatttcaacttctggtcgaccattcctcgaacccgatagattttcatcgcccattcatcgtcctggtcgagggttccgccgtcctggtcgacgaattctcggacccggtcgacgatttcaactcctggtcgacaaatcctcgaccactcctcgtcctggtcgacgaattctcggacccggtcgacgattccaacttctggtcgaccattcctctatcccgatagattttcatcgcccattcatcgtcctggtcgagcattccgccgtcctggtcgacgaattctcggtcccggtcgacgatttcaactcctggtcgacaaatcctcgaccactcctcggacacggtcgatgaagtctcggacctggtcgacgatttcaacccctggtcgaccattcctcgaacccgatagattttcatcgaccattcatcgtcctggtcgacgaatcctcggacccggtcgatgaagtctcggacctggtcgacgatttcaacccctggtcgacaaatcctcggacccggtcgacgattcctcgtcctggtcgacaaaccctcgaccactcctcggacacggtcgatgaagtctcggacctggtcgacgatttcaacccctggtcgaccattcctcgaacccgatagattttcatcgaccattcatcgtcctggtcgacgattcctcggacccggtcgatgaagtctcggacctggtcgacgatttcaacccctggtcgacaaatcctcggacccggtcgacgattcctcgtcctggtcgacaaaccctcggacccggtaaacttttctcgacgattccaagtccagatcgacgattcctcggacccgattgagaaaacaactctatggagttttttttttttttttttttttttttttttctttttcttattcttattcttattacttattcttattcttattcgcgcgcgcgcgtgcgggcaaaattcccgctacacacacccacccctatatagctttatagcccttttccctcttggcaccaacatacattgaaatgtctgaggagacaccggttccaaaaaaaaatcaaatacttggacccggtcgatgaagtctcggacctggtcgacgaatcctcggacccggtcgatgaagtctcggacctggtcgacgatttcaacccctggtcgacaaatcctcggacccggtcgacgattcctcgtcctggtcgacgattcctcggacccgatagatttttctcgacgatttccactcctggtcgacaaatcctcggacccggtcgatgaagtctcggacctggtcgacgatttcaacccctggtcgacaaatcctcggaccctgtcgacgattcctcgtcctggtcgacgattcctcggacccgatagatttttctcgacgatttccactcctggtcgacaaatcctcggacccggtaaacttttctcgacgattccaagtccggatcgacgattcctcggaaccgatttttttccctcgacgatttcaagtcctggtggaggaatcctggacgattacttgctagttcttagcttttacaactttcttagcttgagaactatctcacacttctatctccccaagcattctcttttgtttctttttgaacaagtctgtctcttgacttactcttctcactatgcaccttcgtgagtgtaaccccaagcattctcttctgtttctttttgaacaagtctatctcttgacttactcttctcactatgcaccttcgtgagtgtaaccccaagcattctcttstgtttctttttgaacaagtctatctcttgacttactcttctcactatgcaccttcgtgagcgtctccccaagctttctcttccgtttctttttggacaagtctatctcttgacttactcttctcactatgcaccttcgtggtgggcgttttggacaagtctgtctcttcacttattattctcactatgcacctttgcgagcgttgcgggttttcaaaacacttggcgaggtccggaatcttaccaagtaataacatttaacctcgagagacgagctcgtgtaaagttgggaattcgttaaggagctgttgctttgttagtgtagaaacacttgtgtagaattggggattgttttttttggagtgatttaggggagggtcgaatcttagcgacaaagggctgaatctcagtggatcgtggcagcaaggccactctgccacttacaataccccgtcgcgtatttaagtcgtctgcaaaggattctacccgccgctcggtggtaattataattcaaggcggtccgaacgacgcttccgccgaacggacttagccaacgacacgtgcctttgggagcctaagctcctactgagggtcggcaatcgggcggcgggcgcatgcgtcgcttctagcccggattctgacttagaggcgttcagtcataatccagcgcacggtagcttcgcgccactggcttttcaaccaagcgcgatgaccaattgtgcgaatcaacggttcctctcgtactaggttgaattactatcgcgacgcgggcatcagtagggtaaaactaacctgtctcacgacggtctaaacccagctcacgttccctattggtgggtgaacaatccaacacttggtgaattctgcttcacaatg

SEQ ID NO: 29656 - DNA, 3000 bp, Unknown
  misc_feature (1)..( 3000): 2750-1469P.txt file - cDNA_ID_3020211; gDNA_ID_2684255; Annot_ID_193102
acgcttctccagactacaattcgaacgccgaagacgtccgattttcaagctgggctcttcccggttcgctcgccgttactaagggaatccttgttagtttcttttcctccgcttattgatatgcttaaactcagcgggtaatcccgcctgacctggggtcgctatatggactttgggtcatctacagctttcggacaagagcgaccgataaaatgtaatggatcaagttcaccaccgcatgtcggtacgctccaggcgtccttggctcggatttaggccaaccgcgtgcggtaacacacgggagaccagcttccgtcccgcatcagcaaaggatggtgagggacgacgatttgtgacacccaggcagacgtgccctcggccagaaggcttggggcgcaacttgcgttcaaagactcgatggttcacgggattctgcaattcacaccaagtatcgcatttcgctacgttcttcatcgatgcgagagccgagatatccgttgccgagagtcgttttagacttcagttcgcggcacagcatccgcccacactccgtctccggggaggcgaatgccagccgttcgtttgcatgttccttgacacttttcgtgccggggttttgtgatatccggaagcaacgcgcacgacaagaccgagataaaagctcccgatcatgccgatacgcgaaaccacggatccggcgggcaaggaatcggctaagaaaccggcccaccgagagtggtgatctttggttcgcgggtcgttctgttttggacaggtatcgacaatgatccttccgcaggttcacctacggaaaccttgttacgacttctccttcctctaaatgataaggtttagtggacttctcgcgacgtcgcgggcggcgaaccacccacgtcgccgcgatccgaacacttcaccggatcattcaatcggtaggagcgacgggcggtgtgtacaaagggcagggacgtagtcaacgcgagctgatgactcgcgcttactaggaattcctcgttgaagaccaacaattgcaatgatctatccccatcacgatgaaatttcaaagattacccgggcctgtcggccaaggtgtgaactcgttgaatacatcagtgtagcgcgcgtgcggcccagaacatctaagggcatcacagacctgttattgcctcaaacttccttggcctaaacggccatagtccctctaagaagccggccgtgaagggatgcctccacgtagctagttagcaggctgaggtctcgttcgttaacggaattaaccagacaaatcgctccaccaactaagaacggccatgcaccaccacccatagaatcaagaaagagctctcagtctgtcaatccttactatgtctggacctggtaagtttccccgtgttgagtcaaattaagccgcaggctccactcctggtggtgcccttccgtcaattcctttaagtttcagccttgcgaccatactccccccggaacccaaaaactttgatttctcataaggtgccagcggagtcctataagcaacatccgctgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctgttaatcattactccgatcccgaaggccaacacaataggatcgaaatcctatgatgttatcccatgctaatgtatccagagcgtaggcttgctttgagcactctaatttcttcaaagtaacagcgccggaggcacgacccggccaattaagaccaggagcgtatcgccgaccgaagggacaagccgaccaatgcacaccaaaggcggaccggccgacccatcccaaggttcaactacgagctttttaactgcaacaacttaaatatacgctattggagctggaattaccgcggctgctggcaccagacttgccctccaatggatcctcgttaagggatttagattgtactcattccaattaccagactcgaaagagcccggtattgttatttattgtcactacctccccgtgtcaggattgggtaatttgcgcgcctgctgccttccttggatgtggtagccgtttctcaggctccctctccggaatcgaaccctaattctccgtcacccgttaccaccatggtaggccactatcctaccatcgaaagttgatagggcagaaatttgaatgatgcgtcgccagcacagaggccatgcgatccgtcgagttatcatgaatcatcagagcaacgggcagagcccgcgtcgaccttttatctaataaatgcgtcccttccataagtcggggtttgttgcacgtattagctctagaattactacggttatccgagtagtagttaccatcaaacaaactataactgatttaatgagccattcgcagtttcacagtctgaattcgttcatacttacacatgcatggcttaatctttgagacaagcatatgactactggcaggatcaaccaggtagcattcatcgatcacggcaattccccgccacatcctctcaaacgcaatggaaagagagaaaggacgaggtcttgaccgtcatcttttgcccgaaggacggatgagctttggcgggactgaatcacttcgagtcaccgtcgacaacttttccgcatccgagatatcaacccgcaactcattcaccaatgcgagcaaggcaacaaatgcgatgacgagaggtgaacaagcgccgatgtttgtgcccacgacttccccacgaaggagaagccgcgggcatgggtgtaaaccgaactcaacaattccttcaaattaggtacgaaacacaggccccggaactcatcatcgagcgtaacatcgcccgtgaattaactgagaaggataggtggtaggtagttcgatgcgcgagcatg

SEQ ID NO: 29657 - DNA, 3000 bp, Unknown
  misc_feature (1)..( 3000): 2750-1469P.txt file - cDNA_ID_3020285; gDNA_ID_2214666; Annot_ID_189007
ccgaaaaaggtgtacggaggagacggtggttcgtactttgcatggtgccctgaagagttgccaatgctccgagatggtaacattggagcctctaagctcgctcttgagaagtatggcttggctcttcctcgctactctgactcccccaaggtcgcttatgttcttcaaggttcgtgctttacaatcttccttttgatcacgtcactctctttttaatgttttaaccaaattttttctagatcatgagttttgtttgttctctgtccataaaatatttttgttcagatctgatcaatcataaatcagttgcttatatatatatatatatatatatatatatatatatatatatttttgtatctacgatgtgttagttgtttttttttttgcttgcattaagccgcgatttggaaaacaacaattatatgatttggtaattatagtatactgtaaataacgtaagagtacccacaatctaggaaaattagtttattacgatccaaaataatttaattagggttaatatttcatatattgattagtcctttttgtgaaatatgatatgatttgtagattattatattgtgatttagccaataaatatagagttaaatgatccataaaattttcttgttaccatttttaggagctggaacagctggaatcgtgctccctgagaaggaggagaaagtgatagcaatcaagaaaggagactccatagctttaccttttggtgtagtgacatggtggttcaacaatgaggacactgagctagtcgttctcttccttggtgagactcacaagggtcacaaagctggacagttcaccgacttttacctaaccggatccaatggaatcttcaccggtttctctactgagtttgttggcagagcttgggatctcgatgagaccaccgtgaagaagcttgtcggatctcagacaggtaacggtatcgtgaaggttgatgcgagcttgaagatgcctgaaccaaagaaaggtgaccgaaaagggtttgttttgaactgtttggaggctcctcttgatgttgacattaaggatggaggaagagttgttgtgttgaacacaaagaatcttcctttggttggtgaagttggatttggagctgatcttgtgagaatcgatggacactctatgtgttctcctggattctcttgtgactcggctcttcaagttacttacattgttggtggaagtggtcgtgttcagattgttggtgctgatgggaagagagttcttgagactcatgtgaaagctggtgttttgttcattgttcctaggttctttgttgtctccaagattgctgattctgatggcttgtcttggttctccattgtgaccactcctgagtaagattttattcatctttttcgattgattaaagaacattttggttgtttttacttacatatttttatgggtttttggcagtccaatattcactcatttggccgggaggacttcggtgtggaaggctttgtcgccggaggttttgcaggcagcgttcaaggtggatcccgaggttgagaaggctttccgatctaagaggacctctgatgccattttcttctctccttccaactagataatgaaagaagaagaagagttatggtgtagttgttttatggtttaagcaagtattatgttttttttttcctttggtgtttttggtttgggttttatggaccggtgttttcttctcttttgttatgtgtgcttcaaaataaataagaaatgaaaaaaatatttcttctaaatttattgagaatccatacgattaaaacaaatatttctcttacttctcataagtttataaaatcaagttaaaatctactaattaaataattataccaagtctaatataaaatttacttgcgcatattttattacagaaaacaatatacaaacagattattcaatatattgaaattcttgttaaattcatttttactgaaaattaagttcaactaaaataattttattatctattaaatcataattttaatatttaaatttaaaatttcaaacgtaattaaatccgcgaaatatgcaagtattatgaagttgtttgataaaaagcaaaaaaatgtaatttatttctaaattaatagaagtagtttagtcaaatctaagctataaacacggaacacgtaacagtcagtcgttaatcttttctatccactttaaaatttttataagacaataaatttaattcacacaggattcggttacggtttggttgattggttttcggtgaaagaaatttgtctaaaccaggactcggtatagtggaaatgtaagaaccggaaaatttactttactcttctctcactcacaatgctttgccagattccacaattcaatgccgtcgtctgctctaaagtttgtggctttcatcacgaatttaaccgatcaatggaggtgggattgtgtaagtcttgggtattataatcaaaggacttggtttggtaatggagattggagaaggtgttcacaagacgttcgatgaaatgcgtgagagaggaaaaatgcaaccaacgatcgtgatttacaattagccttattggatttttatgccgagacgataatctctgtcaatcagcgacctttttcatggtaagatcagatcattacttattatgcattctcgtttagtttatattagcagatagatggaaaagctttaagctttgggttatttaacattacagcttagcaattttgaggaactaatattcaaatattgtggagaagttatgattttttctcttcttttatatgattcttctccaaaaccaaaccactagataatgtgaaaaaagtgaccacctgctccatttcatcaactccatcttcttgtattaactatctcatttcatgtatgtatatatactctttgagaatttgattctatcatcacaatcatttacttcaaacaacaatctttgcttctctctgagtgatcatctttcttgttcaatg

SEQ ID NO: 29658 - DNA, 3000 bp, Unknown; identical to SEQ ID NO: 13902
  misc_feature (1)..( 3000): 2750-1469P.txt file - cDNA_ID_3020310; gDNA_ID_2214666; Annot_ID_188998

SEQ ID NO: 29659 - DNA, 3003 bp, Unknown
  misc_feature (1)..( 3003): 2750-1469P.txt file - cDNA_ID_3020339; gDNA_ID_2214667; Annot_ID_189042
gtaactattcatagcccggtggtgggtgatgcaaacatgtattaatgttttagcattccagttttgaatagttgcatctattttcaatatcattttataaatattatattgtctaaaatccatttatgattgatatgatatcccttatttaactcctttgattaaaacgttatacatatcttatcaactttagatattgacttttccatattaaatatttgatttccatatatttgattgtgttattattatttttactaaaaacgttgcaatataatttttctttttataagattccatatatctaaatctttgtgttattattatctaaatctttttataagatttgcatatatttgattgtgttattattatttttactaaaaacgttgcaagataatttttctttttataagattcttttctctaaatctttgtggtatctaaaaaaaaaaaaaaaaaaaaaaattgttcatggttttgccctaattttgcacgaaattattttacccaaatcttgcacgaattcatattaccctaaataaaagttttgtcaagatatatgtaaaatccagattttgcacaaaatagttttattctgattggttttacaatattgcattaaaattgtattagtatataatacttgattattttatgaaataaattgattgataaataacttaatttaaaggtataatcacttatagaaattttcatgaatgactagtttaatgtatcttaagaagatatcatatttttgatggtcaaagttttttcaagagcttaaattatcaccagaagttgagaaaataaatataaaaaaaaaataaaaaaaaattctaacgatgaaataatctagtatatcaagtagtataaaatcttattaaaagactctagaagagcatatacattgttttctatgggaatacaaaattaaaatcatcgatgcggtatagttctccaaatctcaaagttaatatgatgagatataaatacattatgattctagagtggaatttaatacgagatggatgaacttgaagtttcatcatctcgagaaggagaagtaatgaatggataataagtgacatatccagaagattatgttcaatctttgactactaaagatctaaaagttgtataaagcaattcttatatgaatgtgttattagataaaataaattataattagttattactaaaacttcaagacttgaagtctctttttgaatataactcacattgttaagagaatatttctgatgcgcagatggtaaaacagaagattaaacttttacgcaagtatcgttgtcctgtagacacaatatttgaaagaaatttaagaactattatgaacttaaatcgagtgtttttcaaaggctaaaaaaaatatatgagttattgatgataagtaatactcatattctgaagtgaatataagatcttacatagctagtcaaattaaatttaatatcgtttatattagaatctaaaattttaattattatctcgttattgttttattaacatatgattgattattaaaatacatggaagtaattttgattataagatctcattaagggagtaactgataagcaatgaaaagtaaattagaagttttgaaagaactagaagtttcaaaagaattaaaagtttcaagagtatatttggcttaaccggattggtcatcctggtttaatgatgatgtgaaagtattgagaatgctccagaatataatgagtgtcctgtaaggaccaatttcaaactgctatcgagtcttaagatcgcatgaagcgtaatagaccttggttccaaatataaatattctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagctatgtcatgtcaaaatataatggaatcaaaagcaaatcgacgtcgtaatatatttgcatgctatgagcagttgatattatagacaaaaaggaggatcatgaaagaaagtctattgaaaagtgtacacaaagtaatgattagccaaaaaatggaaaagaagaaatggacatataattataatttctaatagagatatttggactagtagtctatgcacatgatgtgtaaaaccagtggaaaataaatgagtctttatgtgaaagaatagtgaaattcatgagattttcacaaagataagaaatgtattatgaagagatatattctcttgtggtggatgtaatattttttaagtatctaaagtctggcaataagagacggaacactggatatgacatttatatgaaattcttgaaagatataatttctgaaggattaattatatgagaattatgttctctagaactctactcgatcgaataaaaaaaaaaaaaaaaaaaaaatatgtaacatgacatataatcatataaatgtatatttatgttgagtttgtcaaaatctattgatcaaactaatatttgttttgaaaatcattaaaactcctacagagttatcataagtaattcgatgacaataatctatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatgcgtggatgtaccctttttccttatgatagtttttatcccacatgatttttctatgacaaggtttttaacgagacattaaagaacacgcaaataatacacttgatgaatattaggaaattctatcaatcatccaatgaatattatacactaatgatatttagagaaataaataagatggtcaagatgaatcatctaaaagattcatgagcagcagaagaatg

SEQ ID NO: 29660 - DNA, 3000 bp, Unknown; identical to SEQ ID NO: 13906
  misc_feature (1)..( 3000): 2750-1469P.txt file - cDNA_ID_3020341; gDNA_ID_2214667; Annot_ID_189041

SEQ ID NO: 29661 - DNA, 3000 bp, Unknown; identical to SEQ ID NO: 13905
  misc_feature (1)..( 3000): 2750-1469P.txt file - cDNA_ID_3020353; gDNA_ID_2214667; Annot_ID_189036

SEQ ID NO: 29662 - DNA, 3003 bp, Unknown
  misc_feature (1)..( 3003): 2750-1469P.txt file - cDNA_ID_3020384; gDNA_ID_2214667; Annot_ID_189025
gcgttcatgaaaaagttattaaagacatattatagcatttttctcgtgataagaatgtccattgtagtgtaaaagacataaaaaataacataatacacataaagacactaagacttctaaaattcaaaagactcacttggacactaaatgcaacaaaactcacaacgaaaaatactatgacaaaaatcatatcttttatatattcaaattcattattatattttccaaaatattgaaacaaacgagatcctatgtagaatgggataacgcaacaaacatcaaattacgttttttaaccataattaatattcataaatacttcttaatcattaatacaaatatttttattaatatcataattaaacataatatatcatgttttcggttaatcctctaaatttgctatgattagtttctatgaattgatgaatttctctgcgtatcaacatgtctcactctctagatatcaacgattttaacattggatgaattattgtcaaatttattaattcgattgcaaaattacattgaaatatgatataataaattaaatatataaaattacaaaataaacttattaaataaaatatattataattataatttatgatataaattaacaaactaaaatttctacacatatttctccacgatgtagagtgtgggttcttatttaatgatcacttataaaggaaaacgaatgagggacaagtcagtacttaattactttagttagttatattttaaacaatagacatgtcgaatcttttaagttaaatgcatataatggatcgaacttggcgctcaaacgtatccaatcttttaattaaagtttagccgcatcactctctctctctctctataagttcattctagggaagggaagcatccaaacttggttgcgacaagacaaatgctaaggatagatttaaactaaaagatatgaaaattttgtattaaacattgtatttttttttactgcgtattaaacattgtataaatatttttttttaatataatttaccataaattaaaataaaaaagggtttacgtgtataaatctaggttacaaaaataaacaactcaagttaactattattgggtttaaattatataaaaaaaccaaaattttaaaaaccttctcgcagtttctgctctcacttccaatgaacaagttatatataaaacactaacaatatttttgttatgactaaactctttccatttctttgtccatgttccaccactataaattacgaattatagcatcgcattttttcttcttattctatgctcttataatccataggacccacttctacatgattctcctacaaccccattataaaacccttggtccacttcctcctcttacttcaaaactaacttcccaattcttcacacaaaataaaaacacagaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaagtgtccaactttatcagacaaaacgtaatctattaacacaatcaaaagcagaaaattttggtttttataccttggagagtgttctgttctatacagtgactttgaatccgttcttcaatatattcattgacatggactttcccatgattcccaaacccatagaaaaccctacttccattttatctatcttctgcgattatagacttatagtgcttactgcttagtgataatggtctaaaataatgagacatttctaatcagggagccattatcatcaaatacttacttgaaaaggaagtatttacagtttactccctaaactttgattctttttgcatctctaactggcagtttaagaacgaacaagatttcgccacgtgattgaaatttggctaaaactccagtgtcatttggaatcttattttactccagtcgggcacgttagaagttctcaatcaaatttatttgcggagtactaatctgaatttacaaaatattattcattttatctgatagtttatgaaatgtcaatttagtccatgcttctaatctattgacaattttttttccttcttctatatatatattttttttttttggttctgggccgaaatccgtaatattagttttgcctagagtctttaccaattaagctaacgacacttaactctttctttcttctattcttgtgcttctacaatgggaagatcaacgtaaacatattattactaaagtttacatacgatagtaaacataactataatgggaagtgcaagtgtttttaattttatttgtaggtataaaaatatgctatatctcttttttgtgtgtgtggttggcaaatcttaggctcagcctttttcacatttgtctcttgttttatttcctcttcttttttcctttgcttttggtccactaaaaaacattagtcttgagtttgaggcaaaaaatggagaaaaactgagaattttgagaacaacgaatcttgtaatcgttgaagaagctcaattacagtttctgtttcttcctaattatg

SEQ ID NO: 29663 - DNA, 3000 bp, Unknown; identical to SEQ ID NO: 13913
  misc_feature (1)..( 3000): 2750-1469P.txt file - cDNA_ID_3020444; gDNA_ID_2214668; Annot_ID_189065

SEQ ID NO: 29664 - DNA, 3003 bp, Unknown
  misc_feature (1)..( 3003): 2750-1469P.txt file - cDNA_ID_3020630; gDNA_ID_2214671; Annot_ID_189118
tgcagaaccgctacataccacatatgtaaacaatttttttcaagattggttcatctgagtcataaataatatttaatgacaaaaaaaacaatattttaaagtatttgatttgttgttgaattatttagattattaagatttgttttgtattttaaggagaaaattgaaaagatatggaagttgtaaaaatttgcattgaccatttgaccaatctgggtcaacaacaaacgaagaaacaaattaaaaaaacacaccagcttatctattgttagttttttttttttctgttttcaggtgttttcttaaatcacaagctacaaaccctatatttatcttctgcaacaagtcagcatcgaactctcagatcatttatcaattcatcttcttaatttacttgaccctttctctttacacgataatggcgagagataaagaagatcaaaacaatgagaatccttcaattgtccagaacatgtcatttccattcaacaccattttcttgatctcaagcgcaatcttcctcgtcacagccgctttctggttcgtagccgtcatgacattacattacaggaccgatgaatgtaaccggttcgtcacaactcccggaatattcataagcttctcattgcttgctatgtccctcactggattctacgcagcttacttcaaatccgattgtctctttcgaatccacttctttatcttcttcttgtggatgttcgttgtcgtgtctaaagcaatctttgtcatctttctacataaggagaccaatcctagattgtttcctgggaccaagatttatgagtttaggtacgaggattactcaggatgggttagtagattggtcatcaaagacgatgaatggtatcgtacaaggagatgtcttgttaaggacaatgtttgtaacaggctaaaccataagatgccagcttctgagttttatcagatgaatctaactcctatacaggtaatataacctaagctacacattaactaaatcaaaccgaatctagttttgattccggtttaatgtttttttttatttcattctaattttgtttctttttttatgacagtcgggttgttgcaaaccaccactttcatgtggattgaattacgagaaaccaaataattggacagtttcaagatattataacaatttagaagttgattgcaagagatggaacaattctgcagatacattatgcttcgattgtgattcatgtaaagctgtgattattgctgatgtacataatacttcattttccataacagttaacattattcatatcatctttagtctttgtatcggcatgaccggttggtttgcctggttaaggatccttcgagaaagtcagaaatagatttgtacacatatgtaagacacatataaataaattgtttctttttattatttcttataatttatatcccttgctcaaaaatcgctaggcgctagttgggcggtaagggtgagcctaacgcctagtaggaaaatcggagattatacgggattaatcggatattagttttagggttatttcatatttttaaaatatattaatccattataattaagaaaattatataatattgttttttaaattgtattaaacacatgaaaacaagattttctattcaaatttataatttttatacaaattacgaacataagttggatattttaaattttaaattttaaaatgaaaaaaaagaaaaaataaaaataaaaaaattgggctagccatcctctagacagatttaggcgggtctaaaccgacaaaaatcggatcaacgattaattttcccaatttagacaaaatcgttgcagactccatctgatctctatgcggccgattttttgaacaaggcttatatgtatacaatcaatttaaaccgattgaaagagtaaacaaaaggttataattttagtaactgtttgtttacttggttggattggactgtccgtcacctgccatttctgtctttgcacttaggaattagaaagtttatatgtatatttttcctggacggccactgaatttgtggatgtaatatatgagtttgtgtatcactgtattgtggataaaaagatttagggctaagcgttctttagaaacacagactgaaaatgtgaaatgaaagcatgtttgttgatgatttttgtgaattacaaaaagaacttagagaggatataatgtaaaaagacccccttcttcataattgggccttagttataattcccttggaattttatggtatgagttttttttgtttgacgagatccaacgccaacaaatacgaagctaacaaactctctcatctaacaaactatttctaaagttacttttttatttgtttcaatatatcaatcaatgaatataaatataaaaataaagaaaaccaaactattgtgatatcatataacaaccaaaataataaaattttatccaacctcttctactatatatgtatttaatctatatatagtccaattatagaaacacgagaccggcatgtacgcatttctgtttcccttctatctcaaaccccaaacgttccaatttctaaatacagttctctactttagtaatgtttaataatgtttctttcaacatttcagttttctatacccgttgtgacaagacactcaaattttccaggacttatgtttgactattttttaggcaaggtaaaaaattgcataagtctcgaaacttttgggtgttcgggcggattggttagttagaaactaatgcacgtcagcctctgaggttccgtgtaatagattctcatgttgtcctttaaaaatgaaactcttccctttgattctttttgttcccaaaacacatttttctacatcttagagtcttagagaagaaaggcaagataatcaatctcatggcgatgtcgatctccggagctgtgtttaatggtttgggttcttcgttcttgatcagtcgaggcaagagaagcggcgttggacttggcgtagtagctatg

SEQ ID NO: 29665 - DNA, 3000 bp, Unknown; identical to SEQ ID NO: 13922
  misc_feature (1)..( 3000): 2750-1469P.txt file - cDNA_ID_3020634; gDNA_ID_2214671; Annot_ID_189115

SEQ ID NO: 29666 - DNA, 3000 bp, Unknown; identical to SEQ ID NO: 13928
  misc_feature (1)..( 3000): 2750-1469P.txt file - cDNA_ID_3020680; gDNA_ID_2214672; Annot_ID_189133

SEQ ID NO: 29667 - DNA, 3000 bp, Unknown
  misc_feature (1)..( 3000): 2750-1469P.txt file - cDNA_ID_3020689; gDNA_ID_2214672; Annot_ID_189128
agagcaaagaagaacattgtgtacattgtgagtcaatcttaaatctctcgattcctcacatcacattagctgtcaccttgggcggtgaacgctaattatttagttattgatattattaatttgttcctcgactctctcacaacgctttcacgttcgttcagtcagataacattttttaatgtaatgaacaaagcatgcttggtcttatactatataacatattcatggattattcagtagttctgtatctgccccctttgtttttgagaaacaatggcaacaatcgtcgttgactttcaaaaaattcattttcatcctcagatcctcttatccatattcacagtcatttgcatctttgtattcttcttcaagaagccaaagggctcacgaggctgtgatctgcctccgagccctccttctcttccgataatcggacatcttcaccttttactctttgatctacctcacaaagcctttcagaaactctcctctaagtatggacctcttctctgtctccgcatcttcaatgtccccatagtcctggtctcctctgcctctgtggcctacgagatcttcaagacgcatgacgtgaacatctcatcccacggccaccctccgattgacgagtgtctcttttttgggtcttcaagctttgtaatggctccttatggagattactggaagttcatgaagaagctcatggtcacaaagctgttcggacctcaggcactcgagcagtcacgaggcgcccgtgcagatgaactagaacggtttcacgcaaacctgcttagtaaggaaatgaaaagcgagactgtcgagattgctaaggaagcaataaagctgactaacaatagcatctgcaagatgattatgggtaggggttgtttagaggagaacggtgaggcagagagagttaggggattggtcaccgagacatttgccttgtttaagaaacttttcttgacacaagtgttacgcaggctgtttgagatactcagaatctcaccgttcaaaaaagagacactggatgtttcccgcaaattcgacgagcttcttgaaaggattattgtggaacacgaagagaaaacggactatgatcatggtatggacctgatggatgtgctgttggctgtttatcgagatggaaaggcagagtataagatcactagggaccacctcaagtccttgttcgtggtaaattctcctttcacttggtggattcattgagaaatccaatacaacaacattaattgtcctgtgtttttttttattacaggagcttatccttggaggcactgacacctcagcgcaaacaatcgagtggacaatggcaaagatcattaagaagcctaacattcttgagagattgagaaaagaaatcgattctgttgtaggcaaaacaaggttgattcaagagaaggatctaccgaacctcccttatttgcaagcggtcatcaaggaagggctaagattacacccaccagcacctctcttgggaaggaaagtcacagatggatgtacgattggaggctgttacgtaccaaagaacacaacacttgttgttaatgcttatgccgtgatgagagatcccgattcttgggaagatcctgatgagtttaagccagagaggtttctagcttcttcaagaggaaaagaagaggagagagagcaagaacttaagtacattccttttggcagcggaagaagaggatgtcctggagtaaatctaggttatatatttgtaggaaccgcaataggaatgatggtgcattgctttgactggagaaccaatggagataaggtcaacatggaagagactgttgctggaattaccttaaacatggctcatcctcttaggtgtactcctgtttctcgaatgcaactgcagaaatcgcagttcgtgagttcatgaattttgattagtaaacaaagaagctttgcattttatgtttccatgtctaagttttttccggtctagttggttacttttggtttattgtgaaaacctataaacagttgtgtattgttcttctgttgagttgtggatcggtttcatatttaatgactttcaattttattttatttttttgtcatccaatttttattagagctcaaacaagtcaaacctgaggaatgttgtttacataagtgacatgaagcggttcagtgcaaactttccgcgcaaattatccgtttttacatttgcacattacgagaaattaaagataaagagaaggttgtgaattcttcattgtcgctctgtagttcctctagataaactaagaccgccgaccttttcggttgaagaagataccatcttcaccaaatctaaaaagtctgtaaaaaatgctacatcttagttgtcgaaaccaattatacacttcattgccaagagtatagctgactttcaatattatgttccttaatttaggtttatgtccagaaaggaagaaaatgtcaatttatttaatttttattttaaaaaaatctttgaagaagatgctgaaaattatttattctaatatggaaggaaacaatatttccaatttacaatatgaaattttttaaagaaggtttcctatttaattcaattgctttttgaagtaaattctgtttcaaatttaagtctaaatttgtacttctcaattaatacaagtaagttatatatagactatagagtatagaggaaaagatataaagacaacctcatttcttggcgtgttcaacctctttagtctttccaaagcgttactacacataaaagccttttatcttaagcatacgcttaaccaatatcacacataaactgaatacattaatgtaaatatgcatgtatatattaaagttgttcttatgattttttcaacaaagttgatttcataaaacggattgatgatgtatctaagtcggagaatgcagagcggaggttttgcggtgtatcgacagggccttgcggaagtcttacaaatatataacaaagttgagaggaaaacatctatg

SEQ ID NO: 29668 - DNA, 3000 bp, Unknown; identical to SEQ ID NO: 13937
  misc_feature (1)..( 3000): 2750-1469P.txt file - cDNA_ID_3020720; gDNA_ID_2214673; Annot_ID_189151

SEQ ID NO: 29669 - DNA, 3000 bp, Unknown; identical to SEQ ID NO: 13936
  misc_feature (1)..( 3000): 2750-1469P.txt file - cDNA_ID_3020724; gDNA_ID_2214673; Annot_ID_189150

SEQ ID NO: 29670 - DNA, 3003 bp, Unknown
  misc_feature (1)..( 3003): 2750-1469P.txt file - cDNA_ID_3020759; gDNA_ID_2214675; Annot_ID_189188
gaaaagggagaattacgatggtcactacaagacttaacaaaaatataacgtaaattcaacataataactaaaagataagcactctttcaattattatgatcataaaatgacgccaactcacatatgtacatatgtcaccttcttctaactctcactataattcattgtttactagataaattttctttttctttttttgtttccttgtaaggagtaaaagtatattaaagttttcttacaatccatgaatgtaagaataatgctaaataaaacagtatttcatcttaaacattccactcaaaaccatgcataattaagaccaaaattcgatggatactgaatattgaatatgcatacgtttttcttattaaattggtactgaatattgaatattgaatatgcatatgtatatttaaatgttgatatacaatagaaaccttgtgttttatttatacgtttactgaatattgaatatagttaggaaaaatttggactaacgatacagaaaagaaacgcaaaacatattgggagacagttatcttattaagttattattccgtctgacccaaacaaaactataagaaaaattaacatcatctgatagcttctttacttgattagggagatgtggattagagttttttttttttgaaaacactttatattagatttaactatgaaaataattttcagaagcaatgtgagatgtgaccgtgagattcccgaatgataccatgatggccaacggttttataagtaccataaattgagaacataatacaaacactaaaaacgaatacacacagttgatccatttcctactttttagtctctagacaccaaatatacttactttaacatgtacatgcttcctccacattcagctaaatgtggtttagatgtcttgatagttcgacaagatgctttcatatgtatggcggaagttagaggctttgttcaggttctcaatccttatatcatggtgttggatgctatgcaaattgatcgtatgcaacttttatttgactattagaatctaaaatggtagttctcccttgcaaaaaaaaaaatcattagattctgataagcaagaaaacccaatccctcatcaaaacatgatatagattcataagaagaattttattgtccattttaacttaacattggcgtcggtgttttgctttctcgtccatcaacgaaaaaacaaaaaagagaattatatttgttttgacttcacatctaacatcactggtttatatatgtgtaattatcttcagctcggacaaaaaaatatctaagactagatgacacatatcaaaaagaaaaaatataattaaattgaataaatatagaaaatagtttattttaattttagaggaatgacacatatcgaaataatagagcgccacttgtcatttcttaaagcatgagtttgagaaaaccttactttattatattagactagatgaatacccacactacgcgtgggtttgtttcaaaaattgttaagaacaaattatgttgattgttcttgttgctaatttttgtttacttttttatatgttattgtttagttaataaagttaatcttatgtagttacaatttgtctgattggatttttttacttaaaatatcgatttatacatttatatatatatatatatataattatttatatttctaagatcctaatattttttcactatcatgaatacatacatcgataatataagatttttttatacaattatatgtaattatgttatttgtgtgatgtgaaactcgcctaacatgattataaatataatttcttgttttgtgtactctcctgatctagtacttccatcacatcgtgatagactcattattatatacaggatagacatatattgaataagatctcaagagttttcatatgaaaataagaaaaagaaagcaaaaactaaaatgtcatttaagtcaacatttttatatcgtctactattgcatatagtcatataagagaaaagtcgtgtcttgaattctttggtatgtccaacgtctcaaaggttcatcacttgaaaaaattacagaacttaccaatattaccaacttaccataagacacaaaataaaaaagatagaaagtcatatgttgagtcatatatgaacaacaaaacataataaggagaaagactcaaagtaaaattactaaactaataagtatttatacggtagcaaacaactaaattacaacaataataaaatggttactattgataaaaactttttagtaaaaataagaagaatataaagaaagtagtgctttttattaacataattttgtattttttaaaaaacattttgattaaatcacttaagagaataaccgatggaaaatttaatgttataaagaacttttattttttctcatttaatttggctaatttttaatttaaataatgtagaatgacatatgttatttttttgtataatgatatgacactcatatagagaaaattggccttcgatatatatgatatgatgtttcaaaataagtaagtatatatctatgtacatttaatttgtctcttacttttcaaattttagtaaagatatgatgtaattgctacattcaactaaagatataggcatcatcgtactaaattgttgttactcgtccaaaaaaaaaagggaatgttacactattaggcacttttagaaaatctttttacgtttgaggcactttctaagattcaggcacttttccttgtttctggaagataaaaggacaattatatcctttcaaaattaaaacataaattgcttaaccagttcaattggttttgttttctgtgttatctaataaaacacacgtgtaatacatgttctttctatttcgtgccggttgagatctcgacatgagaaagggagtaatctcacaattacagcaaataaatggatattttttaaaaataaataatatatagtgtcgctcttcatctctaaaaccaaattcttatg

SEQ ID NO: 29671 - DNA, 3000 bp, Unknown; identical to SEQ ID NO: 25403
  misc_feature (1)..( 3000): 2750-1469P.txt file - cDNA_ID_3020798; gDNA_ID_2214675; Annot_ID_189175

SEQ ID NO: 29672 - DNA, 1251 bp, Unknown; identical to SEQ ID NO: 13941
  misc_feature (1)..( 1251): 2750-1469P.txt file - cDNA_ID_3020811; gDNA_ID_2214675; Annot_ID_189167

SEQ ID NO: 29673 - DNA, 3000 bp, Unknown; identical to SEQ ID NO: 13952
  misc_feature (1)..( 3000): 2750-1469P.txt file - cDNA_ID_3020828; gDNA_ID_2214676; Annot_ID_189203

SEQ ID NO: 29674 - DNA, 780 bp, Unknown; identical to SEQ ID NO: 13949
  misc_feature (1)..( 780): 2750-1469P.txt file - cDNA_ID_3020832; gDNA_ID_2214676; Annot_ID_189196

SEQ ID NO: 29675 - DNA, 3003 bp, Unknown
  misc_feature (1)..( 3003): 2750-1469P.txt file - cDNA_ID_3020853; gDNA_ID_2214677; Annot_ID_189218
gacaattaatttgctaaatcattttgctacaattaatttcttagagtgaatatcactacaagaaaacaattaatttgcaaaatcattgtgaagtaaataatatttcacaaattcatcgtaaatttgtgagagatctgtttaaaatgtcacattcttagctagtgaggaacatttatagtcctttggaatgtgttgcttgataagtggagactgtgttccatttttcttcacaaaaaataatgctaagacaaagatgtgtgttcagatgtttttggtcactcgcaaaacatgaatcaaacttttattttttcccgaaaaaccaatttgaatttgttagtaagagcaccatcacaaaaatcatgaaagagtgtccatctctggaaataaaagcaccttcattagaaatatcgtaataaagttttttacaataaaaaataataataaatgaaggaagaaagcaaggaagatttcttaaatgagaaattttgagatacctataagaaccctataaaacacttgtctcacatatattagttcaatttttattttaaagttatgaaaatgttcaattaacgcacaaatagtgcctttaggcaaaacaattatcgattgagaaggagaatgagatatttctttagacatacaaaaacacattaatcgtcacatttttcttacaaagtgcattcaaaaatggctttataaaagtcaacacatttggtaatgtaaccacaaatgtttacgatatccaaaggagcatcatattagacgacctaagtacctgaatttctgttttggagtcatatagcttcattttatagccttttttaattacggggtaaaataaataaaatatttaataatatttattatgtctcatagttcattgcatatattgtaggccttcgaaagaagaataaacataatagtaatgtaatccttttgtaatatagagtgtatcttttgatattgtgacaacagcaaagtatgtcagataatgaccagaatatggtgtgtattccatatcgatggtgtggatgtgacgtgcgtcactaatattctcggaacctgagaccgtccaacagtactctgcaattttgattaaaatgatattcttagaagaaatatatattttatttttactcaaaactgcaaatgttgctcgacgaatatgaagataagtgatcgttctatctggctttagttcactgattatatcaagtttttcagccaagtctcaagggatgttctagacatcaaaataagacaattattaagatcaaaaatctgacaactaaaaggtatataacaatattattcatctattatatcttgattcttcttagtaaagtttcaagtaaatgaaaacaagattgatgtataaacttagagtacaagagctttgtgtcatttatataaaagaaatgctagagaacaaatgagaaaaattatttgggaagaagtgctttctagatcctctaaatcatatatatatatatataatcaatgtatttaaacaaataaatagaaacaagacattgtttctatgcacttgcaagtaaatgtgttttacacttcactaaagcttcccttaccactagaccacaaatgattgggcgtgagtcatgtttctgaaacctatatcatgtcttgattgtacaaataacgcatgattaagctgtagattctgaaaatagaatatattgaagctttccacagttagggccggctcattgggggtgaaaggggagcaatatttctggatctaaattattttgggtaaatttaaaggtccaatttttttagtatgaaaaagtgtcattttgaaagatttataagaattttttagcatgaaaataggtccaaatatttttttagtatgaagaaaggccaatttaaaagagttttaagatttattagcataaaaagggcacaattttttcttttagtatgaaaaagaccaatgtttaagatttgtacatggactctgaattcattgagctgccatagtgagtaaaatttggaaacaaaactaaaaaaacataacaaaatatctcgttgaattcaatacaaaaagcatatacaaacacaacaatgtaacaatttcaaaatatttgctcttaagaaataaaaatcttcaaccttgaagagcatatgttagaaccaagctccttctaccaaaactatataaaacaatcgaaatagagaagcatatgtaccaacaatgtggctagcgggtaactactcgtcaatacattaccaatataaaaacaaagtctgtcagaaacacactatattctggttagtatctaacaaactttgatgatgttagaaaatcaaatgatagactccatattacaaagggactacactgttattatggctattcttctttcagaggcccatactatgcaatgaaccatgtgacatattctcttcattcccatacatggctacttaaatgttttaccaatcagaaatttgtcgttctaatcacgtaataacctttattagtattcacccgtttttttaaaactccaacattcgcattctcatccgctgcgtttaagtctgtcgagcctataaccccctaaaaatgccataatcttcttaccaatcacaattgatatcatcattttgaacatttcaaaattctcccgttgggcttagaccttaattaatgggtctaaagtagaccacatatctaactatgagttgttgttgggctttggaaaactacacacgtgtgagacaatatctaccgcacgtgtcagtgcaaggcgccaaagccaccattatccttccgttatcgtctatcttctccaccttcccggaatccaattcaccaattcctaagcattcttcagaaatccgagctgctttttgccacatctattcgcttcgaatctcttttcaccagctcaaaaactgtcgctttcaattccgctcgtttcgtcccaccgctccgtgtattgctgaacttcttcatagcaactcaataccatg

SEQ ID NO: 29676 - DNA, 3003 bp, Unknown
  misc_feature (1)..( 3003): 2750-1469P.txt file - cDNA_ID_3020864; gDNA_ID_2214677; Annot_ID_189215
ttgacaaatgataacatcatagtcctgacttcaaacaacaatgtcatgtcgcaggaaactattttttgtttgaatctaatgttaaattatattcaaagaaaaaacaaaagtttacacatgtttaatgcaaaaaatttcgtaacttttagtttaaatctatccttagcattgccttgtcgcaaaccaagtttggatgcactccgcgagcgatgagtttcctccccttgtgccgtagaactatttgtaatgctctgtagtatttgaacccaagtatttttcattttaaccttctttgcaaccaaatgaaataaattatatagcctcataagattgagccaacgaatctcttgaagcactttagcattgagagaaactcttctagttgatgcaagatattcaaaaaatagatattcggatggcaacaaatctaaactttatactatataaaaagattttaacccgcaatataccgcggattattatctagtatagaagtaataatcttctgatactcttcctcaaaaggtcaccaaacatttagcatctaacatatatggtagagcagccaagtaaacatttcccaatggccaacaaaatacaagtctaagatattaagtagattcgaacacaaggtgacatgaatttgaatcccagagcacaatagccaactcgttgagcatctcacgcctcttctcaaaatcttcgagcttttcccttccgatgcgttttgtggagaaagttgctttcttcaaccgtcttgcgttttctaggatgtatgtggcaacttctttctcatcacctcgttgccattcatatcctatccacaagaatgtctcaagatggaacaacaaacattccggtgcacattttggtggattccattttcgttcgtccggatttgttttgttgtcatgcagatatacctgggaacaatgcagtttatgtcatctaaatcaacaaattacctgaaagtggagttgtggaaacaaacaactagtgaaattgcttacatccgtgagcttgaggatttgtagtttaggagaactatcaagcatgatcgaaagcagattccaccactctctttcgtgtgtaagtagctctagacagcctagttgatcgaagattttaccagtaggaactttaacctaagtacatttccacaaaacagtgtaacattgttacatacattttagatacacaaaaacagtgttagcccaatttgcagagaaaataaccaagcgaaaatgttcaatcttaagcttacctcaaggggtgataagtgtaagataagacgtttggctgaagttagagactccagaatgttctcattggttataccagaaacgttactgatttttgcctcctctaactctagtgccttgtcaatcaaacaagactcaatatcaataaccccgttgatgttcaagtatttcaaaccaggggcatttatcacatagcttccatttccataacctccttcttgtctaagatcttctatggtcaatctttgtaatgacggcgacgcaattgtgaaagtcgccacatcggcattgctatatctatgcacgaccaaatcttgaagactagggcagccacataaaagattgcaaacagattcttcgtctttgaaatgtacttggtcaaggtatagctttctaagagacttcaaacaaacccgagaaggaaagtctaaatcgatagcacacttgagtttcaagatctcaagtgaatcattatagctaaacaaaacactaggaagcgtgacagtttgatcctcttgatagaaactatccaataccaatttacgcacaccgcgagcaaatgctgttgcaatccatattccaacatgcaaacaatctgttctaccttcaaatgacaaatgcaaactctctagaaccggagctttatgtaaagacaaagtcttgtaaacattctctgaaaacatagtgggatctatgttatcatcatcaaacacaggattgaaattggaatcaaacttgagttttggcaacatagtccaaagagatctccaacgtttagacaaaacactcgtggctatggcgttttctgtcggaagtgaagacaatatctgtagaagcaaagcatcaggcaagtcactgattctgtcctcattcatagaatcggttttgctgtcaaaaatcaaaggaaaaaaaaaaagttagggttcaaagagttagggttggatctttataacagctaagaaaaacataaacgaaccaaagatacttacaatttctgttccattgaaattaatagaggtaacaattcgctaagaaactttcagattttttttgcataaggaacagctccaaacaagaacccggctaaagctaagcaatgatggaatcactttgggcaaaattcagggttttgtgaataatgggtaacagagtaatctgcatgaagaagaaagatgttgttatcagaagtggaggagattgatccagaagcaagagaatgaatcgttcacagaggaagttgattgctgttgaagagaatttgcatcgaagagctttgtctatggctattcatcaagctcaggtgtctcagagatttgatggatccatgtctactagcgacatacatacatgatctgaagaagaaagaggacgaaaagtgaagtcgaaatgaacgagaccgatggttaagaatcgaatctaatcccaacaacacattcacatgcaaaacgaaaaagaagtctttctttaaatgggcttttttattcggccctttataagtaaggcccaatcgtacaaagaaaaaagtattatagaataaatattaatcgaccggttaatctaattaatcaaatggttaggcctaactatgtttgaaatttcatttacccgatttaatcaattcaatcaaaatcaaaatgttcttccttctcagtactgttcaaattaaaacttaaaatgtctgcatttcccgcacattaataattcaatttcaaaccctaaaaattcgaaaattcccccaatg

SEQ ID NO: 29677 - DNA, 3000 bp, Unknown
  misc_feature (1)..( 3000): 2750-1469P.txt file - cDNA_ID_3020870; gDNA_ID_2214677; Annot_ID_189213
aaagtcttcagctgagataacttctgtttcacaatggactttaaagggattattatctttcagaaggatatgagcagcactgatattggttctgttttgctttttgttccgcacactgtccttctctctttgttgagcagagccattcaagaagcctgtatcggtaagtaatacgctagattctgcaagcagggaatccactttctcagataatgtattcatagaacaattactagcatattccttggtcacatttccatccccagtctcagatttttcgatgtctttactatgctgctcttgatcttgaagaggaacaaaattctccgatgctgacgttgttgcatttgacaaatttgttggagatgacacaaacttctcaggggtgctggctgcctgatttctctgttgttgtttacagagcagtgaaccttctatctcagaattagtatttccttctggacttctccgtgcaaacacatcgctaatgtcaacagcaggaatcaatgcaccgcaactgtgttgatctggtatgcctttcttttcagaaactggtggcctgtcatcgctagtgtcaacagcagggctcaatgcaccactactgcattgatctggcaagcctttcttttcttgaactggtgttctattatcatcgctagtgtcaacggcagggttcaatgcaccactactgcattgatctggtatgcctttctcttctggaactggtgttttattatcatcgctagtgtcaacagcatggctcaatgcaccactaatacattgatctggtatgcctttctcttctggaactggtgttctattatcatcgctagtgtcaacagcatggctcaatgcaccactaatgcatttatctggcatgcttttctcttcagaaattggtgttctattatcatgtttagataacaaagcctccaagttggtaatgggtatatccgcatgcttatccctgagtacacctatttcttccctcccaattgatggggtagtcagaaaacggtgtccggataattgaagctttgatttctcaattctttgagaaagagcagaaccaggtgacggtggaatcaaaccaagtctggatttgcttttctgaatggttgacaagctctcaactagtgcccgagtctccctgctcataaagcttccaccctgtgtaggggaaggagtaacacaagataaagactgaggcaacataccaactaaaaacgcactttgccttctaatagttgacgaggaaagggaagcctcttttgtgtaacgttggcttcctgattcctgcagacctatgggaatgcatccatttggaagggacgaggaaaaatcatcgataggtgatcttgcttccacagtattgtcttcaggaagcaattccttgctttcatctcccattagagctgctagtgtaggagatagatacccgtaatcatatctccgagaattttcaccgacgatactcatatcattcgagtctctaccaccacttcctttatcaactggtacaggtgattttggaaatagcttcttaggttctgttaacaccattgcacttcctgtatcagatctggaagtaacctcagttggtgttttctcttctactagaagatggctactcgtaggggtccttacatctccagactctgacctagcaagactccgaaaatgcatcgaaaacgccgtagaatccatcgtcatttcatggtgttcttcagagataggagtatccaacaatcttccaggattaataaaatgggaagacacaggaccgaagaaattatcctctggtaacgaaaacaaaatcgattcagctaaaaattcaaagaacaaaaccctaaattcacagagcaattgaagcgtaccgttatcacttgtagcggaaccaacagtgctacctcctgaagatggagaatatttcggcctcaagaatgatttatccaagataggttcgtattcaccatcaccatctccgtcagtatcttcgcggtcagataattcaccgaaaaacctaattactttattatcctcatcaggctctgatgtatcaccaccgttttggggtttcgcggcggaggtattgggcggcgtctcgtaatcttcgtcccggttgaaaatgtgaacggaagtaatttcccggtcggcgaagctcactcgtcttagccgcttccgccgttgcgctatagattcctcgtctgttcctattccggcggtgttgttcatcggatcttctggcttttccgatgccattgggggaattttcgaatttttagggtttgaaattgaattattaatgtgcgggaaatgcagacattttaagttttaatttgaacagtactgagaaggaagaacattttgattttgattgaattgattaaatcgggtaaatgaaatttcaaacatagttaggcctaaccatttgattaattagattaaccggtcgattaatatttattctataatacttttttctttgtacgattgggccttacttataaagggccgaataaaaaagcccatttaaagaaagacttctttttcgttttgcatgtgaatgtgttgttgggattagattcgattcttaaccatcggtctcgttcatttcgacttcacttttcgtcctctttcttcttcagatcatgtatgtatgtcgctagtagacatggatccatcaaatctctgagacacctgagcttgatgaatagccatagacaaagctcttcgatgcaaattctcttcaacagcaatcaacttcctctgtgaacgattcattctcttgcttctggatcaatctcctccacttctgataacaacatctttcttcttcatgcagattactctgttacccattattcacaaaaccctgaattttgcccaaagtgattccatcattgcttagctttagccgggttcttgtttggagctgttccttatgcaaaaaaaatctgaaagtttcttagcgaattgttacctctattaatttcaatg

SEQ ID NO: 29678 - DNA, 3003 bp, Unknown; identical to SEQ ID NO: 25406
  misc_feature (1)..( 3003): 2750-1469P.txt file - cDNA_ID_3020878; gDNA_ID_2214678; Annot_ID_189235

SEQ ID NO: 29679 - DNA, 3003 bp, Unknown
  misc_feature (1)..( 3003): 2750-1469P.txt file - cDNA_ID_3020887; gDNA_ID_2214678; Annot_ID_189236
aataatgaatagcagatgttgacgcctggtaagctcgttttattgcaggaaggtttcgcgtttgcgcactgcacaacttgcaaggctccatattatctgagagttcacagtgctggagataggaaatggcggacattgaagtttcgcttctttgttactcgagacattttatccatatttcttgctgttcagcttgtaagtattcatttttcatgtgtgcttctgtttcttacagtagtttttctttcatttggtaatatatctaactcatgccttttaaatgacttcatctgctcacaggtgattgctgcattggcctacatggtctatttcatagatagttaccagcaatcatggcttcgtcatatatggggttttgacagtgaggtcacgttttattacatgtgtggtatgatcccaaactttaatatctaaataaattcccctctagataagataatattttttagtaagacctctgccaagtgtagttggtaagacgggaatgctaagtttattattgtacatatgtcctacagtccttgttaaagctttgcttcaatcagaatcttagattccaatgtaaggagtttgctattagatgatttcattgcctctacgtagtaggaagtgaagcaagggttttgtgatcagttagatttagatcaaaagttaaggggttggctacgttacgaatatacagttagagttctggacctcgtagaatttttaactaaataagaattttcaaagcaagtgtattagaatttagtaattaaaattttgtgttttacacagctcttcatgaaaatttgttactaaagaaatttataccaagtgattctaaaattttacatgtgtgtatgagctactggtgtttatttacatgaggattttgttgtgtgcaggagctttattattctttgctctgctgggtctatctggatgcgtcataacctgctatgatcgaagggttcgcaatgacttagcacagccttgccgtgaattgtgtctctgttgttgccagcctgggtacaatttccatacttcttcctttgtttttgttttcagtcattggcgttttcctgattataagtgttcctcatttggtcacatgatagactttcgtaaaaaatagtttgctgaatatgtgggcttttgctttacctggttcctgggtgatttatgtttgaataagcgacatcagagactagaaatggtgagacaagccagaggaattctgttacacaatagttagtgaaaaattagaatactaactagatcctcttcttttgtctgctaaactctatctatattatctgccaaactactatgatcgagtttattatctgccaaactacaacacaacaaaagtacatacactattgaaaatattttgtcagctcccatttaataaacatatatatcatcaatatgcaggatatgcacagactgccatctaccaggaactatttgtatgtgggcagattgcaccgcatgtactgaaggctgtgcaagtgcagttagtgagtgtggaggttgccttggaggtgcaggggaagccggattgccattactcttcataacggcattagtaattctcggtctatttacagttatcggtatattctatagcgtattggttgcaaccatggttggacagcgcatttggcagcgccattaccacattctcgccaaaagaatgctaacaaaggtaagatttttatttaccttctacggtttctaattgtttatcattcaatgtttctttataccttctttatttggtgtttgtaggagtatgtggtcgaggatgtagatggcgaaatgacggggtcagaatggtctcccccggctttaccaactgagcatgtccagcagctgaagacgcttggccttctgtgaaactatatggcttttgattaaaactatgggagatttttaactgcacgcagggaaatgcatttgacaagtggtgagagagagaactcacagaacgatgaaatctaatagatcttttgtatttgtaaagaaaagactccaacttattaaagagtccgtgatctctcccattgagtcagagacctctccaattcacgaactgagcttgtgttgaatgtttgtttctaatataggtaaatatccgaaataactattttactttcggattattttaactcgaagcaagtttttacaatggcgattacagtttaagacggtgggattagttgaaatggcagcatgtaagaagcttagacggcgtttttaagcagtttaaacagtccgtaagctatctagagtccgtatgctttttgtggttatcatattttaagttaaaagtgttaacttcaaagttaaaacttttaaccgtagtgatcaaaaacatttggttccaaactttcaatgagtatcatcgatttcgaagggtagaatatctttttttgtgcaaagggtagaatatctagaagttgaaattgaaaaataaatgatatactattacaaacccaacaaagttaacaaaattttgttttcttatccaattaaagaaattcgaattccttagaaaataaatataaaattaaatgcttcttaattttattgttcatgacacaaaaaaatggatagagaatataatgtgataatgttaatgtattagttatttgtttgaactaatacactttttaagtatggaaatggatagagataacacgtatctatgaactacaaatgaaaaacacatgggaaaaaattaagttaattgctataactttaacatggtgagaagatgcatatagtaatcaatgtagtcaaccctatattttttttacattcattcactttctatttatttttatttatgcttagatgtatacccgtatatatataaacataaacattacatagccataaagcaaagaaaagagtcattcatttatcctctaatttacaaaacattagtacgtagctttctttttttttgttgcaatcgatatattgatcatg

SEQ ID NO: 29680 - DNA, 3000 bp, Unknown
  misc_feature (1)..( 3000): 2750-1469P.txt file - cDNA_ID_3020893; gDNA_ID_2214678; Annot_ID_189233
gaagaaaatctcaaaaaaacataaatcgaaatccaaagaggaagagaaaccagagaaatcaaagaagaaatcgaagaaatacgaagaagtagaagaagaggagaaatctccatctccatctccatctcctaagaaatcgaaggagagtaagaagaaacataagagatcatcagatgaatccgaagagatcgtcgattcaaagcctgttacggtcccgattgttaccattgagtctgattctgatttcgaattcgataaggaagatattaagaatctacttgaatcttactctaaagaggagcttattaacctaatttacaaaactgctgagaaaggttctaaattgatctcagcagtgtttgaatcagcggatagagatagttctcaacggaacatattcgtgcgtggtcttggatgggatacaacgcatgagaatctcaaggcggcttttgaggtttatggggagataacggaatgttctgtggttatggataaagatacaggaagagctaaaggttttggctttgtgttgtttaagacgcgtaaaggagcgagagcggcgttgaagaatccggagaagagaatgtataatcgaactgttagttgtttaccagctaggccgtttaattctggaaagccacgagaacaacaacaaccggttgagtctgtgaagattgatttgagtcatacgggtaatcagagtgaaatggctttgcctgggattgatttgggtcatggacttgataagggacatcagcagcagcagaatatgtcaatgtatgctggacagaacatgcccttttatggacattctcagcctcctcctggttttaatcctatgtatggtgcaatgatgggtaatccgatggttgctggtttacagaattatcgtatgtttggctcgggtatgatgaatcaaggacctatgatgccaccgaatcatatgggaatggtgggacaatatgttggtgatggtaatgttaacggtgttggtgcgggtgctggtgctggtgctggttttgatggtgaacgtgcttggtatctgagataagagaacccaagtggtatgaccatgttctctgatatttcaagttatagattaggctaatgattagtccggtatcttcgactccaacttgatattttgggaattgcaggagttttttttgcggatctttattttctatgcctgatgtttcaaacctacttttttagtttcattatttatagtctcttttaacgaggtatctacccctatatgagccattttgagggagatgtgtgctcaaaggatgaattttctgttgctctctggaagtctgtcattggtgttctgctctgttctcataaaccagtgaaatgtggtcattttgtctagaagatttagttactaggatcaatattggtttaaagtagtttgctatctctttgttttcccttttggagtcccccattatggtcttctgtcttctccttacccatcaaactcacgtctggttttcttctgtggcatggcgtatgtttttctcttttgtttttccttgtttttggttttatgttttcccgcattttcattgaatatctgttcgctatagctggagaagaagcttatgacatttatagttttgtccactatatgtcataactgccaaaagtctgtatcttccagctgcagttgtcttgagacccgtttgtaggatcagacataatggttttacattcttgttttaaatctgtctttttgagtactggaaaaagttttgggactctttcaaaagcttcaagttgattttctctggaataaacaacctgagttttctttccttcaagcattgttttcttccccataggtttttataagcttctcaatctctttcatcacattcctcttttatggtagtgtcgcccctttctcttttgtatttaagagtccattttgatatcagttgccaagttttcttgcctaagttcaagattgtttttggtcatcggtacttggacccaatttgtttttcaccttacatagctttgttctggatttaccttttttttacctgctcgttattcatattctatataactctggttatggtagcaaagcatacttgttttttttttttttttctttggattttcacaatgacctcacagtgaccgatgatgcgaatgcttgttttcttaagaggatcaatcttgttttcagtttttcgatttcttaagaggatcaatcttgtttctcggtttttggtcttctctgcagctatccatccatccatatgaatcaactcgtattaatctatagtatgcttcagctaaatcaactttggtttggttttggtcatttgatttcgttgttttgtgatcatgatcttatgagggctttgtttttctttccaatggggaaactctgaaaatcttaagaacaaaaacaaaaccctctctaagatctcggtgactatttttttagtttctcataacacataaagataaaaaagaaagaaaaaaaagtttcaactggtgaatgaataaacaagtagcagagcgacaccaccaatatggctaaaacctctgcctagccaggaatcttttctgacggcgctctaaaagaaaagtaccacaaagttcacaccccgtaaagttagggagcttatggtattccggttgatgtatagccatcataacttaaagccagcatcttgccatgtaacctctacaaagatctaaggccttatcttaaatataaagcaaatatttaaaaatatgtaaaataataaaaatattcaaaataaaccaatccaaaaataatctaaatatttgaaaatatattcaaagcaaaatactcgaataaaaaaaaaattaaactgaaaaaatcggaaaaacgacatctcgaggataaagtaaatcgaactcttgacccgaggggaaacaggaaactgaaatcaaaaatcaaaaatcaaaatccctaaaagcttcttgactcgtttatcctctactacaatg

SEQ ID NO: 29681 - DNA, 3003 bp, Unknown
  misc_feature (1)..( 3003): 2750-1469P.txt file - cDNA_ID_3021062; gDNA_ID_2214683; Annot_ID_136698
atatttaataaaaatttacgataaaaacataaccgttcagaagtgtttgcgatataaagacacaaccgtcaaatttctttgaaaaaatacgataaaaagatacaaccgagaaaaacccaaaaaactcataaatattctatcgaaaagttgcgataaacaaacacaaccattcaaaagtgcttgcgataaaagaacaaccgtaaatgtttcgactaaaagttacaattaagagacgcaacccgaaaaagttacagtaaatttgttaacgaaaatttacgatatataaacgtaaccatttgaacttgtatcctactttggtttctaataaaattcagatgacaaagaaaaaacgcaaccattaaaaaaatgtaaaagactatttattgagattgtcttattattattagatttacttaactccaaaaaaaaaccatggaggaggtaagtccaatacacccaacccaaaaaatagacaaacccagcccaagcccaaaaagcccttctatttttatatgtagacgacaataatttttacagacctcaaagcaaaattaataaattatcgtcttgacgaaaaatcgtagaggaaaaaaaatccccaaattgtgtgaccggaattagggtttcgacaatgtcgtccgggaagccaaagcaaggcgacacacgattggtggttgctgccactacggcgtcggcattgatggaagcgaagaaggctgatcacggaggatcttcgtctatcgttgagtataaaccgccggtgatgcttgaagatgaagaagatctagaagtaaagctccgacgtatccttgagaacgttcctgttcgtgttagtaatacttctggaagttccgctggttctggttctggagatttccatcaggtaactaaactaagcctttctcttaaatcgataaggctttgtatctggaatctgaaactgcagataaggctttgtattttgttattaggcgtagttaggtgtggtaatcaattacgagaagttcattgttgggatctgaattatcttagtggactttgtgttgacattgttttcttagttttgtgatggatcacaatgcctttatgcctatataagagtttgatagaatgttccatagactatcctgtattagtcttttgatggctgtgatctgtgaatgatttcaacttctgtatatgaattctgttcttcagtaactgaaaatcagctggattgtttgtgaagaatgcctggtcttttgttcttaggcatggctaagtgtggattcgaagctatagtcgattaattactagaagttccttgttgtacatgtgataggaatcttaaatttcttagtctataagtgttttgtgacgttgattacttagtcggtagagcttgaactgagagtattagttgcgagaagctcatgtgggtattagtaattaatggttgatggtcgttgtgttgattctataggttgtggctgagtgttatctgaagtgtggccctgattattgataaagcgtgtgtacatcattttcttattatactagacatctaaacttgtgcaatactgatgcattgtttttctattacagtaccggcaaatgaggcggagagaacaagaccgactaacaaggatggatattgactataacaagcggttaaaaatggcagagtttactataagaagagaagagaaacagaaagctgcagaggaaaaaacatcgaagaagcgtttgaaacgccaaaagaagaagcagaagaaacaggagaagaagcaaaaaccaaacactactgaggaagaagtaaagcaaccgagagtaggagaaatatcatctgacgaaggtgaagatgaagtagaagaagagtctgtgctagaacctttacgtccaatgtttaatatcaagttccaagagaaccgttcatagcttttattgtgacatgttacatgattccaaaactatctttgtgagattcgtttctttctttccttttgttttcaacaatgtacgggaaaaagaaatggagcaggttttaatcggcttttgtattggattagggttcatcaaatcaaccaccaatgtatattgacaagtaaaccaaaattctttagtcgaaaattgttaaaacgactaaactttggtgccagcagctaagctccatacacgcaagttcccacttttgtgtccactgaatagcaatccttgaggaccaattgtgagtgtgccaatcgtgtggtcccatccaaggaagacgatatcagacatttgtcccaacataagagtgatgttacagtgccagtatgttgcttcaaggtcattatacattgcagggtgttgagatcccacaccttgattgttttatcgacagagtatagcacttgacctccaacaacaaaagtacaaaacaagtgacttcaccactatgatgtccctcgagagatgtcaagtatttgaatggatcatcagactcagagtgtgtagtagctttccagactaagctactaccacaacttgttccagcaaaaagcattccgtttaatataaaaataccccatctttgaattgttgatacaccgatttaacatctctatattccaaagtaatgtatatattgttcacaatggaaaatggagattaaaggaacaacaaaaattgtgaaccaaaaaaaaaagaaatgccaaaagatagaatcagatcaattactcaaagataagaatggtttaaaagcaaaaaagaaatttagttaaggccatgaatggtgacatagaccgcacaaactgcttaaattgaagagacgactatgtgcgtaaaacgaagagactcaaaacaattttgggattcgtgagagatattgattcgctgcaatggaagaatctgttcatcaatcgatacgattcggctcaggtttcttctctctttctctcattgtttcattgttctacgactccattaacgtgtagatctaccgattcatatgatttctgaactgatgcagttgcagatttaatcatg

SEQ ID NO: 29682 - DNA, 3003 bp, Unknown
  misc_feature (1)..( 3003): 2750-1469P.txt file - cDNA_ID_3021062; gDNA_ID_2214683; Annot_ID_189295
gttatataaaaagatacaacaattcagatacaatcgtaaaaagatacccaactaaaaaagatataaccgtaaaaaagtcctgactatatttcaatgaaaatacacgataaaaagacagaacgaaaaaaatcagaaaaccccgtaaatatttaataaaaatttacgataaaaacataaccgttcagaagtgtttgcgatataaagacacaaccgtcaaatttctttgaaaaaatacgataaaaagatacaaccgagaaaaacccaaaaaactcataaatattctatcgaaaagttgcgataaacaaacacaaccattcaaaagtgcttgcgataaaagaacaaccgtaaatgtttcgactaaaagttacaattaagagacgcaacccgaaaaagttacagtaaatttgttaacgaaaatttacgatatataaacgtaaccatttgaacttgtatcctactttggtttctaataaaattcagatgacaaagaaaaaacgcaaccattaaaaaaatgtaaaagactatttattgagattgtcttattattattagatttacttaactccaaaaaaaaaccatggaggaggtaagtccaatacacccaacccaaaaaatagacaaacccagcccaagcccaaaaagcccttctatttttatatgtagacgacaataatttttacagacctcaaagcaaaattaataaattatcgtcttgacgaaaaatcgtagaggaaaaaaaatccccaaattgtgtgaccggaattagggtttcgacaatgtcgtccgggaagccaaagcaaggcgacacacgattggtggttgctgccactacggcgtcggcattgatggaagcgaagaaggctgatcacggaggatcttcgtctatcgttgagtataaaccgccggtgatgcttgaagatgaagaagatctagaagtaaagctccgacgtatccttgagaacgttcctgttcgtgttagtaatacttctggaagttccgctggttctggttctggagatttccatcaggtaactaaactaagcctttctcttaaatcgataaggctttgtatctggaatctgaaactgcagataaggctttgtattttgttattaggcgtagttaggtgtggtaatcaattacgagaagttcattgttgggatctgaattatcttagtggactttgtgttgacattgttttcttagttttgtgatggatcacaatgcctttatgcctatataagagtttgatagaatgttccatagactatcctgtattagtcttttgatggctgtgatctgtgaatgatttcaacttctgtatatgaattctgttcttcagtaactgaaaatcagctggattgtttgtgaagaatgcctggtcttttgttcttaggcatggctaagtgtggattcgaagctatagtcgattaattactagaagttccttgttgtacatgtgataggaatcttaaatttcttagtctataagtgttttgtgacgttgattacttagtcggtagagcttgaactgagagtattagttgcgagaagctcatgtgggtattagtaattaatggttgatggtcgttgtgttgattctataggttgtggctgagtgttatctgaagtgtggccctgattattgataaagcgtgtgtacatcattttcttattatactagacatctaaacttgtgcaatactgatgcattgtttttctattacagtaccggcaaatgaggcggagagaacaagaccgactaacaaggatggatattgactataacaagcggttaaaaatggcagagtttactataagaagagaagagaaacagaaagctgcagaggaaaaaacatcgaagaagcgtttgaaacgccaaaagaagaagcagaagaaacaggagaagaagcaaaaaccaaacactactgaggaagaagtaaagcaaccgagagtaggagaaatatcatctgacgaaggtgaagatgaagtagaagaagagtctgtgctagaacctttacgtccaatgtttaatatcaagttccaagagaaccgttcatagcttttattgtgacatgttacatgattccaaaactatctttgtgagattcgtttctttctttccttttgttttcaacaatgtacgggaaaaagaaatggagcaggttttaatcggcttttgtattggattagggttcatcaaatcaaccaccaatgtatattgacaagtaaaccaaaattctttagtcgaaaattgttaaaacgactaaactttggtgccagcagctaagctccatacacgcaagttcccacttttgtgtccactgaatagcaatccttgaggaccaattgtgagtgtgccaatcgtgtggtcccatccaaggaagacgatatcagacatttgtcccaacataagagtgatgttacagtgccagtatgttgcttcaaggtcattatacattgcagggtgttgagatcccacaccttgattgttttatcgacagagtatagcacttgacctccaacaacaaaagtacaaaacaagtgacttcaccactatgatgtccctcgagagatgtcaagtatttgaatggatcatcagactcagagtgtgtagtagctttccagactaagctactaccacaacttgttccagcaaaaagcattccgtttaatataaaaataccccatctttgaattgttgatacaccgatttaacatctctatattccaaagtaatgtatatattgttcacaatggaaaatggagattaaaggaacaacaaaaattgtgaaccaaaaaaaaaagaaatgccaaaagatagaatcagatcaattactcaaagataagaatggtttaaaagcaaaaaagaaatttagttaaggccatgaatggtgacatagaccgcacaaactgcttaaattgaagagacgactatgtgcgtaaaacgaagagactcaaaacaattttgggattcgtgagagatattgattcgctgcaatg

SEQ ID NO: 29683 - DNA, 3000 bp, Unknown; identical to SEQ ID NO: 13977
  misc_feature (1)..( 3000): 2750-1469P.txt file - cDNA_ID_3021093; gDNA_ID_2214684; Annot_ID_189322

SEQ ID NO: 29684 - DNA, 3003 bp, Unknown
  misc_feature (1)..( 3003): 2750-1469P.txt file - cDNA_ID_3021103; gDNA_ID_2214684; Annot_ID_189319
ttgctggctcagcagaagcagatacactacatcactgatgaagagcacttccaaatgcaagaaggggggaatgatcaaactgaagagctgtgctacattcagaaccaaggagggtttaacaagggctacaacaactacaagcccaacccaaacctctcctacagaagcactaatgttgctaacccccaagatcaagtgtatccacctcaacagaatcagtccaaaccttttgttcagtacaaccaaggttatgtccctaaacaacagttcaatggacgtttccaatagcagaatccaccaccaaggttcactcaacaaccacaacaagccctagcagctcaagatcctgaaattaagcaactcattcaacagatcatccaaggacaagctactagagccatggcttttgaaaagaagatagctgaattacacaacaagatcgattgttcttacaatgatctgaatatcaagtttgaagctctaaatttcaaaaatcaagtatgtggagagtcaatttgcctcaacctctgccccgaagcaccctcaacaacttccagggaaagcagtccagaatcctaaggactatgctactgctaatgctatcaccatccaccaagaagatgagtctccaccaagtcatcagactcccaatactgaggacaatatgattcaagaagggggggggggggttcaactcaaattgatgcacctgccactcagcaattcatctggactatagagcacacacctttgctgaatactcaccattctagaaaagagttcaaaagtgaaaaattcaagaaggatcagaatcaagagatgatcagcagtgcctctactcaagaaacatacaagaagaaagtcatccaagaaaagcttgatgatcccggttcattcactctaccatgctctctaggaccattgacattcaataggtgcctttgtgatttgggagcatctcttagccttatgcctctctctacagctaaaaggctaaggatcatggaattcaagttctgaaacttagccttactcttagctgatggttctgttgcacatcctcatggtctagtagagaatctgcctgtcaagattggaaatgttgagatacctacagactttggggtattggacgtagatgaagaaggcaaggatcccctgatcctaggcagaccattcttagcttcagctggagcagtcatagacgtcaggaatggaaaaattaatctgaaccttgaaaaaggcatcaagatgaagtttgacatcagagaagcttcaaagaaatcaacaacaggaggtcagagttttggaattcaagatatggatgttgatgaagaaacagaagctgaaacctcaccaaaagtcaactatacttctcaactcagcaagctgaagagaacttttgaccacaagaagagagaaacagaaaggctatctcagactgaagatcctgaagaagatgactggtatgagatgagaaaaaaatttaaatggcaaagcagagtcatagacggattgtcttcaagggtgatgaagctgaaagatcaactttggatatttgaaaaaagagttaaaaagttttcagatggtattgacccagagaagatggaaactgcactagctatcaagaaggacgaaaatttcacaacagaatggtttgcaccagaagatcagaaaggagttcacttagaggaaagaagcttagggagcaagttgttgagtgaggaggaaactcctattttgacttattctctaggagtgcctaaacagcccaccaacccctctgctgaagaggaacacttgacacttgattctgttactgaagaacttgtggaactcaggatagaatacaaagctcaagaggataccattggagagctaacttacaaaatggaaggactgaaccatgcaatcttggaacttcaaaaaatggttacaggctacaccagttttgaatttgaggattggtcaaaagaacttggttcagaagaagaagactactctgctgctcagaaaaatcttattttgaagaaaaatcaaatgagtactcatcctaccatatctcaagagaggatgtagagtatgactcaagcactgaaaattcatccactgaagataaggacttctctgttcctctcttcaacctttttcttactaagcactgtaagagtcaagcttaatgacttaaaacaagctcacttgggaggaagtcccatgtctatccatgtaaataactttctatttttcttgttatttttgatgtttttgtttaagtgttttaggtttgttttagtgaccctaagagagtcaacggtcgagtaaattcaaaccaagtcaagaaaaatctcaaccgttgatcgagtagaatgaggaggagtattttgagccattgatttggatgaccaaatgagaggagcattaccgtcgttggatcgagtgactttcagaagttaattttggtccgtttgatcgagtaaacaagaaagaaaagttccccgtcgttggatcaaatttttcgcacttcaagaggatgctcgatcctttgctcgagctctcattatttgaagaccatggcataacttcgtgaccccacttgttcccccaacactcttttactcaatggacaaagcgattacccatgcccctcaccatttataatcaacttttctatcccttcccaaagaaaccaaacaccaatctcctccacccattgaattcgacaaacccacttttgaaactctctctttcatcatctcattttcgcaacctctccatctctcacaaagcttcgaagtttcactccaaactctccctatcactcttcacgaattcgttctcacttcatcatacttcaccaaagttactcgatcacttccaagctcatcctcaagcactcaatcggtttcaagctccaaatttcatcaccaaataaactgatccccttaccccttgatacctcttggagagttgtttttaattgcttggttgaaactcaccaccatg

SEQ ID NO: 29685 - DNA, 3003 bp, Unknown
  misc_feature (1)..( 3003): 2750-1469P.txt file - cDNA_ID_3021195; gDNA_ID_2214686; Annot_ID_189345
aggcagccattccctaaagcaactacttatcgagcatcacaagtattggaacttgttcatggtgatctttgtggtccgataacacaatctacaactgctaagaaaagatacatactcgtgctgatcgatgatcacactcgttacatgtggtctatgctattgaaggagaagagtgaggcatttgaaaaattcagagatttcaagactaaagttgaacaagaaagtggagttaagatcaaaaccttcagaacagataaaggaggagagtttgtctctcaagaatttcaagatttctgtgcaaaagaaggcatcaacagacacttaaccgctccatacacaccacagcagaatggagttgttgaaaggagaaatagaacgttgctaggtatgacaagaagcatcttgaagcacatgaaaatgcctaactatttgtggggagaagcagtaaggcactcaacctatatcatcaacagagtaggaacaagatctttgcagaaccaaacaccatatgaagtttttaagcaaagaaagccgaatgtagaacacttacgtgtatttggatgtattggttatgccaagattgaaggtccacatttgagaaagcttgatgataggtcaaagatgcttgtttatcttggaactgaaccaggctccaaagcatatcgtcttcttgatccaactaaccgcaaaattatcgtaagcagagatgtgtactttgatgaaaacatgagctagaagtggaacaattcagattctgaaactcgggacatctctggaacattctcacttaccttaggagaatttggaaacaatggaattcaagaaagtgatgatatagaaacagaaaaaaacggagaagaaagtgagaacagtcacgaagaagaaggagaaaacgaacacaatgaacaagaacagattgatgctgaagaaacacaaccctcacatgctactcctctgccaacattaagaagatcaacaagacaagttggaaaaccaaattatttggacgattatgtcttaatggcagagatcgaaggcgaacaagttctattggcaattaatgatgaaccatgggattttaaagaagcaaacaagttgaaagaatggagagatgcttgcaaagaagagatcctgtcaatagagaagaacaaaacttggagcttaattgatcttccagttagaagaaaagtcatagggttaaaatgggtttttaagatcaagcgaaattcagatggcagcataaacaagtacaaggcaaggttagtagcaaagggttatgttcagaggcatggtattgactacgatgaagtatttgctcatgtagctcgtattgaaacaattcgagtcatcattgccttagcagcatcaaacggatgggaagtacatcacttagacgtcaagaccgcttttctccatggggaactaagagaagatgtttatgttacacaacctgagggcttcacaaataaagacaatgaagggaaagtctacaaattacacaaggctctttatggtttaaaacaagcacctcgtgcttggaacactaagctgaacaaaattcttcaagaactgaattttgtaaagtgttctaaagaaccatcagtgtacagaagacaagaagaaaagaagcttctcattgtggctatttatgttgatgatttacttgtgacaggctctagcttggatctaatactctgtttcaagaaagatatggctggaaaattcgaaatgagtgatctgggacagctcacgtactaccttggcattgaagttctccatagaaagaatggcatcatattaagacaagagaggtatgcaatgaaaattatagaagaagctggaatgagtaactgcaacccggtcttaataccaatggcagcaggattagagctctgcaaagcacaagaagagaagtgcatcaccgaaagagactacagaagaatgattggatgtctgagatacatagtgcatactcggccggatctctcttattgcgttggtgtactaagcaggtatctacaacaaccgagggaatcacatggaaacgcactgaagcaagttctaaggtatctcaaaggaactatgtctcatggtctgtacctcaagagaggattcaagagcggattagtaggctatagtgatagtagtcatagtgcggatttggatgatggaaaaagcactgccggtcatatcttctatcttcatcaatgtcccattacatggtgttcacaaaaacaacaagtagtggctctttcatcttgtgaagcggagttcatggcagctactgaagcagccaagcaagccatatggttacaagacctattcgcagaagtgtgtgggacaacaagtgagaaggtgatgattcgagtggataacaagtcggcgattgctcttactaagaatcttgtctttcatggtaggagtaaacatattcatcgaaggtatcatttcataagagaatgtgttgagaataacttagtcgaagtggatcatgttcccggagttgagcaaagagctgacattctaaccaagccacttggaaggattaagttcagagagatgagagaactagtaggagttcagtgtgtgttggaagatgacttcaagcttaaaggggagtttgttgggataagcatgaagtcaataaattagggaataaaagttatgttttaaaataggattaagataaatctttaggagtaatctaaagatatgttaggagttatctacatcttattctattgtgtttgttatcatccctctcctatataagagttgccaaagttgtggtaaaccttaagagatttgagagagagattgaaagctttgttttgagttattttcaaagctaataaaaggagtgcttttatatttgatctaagtattcaaatctttaaagttgtggctaaacttcagtttgtgtttgcttttgtttatcaagattgttcttagactttttcgagttaaaaaacttgtgtgttggagtcatcatcgtgatcaatg

SEQ ID NO: 29686 - DNA, 3003 bp, Unknown
  misc_feature (1)..( 3003): 2750-1469P.txt file - cDNA_ID_3021207; gDNA_ID_2214687; Annot_ID_189356
tctagagatagtaaaaatgaggaaatctagaggagtttccgcaacttctactgaatcacactgcgaacaagttgtggttggctttgttgggtacccgaatgtggggaagagttcgacaatcaacgcattggtaggtcagaagcgaactggtgtcacatctacccccgggaaaacaaagcatttccagacattgataatctctgaggatctaatgctctgcgattgccctggtttagtcttcccttcattctcaagctcaagatatgaaatggttgcttctggagttcttccaatagaccggatgaccgagcaccttgaagctattaaggttgtggctgaacttgttcctcgacatgccattgaggatgtgtacaacatctctctacctaaacccaaatcctatgaacctcagtcccgcccacctcttgcctcagagcttctaagaacttactgcctctctcgtggttatgttgcctctagtggactacctgatgagactagagcagctaggcagattctgaaagattacattgaaggtaagcttccacattttgcaatgcctccagagataacccgagatgatgaaaacgagacagcggatgacactttgggagccgaaacaagagaaggttcacagactgagaagaaaggtgaagaagctcctagtcttggtcttgatcaagttctagatgatcttagctcgtttgatcttgcaaatggacttgtgtcttccaaaacgaaacagcacaagaagtcacataggaaacaatgattcggtcttgatggaacgccaattctgagagttttcctgaaaccgatcaacaaatgctcgaatatatgatacagttgtggatttttcttattgtagaaatcgtgataacattctaacagctgttgtttagatattatgtttgagcaaatactagtgatatcgataaagtttcaacttgatgctagtcaatatattgatgaagagtccttcgaagcaggtttggtagttgtaatatattgccattgagatattatagatcactcactcattgtgggtttgtttgttttctatttgtgggtttgtttgtttttaaatatgtgtaaaatcttggcctgttacattggctttataccataaataacaaaaaaaaaaaaaaaaaagatcactcattcatatgcaaagcaactcaaactacaattttcatttcccagacttttattgtattttttcaatttaggaatcagacttttgttttagacaaaaaaaaaaaagaataaacattttgtaacctttatattctccagcatcactcttgtactaaatcaatgcacatgcaaggttttctcaccattgttgatattttcattttttgctctatttcatagctttggactttggacaaattcaatagattcctcaagctttgtcacttcatctaaagtatgtcatcgccgtcttttaatgagcaaacaaacatatcagtaaagaagtcaacaatttatttgcaattggctcaaatttgagtagctcaactcttctaactcagaattttcctaggttcttcattgttttaaaaaaatttggcaaagggaaactttactgattaagctctttttgtagttaattacaaaccctctgaaatttaaattcatatataaaaaagtgtaacatccagattgtacgcaatgatgaatgagtttcattatttccattatattagtcatttttcttcatagattatttctaaagcttccaaaactgaaattggcggtttgtacgaagttaatctgaattgactaatgtcgtttctgttgtagatgacattcaatgcattagaaatcctcatttcattacgatttttcttcaccattcattgtatatttattcatgagcaatattgtttattccacttttatgtattgtaacatggatattattagcaatattttgatgatggagtttcatgtgttatattcatcaatgaacttaaaattgactgaattcttactttctagtaaatgtagttactgccatttaagaaccgaggacatgtgaccgaacttttcttctctacgtggttttatctagtctcaactctcaatttggatgatcaaaaccaatgtaaaagtcttatagcacttattggtgaccttaaattcgtaggtacattactagattctgtactgtaagatacatttctatatgttactgcctaataaattaaaacatttataaaaatacgatacaaacatttgaaagggtacgatgtcaaaaaaaaaaaaaaaaattttgaaagggtacaaactctgagaaagtgtgtcaaatacaaatagttttctaaaaagcgtatcaattatcatagtataaatcaccctttataaatcaccctaaattttcctagaaaacactacaatttgcaacatatgtctctcacaaatccaccattaggtatataaaataatcaacacaatattttaagctaactacacattaccaaatcagttcagtttcatgcgtattgtttgcattacataaatgatgaaacaatttcttagtacaagactatatatagcttcaatttcgttactcaaatcgaaatagataattgttttatttcctcaaataatttctgttgtttttatagtaattaagtaaatgataaaaatgatttaataaatgtaattatcttagcttaaagagagagagataaataaacaaagggcaagttttttgattgtttggtgttgagtgtctctctgtccttattcctcaacaaaaaaaaaaaaactgggaagaagaaagaacaaactcattttcaaattctccgaatctctctactccaattaacttttttccgggaagatctcaccggagaaaagctagctagggtttctccaccgtgaagattctagaagcgagaatttggaatttgctaattaagaagatgtgttacgatctttcttaattaaaaaagcattgaaattgacgaatttagggttgtgaaaaatatg

SEQ ID NO: 29687 - DNA, 3000 bp, Unknown; identical to SEQ ID NO: 13986
  misc_feature (1)..( 3000): 2750-1469P.txt file - cDNA_ID_3021211; gDNA_ID_2214687; Annot_ID_189352

SEQ ID NO: 29688 - DNA, 3000 bp, Unknown; identical to SEQ ID NO: 13991
  misc_feature (1)..( 3000): 2750-1469P.txt file - cDNA_ID_3021232; gDNA_ID_2214688; Annot_ID_189363

SEQ ID NO: 29689 - DNA, 1814 bp, Unknown; identical to SEQ ID NO: 14002
  misc_feature (1)..( 1814): 2750-1469P.txt file - cDNA_ID_3021265; gDNA_ID_2214690; Annot_ID_189394

SEQ ID NO: 29690 - DNA, 2166 bp, Unknown; identical to SEQ ID NO: 13998
  misc_feature (1)..( 2166): 2750-1469P.txt file - cDNA_ID_3021306; gDNA_ID_2214690; Annot_ID_136726

SEQ ID NO: 29691 - DNA, 2094 bp, Unknown; identical to SEQ ID NO: 14000
  misc_feature (1)..( 2094): 2750-1469P.txt file - cDNA_ID_3021306; gDNA_ID_2214690; Annot_ID_189382

SEQ ID NO: 29692 - DNA, 3003 bp, Unknown
  misc_feature (1)..( 3003): 2750-1469P.txt file - cDNA_ID_3021353; gDNA_ID_2214692; Annot_ID_189423
agaagaagaagaagatcgttagagaattgtttgactcggactgagtttggggaaaacggtaggagcgagtttttacctttaggttttttttttttgtttgacgagagagcgtatgagtgagtaataggattttttttttgggggggctttagatgcgatattataataataaaataatatctatttttaaaataaaggcgacttgaaattttgcactgtggcgggattttttcgtgaaggagcgaaataatttgacacgtatgggaaagaagagcaacggacggaataatggattgtgctcttcaaatcctgaccgtccatttgacacgtgtacctgagcttgcagatctcgcccttaattacattcataaagttcttcaccaattgacgcatttgctttctaataaaccccaaatattgtttgaccagaagagagaaagataggaaaactcgaaccgggtttgaccagatcaattagatttaaccggtaccggttatttacattttttttcccctgtaaaatattcccctcccctcttttctctcatcgctcgctgcctttctctttcacagtcagcgctcttgaacggagaatctcagtcgcgccgtcaactttttgttgagaagagatatcatctgttttcgatccaaagaatagaaagcttggattccgaaatctccctttttgcttccccaattcgttttcctttacaagctcggcgcttgatctcgctatctctcaggtaggatcgagctatatacaacagtttctcaattttactagatataattgctttagattttcaagtgctcttgcgtttctggggttttgttaagattggagtttttgtttcttattctcgaaatctgttgattgattcgtttgatccatcaatgtttgtttagaaattcaaaaagcatgcaaatttgcagattctttgtttgccttgtgcgaattctatttccgtattccgtatcgaaactaaaaccctgactaggttatgtttcaagtgtgttttttagttttctatttgagggatattttaactaactccataagtttggggttttgtgaacagccaaaagtcttttctttcgtgacatcagtttcttggtaaaggaattcgatttcttcacctaatagagaatttattttagaactttggactgatatgttgaacattgatgctgatttggcagaaatggatcgtttgatatgatacgtatctacatttgtagaactgattttttcacctagaatttgcagcaagtaagactagaatgaataaaggggaagcttgtattatttgttgttaaatgagttgttcaaagagctttgtttgatatcattgttgcttctttgttacatgtggatagtttaggatgctacttgttaagtagtaagtactgttaaggtgtgtagaacttatatttcactgtgaaacgttggagtaggttgccgtttgtgccgttagtatatcttgttttcgccttttactgacaagacttatgaatgttttgctttcccgtagagagctgagagctgaggatattggaaatttggaaggtggaatctcaaatggctgaacttcctggtcaaataagacatataggcggtcgaatgagtcaactgctagagcagatatatgggttttcgagaagatctttgtttcgggtcatatctatgggtcctataccttgtcatattgcctttatcatggatggaaatcggagatatgcaaagaagtgtggtcttttagatgggtctggtcacaaagcggggttttctgcgcttatgtcgatgctgcaatactgctacgagctgggtatcaagtatgtaacgatatacgcatttagcatagataattttagaagaaaacctgaggaggttgagtctgtaatggatttgatgctggaaaagataaagtctttgcttgaaaaagagagtattgtgcatcagtatgggattcgggtctattttatcggtaacttagcgcttctaaatgaccaagtgagagctgctgcagaaaaagtcatgaaagccacagctaagaatagtcgggtagtgcttctcatttgcattgcctataactcgacagatgagatcgtacaagctgtcaagaaatcttgtattaacaagtcagacaatattgaagcatctaattataaacacgaggatagcgatagtgatatagaaggaacagatatggagaaccaagagaagaagatacagttggtggatattgaggagaatatgcagatgagcgtggcgccgaatcctgatatactcatcaggagttcaggagagacgaggctgagcaattttctcttatggcaaacaggtaatacccagctctgctctccggctgctctgtggcctgagattggtttgaggcatctgctctgggctatattgaacttccaaagaaatcattcatacttggaaaagaggaagaaacaattatgattgtcttgaaaggagactagtgaaggatatacaaaagctctcttctctatttggctttgtaatgtgatgtgatgctcttgtggtatactatcaaaaggaaacttgggattacatagaacaagcaatgtattttacacacgaactcatttgagtttttctttatgaatccttaaccaaaactccaaaagtcctctctaaagacatcttacttcctgttctgtcttgtaagatccagaatcttaacatttgtgtttcacgagtgtttttttctcaaaccaaaattaaaccaataaatttagttcgttaatggttcagattgattgcatatatcatggaatttcggtttagcgatattaaaacaaggaaaaccgggattggtatccaaaaccgtaccgggcgtcaagtctggttcggtaggttagagtacacgcttgtggcgaacttgcaattggaaacctaaaaagtcgcgactatgctctctgcaaagatggttctacttttggcttaaagagcaatgttttcgagtctttgccatg

SEQ ID NO: 29693 - DNA, 3000 bp, Unknown; identical to SEQ ID NO: 26126
  misc_feature (1)..( 3000): 2750-1469P.txt file - cDNA_ID_3021365; gDNA_ID_2214692; Annot_ID_189420

SEQ ID NO: 29694 - DNA, 3003 bp, Unknown
  misc_feature (1)..( 3003): 2750-1469P.txt file - cDNA_ID_3021375; gDNA_ID_2214692; Annot_ID_189416
taaagattagatattaagaattgagtttagtaaaaaaaaaaacaatgcattgaatatactaacggaaattatagttggagtcttcttattacgatttcagttatattggccacggtgacgaacaatctaacgccataagaaaatgtattgaacaagaatgatcaaacatattttgagtttttgtttaacgaaaactatgcattaagacttttatatttttcattaaactaaacatatttcgttgttaaatcgaacgtaaaaaagtttacgggaaaacatccatcgtttctggtgcatgcaaatttctttgctctctagaggttaattctcattttggaaatccattttgatcccgtagacatctaatttctccatcaagtcatgtttggcgtaaacgtgtatgattttgtcttgttttcttcaaagcttatcactttggttgcttcatatctaacatttctcgtatatgctatagactcgcatccatttttgtataaccttttttatcttgattttaaaaatttcttttccgacctctataatttataactataaataaaaaactgtctaaattggattattaatcgactgaccaacgttaaaacttaaccaactaactgagagggcataatggatatcttatttgacaaaattatgacgcctcaattacccccttatagtggcgtcatgatgggaaccaaacgattaaccccctcaacatttgtgtttctcatattacaacgatgcaaaagttgatcgcgaaattatggctgcatttaaatttttaaatattgtttagtgttttctaggaagagtaataatagtaaatataagaattttagaatttcttctaaagtgaggatcgagtggacttgaactcttattcacgatactcctccaaaaaaaactgttgttgtaaatgtaactcaatatgcagtttatacaacaaattttttacttcgagtcatgccaaatttagaacatcacatacattcaaccaaactaacattaaatttatgtgttgatgttttagtgccactaatatgatttgttcaatagttggtacaagaacattaaatgtttgtaagagagataaaaaaatggacatttttatagtatttttgcagcaaattttcggcgggttggtaaaagtgattttgtatataataggtatcagacccgtttagaatttttggtcattcaaaaatcattggatcggattatatataatccaacttttccaccggatatatatttaaaagtcacatacaaatattactaaaattggattgtatctactaattacatttatatatttaataaaacaaaaattagaaaatttggttttgatttaaatttatgattctcctttcatcttttttaaactgttttaaatcatcatataatacataaagtgaaaaaaatctcaattttttcttatgcatatattgtgatttcgaaattttttaaaacggacatgtattacttaattaatgaaaagtgtgttttcaacgtcccacatctgctataaagtttagacaatgatttagattcatattatacataaaattaaaatgaatccaacttcgaatgagtataaaccttaacataacaagcatccaaatttaaaaattgatgtacgaattaaatcattggtaaatatgcttcacattatatttatatgatctgctgaacttatgttggacttttgaattgagtagagtaaagggaatcatgacctcttatttttcgtcattcaagaaaaaagtcagaaagaactagagaagggctgctaaagaagaggaaagaagaagagttgaggaagagaaactcatccctagtctgacagaagaacaatttgcaaagaacatggacttgatgaggaaaaaagttgaccgctttcactgactacatggtggtaaagaaggtggaaaaaaagaagcgaaagatgctaggggcattcagaaagataaagcttgatattggcaactaagaaataagtataagaatgttcagagattcgagaaatttgacgaagaggaagagtaattctgaaattctatctgattactttctatttagtctcttgtacacttgtaggacgaatcttattttgtgttctaaaaccattatgaccaatggtagtgtgataccatttaaatagtgaggaagaaaggctggaaaaacaattaagtaacaataaatagattttgcgactattgaaataaactggtttgcaggtgatcgaggtttgattggaattcaatagatcaatatccgatgaaataagattgatttgctttctctctctaaaagatttaagagagaagatagaaaaaatcatcgcccattaaaaaaaatagatattaagaatttgagttttataaaaaaataaaaattcaatgcattggatattactaaaaggaaactatagttggagtcttcttattacgattttaattatatatagttggccatttttcttcgaatctaaattacggacccatgaggaaaatgaccgttgtctccgaacgggcttcgtgggcttattgtttgtaaactcacggcccattgacgtcttcttatttgattcaagaccagaaaccacgttttgtactgtagtcttgaattgctctgttctgctgatagaatagcaaagttctgttctgctgataaattagcaaagtaaatcttgaatgctagtttgtctttttctctcatgttatgtgtaagaagatgatgatgactctgttaggtaagaaagtccaactttgtaatctaatcagatttagtctctaattgtttacttgtgtctacatataaaagttgcaagttgcagatgttaagaactaagaagtggtatctgcagattttgggtattaaggaaagtttccccctttgaataaataaggacatatactaatgtaaaggttcctcctttttcacaaatcaaaatgtgtttctttgtgttctagtgaaatccaatccattgtgtctctgatg

SEQ ID NO: 29695 - DNA, 3003 bp, Unknown
  misc_feature (1)..( 3003): 2750-1469P.txt file - cDNA_ID_3021379; gDNA_ID_2214692; Annot_ID_189415
atgctgcaggcaggaaaaaaaacaaaattggagataaaagttgtttgatggcagtatcaagttacccaaagctgagactgaaaaacaaatgtgtttatctccattacctcttggtatataagtttcctcttcgaaggtctagaatcatctgcatcttccatagttatgtcttcattggttggttgggcaagcagatccagcaattcaggttgtccaagtgatttaacataagcctcaactgatacagaaacattcattgataaacttcaacatcatgtagcaagacacacaaacagtcatgcaaaaccaagcttcgacaacttctatgaaaaatatagatgattcacatacttgtctccgcagatattccctcttcagtggccttccgtttattttccctatcattagttacaagcaacacctgagatgtatcccctagatgcttctggtaccatagagtagcgacgcgaatagctgaattccagataaatttaaaattttaataacagatgcttaccaagagaagtatgtaagttcatcatcaagaaagtaacatgatgttaacaaacaaagaaggtgattgaatagtaaataaaacctctatcgttgtggtcatttgcactctctttctccatggcttgcacataagtatccctgtgaagagtttagtaaacgcgagaaaacaacgataaggacacggagaaaagcgtttctatagcttagtaggttccagtaaggagagcatctaatcaatataaccgaacagaaattccaaaatcattgaattctttatgttcttttgtccacctaaaatctggttaatctaaaagctaaaagttcgaacaaggtcttcttacttgtggacatgattggagaaaacatagaattgtctcgctggattgctgcagagaagtctgattctattgtaaaccgatctattcctgttcttaacttcgtccaacaccacagacagaacaacaacagtgtctatagccttattttccaacaaatcaatctaccagaaacaaacaaaatattacattagtaatacccacaagctcaaaacttttagcttatgtaatcaaattaaagaaaaattacttggtgaagaacgacgttggtatcaacaacgattatcttagaggaagacaaacgagcagctgaagaatcacaagacttgcaagagaaagctccacagtatatgtcatctcgtagataaacctctcttacttgctgtcgcagacaaagagttaaaagttacaataacgaacaaaaaaactcggaaggaagaagaagaagaagcatagagagattgaagagaaaccttttggattcttcctcctctggttttcttattgaaaactttgctctgcaacatcttcaatttcttgctggaaaacttttcgatttcgccggtgaagaagatttcagtcgtcagaacggaagagaggaagaagctttttaaagcctttaaatttaaacctaagccagccaacttgactactaaaattttcaattctatagctccttattcgttcatggttaacgaaacgatgacggttaaaaccggtttagttactttttctctaaccggctcaatctgattaaaccgaagtaaacacagcaatacagctagtaaactcggtattactcttgatggaaaaaggtcaaaaacactctttttattttaaccaaaactaaccaatttttgcaagataatattgcatacctaagatcatttaccttgatctcatagaaatttttttaatgatgcatctccaattataccgatacaatttctagtaaataaatcagtgttcaataaagtgggataggcgtcgtctaggacgcctaggcactaaacgcttttataccgttttgactttttcaaaatcggttctattaatcagtgagatagatttggcagactatgtaaacattaagcggattagactctcattaggtgggttaggctaggcggatctaatcgtctcttaatattttttaaaaatttcaaaaatatattttaaataattttaaggacacctatactttttattattttattttattttactaaaatgttaaattttaaatttatttttaaaaatttgataatttccgttttttataatagtttttgcaacagttcagataatagtatataaatatatatcgttttattctaaaaccgattaaaccggctaaaattgtctaggcctcgactaagcgttctatgcgctaagcggagggtcaccgccagctaagcgcctaacattttcttaaacactgaaataaacacaaaattatatgataagaagtacgattaaaccaaaaataatcgtcacaatttttgccactatgtctaatgtatatgtgattgttttacctttaacaaaagaaaatgtgatttatttacctttaacaatatgaaaatttgttttttttaacacaattagtaattttagtgatattttcactcgaatttgttgatagcaaaaggtgtttagaagaccaaaaagcttaacgcatattggctcggctcggccgaataagttagctggacagtacggtggggcacacgaagatccttaaaccgcagcctcagacaaaccttactcgaagcaaaacagtgtttggttcgttcgtgggggtttaaaaaaaaaaaaaaaacttttgtatttttttccattaaaatatttttttgttaagaagattcaaaaggagaacgcgttagacacactaagggtgggggcaagggaggagaaactcgccggacagagacggagatccctaaaccgcagcctcagactaaagcttcgcatcttatctccgatccatcgttgacttcactcttaggtaaattcgaaaaccctttctcttatcttttatctcccaattcttaaattcgatgattgactcgtcctcctctgttttttcacagctgatcatcatcatcatctctatctctgttcggattctccataattgatccggaccatg

SEQ ID NO: 29696 - DNA, 3000 bp, Unknown; identical to SEQ ID NO: 14008
  misc_feature (1)..( 3000): 2750-1469P.txt file - cDNA_ID_3021383; gDNA_ID_2214692; Annot_ID_189414

SEQ ID NO: 29697 - DNA, 3000 bp, Unknown; identical to SEQ ID NO: 14006
  misc_feature (1)..( 3000): 2750-1469P.txt file - cDNA_ID_3021394; gDNA_ID_2214692; Annot_ID_189409

SEQ ID NO: 29698 - DNA, 3000 bp, Unknown; identical to SEQ ID NO: 14018
  misc_feature (1)..( 3000): 2750-1469P.txt file - cDNA_ID_3021398; gDNA_ID_2214692; Annot_ID_189407

SEQ ID NO: 29699 - DNA, 2225 bp, Unknown; identical to SEQ ID NO: 14026
  misc_feature (1)..( 2225): 2750-1469P.txt file - cDNA_ID_3021416; gDNA_ID_2214693; Annot_ID_189453

SEQ ID NO: 29700 - DNA, 3000 bp, Unknown; identical to SEQ ID NO: 14032
  misc_feature (1)..( 3000): 2750-1469P.txt file - cDNA_ID_3021440; gDNA_ID_2214693; Annot_ID_189436

SEQ ID NO: 29701 - DNA, 3000 bp, Unknown; identical to SEQ ID NO: 14023
  misc_feature (1)..( 3000): 2750-1469P.txt file - cDNA_ID_3021443; gDNA_ID_2214693; Annot_ID_189434

SEQ ID NO: 29702 - DNA, 3003 bp, Unknown
  misc_feature (1)..( 3003): 2750-1469P.txt file - cDNA_ID_3021476; gDNA_ID_2214694; Annot_ID_189476
aaaaattatcttcaatgaagactccgtcagatctccaacaaccttccgctccatagtaataatctctttctttaggttttcgtttctattggttagcaaatttacttattataaatagggtaaatgttgcctcccgggagaatatgttaacaaatctacgtatgaacatttagttattaagtaaaagtaaaatcaaaattttagctacaaattgagagattttgttttcccattctctaacatttaccggaaaaataaaaacagttactaatatttgagctaaacgaccgccacaaagggtgattccaacttatataaagaaggtcttgttgataaacgactaagatgtaaactgattcgcgtaagattaatatcaacggtcaaaatttaaaatctagtgttagaggtcaaccaactttgactgtgttagacaatccagctggcatttactattaacactgataaataatctcacacgtgtcaaatttccattcgttgattaaacagaagacatctaatcataaataggagaaaataaattgaggatgaagcaaaccaatcaatgattattaaaacttgattgtccttgttgctaactgctgaataatgattcttgggttctacatcaagaaaatgaaaatttgttggaattttaccttgttgattataaaattggatttttacgtttcgaataaacatcatactttacctagcaaacacacccttatttcacgaatcctcaaaacttaagattaaatgcctccaattccaaagcattaaatcgttggaagttaagagacttaaacacaatatttttcgtacatttaattttttgttaatgatatagctcgttaaacaccttgcctgaattccatgatttatattatcattagtaaatatacaaaaaaaaaaaaaaagattctaagaagaaccattattcgttaactagattaatgtcaacattccaacacagccatcgatgatgatgatgattcatcaagaagaagaagagatgccctcaaaacattcaatcgtcattagaagatccaaataaataaatcaagacaacttgcttgaattccattattcatattatcattagtacatatgcaaacatgcatgatttaatttatgataacttattatcagtatgcattattcattattcataacaatatcaaattaagaattcacaaccacatacagatgataaatcatgaaggaacataaccaagtatctcaaattccatgagagtaagtgacaattgaagaaatccggtttcctcaggaccagagaggttaacttcacggtaaaaatcaacccctttaaccgttggcaacaatgtgactcttctcccaacgaaataggtaccagttgaattcgttttgaaaacatctacatataaagattctacgggaaaattctgatcttgaaaaagttgtaattcttcatcaaactcaggatctccttcggttgctacaacctttgtttcatgtttctcgttttcatttgtccaagcttcaaccttgtattgatatgggcgaccattggtgactccgattgtaccaaagatattcacaagtagcttcacatcttcacctgtgattattatctttttccctcgcatttttcttcttttcaaataataaatctgagtagaataatatgtgtgattgatatgtcaacttaactacacctcaacaattgtttttgtggttttttctctcactaattcacgaaattcgacattttctaaatatatttatgttaaaatgcacgtgtttcatgttgtaattctttgtttataaacaagaaaaaatagatgctaaacaatgagaaataaatgttgtttgaataataaaaaaaattgaatgtttcttaataccatttcaaatactaaaaacaatgaaatatcatatttagagatttatttctatataatatctattttggtcatattcttagttatgatatttgactactattcaaaaacctaaccccaatatagtcaaaactatataaaaatgcagtaagatattaaatgctgttgaacaaaattcaatatcttatggcttgaaagtaaactagtaagatagctacaaaatgcatggtaagaagttaggataatcatattttaagaaacgaaaataaaatacctaatataagcttcgacacatacagctctttcttactggaaatcttgcatattccgaacatacatttttattttaggacggatatacctatagattcatttgcaagattgatttcctattgaaaaaaaacatgttgtggattcaaatatttgtcgctttttgttcattctcttttgtaatttcctaaacgagaggtcactaatccaaaaatcgttagcaattaactagaacatcttccatggttaacaccacctatcaattatttattttcttcaatgaaactttatgaaactctttccattttattaatttatatattaaagtttttgttcacactaaatttattgactcaatatatatctactttataactaaatactaattatttcatttactttttattttattaataatctacatatatatatatattgtttgtcttgtttattgtttttgcggtttgtatatttatatctcatattcatacaattttttagtatatatgcttaattaattaagatcgaattgtggcttgtttattatttttgcggtttatttatatgcatctcatattattacttttttaaattaatcgattaaaatttattaacttacgtaacatatttgatattgcataaattaaaaatcatatgtatataattctctttagtttaaattttaaaatgaataaagaaaaaaacaataaaatttgaaaactgaaaaccttttaaaacgaaaaagaatggctaagatgatgaatcggtctcgtacgggaaacacctacgttttggtttagtccggtttggttgaattcccagagactttgcttgaattgggtccccaatg

SEQ ID NO: 29703 - DNA, 3000 bp, Unknown; identical to SEQ ID NO: 14045
  misc_feature (1)..( 3000): 2750-1469P.txt file - cDNA_ID_3021484; gDNA_ID_2214694; Annot_ID_189469

SEQ ID NO: 29704 - DNA, 3000 bp, Unknown
  misc_feature (1)..( 3000): 2750-1469P.txt file - cDNA_ID_3021495; gDNA_ID_2214694; Annot_ID_189462
agataatgttcgagttttctccactaactaattcaaaaaatgatcatacacatactcagctaccaagcaaaacctcacaaaaaagcagaagcttttgagatgtcatcttcttcaatacttacaggatccaaagagaagtgtttgcagagagctgaaagaatcatctgcttcgcctttgaatccatcgtcaacttcttctctttctctattttcgaaattttgttcttctctttggggctcttcgctgtaagaaaacacactgcaatttcttcgatagggtttttgcttgatgtaactaacggtcctaacggacttccaactaacggcgttatctccatctataatgggcctagatatattagcagcccattaatatgttcttactatgggctttaccaccgaaagcaatcattaataaaataaaataaatgaattaacttctcagattcttcaaagacctagagtgtcttcgtcttcgacgacggcaaattcgtggaagctgtttcatcgattccggcttcactgaagcggcgtcgctcgacgtttattattccgacgactaggcctttgaggcagtttctgattaacttcaggcgataatggcaaacagaacagatccgttggcaaagaatataagaggaacgaatccgcagaatctggtagagaagattgtgcgaacgaagatttatcagcacaccttttggaaggagcagtgctttggtctcacggcggagacattggtggacaaagctatggagctcgaccatctaggtggtacctttggtggtagccgcaagcctactccgttcctttgcctcatattgaagatgcttcaaatccagcctgagaaggaaattgtcgtggagttcataaaaaatgatgactacaagtaagatttctaaccaaaagcttatttctgcgtaatctagattggatactgctattagccttgtcgtagttgtttctcaagtatacaggtatggaatgtctctcaaatctattggtcttagataatctactctcttagtttctgcagatatttgttcttgaattactgaaatatttactcttttggtttctgcagatatgttcgtattcttggtgcgttctatctgcgtctcactgggactgatgttgatgtctatcgctacctcgaacctctctacaatgactaccggaaagtgagacaaaagttatctgatgggagtaagtttcattttctttcgatggatccgttgtgtttaacttttgattgatttgttcactaactagatttatttctttggtttggaatagagttttcgctgacacatgtggacgaagtcattgaggaacttctaaccaaggattattcttgtgatattgcaatgccacgtttgaagaaaaggtttcttcttttgcatttgtctgaagctgaataattagtttttggtttctgcagtattttaagatggttaatttttcactctgatgataggtggacgcttgaacagaatggtttattagagccaaggaaaagtgttttggaagacgactttgaagaagaggaagaaaaggaggagaatgaagggattgctgatggatctgaagatgagatggtcagtgctttcattctgcaatagtttttatgtgatctgttttctgtttctatctagcagctctaagatgataccatcttcctcctcttttacaggatcagcgccgtaagagtcctgaaagagaaagagaaagagacagagacaggagacgcgacagtcatagacacaggtatctgaatccgtgacctttactagatacatttctatgctagttaacatttttcaaaaaaaaattctttgtgattgtggaagctgtttgatctagctaatgctcttgcatcatgtctagtactctgtcttttgagtgtctgtttccactatggcatctcaagccatcagcggttggatacagcttccgaaattaaatttgtagagatccttccaggtttctctgtactgacagtgttcagagagaagtattatggatcagacattattacaatccttaccctgatacagtatatggtagttgtcattgtgttactttgaaaaagatcagttaatcatgagagcacttcccatctagtttttagctcaatcaatgttttctttttgttacagattttcattatgattgatgttgagacttgagctcattgtttcatgaattataatttgaccatggttctgtgattggcagggatcgtgattatgacagagactatgatatggatcgagatcatgacagagactatgaaagagaacgtgggcatggtcgagaccgggatagggagagagacagggatcactatagagagcgagatagggacagggaaagaggcagagatagagaacgagacagaagagacagggcaaggcgcagaagtagaagcaggagtagggatcgtaagagacatgaaactgatgatgtgcgggatcgggaagaacctaagaaaaagaaagaaaagaaggagaagatgaaggaagatggaaccgatcatccaaatcctgaaattgcagagatgaatagactgagagcatcactgggaatgaaacccctcagggactgaactgtgaaatgaggacatctttatcaaaccgaaacttggttcatttgcccagctaaaccggttactacactgtgatcctactcactatagttttggtttttttgagtttacctgatccctctttaatgtagaacaaaatggagaatctgtaatggcattgtactgtatgttctctaaaccgtaaacgaattgtggtcgagaaattctgaatgtaacccggttcttgatattagttgtttttaaggtaattcagataaatataaaaacctatatgttatgtctacgtggcgatatcactttatgagtccatgtaaatcggacccaccaaaagcttataggtaaatgatacggtttcataatcattaaccatcacgacgcgcgtgctactcatg

SEQ ID NO: 29705 - DNA, 3003 bp, Unknown; identical to SEQ ID NO: 25430
  misc_feature (1)..( 3003): 2750-1469P.txt file - cDNA_ID_3021519; gDNA_ID_2214695; Annot_ID_189517

SEQ ID NO: 29706 - DNA, 3000 bp, Unknown; identical to SEQ ID NO: 14067
  misc_feature (1)..( 3000): 2750-1469P.txt file - cDNA_ID_3021523; gDNA_ID_2214695; Annot_ID_189515

SEQ ID NO: 29707 - DNA, 3003 bp, Unknown; identical to SEQ ID NO: 25428
  misc_feature (1)..( 3003): 2750-1469P.txt file - cDNA_ID_3021527; gDNA_ID_2214695; Annot_ID_189514

SEQ ID NO: 29708 - DNA, 3003 bp, Unknown; identical to SEQ ID NO: 25425
  misc_feature (1)..( 3003): 2750-1469P.txt file - cDNA_ID_3021531; gDNA_ID_2214695; Annot_ID_189512

SEQ ID NO: 29709 - DNA, 3000 bp, Unknown; identical to SEQ ID NO: 14051
  misc_feature (1)..( 3000): 2750-1469P.txt file - cDNA_ID_3021551; gDNA_ID_2214695; Annot_ID_189500

SEQ ID NO: 29710 - DNA, 3003 bp, Unknown
  misc_feature (1)..( 3003): 2750-1469P.txt file - cDNA_ID_3021559; gDNA_ID_2214695; Annot_ID_136789
aaacagaagttaattatatgattattttaacattatgttacattcattatatatacattattaaaataacacaaaaaaaaacgttaaaaatttgtcttaacaaaaattcattacatgctattaattttcatagatagtggatacatacgctatagtgacactgacatcttaaacaaaaatcaaatgtattaatttgtcttaactgtgttaagaaaattggacattgaaatattattcggtttgagttgaaattggcatttgacggatccgtggtttgcatggtgtaccaagcaagaatcgttggttaaaagaaaagaacacacattaattatcatgtttatgcgtaattgatatgtaagttaagtagattatatgcttctcaaaactaggtatttagacaatgagattagttagtcttaattattaaattaatatcccgatcttatcatataagccaaattatacgaagattcttaagaataatcattttaatttcactaacctctctctatctctctcttcattatccgaattaagccaatcgaatccttttcaacccgacgggtcgtgaaattccccaaaagattcctctttctcagctcaatttccaaaagctccgacctttacgatcctctagattctcggcgccggtttctcggagtaaataatggctcagttcacgggtcgggtcgttggagactacttggtgggtcgtcaaatcgggtcgggttcgttctctgttgtttgggaagcgaggcaccgcgttgacggtactgaggttgctatcaaagagatcgccatggacaggcttaacaagaagctgcaggaaagtctcatgtctgagatttttatcttgaggaggatcaatcatcctaacatcatccgtctgatcgacatgatcaaggtttctttttttgatttgaagtttcgatttttttggtcggttctcattttttagctgagaattttgaattgaggttagctttgttactatatatgtttctcatttgctcatcccaatgccaattttgtgtcataatgccatgattttgccggtgaattttggatcatatacatggaattaagcttcaattgtggaacaaaatttgggtctagtttgatgttgttctgatttgggcaatgtgatgcagtctcctgggaaagtacatttggtgttggagtactgcaaaggaggtgacttgtctgtgtatgtccaaagacatgggattgtccctgaagctactgctaagcatttcatgcagcagttaggtaaattctagtggcacttacttactctctgttttgttgtttttcttggttgccagaaacatgttttgtaatctctgacgggttttattttatgtaacagcggccggcttacaagttcttcgtgacaataatattattcaccgagatttaaagcctcaggtgtgtctgattctcattcctttcatttcaatgatcttctgtgcaccaggtgttttttattgttaatcagattagtgtgttagttgatctcactgttaaatgatacaactttcagaatgatgaaaggatgctgtagaagggtgctctgttagtttccaataaaacatgtttttggatatgttggggtttccttgtccaagtcttggagattccatctttgttgaaatttaattcttaaggttctttcgtttttgaaacagaatcttcttctatccacaaatgaaaatgatgcagatctgaagattgctgattttggatttgcaaggtattgtcatcagcaccccttgttactagatcaaagagtgtaatatgaatgaattagagaaggtttcaaatgggctcaagctgcttttgaatgtatattgtcgaatttctaggtaatttcattgttttcttgggggattatacttattatacgcctcccccattttgaacatcgctcttttcttgacgcagatcgttgcaacctagggggctcgcagagactttatgtggttcaccattgtatatggccccagagatcatgcaactccagaagtatgatgcaaaggtcagacctttctcttactaagctacctaggcccttctcttgacattatctccttacaatcctagctgaatacacaggcagatctctggagtgttggtgctattttatttcaacttgtgacaggcagaaccccttttacaggaaacagccaaattcaggttttgtgttctgtctcattgacttctatattatgtatgtgtttgtattctggtgcattaaactaatacgttctccatcgtgtgtttacagttgctccaaaacattataagatcaaccgaattacattttccaggggactgtagagatttaagcttggactgcatagacctgtgtcagaagttactgcgccgtaatccaggtcagcactaattctgcttgaagtagtggagactactattcttttgcatgaaaccatatgccccaggttctattggcatgtgtgttgatctaaaaatgtgaaattatattgaattgtggccacgttggattggcgattcaagcattttataatttgtaccgtgttcagagttttttgtttgattagcacaattaaaaacacaaattgtactgttgccatttcagtctgtcctaactttccgagtaactcatatcaacgggagttgcggagttttccagaacttggaattgtgatttgaatagcggtttatactaaactctagtcatctcctacagttcaccgcgtattttattcgagagagcatggtcctactctgtgtgtatccaaatacgattacaaatcattcttgaatatattgtcttttgcagtggaacgtttgacatttgaagagttctttaatcaccctttcctttcggacaggcagtcatatgatttctccaggtagatgtgacaattgtgggggctaatgcttttctctattttatgcagaaatttgtactgattaaactatctgtgctacaggagtagattggggttaagaacaatg

SEQ ID NO: 29711 - DNA, 3003 bp, Unknown
  misc_feature (1)..( 3003): 2750-1469P.txt file - cDNA_ID_3021559; gDNA_ID_2214695; Annot_ID_189496
gatgttctagtatggctctaaaacattcatccaaactacatcattggtattatgttattgccatggtatattcagatggatgataataattgtcacatatatagcgttattgtgaaataggataccaaaccaacttcatacaagaactacaaattatatacataaataatcaacaaataatatatagactactaaaattcaaaatgcttcagaaaactaagaattttcacataaaataaattctaggaattttccaaacgagaaccattctaaaagatgtgaaacaccgaagctcagcaacctcctccgcctccgcctcctcctcctcctcctccgcctccacctccatccccaccgccaccaccaccaccaccaaaacctccaccacctccatcaccgccaaagccacccccatttgctccatcacctatttccacatcttcacctccgccatcctctcctcctccaccatcacctccttctccgcctcctcctcctcctccgccgtcaccaccacccccacctttgcccccggctccagtcaaggccgcaagaaatatcaaaacaccaacaaaagaagcaatagcaatgataattactatccaagtatccatcttatgcaaaatcgttacgtttagctaccttcgattgtgtatatatagtttgttgccgagggttggctgcagacaaataacgtgtgtcaagcttgtattgacttaagacttttattattcatatgtttctatattcaaacttcaaaggttttcattacgggccggtaaaacttcatctattaattaaaatgtttctatattcaaagttttcattacggccggataatacattccgtatgatgcttgctttctttgataatgccaactatgacaaatcttatactaataaatatagatagctatatctttgtcgttgataaaataaaaaaaaagctatatcaatgtttgtctaagaatatatcgattgactcggtcagttgaagttgaattccaattggtttaaccgttcaatctatgtgacatatttcacacggtcttgaccagaatcaaacatgagaaagaagtgcatgcacatatgatcatatcagttttggataatttagccttgttttgaagactttgataattatgtggaagtatttatagtctggtatatatataattatgaaatgtctacaaatttattggatatatacgccacagtgacatgtttgaaaattcagtatatatgttgtcttcattgtttagaaaatcggacagtgaaatcttttttttttttttttttggtttatgtgaattactttgacgaaagttcaacagattatatgaacagtgaaatatttttggtttaagctgaaattttgcaagtgttatgattcgtatatttatggcttgcatgccaaacacataattcgaggaaccttaatatttaaactaacatcaataatcatttgacaaggacgatcagacaagtcacatttttaactcgacgaggtatccgaataagcccaatcgaattcttttccaacccgaatacccggtgatgtaatatactctaataattatacttttctgttcataaaaattgaatattctagtttttgttgtttgttctacaaaacttgattttctagcgttttcattttatttttattgatatataataataaatcttaaacttgtaatgactgaaaatattaatcattaacttatttttggttaaagtaggtcaagacgcaagtggtttctaatgcaggtggacttccattgatgattctagcattgaatgcagcgttgcgtatccagactagcgtttggctcatgtttgttacttagtatttccttatgttttgcttgcgctttgctttttagttaagtttgcttgtgttagaaaaccaaaatcaaactcttgtgttagcttagattaaatgaaattgtgtattcttgatgatcctaagtactagattgataaaaatattagtctgttattagttagaatttaacttactaaaacgcttgtaaaacgcaagatcacccatcatcgatgatgacaagcgttatcattaccgatgatgtagacactattcagaccatccgccaaatcaatgcagaggtcttcatcctcgggatcactgccggaaatgaccacaagttagcgtgtctagccgccggagcgacacagtgcgtcacaaacttcatagatgtcaaaaagattaaggatatcctcgaaagtctccccgacgtcccggtcccagccccccaccgtttaaatccacatcatcaacctcgatacattcattagtatatatatatatatataaacagaagttaattatatgattattttaacattatgttacattcattatatatacattattaaaataacacaaaaaaaaacgttaaaaatttgtcttaacaaaaattcattacatgctattaattttcatagatagtggatacatacgctatagtgacactgacatcttaaacaaaaatcaaatgtattaatttgtcttaactgtgttaagaaaattggacattgaaatattattcggtttgagttgaaattggcatttgacggatccgtggtttgcatggtgtaccaagcaagaatcgttggttaaaagaaaagaacacacattaattatcatgtttatgcgtaattgatatgtaagttaagtagattatatgcttctcaaaactaggtatttagacaatgagattagttagtcttaattattaaattaatatcccgatcttatcatataagccaaattatacgaagattcttaagaataatcattttaatttcactaacctctctctatctctctcttcattatccgaattaagccaatcgaatccttttcaacccgacgggtcgtgaaattccccaaaagattcctctttctcagctcaatttccaaaagctccgacctttacgatcctctagattctcggcgccggtttctcggagtaaataatg

SEQ ID NO: 29712 - DNA, 3000 bp, Unknown; identical to SEQ ID NO: 14082
  misc_feature (1)..( 3000): 2750-1469P.txt file - cDNA_ID_3021580; gDNA_ID_2214696; Annot_ID_189544

SEQ ID NO: 29713 - DNA, 3003 bp, Unknown
  misc_feature (1)..( 3003): 2750-1469P.txt file - cDNA_ID_3021584; gDNA_ID_2214696; Annot_ID_189543
gtgagatattaatttaaacaccacatctacgaccgacacaactttccgaacatcctcctcgtcctcatcagattcaccagctactttcttcatcttcttcttcttcttcctcgtcttcttttgtgcatatcctccaccagattaaacaccctcattgtgatagattttctacttctttgcgggagattcagacttagcggctgctttatcttttacgtttttcttcttcttctcattcctcttcacatccctatagcctttaacattccccatgtatgtcttcaatcaagtgatcaagtgatgggtcttctacttcatctagccacatatgaaatagctcgcttacatcatccgtcataaccattttacgcacacgcatatataacataagagattataaaacccatcagtatgtttacagtcagtcatcaataagtataacgcagacattgctcaactatgattccaccatcactaaaccacaaccaagtcattactaaagtataactcaaccatcaataaacaataacacatccatcacaaaacataactcagccatcacaaaacataactcagtaagtaactatcataacagagccaaaaccttacctcaccaccatgcgctgtaatatcttcagcaatggtcgattccattgttgcacgggtacggttgacaccccatctaagtaatagaatctcatcctctttgattacgttcccatatcgctctccaatggtgttgattgacttatacgcccgagcctgtaacacgaaagcaacaccactgatggtgtacgacttgccaataggcctcttcaactttatagaatcaacaagggcttcaaatgctaaccgactccataaataagtcttcatggcttcgtcatcaaaaattcttttggcactctcaaatagtatcctagagttatgatgcaagccaaaaagtccattggctagacgagtcaataaccccaaccatctacgcttttcaggaggccatgctctccacactactaagcctcgcctaagtatctaacttaggaccttcaccacaatgcacattcaattccctgaagaacgttttgtagtccacttcaggttcaaactactctataggcagtggatctgtgtttaaccccgtgatatgaccaaattaattcaagtcaaacctgataggttaaccagccacgagacaccaaatctccttcttcagtattcttaactgtctacagagtagtgaatgtacagtattatcagaccaaacaaaatgactatcaactagcttagcaattactttaagaggtgtctttttcatttgattccatgcatcttctctaattgattctctaatcagagggacatctcccatctcgatgttgtgattaatggctttattctctagattagattccccttctggataaagtcttggagggtaatcccttgcttggtcttcagacatctgataaaccataaatcagccataagcatacattaattcagtcacaacataaaacaaactcaaccacagatgcattaaaaatataactcaaccaaaacataaaaaaaaaactcagcaacaacatcacagaaactcaatcacagatgaaaggttaagccataactcagccaaacataaaataaactcagccacaatatcacagaaactcagccacagatgtaaggttaaaccataactcaatcgtaacataaaacaaactttgccacatacgcattggtaaaccataactcaaacacaccatataacaaattcagacacagatgcattgataaacataaatcagtcgtgaaacaaacagtaactcggccatcaaatcgaatagatctaacaaatcagccatcgtatgtaaatcagtgacggcgaaaatcaaccgtaataattgtcgataaaaaccctcaatatcacagttttcgtaaaacggtttcagtcacgggaatcacttgctgttgaacttagatgtcgaaaaaatctaattaaagttagtttagacacttaccggaacaagttcaaatgcgacttgatagggatgtgactttactcgacttaaaattcgacactatcgaaggattttggccgaaagagatgagataaatagaaaacattgacaaaattagggttccaattaaggaatcaagtcgacggaacaagagaagagagagccagagaatagttctttttttttttttttttttttttgcacgcggattaaccgtgtagagggaaaaaggaaaactaaaaggtttaacgaaattttcgggtaatgacgtggattaggataatgacgtggataatgattgtttttaaattaaaaaaaaaatattatttagataaactaatcaaaggtgttaattgtaattatacaaatgctcaaaacatatgagtaattttttaaaactctatgatattctagtaataaacatacttttctatgatatctgagtaattaattcacccatttttaatataaaaataccaaaaaattagttttagattataattcataaaacctaataagtttttagtttaaaactaatatatcatagtcacaactcatgactaatatgaactactgaggaacaatgggagattagatcgcatagagttcaattcccgttctcaacccatgaccaatatgaactcaaagtttccttcaaaaccctcgttgctccgttcgatgcctaatttaatagggaacctcaaagcggctctatttcattctattccatacatatcccaattccattcatttaatatcattttggtgtcattgacataagagatgtaatttctagtctatctctttatatttatatatatgaaaagttgcaaaatcatcatataataatctagaaattgaaatagaaaagaaaaaagagaggtttgtgatggaatttcaatcttttatagtaggtaatctagtatccttatgcatgaagataataaatttggtcgttgtggtcggactctattgtggatttatg

SEQ ID NO: 29714 - DNA, 3000 bp, Unknown; identical to SEQ ID NO: 14088
  misc_feature (1)..( 3000): 2750-1469P.txt file - cDNA_ID_3021657; gDNA_ID_2214697; Annot_ID_189568

SEQ ID NO: 29715 - DNA, 3003 bp, Unknown
  misc_feature (1)..( 3003): 2750-1469P.txt file - cDNA_ID_3021664; gDNA_ID_2214697; Annot_ID_189566
tattatgtaagtgaagacttggtgtgaagccttggagcttacgttagaagagcaaaaggcccggggctagggtgagctggggggggacagcgtaagtgagcgaatgtgtgtaagcccagtcaaagatgactgttctaagcggggggagccacccacctttgaatggtgttggtcctacggaccgtgaacggatttcgcctctggcctctgggcacgtcggaaccgcgtgagttcaccggggtggagcacggtccgccaaaaccggcatagattaggtgctattgatggaacatggtaagcctatctttctccatatggaagtgctgcgagcacttagagatgcgggtagaggaagcctcaaaaagcgaaggccgagctgtaggtcacgtgacctgcaccgagttggtggctgactgggctttttccttgatcaaagcagatcaactcgccttctttcttgttacccaaaactaaagttggtcgaatggtttttttcctgccccggaacgtcgaatgaaatagggggccgggttctctttctacaacccttttgatatgataggcctggctacctttcccctatcccttatgattagggggctgttaagcccaagaacaaccagtcttgtggtggtacggaaggaacggactccgcgaacgtcccgcgccccggaaagaaagtctcaaccagaaccacattccttttgcgtgcggatgtagctaagtgtctgactctattggtcatagtttcctgctgttgcggctggtgctcgtttgcgcgcgcgtgaaccaactcaacaaagaaggaaaggatgcccggggaggcatctgagaatgattcgagccgtatgaagggaaactctcacgtacagtttgttttttttggggggggcaggagcccgacagggtcccccactgactcggcccgggcctaagttaaagtgaagtggtgggcctacccatcccaaccaggggtatgctgggattcgcgaagagcagcaccttacgatgttcatgaccaatcggatcttgacgtaccagtaggtaccagaggagatcgctatgatcgttactgtatccgtatcgaagagatgcgacaaagtcttcggatcattgtgcaatgtcttaatcaaatgcctagcggcatgatcaaagccgatgatcgtaagctatgtcctccatcacgatgtcgaatgaaactatccatggaatcgtgcgtcgtgtgaaacgtagatcatcgccgttcttaaccaagactcaggttaagctccgtctcggaaccttgtgggttaggagtaaagcatcccggggttggcgcatctcattgggcgtagagaagcattgggaaccccaatttatttcttcggagccgtttcttttcccgtcccccccaccccggcatagcgcttcgcttccggttcttcggaagaatcaacttacttctaccttcttcattgatctgggggaaaaggaaccgtctaccagttgggaagctagacatcaagtaagtggcttgatgaggataactaagctgacacgccggagttggctgctggcacaacagggtggtgccttaccgcactgcaggcgaacgcgcggtagcgttcgtggtggtgcttcaggattccaatgtactgcgtccaagatcagaacgagcttgccggcggaccactgtcgtcccattcttgagtgagctggagcgcagccatcttatccactgaactagctagaagctatcgcttcgggtcgaagcactaaaagaaaagcaccgggaaacgcggcggcataggaaccacgggacccccaccctactagtaaagggaaaacggaagtgcgctcctgcgcaccagctgaaaaaagccctttcccctttctctgataataaggaaagcttcttagctccaacctatacaaggggtttttatgtcctttttataggttgggttgttggatacgggatcctcgtagtaggctggaccaacatccagccgagagagggcagcctctagaagcaacaggttgggaaaccaagagaacgcttcgccttttcttatcttctttctgccctaggagtagaattagcacaaaaagagggattcgcattattgacccaatgataaaccactaacaccttcctcgttggggctccgcgcactgggaaaacgctgacgcgatgggaaaccggccactagttacaaagctccaataaggtatcgagagggctatcacagtcaggtgcgaagcaattacccctatttggaaagtacccttcttcctatttagggggttaaggcgagaaatggcttgatgaatcgttccgttcgccatgcaccggccccattcacttgcttatcgtagaggctgtaagtacacagtgccccacaactatcaatagtatagtggggttgaaagacgagagtgcccgccctttcttttctttcaagtgggccacttttttcccgaacgcagtccgggatcaccgtggccgtgtatatatatatatatatcttcgatgctgtcatttcgaaatgtccgcttcaatcgctctttcacctccccccaaaaaaagcaaagttggcttaacgagcgcagatgtgaggaagcgggagcaataaaacaaaaaaatatctttcttgtccttctacttaaggggcaaagagaagcgcttttgctactgagaaagcgaacggtcagcgcgaaggttcaagacttttctgagcgttagcgaagctagattctcatagcgaggcgcttcgagttagcgaagcgctgtagtagcgccgaagccctatgtgctataatgctgagccaaggacactccgccttatctatagaagcagtcaactgagttctgaacgaattagatccttggtaaatggctcaatctatagatagaaagccttatgatgggaaactaccacgttaggtttggagagagatgggaccggttatataatagagggagcagatgcaagcttttttctttcaatagccggccaaatg

SEQ ID NO: 29716 - DNA, 3000 bp, Unknown; identical to SEQ ID NO: 14089
  misc_feature (1)..( 3000): 2750-1469P.txt file - cDNA_ID_3021669; gDNA_ID_2214697; Annot_ID_189563

SEQ ID NO: 29717 - DNA, 3003 bp, Unknown
  misc_feature (1)..( 3003): 2750-1469P.txt file - cDNA_ID_3021672; gDNA_ID_2214697; Annot_ID_189562
tatgttagtatctagattgagtatcataccattttccaaagaaagatagtatgctaaaatattatgctaatatggtcatttggtatgctcttatagggatagagcactatgtaagaggtctcgacgagcctccaccatactaagctaaggtctactagctatagtagctagatgggaatgtagcctagcagctagtagctctcttcttatagctcggtagttggatctttcataattcctttatggttagagcacactgggatagaagaatagatgagtttgtatctttcttcctactttttttttatcggaaaacagagctagaacaaggaacaagcaacactagcacttaaaataaggtaggcggctaaaacaattgggcatttccttgatgtccggaaatggtatatctgaaaacagaagaaagactttcttttgaaccaaaactaaagatgatccgatccgtgcaccgcttttcttctctaccctttagaatccaaggaaaaggcaaagagaaagaggttgcagagggcacctaaccttccaaagacacagcagctctagcctaacttcggattcgaaaccatacttccctgacttcctctcaacaagaagttaaggctgaaagtcctaatcttcttatcccgatgcctggagtagcgggtcttagttcggattagtaccttttgagcaaggtaagttaagtttcggcagtgaaagaaagtaaccaggatccgcttaaccagttatggatgaaggtaggtctactccaatccctcagccaataaacaataaagtaggcacatttccctcggcaaagaaagtagtccctcgctaaagagtagacttgagtatcttcgaagtcaaagccgaggaataagactcagttcgggtagagcaaccatttatattttcattattcttacccgtttacataaatgaaaaataaaagtgaattaccacggaaaatatccacctaaaaaaatttctggggttacttggcatagtcctctaaagaccctatttagatactctttcttccgagttcgagataaggaggaagaatggggcgacagataaaattaaataaagagcaaaaatgcttgactttcattttattaaatataatggtaggtagggcttcttttaggtcataaagggaatagtacttttagctcgttcatctaattctgctggtctataggagtggctcccagggctatgtgatagcacccaaaatacgacggcctgatcaagagagccagaagctgggtccgcccgccggagcttctttcaatttccggggggcttagcttgaaccactcccaagtgccaagaaccggcgaatgaaggctccgtggcggcatcggagctgccaataagctaatccgttcccagtgagctattacgcgctctttcaagggtggctgcttctaggcaaacctccttggctgtctctgcacccctacctcctttataactgagcggccatttgggggccttagctggtgatccgggctgtttccctctcctagagaaagaagttctctagtcactaaagtgcgtttcactctcgttcctctcgtttcactcgggttgctaaagcacctctcctctgccaagctctctgtcttggttaatggttatccaaaaggatatttctcatgttaggcggtgtgagacagggggataaaggatcccccgttgttattttgtattgcggaagatgtcttatcacggggtcttaccgggcttaatcacctgggcattctttcttcaattaccgagacctgtacatacaaagatctaggcagctcatcttcttctaacgaagtcagatctttttccataccataacatatatagaatcgattttcttttctgatcgctagcctgccgggccgcccccgcgatcaaactatcaatctcataagagaagaaatctctatgcctcctttttcttggttttctcccatgcttttgttggtcaacaaccaaccacaactttctatagttcttcactactcctagagacttgacggagtgaagctgtctggagggaatcattttgttgaaatcaattaatctaatcatgcctcaactggataaattcacttatttttcacaattcttctggttatgccttttcttctttactttctatattttcatatgcaatgatggagatggagtacttgggatcagcagaattctaaaactacggaaccaactgctttcacaccgggggaagaccatccggagcaaggaccccaacagtttggaagatctcttgagaaagggttttagcactggtgtatcctatatgtacgctagtttattcgaagtatcccaatggtgtaaggccgtcgacttattgggaaaaaggaggaaaatcactttgatctcttgtttcggagaaataagtggctcacgaggaatggaaagaaacatattatataatatatcgaagtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgccatcttaaaaaaattggaatcttgttaggtacccgtacgacagctctaataatgagctaacgtactcatctttagagtggtttgtgcgcaggctcgagaagttgctgcccgcttcagaagaccttagggtgccttcgattcctggacgactttgttcgtcgtgtacaggggacgggaagagatg

SEQ ID NO: 29718 - DNA, 3003 bp, Unknown
  misc_feature (1)..( 3003): 2750-1469P.txt file - cDNA_ID_3021682; gDNA_ID_2214697; Annot_ID_189556
agaacttgcttcgctaggaaaggaaaagggagagttggtttcaccttccctataagaactaaggtttaccaaactccctagccatctatgaaactatgatactttatacttccaaacctgaaaaggaaaaggaagactaaagcatgggactaaagctgaggaggagctagtggaactgtctacccaagaattagaacaaaagctgctcacagtacacctttgtttaactgtacgagcgagaataccagctaatcatgtaactgccaagaataaggattctaaaggaaagagttaggtgtgccagagatcctgggattacctttggagaggaaagctcctactattactattaaggagcactcaaagcttgcttcgctaggacaggacagcacagaagagtagatagcttgcttcgctaggagtgtgctaacttattctcataggcgtacccgcgtagaagaagctaccttcctcaaactcctctgcgcaacccagccataccagagagtgctatcacaaggaaattgtctggtctcagaagatgagagcttcttttttagcagaggtactgatgtcaggagagtgtcgacgcgctcttccccagtcgtgttgaagaagtttgagggaaagatggattctgaaggaaatcggctgacctatcggatgaagcagactgctgcgaaagtggtgccacgagtcgagaactcttagaattgtgctcgttcaggctctttagtgcacctaagtgcgaagctggtgctgcaagggaggatgtgggcgggagagcggtcagtcctctacctctcgctatcgatcccttttgcgtcctttctagctatcgactctatccctttttctttctagctatctcttcttccgtaaggacctttttgttcccccccacgctgatcaacaaccattgagataggatagagccaatgcaggaggtgaccgaagtagctcaataaaagaatgaagaaattgggaatggtaattcgagcaatgaaaagaaagaaagagttcgcccaatcgtatagctttttccttcaaatgcttctatctcacttgtttgctagcttgcaactgctgggcactgaaactcagtcggccgacatcgataagggagattttcttccaaccccttggaagagaggaagagaaaggagtggtgatggcttaaagaaccacgttgcataagccggaagcacagaatgttactcggaaacaagcctgagaacgactcttcaccgttagccattatgtttacctggtcaaatgccgtcgtttatgataggtcggtctagtgagagcaaatgatcaagcaagaacgtgcctacatccgttgatgcacttcgttgactagtgaagggtttttccttggggcccacgttgccactggggtcgctcatcttactctagggtagcactctctatggaaagaagagtggttgtgcttcactactagccaagtccatgcagatggggataagggggttcactgctgtctgatatcatcatatctattttgacctaaaagcttacttgggatatctaagagctaattaaatcttttctcttaaaaaaacgggtaataagaaaacacttattatctttttatttgcaagcaacatctgctcaaaaagaaaaggaagttgacttcacctccggtgaccggcttcgcgggatcgccttacgtataaggacctgatccactctaggcgaagcttttttgggcgaaagctacttactatgttatcttccaattgagttgagagagttttcaatcgaattccaatttttcgttatataagctatttataattgaatgatttaaagattgagtttcaaaaagaaaataccggagaaaaggtgatgcaaacaggaaacctgcttcgcccgttgatggtccaagcccaagtattcattccttaaggagctggacgtattgttcagcttcctatgaagctaggctggcacttaggaagattggacgagtacaagatcgaaaagaaccctataggcaggctaaaagcgctgtccgtcttcatggcctcaataatactcagtattgtactggccgaatccgtttcgcagcacggagtatacctcaatctccgttagttccgtttcggctttttccccaatttcccactccttctgtgaggcaaaacctcaccacactacacttcgacacaagagaagaggaccgggcgcttgtatcttcgggataggagttatcggtcttctttaagaaaactcaaatcaaatactccttatctcatggatcaacttattgctgatttcgtttctaggatgggtttggctctgcctgtacttttattcttgtagccgttaggtctggccaaatgatccatcaaataaatagtattaatatggaaataatcctgactgatgtagcgcgagatgcgcttcaagaaaaaatcgtgtcccaactctcaattctgttgagagtatatagggatactaatactagtgagagtgtgaccttacctttatccggagtaaatctccaagaagtcgccgctcgtagtttttttaacaacgagagcattccatggttttttcatctatttagaccttgtcaatcagggcacgaaaaaaaaccactttgcccacaagctctggagttagtgctttcgttcagttcataaggtagactttttttttctaaagcggtattcctccttgcctctaatcctcaaatctaatatgattactcggctgttcgcccaactggtatcgttatcaattgtaacttattggaatgacgctattgttgcgacaaacttttcctggctcttcataactttctttgttatgactttcacctttcgtaccttctcgcgctacttcaaaaaaccgatcatttggactttctatttttttttatgtttaatagcctttctccttctttgggcagcccgaatccatataaatatccttttctcatttgcttttggagatgtttatagcttcttcatg

SEQ ID NO: 29719 - DNA, 3000 bp, Unknown; identical to SEQ ID NO: 14086
  misc_feature (1)..( 3000): 2750-1469P.txt file - cDNA_ID_3021692; gDNA_ID_2214697; Annot_ID_189549

SEQ ID NO: 29720 - DNA, 3003 bp, Unknown
  misc_feature (1)..( 3003): 2750-1469P.txt file - cDNA_ID_3021726; gDNA_ID_2214698; Annot_ID_189587
aaagcaagaatagatagagttgaaagaaaggcgctcgtatagagccctcgactatgtatcggacatatggcaggttgggaaagcgcgcttggaaaagaaagactatcctcgaggtaaatgtaaatcaatctatctcgcattgcccaatctgaatgctaaaggctcgtaaccccctaaaaggaaactcaccaccaaaagaaaaaggtaggttaactaacgaaactcaaaactacattttaattcttgctcaccgataatcctttataaaaaatattatacagctgtatacaggattattggtatagctgtccactagccgaaaatcggacaccaaattattgtagactgacgacctgtccttaatagaaccgatctgactctctgaacaatcggaatttcgtacttctgtcggatcctccctatctcctgatcgagcttgtgtaggtagatgttgcctggtagggccgatagtagtacactgtgtgggacggagtaagggcccctctcaactcctacgagtcgtccggcggaaaagactttctgaatggagtaaaagaacttgggatcgtcgatctcttccttcaaaatttggatgagtcgatgtcggtcgatggtgtgaaaacacttcctgatgtcgaattctaaaaaccagcgagagattccccactcttctttgatccgtcttaggaccgagtggcagccttgacccgagcggaaatgcgatgtgtctggaaactcgggatcgtaaatggattcgagtaccattctgatcgcctctttcatgatcttttctataggtagaactactgtgagcggtctaaacttcaacccttctttctttcttcatattgtaaaggggggaaaagctcgttttttgctccccttttttataatcaaaggccccctcctgccgtcgtttcagtgactcatagggcttccctcagttcagtctttttggttcttgaaaatggtcgccacctctcctcttctttcagtcgatggggttcctctccttttagtcgagtaatcaatacctctcccaggaccggaatgattatccctgcccgatgggtctacatccatccctgaatgtcgtcgggtactgttcacttccccgccattcttgtaaccgtcacctgtaatccgcgcgggtgtgtccgcacccccctgagtggacgagaaagaaaggatttctcggagcaaccccccaggttccagacccaggagtcaactttcccgtatgagcattcggtacatgtatcagtccgtgggaagaggtgaaagggtcaccactactgaggatctccccccccccctaatcttagataggtcgtctgagggttcgccgcggttcattgctgtgcttacacacaaggctacccttctccgaaagctacgcgggaccacctaccactagtcttcggccggaggggtttattgcacaaaaacggccgggacgcaggctcccgaagagggaagcccaacgaatgtcagatgcaaagttccgcacctcattaagatcatattggcatactctcccaaaaaaaaaagagcagaccccattgaagacgagagtaaggtacaacaaggccatttctgtccaccgcccttctcacggaaccgtacgtggacgttaccgctcatacagctcccagccagcaagcacagttagccttcctctacaagaaatggaaatgtggatgaatcgaatgaaatcgaggaattcggtttttcttttcagacatgataagtaagagcatccctttcacaaaaacctacggatccccctcctatcctgccacttcagcaccttgtgatctttgagaagatcattacgagccctttcctagaatgtttttgtagattccgaaaattccagagtggatcaggacgagaatgaatccgggaatccagggcatactcatcctggagcttccgctctcctctgggaagggcttttttatggatagagagatgagtcgagggattgattactcgactaaaaggagagggtagcctcccgtttgaccgatttctcggagtcggaagaagatctctcatctgatgaccctgaacaagaaggagctgctctcgatgtgagatcagcagcaaaagaaagaagaaaagggccatgatgatgatcctatgttcgttttcgccctgcccctatgatgcgctcctagctcgcagagcataagtcagcgcaaaggagagatacatcctttaagactgtgaagagaatccttggtttgacctacggactacgtgggaaatacgagatctaggcaagccgctacatgttctcccccttgcccttgaacgatagaagaactacttatcttctcttagatagcagtcgatcggttctatgatctatggtcaatcaataggcccacggatctattcttctatacgataaattgccatctcgtagcaccacagcctgggggtaagactagaagaggagatttgcttggtcttctgtgcggaatctgcttcctaatcagtgtagctcttgggtcagctcacagctaggacgtcatcagttctaaaggattcctcactagggagactctctccttatgggcaagggaggcagattttgatggggagaaggattcggaatatagttacataagtccccttccctctcctcaatatagtttcactcgagtcacgtcagtacctctccttttagtcgctcgtcgagacctcatcaactagttaatacctccggacctctcctttatcagtcgagtttgtgttcacaacctctcgagaaacaagttcgagagttacgtactttcaatgctctctctattccttgctaatcaaggcctgcaagggaactggctacgactataggcgggacgacatgcttttagcttccctgaaataggcgacttgctcgctttggcaggaagtattttttttgaagaattgaacaaaaaaaactgaaatttctgtaaatcattaaaacgggactttctttaaagaaaaatg

SEQ ID NO: 29721 - DNA, 3000 bp, Unknown
  misc_feature (1)..( 3000): 2750-1469P.txt file - cDNA_ID_3021734; gDNA_ID_2214698; Annot_ID_189585
ggcaatgcgagatagattgatttacatttacctcgaggatagtctttcttttccaagcgcgctttcccaacctgccatatgtccgatacatagtcgagggctctatacgagcgcctttctttcaactctatctattcttgcttttcaaacattgtattccttatagaatatcatctcatgtctatctatagtataacgtttctcatagtggcatagcggctccgaggtgattctttctggtatccgtcctctctcatactgctttaaggttggaggatttagttcaagctagtctcctatggtgaagatctctatatttgttaagactgtatgaaagaaatcacatatagtaatcatctaagaatatatctatactataatggttgcatctaacatttctcatagtgtagataaggcagtccccggagctaagaaaactacgctattcaaagcaatccgcccaaggaaggctagctagtcgagtctaatgctaggctaggtgattcctctctatcaatgaccgaagcttaatccagagagagagctcactataccaccaggttgccacatttgcttatgaaacaagaacagcttatcccgaggctctgaaagactgagggtagtcactcaaaaagtaatccgtcacttcgcccgaaaagcactataggggattccggccaagcgagcataaaaatacaatacccaactttctgtttcagcccactccacttcattgaccgagactttctattccgaaccggttcggttaaagacctagccacgagaccaactccgggctgtctcgtaaaagatcaattcccagatgctcttactcgacgcccacaggcaagcttgtttagagaaggagagttctcttcatcagggaaactgctcaacctccactatttccataagcatgattatgcactagcagacataaagtgccaagaagagaaaacgcataactcataagccaaagatgtattcgatcctgaattgaacgtaattttttccgattggttggaaggtaaggatagcatgattgactggttgcgggtcccttggatcatgggccacagctatttggatagattcagatcctttcatgtagtagagtctttgatgggctcggatccttttcatgatttcatgtgaggacacctttggcgggcttttttgatagatccaggatttctgtgcgatatcgatcttctctttatggctttggttaatctatcgtctagctgtcttggtcttccgaaaaggcgaagacaaacgcatggatttactgtattctatgactaaaccagaatcaccccggagtgagctgttccataaggggctcatattatccgacagagcagagctatcatgccgaagaagcctttttctttctacgccccggtggcatcttgactttcctaggtctctaatagttccccataaaagagtcaatgggctgagctgatcgagtcccattttctggctgcaaggcccggcccgagtagtcaatggttgctaccgctcactgcgcttctctgtaccatttcatttctagtcaaaatggatcctgggcatatctactgacccgacaagctgacgtaattctatccatccgtagctgtctgtgccgctacctctatccagcagatccagtgccaaccgatctatatctagctttggccggccgggccaacccacctatacagagttgatgccatgcccgcctaaccacgaaagaaagcatccaatatttcaagactttctccacagagctctaaaatcctttctccgaagatccaggctcacttttttaggcaatggaatgacccgagcaaaggaaagggatcaaggcaataactacgcgcatcaaggtgatacctagaccgagcgaatctgaccgtagcctatcatactgagtgaaagcgtgccgaaccaagggaacttgcctttaatcttaggctcgcagctactaggtgcgtacccttgaacctagctcgccctagggtacaggcattgaaagacggctttcagaataggcttttttgtacgaagagaaggttacactactatataagataagtaattcattataagataagtaattcattgtgctaaaagaaccactttgaggatcaatcccttactgaatgaatgtccttttgatcagtgatcacagaaggagaaggcactgtgaatgagaacctctttcctttctggctaccaaacgtgctaataaaagagcttattctgagtttgaattcctcgaattctgtaagctagcttggtctacctgctttgttctgatttcattgtattcctccgtattcagcattcgcgccggtgtcacaaaaagcaaaagcatatcaattcgttgaggcaactagtcttggtaaggttttttccactgaatgagaagtttgtatgatccagatgttttgaaggcgtgtttgcccctgtgatacgcgtacgaggagtcgacggggaagagccgtgctggggttggaagaggttccagctttagaggagcctccctatcttatcccttgttggtcttatttgacagctcagctttgtctcgggcagattttggtccatgatggactctttttatttattttgacgattggatttctatatgaatggaaaaggggtgcttcggatcgggagtaaagtgatagggcacaaaatggggggaaaaagaaaggaaagagaataatgcccacgtttaatcaattgattcgtcatggtagagaagaaaaacggcgcacggaccgtactgaagttttggtctttggtttgctggttacacgtattatccgttttgtacattctgttttgtttcccatcccagtcttttgcagcataaaagtccttttagattccttttgttcgcttcctattataaacaaactttccaaaaaatggcaactgatttggttttatgttatttcagttattctctgtaaatctttatttgctgtaggatacttgtggatg

SEQ ID NO: 29722 - DNA, 3003 bp, Unknown
  misc_feature (1)..( 3003): 2750-1469P.txt file - cDNA_ID_3021734; gDNA_ID_2214698; Annot_ID_189594
ttgggcaatgcgagatagattgatttacatttacctcgaggatagtctttcttttccaagcgcgctttcccaacctgccatatgtccgatacatagtcgagggctctatacgagcgcctttctttcaactctatctattcttgcttttcaaacattgtattccttatagaatatcatctcatgtctatctatagtataacgtttctcatagtggcatagcggctccgaggtgattctttctggtatccgtcctctctcatactgctttaaggttggaggatttagttcaagctagtctcctatggtgaagatctctatatttgttaagactgtatgaaagaaatcacatatagtaatcatctaagaatatatctatactataatggttgcatctaacatttctcatagtgtagataaggcagtccccggagctaagaaaactacgctattcaaagcaatccgcccaaggaaggctagctagtcgagtctaatgctaggctaggtgattcctctctatcaatgaccgaagcttaatccagagagagagctcactataccaccaggttgccacatttgcttatgaaacaagaacagcttatcccgaggctctgaaagactgagggtagtcactcaaaaagtaatccgtcacttcgcccgaaaagcactataggggattccggccaagcgagcataaaaatacaatacccaactttctgtttcagcccactccacttcattgaccgagactttctatttcgaaccggttcggttaaagacctagccacgagaccaactccgggctgtctcgtaaaagatcaattcccagatgctcttactcgacgcccacaggcaagcttgtttagagaaggagagttctcttcatcagggaaactgctcaacctccactatttccataagcatgattatgcactagcagacataaagtgccaagaagagaaaacgcataactcataagccaaagatgtattcgatcctgaattgaacgtaattttttccgattggttggaaggtaaggatagcatgattgactggttgcgggtcccttggatcatgggccacagctatttggatagattcagatcctttcatgtagtagagtctttgatgggctcggatccttttcatgatttcatgtgaggacacctttggcgggcttttttgatagatccaggatttctgtgcgatatcgatcttctctttatggctttggttaatctatcgtctagctgtcttggtcttccgaaaaggcgaagacaaacgcatggatttactttattctatgactaaaccagaatcaccccggagtgagctgttccataaggggctcatattatccgacagagcagagctatcatgccgaagaagcctttttctttctacgccccggtggcatcttgactttcctaggtctctaatagttccccataaaagagtcaatgggctgagctgatcgagtcccattttctggctgcaaggcccggcccgagtagtcaatggttgctaccgctcactgcgcttctctgtaccatttcatttctagtcaaaatggatgctgggcatatctactgacccgacaagctgacgtaattctatccatccgtagctgtctgtgccgctacctctatccagcagatccagtgccaaccgatctatatctagctttggccggccgggccaacccacctatacagagttgatgccatgcccgcctaaccacgaaagaaagcatccaatatttcaagactttctccacagagctctaaaatcctttctccgaagatccaggctcactttttcaggcaatggaatgacccgagcaaaggaaagggatcaaggcaataactacgcgcatcaaggtgatacctagaccgagcgaatctgaccgtagcctatcatactgagtgaaagcgtgccgaaccaagggaacttgcctttaatcttaggctcgcagctactaggtgcgtacccttgaacctagcccgccctagggtacaggcattgaaagacggctttcagaataggcttttttgtacgaagagaaggttacactactatataagataagtaattcattataagataagtaattcattgtgctaaaagaaccactttgaggatcaatcccttactgaatgaatgtccttttgatcagtgatcacagaaggagaaggcactgtgaatgagaacctctttcctttctggctaccaaacgtgctaataaaagagcttattctgagtttgaattcctcgaattctgtaagctagcttggtctacctgctttgttctgatttcattgtattcctccgtattcagcattcgcgccggtgtcacaaaaagcaaaagcatatcaattcgttgaggcaactagtcttggtaaggttttttccactgaatgagaagtttgtatgatccagatgttttgaaggcgtgtttgcccctgtgatacgcgtacgaggagtcgacggggaagagccgtgctggggttggaagaggttccagctttagaggagcctccctatcttatcccttgttggtcttatttgacagctcagctttgtctcgggcagattttggtccatgatggactctttttatttattttgacgattggatttctatatgaatggaaaaggggtgcttcggatcgggagtaaagtgatagggcacaaaatggggggaaaaagaaaggaaagagaataatgcccacgtttaatcaattgattcgtcatggtagagaagaaaaacggcgcacggaccgtactgaagttttggtctttggtttgctggttacacgtattatccgttttgtacattctgttttgtttcccatcccagtcttttgcagcataaaagtccttttagattccttttgttcgcttcctattataaacaaactttccaaaaaatggcaactgatttggttttatgttatttcagttattctctgtaaatctttatttgctgtaggatacttgtggatg

SEQ ID NO: 29723 - DNA, 84 bp, Unknown
  misc_feature (1)..( 84): 2750-1469P.txt file - cDNA_ID_3021791; gDNA_ID_2214700; Annot_ID_189644
aataaaccacttgttttcgctcgctcgctttctatttctcctccgatctgctgaggcgtgcgttcattacgtgcttcctcaatg

SEQ ID NO: 29724 - DNA, 3000 bp, Unknown; identical to SEQ ID NO: 14104
  misc_feature (1)..( 3000): 2750-1469P.txt file - cDNA_ID_3021816; gDNA_ID_2214700; Annot_ID_189632

SEQ ID NO: 29725 - DNA, 3000 bp, Unknown; identical to SEQ ID NO: 14103
  misc_feature (1)..( 3000): 2750-1469P.txt file - cDNA_ID_3021820; gDNA_ID_2214700; Annot_ID_189631

SEQ ID NO: 29726 - DNA, 3000 bp, Unknown; identical to SEQ ID NO: 14102
  misc_feature (1)..( 3000): 2750-1469P.txt file - cDNA_ID_3021822; gDNA_ID_2214700; Annot_ID_189630

SEQ ID NO: 29727 - DNA, 3003 bp, Unknown
  misc_feature (1)..( 3003): 2750-1469P.txt file - cDNA_ID_3021830; gDNA_ID_2214700; Annot_ID_189622
atgccaaaggcgattgctgatatcatatttatgtagcttttgtactttttaatagaagtggacacaatactgatatcattagtgaataatcttttcatatctttcagtctaagtatacacaaatatatcgtatatgcataaaacgaatgtctctcattttcgtaggaaagaaaacacaattaaaaagaaatatttttaaaaagcaatgtgaaaagaagttggtaacttgaggttcacgagatccaaatgtggatgaacgttggaacagctaaatccacgtaataaaagaggacgaagcttatgattaaatttggtcagttaagattctcatcctatgcaactacctaatacaatacaattaatttgtctccctcccaaattcattcaaaatttttttttgcttggttataatctatttattttgaatctggtggctataatttttcaaaaatctatgtcaagtaacgtatcttacgaaaaaaaacactgtgattaaattcatcggaattactagtctcatactaaattctacaaatagatatcattttctcttgtaaattacacaacaataacaaaataacaacaaaaatcattattttcttctcgttgcttttattcttacgaactggatactatctttcttatatgtaaaaacaacacgtaatatctaataagtaaagtagggaaagtagacttacttatgttacatagggtcccccttattaggctacatatgtataagcaggaagtagacttggcatttgaaatagacggttgatatctccctgtcactatttatccatccttatgacctttcggcgggaaattcgaaatgacatttgcagattttcttgttttttccttttctttttttgtttgtccactccacttatatctttttttcttttggggtttttaatcgcatcctacaacatatcactcggatagggtaaattgccccaaccaaccattcattattaattaataaacctgacgaggaaaatgaatatattttggtttcaaatgttttgtggaatgaaggcagagagaaagacagcttctgtaaaagcatttgctggcagacacaaccctaaacccaccttcacttgcctcacctcaccactctctcttcctcgcgcgtgtctatcacttccataaactctcattgcccataattgcttgttttctttctatatgccaagcctgataaatctcgtagtaaattacgggaaaaaattggattccacctcacacaataaagcattttacaaaaccagctttatcattgggttttttaacagattatagtattgtgggtgctcttaatatctggtacacaatagtataaggtctatcgacaatacagagtagactccgggagacaagagaagccaactaggggcacattttttgggcgtaactagacattatatattaatttaaaacttttgagtttcttcgttgaaaaacaattatagaatatagttttgtcttcaatataaaatgagaaagaagagaagaagatctgttcccgctcttttgacttaacggtgctgtcgttttcagcaggttaacctcgaccccaccctccatttttcacttccttctttttaaattattttctctatcactaaaaatatcaaaaaggcgggaaaatcacctattatccaattcagtttataaaccggtttcggttccgtcgttaacggctgattcttctgaccaatgaaaactcgtgaagtctgacggagaagaagacggaactgttaaaatccgttacgtcagacggagaggagggagagggacggatgactgaataaatctgccgaatcctgctgaattgccacgtcagctttattcaaaattctctgagtggtcacgagatttctatggactcttttttttttgttaattaaaagtttaaaaccctacaaaataggggtcttcaatggggttaccagaaaaaaccgaacagtcgccgattccttggtttaatctttgaaccgacagtgtgaccttttaattttctaacctttgctatattattatgaaaatcagatgtaattatttagtgccattcattaacgtgattcttacttataattcctctcatgaatactaaatggagtgtatataattatatttagcagtaaaaatgtattgtattgattgttggaaagggaggaaaaaatgatgagaaggatttgcatgaggaaaagagagagaaggcgtaattatcaagtgttcgatacttttgattagcccacacatttataatattttagtgtagtagtgagatttttatttagggttttaattagaacatagtataagacattggagctgtaaatgacaacttgtttgggatttagtgggttccacctgtatttctcatgcccttacacatttccacattaatatctatcttatcttataaaaaaaagttccaaagaaaagagtgagatatacatatattagcaatatgagtttaatgtgccattcaaaataaataaataacattttgaagaatattaagagtctcaattaaaaaatatttaacttgttctttagtgagttacatccatatcttaagagacatgtgaagagttgaatccaaatgataacacaccaaaattgatggtttttaaaaaatgtgaatactattactgtttttttctttggatttccaaggcaaaatagttaagaaaagaccaaaggaaaatagttttgattttcgtccatcacgcattaattacggataattattatattaagaaggaaaaaaaaaaacaaaaaaaagcagaagtgatattaaagtgcttttgagctgtctcgtagaaaccatgaaaccttaataaaagcaaccttgtcttcaacattctccatcttcctcctcacttaatccccaagttcacacttcaaatccactctttctatttctctccttcttcttctatgtctcgcctcctccctcctcatctctccgtcaaccttcctaccatg

SEQ ID NO: 29728 - DNA, 772 bp, Unknown; identical to SEQ ID NO: 14096
  misc_feature (1)..( 772): 2750-1469P.txt file - cDNA_ID_3021834; gDNA_ID_2214700; Annot_ID_189620

SEQ ID NO: 29729 - DNA, 3003 bp, Unknown
  misc_feature (1)..( 3003): 2750-1469P.txt file - cDNA_ID_3021839; gDNA_ID_2214701; Annot_ID_136866
ccttgcacaaaataagtggtccatgagcatattaatatttacaatatcactgcttgttgtaattttataatactaataacacagttagcgaattagatttgtcgatgatacccgacatcattaatgacaacttcaaaacagtgactgtatcacaaattattggacaagaagtttaccttactaataattgtgattaattaagtaatcaagaaggagaagaagaagcaaattgagatttgaggacagaggaatatgctgacattgattttgcacaaaaaaaaaatgctgacattgacatttattttataaatactaatagtgcacatgtgtcatgtgtgatatataaatactgtatgtaggaaattttgccttttggatttgatcaaattggattttaaatagattttggcacgacggaagacgaaatgtggtagaaatcatatttctagatttcaagtagattttgaaatttgcaacgttgcaaggcaacaaatttattttgactgtttacgtctctttttgttagaaaaatttcagaaaatgtttgatgaatataataaaataagcaaaaaaaaaaacttgttcatttttaagaatttattaaccaagcaaaccaaatcattactaattcaaatatcactctgcttaaatagtgtcacactatcaccattactgtcacaaatcttacttaacaacaaaacacatacagtggaaactctataaattaatactcgataaattaataaatacaataaaataattaattttgctagtctcaagtcgggccaatgtaaaaattaagcaaaatcgataagataataagataataatttttttgaaatttctatgtaaaaatatggttccaataatatcataaattaataatcatagatcttaaacaaatattttaagactaattttatatgaaacttttgttaaaactacaattgcaattctttttagattacagttggtatgatctcttttgtactcacacaactctttgagtatttgatccatcatatttggttttgtaacatttttttctatgaaaaatcattgttaagatttgtgtaaagaaaaattggattaagctatacgttaacgtcgtagatatacgaacacaatatcttgtaagaaaataaattaaaaaagtcaaaaataaaataaaatatataacataattgaatatacaaacaacaaaatacgagaaaatctaaattaaaaatattgtttaaaaaaaaataatattgtgttttacgtaaatattctttaaattaatatttattaatttatcttattaattaatatttattaatttattatataaattaataaaattatgtggtcctatcattattaatttatagagtttctgctatatttataattatcgccccaaaataataaaaacagtacaggaaagtcattatgaacatcattacacaaagcccattacaaaattcgcccataagcccaatctaacaacggcagagattcagagtcagttccgacggcgctgaccaaagaaacgcgtctctctctctggagaaaatttcctcacagagaaagaagaaaaagacgagagacgtgaagaagaaatcagaattcagaattgagaagcaaacaatggcttcaacgatctacacttgcaaagaatgcggatcagatctgaatctaaaccctaacgatttatttccaccggatttctacttcgaagccggtaacaaaggaacactctcattcgccgccgtcgacgccgagaaattccgattcgagaaagaagataagatcatgcctttcttcgaaaccctaaattactggggaatccaacggaaacgaaccaagatcaagtgcactagctgcaaccacctcatcggttacatctacgacgatggtcctcctctcactggtggtattggccaatacggatttggtccgagtcaagtcattcctcgtgctcctcggtatcgattcaaaaccaaggcggttcaagtctcgtcccagacttagctaaagcagagggtttaatgcttttacatagatatgtataaacttgttaaaagggttaataggattgtagatgtttgttgcttaaaactcagatagtaaggtcgttagacttgccatcggtcttggcgcttgcttcagcgccaagacggatggcaatacggaggtttaaccgccttttggaactgatttttgttgcttgcttttgaagaaacatctacaatcatattctctcctttgtctcttgtctattgtagctagtatagttaagatatgtatgttaagtatgttgttggcttggattttgatcatatttgtagtgtttgtgtttgttgtgagtttgaatcacatggttgactgatttgttcaatgatttgggacgaatattttcgtagtttgttcaataatcatcggttgttttgtttggtgattcgagttttgtacgaggaactttagaagctgattgttttaagaacaaactctatcggcttaaagagaatgtgaagaacagaacaaaaaccaatagtgttagtttaatggaggacgtcatttgaaaatgacgttttggtgatattgattgtgatggccatttatgattcaacggctgtgattgaatgatgtaacattagttgcttcaagaccatatattttatattatccatacactacctaattgcttaaaatattgttgatgttgatgaagattggaagttacatctacttgtctacttgtcgtttcttgtatagttggagtttatagtttgtcttaacgtacaagataatttgaaaggtagacgtagacgttggatacttatttggtaggctcttaagaatcttaggtgtatctctttagtttgaaggttagattcagaatctctgtagattcattagtagctttttctgtgtgatctttgtgttgtatatatatagatcgaattgattttagctggtgaaaggtgaagttgtggtatgaatatgaagaaacagattatg

SEQ ID NO: 29730 - DNA, 3003 bp, Unknown
  misc_feature (1)..( 3003): 2750-1469P.txt file - cDNA_ID_3021839; gDNA_ID_2214701; Annot_ID_189668
gaatgtgttgttaattatcccccttgcacaaaataagtggtccatgagcatattaatatttacaatatcactgcttgttgtaattttataatactaataacacagttagcgaattagatttgtcgatgatacccgacatcattaatgacaacttcaaaacagtgactgtatcacaaattattggacaagaagtttaccttactaataattgtgattaattaagtaatcaagaaggagaagaagaagcaaattgagatttgaggacagaggaatatgctgacattgattttgcacaaaaaaaaaatgctgacattgacatttattttataaatactaatagtgcacatgtgtcatgtgtgatatataaatactgtatgtaggaaattttgccttttggatttgatcaaattggattttaaatagattttggcacgacggaagacgaaatgtggtagaaatcatatttctagatttcaagtagattttgaaatttgcaacgttgcaaggcaacaaatttattttgactgtttacgtctctttttgttagaaaaatttcagaaaatgtttgatgaatataataaaataagcaaaaaaaaaaacttgttcatttttaagaatttattaaccaagcaaaccaaatcattactaattcaaatatcactctgcttaaatagtgtcacactatcaccattactgtcacaaatcttacttaacaacaaaacacatacagtggaaactctataaattaatactcgataaattaataaatacaataaaataattaattttgctagtctcaagtcgggccaatgtaaaaattaagcaaaatcgataagataataagataataatttttttgaaatttctatgtaaaaatatggttccaataatatcataaattaataatcatagatcttaaacaaatattttaagactaattttatatgaaacttttgttaaaactacaattgcaattctttttagattacagttggtatgatctcttttgtactcacacaactctttgagtatttgatccatcatatttggttttgtaacatttttttctatgaaaaatcattgttaagatttgtgtaaagaaaaattggattaagctatacgttaacgtcgtagatatacgaacacaatatcttgtaagaaaataaattaaaaaagtcaaaaataaaataaaatatataacataattgaatatacaaacaacaaaatacgagaaaatctaaattaaaaatattgtttaaaaaaaaataatattgtgttttacgtaaatattctttaaattaatatttattaatttatcttattaattaatatttattaatttattatataaattaataaaattatgtggtcctatcattattaatttatagagtttctgctatatttataattatcgccccaaaataataaaaacagtacaggaaagtcattatgaacatcattacacaaagcccattacaaaattcgcccataagcccaatctaacaacggcagagattcagagtcagttccgacggcgctgaccaaagaaacgcgtctctctctctggagaaaatttcctcacagagaaagaagaaaaagacgagagacgtgaagaagaaatcagaattcagaattgagaagcaaacaatggcttcaacgatctacacttgcaaagaatgcggatcagatctgaatctaaaccctaacgatttatttccaccggatttctacttcgaagccggtaacaaaggaacactctcattcgccgccgtcgacgccgagaaattccgattcgagaaagaagataagatcatgcctttcttcgaaaccctaaattactggggaatccaacggaaacgaaccaagatcaagtgcactagctgcaaccacctcatcggttacatctacgacgatggtcctcctctcactggtggtattggccaatacggatttggtccgagtcaagtcattcctcgtgctcctcggtatcgattcaaaaccaaggcggttcaagtctcgtcccagacttagctaaagcagagggtttaatgcttttacatagatatgtataaacttgttaaaagggttaataggattgtagatgtttgttgcttaaaactcagatagtaaggtcgttagacttgccatcggtcttggcgcttgcttcagcgccaagacggatggcaatacggaggtttaaccgccttttggaactgatttttgttgcttgcttttgaagaaacatctacaatcatattctctcctttgtctcttgtctattgtagctagtatagttaagatatgtatgttaagtatgttgttggcttggattttgatcatatttgtagtgtttgtgtttgttgtgagtttgaatcacatggttgactgatttgttcaatgatttgggacgaatattttcgtagtttgttcaataatcatcggttgttttgtttggtgattcgagttttgtacgaggaactttagaagctgattgttttaagaacaaactctatcggcttaaagagaatgtgaagaacagaacaaaaaccaatagtgttagtttaatggaggacgtcatttgaaaatgacgttttggtgatattgattgtgatggccatttatgattcaacggctgtgattgaatgatgtaacattagttgcttcaagaccatatattttatattatccatacactacctaattgcttaaaatattgttgatgttgatgaagattggaagttacatctacttgtctacttgtcgtttcttgtatagttggagtttatagtttgtcttaacgtacaagataatttgaaaggtagacgtagacgttggatacttatttggtaggctcttaagaatcttaggtgtatctctttagtttgaaggttagattcagaatctctgtagattcattagtagctttttctgtgtgatctttgtgttgtatatatatagatcgaattgattttagctggtgaaaggtgaagttgtggtatg

SEQ ID NO: 29731 - DNA, 3003 bp, Unknown
  misc_feature (1)..( 3003): 2750-1469P.txt file - cDNA_ID_3021858; gDNA_ID_2214701; Annot_ID_189679
cttcatgctccaaaacatgttcgatcttgcaggtgaaagtgcagaacttggaattaatcccttggacatgtttagtgcaaccttctgtatttcttacacagtctctccatggcctcaacattataaactgcttccctccaacgtaaccatgattctgtaaaaaaaatatcaatcatgtgtttaaataaattacctttagagaaattggtggatgagaacaatttgtctattttgttacttgaatttgggaacaatcaaagagatcagagatttggttcagttcaaaggcgttaagatcaagcatggtgcacacctgcactgattcaaagatgcaaaatttatgataaagtaatatatataattagggcatatagaaaaaaattagaacatacttgaacatgaggttgaatatggttgggatctatgccctcggggcacactacgtcgcaggactcgaacctgaagatgttttttcggaaaccacaagtatgcttttggtagtttccatctaagtcttcctctgtcaatacttgaaaccatctcggtttactcatcataaatctatgaggagaagcgatgaataataataacaaaattggtgttgaaggatgataaatctatggagaggtaggaagaagaaatgagcgatgttcaaatctagggtttcacaaaaatagaaaaataaattgttgtttcttttctttttttctctaacaatacaattataatttgtgaagacaaatatagtatataatgatttgttctattcattttatattaattaatatttatatatttagtaattttattatataagttttagttttggaaagttagtcattaacataaatgagagacatgccaaatttaaatttgttcatatatttataagaaaaggaaaaaattttaattctaaaatctatctctacattattaaaagagaaatacaaatgataatataccctttaatttggaatatattcttgaaatactattgattttttatttagattttttttttagaaacttcattatcggatcgtgttggttggcaaatatccaacaaatattttagatacaaataatataaaaatgtcgagaaaataaattagtgagtgcatattttgtccattcaccaaaataaactcagttacgtatgtaccagtgagagcatgttttgtacatgaaccttttttatactctgtagctcaataactataaaggacttttctcgtgtaccaattcatgagacatgtacttgagctctaagacagttatcaagaatagagtaccggtttctatgtctctgcgccatatgcccacagctcccatgcctggtgtaatccagcaatgcttaaagcttgctagctgtaatgaatgttccttcaatccttcacaagaagaaagccaggttggactaactaggctatcttaaaatatacgatcaagagatttatattccagctgagaataaaagaaacctggcttaagtcacccgtagtctcatccaatgtgttgtactgtttttaaatgtcttgaaggatcttgcgctgcaaccaagtctgaccctttcacattttgatcaggttacttgtgtgtttcgcactttctaaaaacttcatccaatacatgaagcatggcgttatagctctcttcagataaagatggctccttactcaatttcaaagaacggacacagagatctgtgccaccgttgagatactaagaatataatttctctatatttttgcatcttttatcacagttgacacatactgagaagggatactaagaatttaagttatttttctttgaatataaaataaatgtggattactatttattattcaaatatcatccatacattttatatctaaatatagaatttaatttctctacatttttgcatcttttatcacacttgacacatactgagaagggatactaagaatttaagttatttttctctaaatataaaataaatgtggattactatttattattcaaatatcatccataagattgagtgtgtaaaataataatagaatgcaaaagactgaaatgaagcaaattttattaagttaaatatcaaagaaaaaatattgattactattgtactattcaaaatttaaatattatcgatcaaaattatttttttttaccttacacccgcctaaatatgcggatcttatctagtattctataatactaagttactaacattaaagaaactaacaaaaattttggtccaagaaaaaattatcaatttttttgtttcaatgattgatcgaccatttcctagattccaaaggtacctcccccatcgaccattttacacacttgtctactttagaattgtttgttagattggtaagtaggtaagcttttgtaatctccttttcttgttgttttagctgggttcagcttggaatcttttttaattaatggaaatttaaaatacaaaaaaaaaaagttatacaaatggttctaatttctatttaaaattttatgggcctgctatgtataaaaaatagaaaaaacattttaatgggcctaatgtcaaaaaaacagaaacaattgttttctatgggcctgcttttgggtcttatggttcgaaacaatggtccatgtgaagcgtgcaccgtcaagtaacctacaaaaccacgacatcgtttagtgctattcctgtttccaaacacaccttaagttcgttatcaaccccatcctctttttttctataaataacgaagcaacgagttaacgagaaaaattctggatcggagagagctacgaagcctgggaattttcgttacctccttcgttcttctctgatctcgaattcaataccaaattcttcaatctcccgaatctgattttcttatcactatccctggataacaaaagcccccaaagtaaaaacccaattgcgattccctcgtaaaccaatctagggttttcgcgagttcgtctctgagcttgtttgtttgtgatcgtgtgagaatg

SEQ ID NO: 29732 - DNA, 3000 bp, Unknown; identical to SEQ ID NO: 14122
  misc_feature (1)..( 3000): 2750-1469P.txt file - cDNA_ID_3021866; gDNA_ID_2214701; Annot_ID_189677

SEQ ID NO: 29733 - DNA, 3003 bp, Unknown
  misc_feature (1)..( 3003): 2750-1469P.txt file - cDNA_ID_3021876; gDNA_ID_2214701; Annot_ID_136871
gattttgaatatagtgttaagattatcaacaatttgtataaatatttctggtataatattatgagagttttgaatctaataagattagaaagcaaatatatagaactttatgttaaaagttataattataagagaactaagtaagaacctgaatcgtgtagtttttgaataaaggatgatcataaattggatgattattcatatgaacgcagtctattatatctccatctggactctgtataaagattatcgaatattcacgaattaatattttaatgaaaaaaattgttaggtgtaattatttttgtgtgaaccaacaaatttcattaaccttgatagatttaagagcaggtttgttgagtttctttaagattttttctacttttgcatcacgagtatcagaaaactcactaccagaaactatcgccgctacgattagaatgctgagcacaaaacgagcaatcatcattcgattgattattaagagtatccaaaatattttttttctttggctaagtagatgattaaggtgagtgccttatatatatatctacaatgaagaattttttttgcaaagcatatgttaacaaatggtaagaaaattatacttcaaaactttttattcattagagcaagactcttaatttaaagcaaattaaagtgtatttaatttgttccttgaaatagcttaatctatttttgactaaataaattgtatatggacatgtcaaaagtcaagtaagctatttcaaggaacaaattaaattttgatttaagttttattattttatcaaaaaatacaatttttaatgaagatgaaaataagtttttatatatagaaaaatacagatttaaatgattttaaagagaaaggttgggtttttacttttgaaaccttccattcaaatagaaggtttaagtattttcagatttagccagatttgatttagtcttagtttattttcctggttttgaatttgatttgttaatttctttttaaaatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagtatggtttggtactcaagctgtagaattttgtttctgggtctgcttattttgttggcttcgagctgggttttggatagatgcgagggatttggtgaatttgggtttgaatttcatcatcgtttctccgatcaggttgttggggttttgcctggagatggtttacctaatcgagattcttctaagtattatagagtgatg

SEQ ID NO: 29734 - DNA, 3003 bp, Unknown
  misc_feature (1)..( 3003): 2750-1469P.txt file - cDNA_ID_3021876; gDNA_ID_2214701; Annot_ID_189673
tgtccatagttgagtcacaacactttgtttctctttgtctgaagattcattatttttacctttagggtaagaacttggtttcatctatgacacaccaatgttagaaacaaatatcgaattaaagataagaaaggctagcttaagagcagaattaatccaaccaattaaaacaatgttttagagtattattgacctgattttgaatatagtgttaagattatcaacaatttgtataaatatttctggtataatattatgagagttttgaatctaataagattagaaagcaaatatatagaactttatgttaaaagttataattataagagaactaagtaagaacctgaatcgtgtagtttttgaataaaggatgatcataaattggatgattattcatatgaacgcagtctattatatctccatctggactctgtataaagattatcgaatattcacgaattaatattttaatgaaaaaaattgttaggtgtaattatttttgtgtgaaccaacaaatttcattaaccttgatagatttaagagcaggtttgttgagtttctttaagattttttctacttttgcatcacgagtatcagaaaactcactaccagaaactatcgccgctacgattagaatgctgagcacaaaacgagcaatcatcattcgattgattattaagagtatccaaaatattttttttctttggctaagtagatgattaaggtgagtgccttatatatatatctacaatgaagaattttttttgcaaagcatatgttaacaaatggtaagaaaattatacttcaaaactttttattcattagagcaagactcttaatttaaagcaaattaaagtgtatttaatttgttccttgaaatagcttaatctatttttgactaaataaattgtatatggacatgtcaaaagtcaagtaagctatttcaaggaacaaattaaattttgatttaagttttattattttatcaaaaaatacaatttttaatgaagatgaaaataagtttttatatatagaaaaatacagatttaaatgattttaaagagaaaggttgggtttttacttttgaaaccttccattcaaatagaaggtttaagtattttcagatttagccagatttgatttagtcttagtttattttcctggttttgaatttgatttgttaatttctttttaaaatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagtatg

SEQ ID NO: 29735 - DNA, 3003 bp, Unknown; identical to SEQ ID NO: 26146
  misc_feature (1)..( 3003): 2750-1469P.txt file - cDNA_ID_3021880; gDNA_ID_2214701; Annot_ID_189670

SEQ ID NO: 29736 - DNA, 3003 bp, Unknown; identical to SEQ ID NO: 24907
  misc_feature (1)..( 3003): 2750-1469P.txt file - cDNA_ID_3021882; gDNA_ID_2214701; Annot_ID_189669

SEQ ID NO: 29737 - DNA, 3000 bp, Unknown; identical to SEQ ID NO: 14118
  misc_feature (1)..( 3000): 2750-1469P.txt file - cDNA_ID_3021888; gDNA_ID_2214701; Annot_ID_189666

SEQ ID NO: 29738 - DNA, 3000 bp, Unknown; identical to SEQ ID NO: 26150
  misc_feature (1)..( 3000): 2750-1469P.txt file - cDNA_ID_3021901; gDNA_ID_2214701; Annot_ID_189659

SEQ ID NO: 29739 - DNA, 3003 bp, Unknown
  misc_feature (1)..( 3003): 2750-1469P.txt file - cDNA_ID_3021936; gDNA_ID_2214702; Annot_ID_189716
gataggaatggagttccaaagaatttaggtgctacgtactaaatctataactgagtaaaagaaggatgacataatgtacaggaatctcatcagtttgagctcatgccacaccaagtgacatttggtttgataactcagggtttaccatacttttcgacatacccctgcaaatgaacataagaattgttagcttatgcaatacttactacttaggtttttacctgctttaagtgtcttttatttccagctaagaaactcacctcgacaagtttcacaattctggttccagacaaaccaagatattgatcaactgattctgtgtcagttggcacctgatgaaactggacagcggcgccgactaccttttctgcagcttttttaactatcatgttatgcacgtctttagttagacgaccctcacgccacaacggtttcaacatttctttaatggtttccacaactgcagtccggaatagtctcattactttcattcctgcatctgacctcacttcaccatctatctcatctgatttctttgtctttttatatgaagacccatcacttctatgccaagaatcatgccctgcaggtttgattcttttcaaaacaactctattctctgcagccgtagccgaagaaatctctttgctaggcgttgctgtatcattttgatcaaccactgacgtagccaccccttccactactccatgtgcttccaaactccttgccacggtttcttggtgttgattttgactgcatgaactgcttttatcatcattcttgcaatcccgtgcttggggaccactagcagaatcaccatctttctgctggcaggaacttttccgtgcatgttctcctttacttgacaatgaatcattaagaggtctgtctcctagattctctatatccgtgaaaggatcgtagagggcatcagacgagggaagaatataaggtggaattgtaaaagatgctttaaaaggttcagaaggttcccagtcatctgaagaaactttctttttagtgctagtagtgttggcttctgcgcctttatcagaagaaacagctaccccttgcagcgttggaagtgatccggatccagataaactattcccattttcaaaatcccccaccgtagaagcacgatcattcataggaacagaactggataatgatcctgtccaggctggtccagcagatcccatgtctgtttttaaataggaactgatagaaggtctatgctcatgaacaaagctgcttctcaatgcgaaggaattggcgttattaataactagagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttgatg

SEQ ID NO: 29740 - DNA, 3000 bp, Unknown; identical to SEQ ID NO: 14140
  misc_feature (1)..( 3000): 2750-1469P.txt file - cDNA_ID_3021940; gDNA_ID_2214702; Annot_ID_189715

SEQ ID NO: 29741 - DNA, 3000 bp, Unknown; identical to SEQ ID NO: 14165
  misc_feature (1)..( 3000): 2750-1469P.txt file - cDNA_ID_3021976; gDNA_ID_2214703; Annot_ID_189761

SEQ ID NO: 29742 - DNA, 3000 bp, Unknown; identical to SEQ ID NO: 14156
  misc_feature (1)..( 3000): 2750-1469P.txt file - cDNA_ID_3021980; gDNA_ID_2214703; Annot_ID_189760

SEQ ID NO: 29743 - DNA, 3000 bp, Unknown; identical to SEQ ID NO: 14163
  misc_feature (1)..( 3000): 2750-1469P.txt file - cDNA_ID_3021988; gDNA_ID_2214703; Annot_ID_136913

SEQ ID NO: 29744 - DNA, 3000 bp, Unknown; identical to SEQ ID NO: 14157
  misc_feature (1)..( 3000): 2750-1469P.txt file - cDNA_ID_3021988; gDNA_ID_2214703; Annot_ID_189754

SEQ ID NO: 29745 - DNA, 3000 bp, Unknown
  misc_feature (1)..( 3000): 2750-1469P.txt file - cDNA_ID_3021996; gDNA_ID_2214703; Annot_ID_189748
ggaaacaaggcactgatcggtgaaggttcttatggacgtgtcttctgcggcaagtttaaaggagaagctgttgctatcaagaaacttgatgctagttcttctgaagaacctgactcagatttcacctcacaggtacacacatacatattacaataacgattatcttctcttcaaactataatttgttcaagcttcttctcttcaagctataatttgttcaagcttcttctcttcaagctgtttagattaaactactgttattttctaatctaattaatttctattcaaaatggctaagttatcggtggtatcgcggctcaaacacgaccattttgtggagttgctggggtactgcttggaggcaaataatcgcattctcatttaccagtttgcaactaaaggttctttacatgatgtattacacggtacgtaaattttaactctcactactcatattttagtatatggtacatgaaatatatatggaccaattgaatctttagggagaaagggagtgcaaggggctgagccaggaccggtgctgaactggaaccaaagggtaaagattgcatatggagcagccaaagggcttgagttccttcacgagaaggtccagccaccaatagtccatagggacgtgaggtcgagcaatgtcttgttgtttgatgactttgtggccaaaatggctgatttcaacttgaccaatgcttcctccgataccgcggctaggcttcattctactcgtgttttgggaacattcggctaccacgctccagagtattataccataaacccgttaattcatttgtttaaaacaacctgatagttcttgataacgtaagagttttgttgtcttaggtatgcaatgacaggacagataacgcagaagagtgatgtgtatagttttggtgttgtgctattggagctcttgacaggaagaaaacccgtagatcataccatgcctaaaggccaacaaagtcttgttacttgggtacgtacacaaattaaagcaaacattttggaatgactccatatatatcatcattataagtccccttttaataacctttgtattgttgttacaggcaacaccgagactaagtgaagacaaagtgaaacaatgcatagatcctaagcttaacaatgactttcctcccaaagcagtcgccaaggtccgttcttcattttcttcttcaaatatcaaacgatatcttcatttactttgcttggttaaagatattttgatattagatgcatctagatatcatattttgaaaactagggacatatgattatttggtttagctttgtaattttgaaaagtttctttgcgtatggtcgaacagttggcagccgtggcggccttgtgtgttcagtatgaggcagatttccgaccaaacatgaccatcgttgtcaaggcacttcagcctcttctaaactctaaaccggccggtcctgagtctacgtcctaaactaaacaatataccatttctcttgtttttgttcatgttgttgttattatggctattttctccctcttttctgttccaagaactatgattattggttgtaagatgttgttatttaagcgaatgtaacttatatttttcatttggtttaacacccctttcgttttttattgtatctaagccttaaatccaagtttgctctcacaattttgaggagtcaacgcaagcaatagcaaattagttgtgagatttaaataataaaaaaaagtaaatatattaaccattaaagactttcaaattttttactattctcaataaaagatttagagatttatgtagattgtattatacctctagtttcttataagatgtttatttgatttccatctttctttaaggtaagtatccattataagacaactgccaaaacttagacatctttctatattcgttcatctgattccaatctttcttattttgttaccaaattgtacacatttcaatattttggggggctcatctttatttttattcaattcagtaaccaaaactagaagttctttctatcatatgcctatcagataaaaagtccttaaatttaaaactagaagttcgtttttttcatactaacaatatatatcaaataaataaaaaacttaataaagtcataaatttaaaatgtgaagaaaccaatactataataatttattatttatcgtcaattagttttgaattcggaactcgttacccttcatttgataaaataatttatatagtgaattaatattttacaaaatgaaatttagtataagtttccatggtcatatatctcaaatcattgagtaaaaaaacaagagtgatgacaaattacaacataatgacgacacccacacatgaagctgaagtcccaaaaacaaaccagtaaaccacatttcaccaccacgattcaaaatatataaaaaaatatggaaaaaatgatttttcttaattggtccatttgatgaaaaaagaaagacatttggatttttgctataaaaatgaaatcagcggcattaaaaataataataaaaaaatgggatggtttttaccagaaaatctcaagaaagtcacgtactgtaacagtaaagcacattttaggtttatttttttattttatttttaacttttttaacaacacgtcgcctcttttatacacagcgtctctctctctctctcctcaatataacatacttagctgcgaatctcgtcgtcatcgccccgacgaaccctgtttcgcgtctctttcccaatcccaatccaatttcgattccttcatttcaggattcgtatagccgtaaatccgttattgggttcttccgattatccaccgatagatctcgatcgaacgtttttctccgattggatttttgggtgatttcgccggaattcataatcagacgggaggagtcgcttctcttctcttgagtaatttagtccctttttgtgttatggaatcaattggttgatgaacaaatacaagtgtaaaacgatg

SEQ ID NO: 29746 - DNA, 3003 bp, Unknown
  misc_feature (1)..( 3003): 2750-1469P.txt file - cDNA_ID_3022003; gDNA_ID_2214703; Annot_ID_189745
gaagttcggtccttgtatatagctgaacattgtgaggtcacatataacgaaaaggacaagatatgcttgtccctcaaaatctagactcttttttctcatctttcatatttattatctttattatttattactggcccaaacatttcatcatatttcttttcagaaaaataaacaaggagggaatttgcatacatatgtgtatataagagtggaggagttgaatccaagaaatggatgtgagggcaagaaagtgagagatatggtcccctcaacaaaagccattaaatctctgagcatatgactgtgactttaatggcaaagcaaagaggtttgcaattgcatgattcaatgaagagttgctgttagggtttgggagatttgtgggcttttaagtgcatgtttttttgtggggttcaagtgccattcatgggacccaattacattttttttagatttgttttacttttctttgtaaccatgtttttagatatgcatttacaatatgttttttttttcttcccttttttatgagatttaaaagtattatattatgacacaagtatgttacactggttaggacttagctttagacaaaaaaaaatcagagtccgagattttatatagatttcgtctttttaatcaaaaaagttctgatatataacctaaaaagactacgtagtatgatctaagagatttgacaaaatttggttgtagaaagtccgatattaagcattctcatcaatttcccttaaatatttttctaaaatattagaggaatacaaaaaaacattctcattaactatataattttaataacagttaaaactttcatatttgcatgccaaggctctctgatgagtttaaatgttaaatcgcatgtgtaggtttaaacagagtttattgtttgtggaaaaataaaagagacgtggactcgtcatgtgaagtccaaaatctgcaaaattatgtatgtaaattaatgtactttgggaccagcattcgtatggacattattaccatagttgaatttacttccctttcttacaataagcttttgattactcatatatacctcacacatgttatgtgaatcggtaaattcatactatatgtgaggaagtcacttacaacagttggattttaaagggaatccgtctgaaaaaaatttggagaaaaaaagaaattgttttgcttacataatttaatttaaaaattataaataacaatacttttataagagaatagtttatctgttgaccaaaaaaaaaggaatagtttatctatccacaaatggatgatccatattggagtatatagaacgataagagatgattcgatacgtactaaatgaaaactttgaatactgtgtatagtaagcaatcagcattagtttacaagatcttagttttcgtaggattagtttagactgtttagtaatttgattccaaccattgtacaggagaaaatttttaccgctcaaaacaactaactgaacgtcatacttaattgggaatttgggagtcgtcaaagaaatgaaaaaggtcagattaatttatggattaatgagttttatagtccttattccagcttgacattagcaacatatacattatttgtgtgacataatcagggaatatatataatcaaaattaatgggatttaaaatttaattattcttacaaaatatcaaaaaatttagtgtagacgaacaaaaagagaatacatatatatatatagttcatttgaagaagacgtgtatatgatcgatccgagttgataagtattaacagattacatacatattgataagatgatgtgatctcatcgattaaggttcaatcttttaaattggttaactatctggtgatgacatgtcaactagtcgattatgagcatcattaatgatcatgaacatggaccacctctctctctctgtaagattatctttgcatcaaagagacaaaacatccaagagactaaaagtatggtccttgagagagaagaagtctctttaattaggtctttctatttctctctctctctattagtagtaaaatccatgtacttatacgtagacataataaccaaataggtccgtgatgttaaagagtacacacctaacttcaccttgctaatgatctcttacctacaaactctcactgtttttagttcatctcattactcactgtgaccccatttcatctgcttacgaccaatttggtaagctttttgtcttagtttcaacatttgcaggaatcactttaagaaacaactaactaaaaaggagataactttgaaaaaggaggattgatgggtttgtttttgatgagatggatatttgtatatgtatgtctaatgagagatatattgcgtaggggaagtgaatgtagattagaggtctccctatatattgattgattttatccggctatttttacctaccgcgacacacggtatagattcatagtaagctacaatttaaacacaagataaatctgtaatcatatagtatagtactatgcttccatatataccccatatttacgtctcctatgcttccatacgctaattagtttttttttttttccaaccataattgcaggtttatataaacatgaactaacgaaaaaaataaaatataaacatgcaccatggagtcaattttaaaattctatgaggtttgattttcaaaaggaaaaatctaatatactaatgaaaaaattgagatcataaaaaaactaatgaagaagtagatttatttattttgaaaaatatgtacaagtgaaatgtggatcattctttagctatatatatataggtggataaacgtaaaatcacgcacgcggccatgctgcaggggttaaatagcaattatgtatttaccttaaaaagaatttgggaacctctctttaaattaatgcaaaacctcatctcttgtctttctgtctctgaaacagtcaacctcattcttctcaaactcactctccctgatctctctcttccatg

SEQ ID NO: 29747 - DNA, 3003 bp, Unknown
  misc_feature (1)..( 3003): 2750-1469P.txt file - cDNA_ID_3022007; gDNA_ID_2214703; Annot_ID_189742
gagtggccttcaaagcaaattcttgggagacatgtgtctatgttaattacttaatgactcactaactaattatttatgtggcgttagtgcaataaatagataaatatttgttgggtagaagaactgagtgggggctaatccataaaggattaatttttggatttcttagggatgtggatgtggtttatggggcaggtgacagtgatatagtatatctttaaatgtaatataataaagattcttaagtaagttctttactttttgtcaattcttaataaaaattgatcaaccacattttctttttttaatgctttggaatatgcaaatttagctttgtgttgagatggtggcctggtgggttgatttaataatattcacttaaattcttttaatactttacattatctaaatacgatagatattaatctgtttttcactccttggtgcaaccaatttttgtatcctcgagctcacgtgactgttctctttggactctttcttagcattaaactttgatcaggaaatgaaaacaaaaacaaaaacaaaccaagattagtgcgaacatgtttattcattctctgttcagttatcttgtcttcttttgctagagcgtatagcccaataataggatgtttaagttgttctttctttatcggttatactttaaataaatataaatttcactaaagaaagcaaatggacggatttgagaaattaaaaaaataggtgatcgtcacctttcagtgatcaaactttcggtgcatatgtttgttcttgagtgattttctttatcaccttttatatttccattaatattttaatttaccaaaagctttgcggtgatgtgatcaaacacaaaaatcacaagacttatgccgagtatcttattcaagataacaccaaacctatttgagcatatattatacgcaagaataatatttctaagaatttattcatcaatttataccttttaaaaatattgttttgggtttaaaatataaaagaaaagaaaaagctgattgcgacgcaactttaatcaaaaccaaacagaaagaaaaagaagcataaacagagaaagtaaggtgaagaaaaagcatagcagaagctaggaaattcattccttcttcccccttctaatgattctcttcattgttcccaaaaaaagtcttcaaatttcactttgtttttattcattcataatgtttaataccaaaatttataccagccaaaatctactttaccaaaaagtttaaggtttttgatattgtctttttaggttcggaacaagctaataataacataaataaaagggatggatcacccacctgggccactctaaagtctaaaccaattgaagtaaccattttaaacacacaaaattatgttggtgggcttttagctctttaaaaatccacacatatgttagtgggctttagctcgtggaccagatacggttacatggttacaaaaggccaaacccaaatcggaaaacatgccggaaaatacgatctgcactcattttgaccaggtaaaaatatggttggaaacgcgtaaatgaatcaaagccacacaatgaaataaaaattcaacggtgaggttcctacattatttctgtaatttctgttttttttgtgtgaacaaacggatttctaattttaaatttacctaaaaatagcttaactccatccggtataaatccccaaaagcatcatccaattatcctcagacctgcgagaaacaaaaaataataaaagtaaacaaaactaccaaaaaaaaaaacagaaaaaaacctttcaggtctcaactagcaatggagatgaagaagattgcctgcggagtcgttttcgctgctgcttccatgaccgccgtcatggctgcagaggtcggagcacctgcaccaggacccgccgcaagtggagcctccgtagctgttccggctcttggctctttggttggagcttcccttgtgtctctcttcgcctactacttgaactaagcttttctatttaaagcaaaaaaagaagaaatatcgatgtctctgtcaatttctatgatgtccaattttgtgtgtgttgtttagacaggcaaagtgaataaaacgaaaaataatttgattacggtcagacatgtttttatgtaatgctgattaataaatatatatatacactatctgttttctctttttcatatatctttcttatactaccaccatattttggttactatattttttgcgcaggtataattttgaccaagttagaattttacaaagtcttaattttattgaattcaacatataaagctttgtgaaagttatttggtttaggtgaattcacatggtctacacaaaacaaaaaatgtacaagcagaaagatattttctgctcataaaaacatcctcaaactattggatattgcctagaaatcgcttaccggttctagttttctgagtgattttatccgacaaaagtacacatcgtaatttcaaaacaagcgtatcacttgttgaatctatgacgaatcacaatcataaaccactggtcttgtgattttgttaatggttcaaattataatgttgattgatgtctcacataagtcacaacagaacatgatcagatcatagaagccactaacaacttcagccgcagtaatcaagctcttaattagcgatttgtattgttaacagcgatgccttttttaattcttttatttttttggaaactaaagttttgtacgcttttcagaaaaaaggaaattgttattttcgtttataattttcgtttataaattaatacgatttgaagttacttatgttttacaggaaaaaaggaaactaatgagtttacttatctctaacagaaagaaggaaacttttctctatatatatgataactctcttcaccaaattatttcgattctcagatttcacgtacatcacctaggttttgtttcttaacttggagccaaagaaatcagagaatcaataatatattccattgcaatg

SEQ ID NO: 29748 - DNA, 3000 bp, Unknown
  misc_feature (1)..( 3000): 2750-1469P.txt file - cDNA_ID_3022015; gDNA_ID_2214703; Annot_ID_189739
tttgtggcttcgttattatatcttgtcaatcaaatggtcaataaactgggcctgtcaaattgttttgagtcattttagaggttggtattccggaaggacagaaaccattaagtggtgatatttctgtaatagttgcgtaccacaactctccgttcttctacattatcgagttccctgaaataactggaatcggtaactaaatcgggtgataaacgatttgattgaccttatgcagttgggcctaattccacatgggcctgtgttgtgaatcttttgtggtttgagactctgtttgcttcagaggtttgtcttgtgctctaatattattaatgtattctcagatgaggtagaactatgtttctagttctctttttataaacggaatttgacttcgaggatatcagccgtcgaagttaactactccaacatacctatacaattttatgaagagaaatacacaattaaatttgttttggaaataagaaatcatattgtacaagattgtcatatatttattagtttaaatgaataaatatatgatgggcataaaataatatatattaatatatacataattttctttaaaaattgccgatttattggctgctaagaaagtaaaagtaagaattatgatctaaaacacgaaaagggaagcaattagctcaactgctccatgttagattggagagatcagtgatgaatggaccctatgaatagaatgtatgacacacccgttcctctcaattttttttctttttgttatttctttattattgatgttttgtatgactaaatattttcattgaatatatgaaacaattattatgtggggatttacttaaacggaaaatattactttttattatattttaacactcatggcttgtaatctgcatgcaacgcatgagctttatgacaaagttattttgcattatttctctactaaacaaaagtgaaaggaagggtctcctttccttctatgaaaatcaaaaaagtaatctaaaagctttaacaagggcatctcactcgtcttccactcgctcattatctgcaacaacgtaattatttgttccctatgtatttgactaacccagactatgacgtcgagattattctttagtagtttagtacgtcttcctctgctttcaaaaaacgtgtcatatactcctgtttgaattcggatacgtgtaaattgaattatatatcaaccttctagccgttttattacaacaacaacaacaacaagaaatctagccgatcactttactggcgcagaaaatgtcaaactaagcacccagttgcctcgctttttttcaacaagtaacttttttggattcaaaacaagtgagttttatagtatttttaaaagtaagcgttatttcgaaaaagataaggaaacgaatatagtatagacacacacgtgctagagtgctaggacccgacattcttcaaccgaggcaagcaactcgtcaaaccctgcctgtctaaagctgaccctcttattatttattatattgaacggagcacctctgattttctcaatttttccatttggccaaaaacattgaaattaatatataaatacaatttgttgttaatgaccgcaaatcagaagaaagaatatacataaatttagcagtaactgagatccatcgtaaatatcaaaaaaaaaaaatgtaaaaagaaatctaaagtcattatttttagtctatgcgagtcacagagcaaaactatccatattttagtctattatctaagcagcagtagaactgttagttatcgtaatcataattattggtgctttattatgctagaattattggtcctttattatcatcattattaatgtatggttatcatctaaatgtaattcaagattttggagacctattgagacgagggaccattgttagaagttcttattgttgagagttgagactggaaacaactatttgttttgcaagaaaaggttacaactttaaaagtgtgtaacaaagaaaatggacactaaactcgttgattatattacttcattcatcatctaagtcggcaacgaattgattaaatatggaaactaataattgaacgcaacccctaatctgcccataaattattgtcatgtatatacttgaaggttttttaaaatctcggtctttatgttctatggattttaaagacttattaatccttaaataaatacattctcttgtttgcattcttttaaaagacaactcgtaaaggaaaacgacaaagttcaatcaaagctttaaaaaaaaatgttttcttttgtaccatccattgctcaagtaaaaccactttccttttcacactagccaaaagaagagaagcccaaaaatttatcagattcatcatctcattgtaactctcccttgagagatttctcacattatccaccacttgcatcatcttcttcaacatttcagttttcactacgtctctttcaatctcttcatgcttcttcgtctacatctactggttagtgcgtcttcactgtcttcctcttcatatttcacaacagcttcattctctgaaattcttatagtaatccactcattgagtttttaaatccttcaaactcaatatcttgggtcccatttttcagcttaaagtctctgtctttatggtcaatctttacagtaataccctccacaattcttcttcgaaagttcagttagctttttctggagattataaatcaaaattttttcgtcaacaacactattaattgctctggtcaatttgttgatacttacttggtgatttgatatatctgtgggtccaatataagaaattaagcttcttcaagtgccatacctggtagaaatttgttttgaggttcttattcataatatcttcttttaaagtttgggtttttatttttggaaacacaggttttggattttggaatcatgttgagatgaaaccagtgtctctttccttgtatcttgctgttgttgttggatctctaaatcagacatg

SEQ ID NO: 29749 - DNA, 3003 bp, Unknown; identical to SEQ ID NO: 25452
  misc_feature (1)..( 3003): 2750-1469P.txt file - cDNA_ID_3022046; gDNA_ID_2214704; Annot_ID_189794

SEQ ID NO: 29750 - DNA, 3003 bp, Unknown; identical to SEQ ID NO: 25451
  misc_feature (1)..( 3003): 2750-1469P.txt file - cDNA_ID_3022050; gDNA_ID_2214704; Annot_ID_189793

SEQ ID NO: 29751 - DNA, 3003 bp, Unknown
  misc_feature (1)..( 3003): 2750-1469P.txt file - cDNA_ID_3022053; gDNA_ID_2214704; Annot_ID_189792
tcattgcacaatcaaacagcaatactgaagagttcctggtgaggattagaacagaaggatctaagctcaggatatacgtacaatgtcggataattcttcaatgaattctcctctatctgccagaaaacaatcaatagacaaaatcaaaacagctttcagaagcgtaatccaaaagctgagactaaatcaaacaaaggtaaatccagtaacgaattccagaaatctaatcaacgcaatctgcaatcaagtaacaactcttcactatactatcgccatatccatcaatctaacatccctgagaccaaaattagaaagcgaattgaagaaaccgcagaagtagaagaagctcaccgacggaagtgatgctcttgagccgattcgaaacgaaaacaatcggagctaaaacagataacaatagcagcgagaggatcagaatcctctgccaacgacgaacttgattcatcaatgtgcgtaacttctcagagaacgcttcatatattttatctccgttgcgctttaatcgttctccacgaagaagaagaagcacattcccagagggaagaacacagatctcggagattctctgcttcttcaacaagcaattgaagaaaacgatgagcagattagggttttcagattcttctgcaataggattcgataaatgcgagagtctgtttctacgatttcatatctggagattcagagcttcctcgtgcatgtttagagacttctgctcttttattttttttcgcttaactcagattttttaatatttataaatcaatgtatttatttgatttttatacggagaggattaatgttgagatacagatatagtgcggcgcggtgtacatgtgctagcaaaattactagtttactaagatttgacttcttttgattggcttagtggaaattctcccaagccaccatagatgttttgacacgttgatagaatgtactgtcaatgattttcaagagtgggaaattcacagctttgtactttggagtttggaggaacaactggaatgtttgaggtcgaatttgggaattgaaatttttaacccctggatgagtttatatttgattgatctctctattatggggtgttgaatgttatttacaaaaaaaaaatagtcattgttttatggacgaataaattatctacttgtcgtttttttaccgaataacgcataaattagattcaatacggataattcctaaaataaaataaaaacggttagttcttctaacatacgttactataacaaacgtacttgacgagttggcataaaaatgtatttctactgttttaaaagtaacgtacgattcgtcttgcatactgtgacgaaatatgtaaattcttttgtcgcttagtgatgatgtgaattattttgattcataaagtagaaactcgatacatacctattaactaaacatgtattatgttgtgattcatttttgcctaacaaataaaatttattagcaagaaccattaaaatttcatactaattttggatactaaaatgttagattgatatataagaaaagtatatactcaaaaagatttaacaatttaccaatatttagtattggaatcagtgtagtgtttgttagtacatgcttttctacatttagaaacagttaaattataattgcaaaaggaagcaatattgaggtattaataaggttttacacttttacttcagctagctttgaattttagaagttttatggactattaaattatctacttgtcgatctttcataaaaactgttggctcttgcgagagatatgtgaccttccaattgatcgcgaagtgataagatgtattcgattttttcagcttatgccatttttacaacttttcggaaaaatgtttcaaaatatccattatgaatttgacatccaagttataaattagataaaatttacttgagataacatatggacatatagattttacttatttattagagttcattaacgaaaaattattgagttaaatatagacatctttaaactcgttaattttaaaaagaaataataaacaatatatatatatatataaatattttattttcaaattttatttatttaaagggttttaatttttattaacagttataatatttatgattgtttccggttactttgatgctattttctcgtaattcccttttgtacatatatatttagaaccaaaaattcaatcattgagaagcatactctctgtcaagtgtaattgattcctcctcttcattttttaattcttcatttcttaagttttattaattaattgactcacctcttcatcttgtttatttccaagtaattttcctaatgatgtcaataaacaaaaataaaaagattaaaatcacgcaatatcagtaaaaaaggagagagggttaaatcggtggtggactttgcagccctaaaccattgtttcgcctcggaaaagcccatttacacaattgggaaataaataaaaacagagtaaagaaaggaacgtcttttactctttacggtatcgctcgcttctcttctttctcctcaacacgaagacccctcttgcctctttattagagagaccccttccttcttcttcttcaccttcaccttcttcctcgattcagatcgtctcctcctctgttttatactcaccctattccttcgaatctctctccatttttatccccagattctcccttcttcaacctcgtcgactcttcttcatcactctatttcttccgattgagacttctttcactctgattttcttcgaccctttacggatatattcggtcttgagtctccatcggatttggatttgaatgtaggtatctcgcacgagagttgttgtttaacgtaaatctgggttcttttttttggtgggtcgttgtttttcttctacatgcagttttggggatagtacgtgcgattcatcgatcaatcctcgtttagatagacatcaaggatttaaaggagtcgttaagagagcaatg

SEQ ID NO: 29752 - DNA, 3003 bp, Unknown
  misc_feature (1)..( 3003): 2750-1469P.txt file - cDNA_ID_3022066; gDNA_ID_2214704; Annot_ID_189787
aaggttccccaagtacattaaagtgactttgttaatattttgttttcctctttaattcatattatattagtaaggaaggaccaacaaaagttgcataatcacaattcacctacccttttttcctcctagataccaaagtgagcattttgagttgaacaggacaatatgtttctttgttgcagatgctaaagaatatggtacatccgcacatgttttatatatgtatttgcaacttttttatgcatgatcggattagaatcttacaatttatgtggaccaagcttttactttttctctcgaagaatattattttgttcaagaatcatgctcagatgaagggtgtgggtgtgagatagcccaaagtggtggggaataagcagagagatatgcttattcttctcttgattgacggtatttttcgcagccacgaaaaagagatcaggctgggtttgatggattggatcgtgtgtgtgtcaacaattaaaaaccctattcttgaaacatgtcactatacaacaagatatgattgtctttgtgagattctctcaatctcacttctgatcatgaaggaataataactcctatcggtttcttactttctcttgtgtgccacttccctttcaacaatttgccaagattctttcccatttaccacttgactaaagtaaaccagtgattatgagatcccatgtcagttgaagtaagcttagacctagagtaatatgtataggacatgaattaatttactaacgccaattgattttgtttaaagattaaggaacttatttggtccaagtaagatatgttgtccttcatagaatgagaacaatttgagttggaccaagacaatcatcacctcgaaagataaggattagagttagaaatccatgaaacttaacatagttacaaactcagcatatatttggaattgatcttcttgattcttatattaattatatatatgaccatctgaatatctatgttaaccccctcttccattaccaccaaaaagtgcttcccgtaagatcggagacttgccctatatagaaatatttgttttggtttggtaaaaagctttctagggattataattaatgattgaaaaagggttagtagctaagtgaggttatatggtcactcacacgatgaaaccttgaagaagtggccataaaagataatggcaggctggcgataatggctactacaaactcccttataagccatgcatgatcatagattcatagttactctttctctccgataaatttatatatttatgtttcaaaagctaataatcttttaagcagttttcagaagtgagttgtttagctttaagaatatacaagaatttgaatatttagagggttcattttcggatatggtctaaagaaatgggccgggtatgcattgtctcgacgactatgaccaaactgagaagaaaattgaacgtgcaacctcctagctaagtgacataccaatgacttatagaaatctcatatatgtttaataagtcataacgcaaaaattatttctaacaaaagcaaatgggttgattttggaactatatttaatggcatagaaaacttcttcgaatcagaaaagaatataaaatacgtgtgagttaggatgtcaccatagaaaatctccacaaaagcgtgaactcgattctatatatataacattcaatcattcttactaaaaacatctatatatatatattttaaacagtatggatccattcattctgatctgtaccagattgcaaaaattagtaagatatcacaattaaataaatgaaatacaaattgagttattttggattttcagatgaaaccaccaaacaaatacaagttgacttgaatgttctccaacgctatttttttctctattatattttataactaattaattcattaaatcacatgtccaaatatttaatgatgaaacataaagtaagtaagctagtgacgagagaaggacacctcattctcattacataatgtgacgagattgagctgtcgttttgttgtaaatatatggtcgggggtcaattattcatatgcagttttaggtcatttataaagaccattaaaaacgtctttaatatttcaacaatcttataattcaattattaagaagcatctagatatggattcacattagagttcgtattctttgacagcaaattcacattagacttttgatatatatattgtacatttgtaatatagtatacgaaaatattacttgaaaactgatgttatgtgttgccatgatgccattggtccatgacttttccacacgaaggccaaagcatactcttatattatatgagttgagtcattcttttttccttttgacggcaagttgagtaattcaattctcttgtcacttaccggtgatataagagttaatcttataaatagttttctgaaacttaatatactataacaatgtaaaagtcgtcgctttgttatttgaagtgaaaattaagcaatgttatgatatttttactaattaactcaatatgaaaaacaaaaatcctcttaactaaaacagaaacataaaagacgacttagtttttgctttagatctagactcataactcaaaaaacaatttcattataaacttttgtagatcttacaattttaaaataaaatgtacattaatgttgaaaagcaaaatcttaaattagtgtatactactactttttttttatcaccgtgatagatcattagatccttaacctcaatccctagagcctgcttattgcctttaagcattgtgcaatcactaccaaacacactcaaaactaaataaatataatttataacttatcaaataaaataaatactatcaagtgtgtatgaaatcgatgacaatttatttattaccttattaccatttgtgtcttgaagtacacgttaagctatttttatgtgttataaaggcttcttcgtcaaccaattacgaaatcaagcttttgaagcttctcaacaatg

SEQ ID NO: 29753 - DNA, 3000 bp, Unknown; identical to SEQ ID NO: 14172
  misc_feature (1)..( 3000): 2750-1469P.txt file - cDNA_ID_3022070; gDNA_ID_2214704; Annot_ID_189784

SEQ ID NO: 29754 - DNA, 3000 bp, Unknown; identical to SEQ ID NO: 14173
  misc_feature (1)..( 3000): 2750-1469P.txt file - cDNA_ID_3022074; gDNA_ID_2214704; Annot_ID_189783

SEQ ID NO: 29755 - DNA, 3000 bp, Unknown; identical to SEQ ID NO: 14175
  misc_feature (1)..( 3000): 2750-1469P.txt file - cDNA_ID_3022086; gDNA_ID_2214704; Annot_ID_189779

SEQ ID NO: 29756 - DNA, 1705 bp, Unknown; identical to SEQ ID NO: 14192
  misc_feature (1)..( 1705): 2750-1469P.txt file - cDNA_ID_3022115; gDNA_ID_2214705; Annot_ID_189820

SEQ ID NO: 29757 - DNA, 3003 bp, Unknown
  misc_feature (1)..( 3003): 2750-1469P.txt file - cDNA_ID_3022119; gDNA_ID_2214705; Annot_ID_189816
tagccatctaatcaattctgcgccgtttcttaatgttcttcttgtcgggatatcacccatagattgtgttcacattttctcattgcacggggtggtaggttttacttttcctcttcaacttgtgttatttgacaatgaacgaagaatgttctgttttcaatgggttagtatttatgcttcttttgccaggtcccattacttgctggtgctttgatgccaatatgtgaagcgtttggctccggcgttccaaacattacgtggactctcccgactggcgaattaatctcctctcatgctgttttctccactgcatttacacttcttctgaggctatggagatttgatcacccaccactagattacgtcttgggagatgttcccccggtgggccctcaacccagccctgagtatctgttgttagtaagaaattgccgtctggaatgttttggaaagtccccaaaggatcgcatggcacgtcgaagattttcgaaagtgatagatatctctgtggatcccatcttcatggattcattccccagactgaaacagtggtaccggcagcatcaggaatgtatggcttcaattctctctgaactaaagacaggaagcccagtgcatcacattgtcgattccctccttagcatgatgttcaagaaggcaaacaaaggtggtagtcagtcactgaccccatcttcagggagcagtagtttatctacttctggaggtgatgactcgtctgatcaactcaagttacctgcatgggatatcttggaagcggccccgtttgtgcttgatgctgctctaactgcttgtgctcatggatcactctctccccgggaactagcaacaggtttgtccattccctgaaactatagaaagtgttatctgcttaatgacaaggggatacttacctacatctgacgatcataagctattttattgtcttactgtctggatgcatcataaacgctacttcagaaggtagctaatagttgggtgggcgagatcttaatctgtcccttgatttgtttcaggtcttaaaatcttggctgattttctgccggcaacacttggaaccatggttagctacttttcttcggaagtaacacgaggtctgtggaagcccgtttccatgaacggaactgactggcctagtcctgctgcaaatttagcaagcgttgagcaacagatagagaagatcttagcagctactggcgttgacgtaccaaggcttccagcaggtaatgcttttcttctctaaggataatggatattctcaggtgtccaggggttttgtcatgaaagattagaaccttagatgcagtcatggcagtcccggataacatgtccctggagggtcttgcttagatttgtaaacaattgtgatatctataaaactgaaactgcggagaaagtgtgaaaagaacatgctggaagaaacgaatacaatgattatgctgaaaaaactctcatagtttacacacgtctgtctttgcagatggaatctctgcggctacacttcccttgcctctcgctgcactagtgagccttactataacctacaagcttgacaaagcaacagagcgcttccttgtacttgtaggaccggccttagactcccttgctgctgcttgcccctggccctgcatgcctattgtgacatcgctgtggacccagaaagtgaagcgctggagcgactttcttatcttttcagcctccagaactgtgttccaccacaacagagatgctgttattcagctcctcagaagctgcttcacttgcacccttggtctaacacctacttcccaactctgcagctatgggggagtgggtgcactccttggccatggctttgggtcccgttactctggaggaatttccacagctgccccaggaatcttgtacataaaagtgcacagatcgatcagagatgtcatgttcctgacagaagaaatcctgtctcttctgatgttctctgtgaagagcattgccacgagggagctaccagcagggcaagcagagaaattgaagaaaacgaaagatgggtcgaggtacgggattgggcaggtttcactttctttagcaatgagacgtgtcaagctggcagcttccctgggagcctctctggtgtggatctccggtggcctaaacctggttcaggcactgatcaaggagacattaccgtcttggttcatctcggttcacggagaagaagatgagttgggaggtatggttccgatgctaagaggctatgctttagcctactttgcaatcctgagcagtgcatttgcctggggagtggactcctcatatcctgcatcaaaacgtcggccaagggttctgtggctgcatttggagtttatggtgagtgccttggaagggaagatatcactgggctgtgattgggcgacatggcaagcttacgtgacaggctttgtgagcctgatggtgcaatgcacgccggcttgggtgctagaggtggatgttgaagtaataaagagactaagcaaaagtctgaggcagtggaacgagcaagacttggctctggctctgctttgtgccggcggccttgggacaatgggtgcagctacagaactcattgtggagacttgccatcaacattagcttgacgtctttcaactttcttttctcgactaatctaaactgtgatcatgatcacttttgttcctgagattagctctctcttttttttttttgtttgtctatattgtatattatatttattatttagagcaacatgattcgctatgtgtcacagacactgactggggaaacaacattagattatgaaaggaaatgaagccaagatttttcagatttctttgagacatttttcaattgagctactagtactaagctacaccacggggtttaatttgtgaaatccgaaactagggagactaaatccgaatagatatagatagcctaagggattcggggctgcaacaaaatcactcccactcactgcgaagctcgactatg

SEQ ID NO: 29758 - DNA, 3003 bp, Unknown; identical to SEQ ID NO: 21029
  misc_feature (1)..( 3003): 2750-1469P.txt file - cDNA_ID_3022123; gDNA_ID_2214705; Annot_ID_189815

SEQ ID NO: 29759 - DNA, 3003 bp, Unknown
  misc_feature (1)..( 3003): 2750-1469P.txt file - cDNA_ID_3022127; gDNA_ID_2214705; Annot_ID_189814
aacactaggcgtcctcgagtttttttcttccttttcaaaccagtttggtaacgtcagatttagttgacatatgaatgtagttttattacttaatttgaatttaaattgcataagggccaatcatgagattcgtcgtattcatttttgtttttaatttaaatatacgatcgattttgtctattgtgcatattatgcatctgctggagtcaaacttgactcttgatcgtcggaaagggacttctccatttatgtattataatggacgtaaacaaaaattgtgagttatcgacacaacttcagaaacacctctcatttatggtatattgtgaataaacgaataagttatccattggaaaaattaaatcagtagctagtagaaacatatatgaaaaaatatactgcgacagacagtatattaactgggaaaggagaaaaaccgagaaagaaaagaaattgtcaaaggaaatcaatcgtatttaattaagaaaaggaaatctcaactgaatctgcccttttttggttaagggggcttcagattaaaaaagagttatcgcttcataatgaatgaatgaatattcagtacaggtcacgacgtcatgttacgtacgactaaaaccgcccattttcagaatcagagccgatcggggtattgtttaataacggatttaacgatcgtgcatgtcatttcgttataattccaagctttctcatcattatcattttattatcatctttatcaacttaaacagactcttctttggcggcccattcacagcccatataatgattcttaagaaaagaaaccactcgctaccgatgtaacaacaaaattattaaaatgatcactagtattatagttttcattaaaacgacaaatccatgtccgtacttgtcaacacacaccacaaaacatatacatatatatcaatctctcaggccagaggattattcaaatcattaatttgtcgaaatccatcacttgaaagtcgggttagcacgagcaatggtggaagaggaactgagcttcatctttgccttctttatgtactcagagaactgatctgatgatctccggccactactacctacgtgagagataggcacatggtggtgaagatgatcatgacgtgtctgatctgtttcatcacttgtctcccacgcatcctccttcatcatatcaccgacattcgtcatcgcccttatcttcagcttcgctttctttatatactcggtgaacctctcgtccgttttgatcgtagtatccactcgagcgatcaccggttccacctttgtaatgggtttggctgccctaggcctagccgatgtctctgcaaatttgacgcgaacagcctctgctggtgaagatttggtggagatgcgacgaacggttcggacaggactagtcactgctctgaagatcttctcgcacactctgttttcttgcttcttcttgctactactctgtgatgatgagttctttgccatggatgtcaccttgggaagtactaaaggtgatctgtgcagagaagatagtgacattaacgagctttttataatgcaaaatctatgtgattttatctttgttaattgcagaataacgtgtttcaacatgcaacaagcgaagaaattacaacttgttgaaaagaggaaagttggaaacttttacaagtttttcaaaaaaggaagagtgatgttagaaagggatcggattctgattccactatgttttctttctttctttcttcttcgttgtttttgtttcggattgttacgttcctgtcaggatttgagaatcatgcatcagctgtcactcctctcaggagggggagattatatctacttgtaacatactaatcttccaataaataagcacttcacatattattaaaatacagtagattctcataattaggccattttccataagcttttgtttacttatttcaatccactagtatgcttttcacattattcttttcctgcaatttagcatgaatcatgtatgcaatttagcatgaatcatatatatgaaacgggggtttactaaaactctatacataaatttctaaaactctaacccactccaacccggttttttctgttcgggtatcgggtccggtttttttttcgcaggccctaattaagacattcaagaaaacaagaagaagcataagaagaggcctaaatgcccagagaattaaacaaatgggcctttaacaatattttaaacaacactgaacaatagatgagatctcaacttcgaaaagctaaagccttaatataaaaccaaacatcaatctctcgccgttaaggttacatctgtcgccgccgctgagaccgccacttaaggccgtctcctccgctctatccatatccaaaacagctataaagataaacttccagagcttggtgaaggagcagcaaccctagttttcaatccctaaaggtgaagtttttgttcttctttttctttgattctactcttttttcgtcacaatagcgcagtagcgatctgggttggcgtttttattgacggattttggtgggtttgggttcgtgttagattttactttcacagattcaggtatgtatttgatcttatttagctttggtaatactcaaaccaactagtatttgatcttaattaggtgacgttgatattttgtgtgttgtgggtcaatcatccactctaggttgatctgcgtctatgtttagtcctaattttgaagaatcattctaattgctgatgtttatttatgacaattttatgtcttacttcgaatttagctaagataataaatctagacgagtgcctttataaacagtttatgtatgaacaatgcttcgcttgtgggattgttgatttcactacatttgattaagaatgtacatactattacaaatgttatcgattaaaaacgtcattttcagatattagttctccagcgagttgacacaaaacccgattacgtttcatccggcgactcgctttgatattccatg

SEQ ID NO: 29760 - DNA, 3000 bp, Unknown; identical to SEQ ID NO: 8350
  misc_feature (1)..( 3000): 2750-1469P.txt file - cDNA_ID_3022131; gDNA_ID_2214705; Annot_ID_189809

SEQ ID NO: 29761 - DNA, 3003 bp, Unknown; identical to SEQ ID NO: 21947
  misc_feature (1)..( 3003): 2750-1469P.txt file - cDNA_ID_3022135; gDNA_ID_2214705; Annot_ID_189807

SEQ ID NO: 29762 - DNA, 3000 bp, Unknown; identical to SEQ ID NO: 3110
  misc_feature (1)..( 3000): 2750-1469P.txt file - cDNA_ID_3022153; gDNA_ID_2214706; Annot_ID_136967

SEQ ID NO: 29763 - DNA, 3000 bp, Unknown; identical to SEQ ID NO: 3110
  misc_feature (1)..( 3000): 2750-1469P.txt file - cDNA_ID_3022153; gDNA_ID_1620626; Annot_ID_47142

SEQ ID NO: 29764 - DNA, 3000 bp, Unknown; identical to SEQ ID NO: 3116
  misc_feature (1)..( 3000): 2750-1469P.txt file - cDNA_ID_3022153; gDNA_ID_2214706; Annot_ID_189844

SEQ ID NO: 29765 - DNA, 3000 bp, Unknown; identical to SEQ ID NO: 3116
  misc_feature (1)..( 3000): 2750-1469P.txt file - cDNA_ID_3022153; gDNA_ID_1620626; Annot_ID_162479

SEQ ID NO: 29766 - DNA, 3000 bp, Unknown; identical to SEQ ID NO: 14215
  misc_feature (1)..( 3000): 2750-1469P.txt file - cDNA_ID_3022193; gDNA_ID_2214708; Annot_ID_189871

SEQ ID NO: 29767 - DNA, 3003 bp, Unknown
  misc_feature (1)..( 3003): 2750-1469P.txt file - cDNA_ID_3022213; gDNA_ID_2214708; Annot_ID_189865
ggttaaatattagtttaagtttatgaacgagtttagattttataatttaatgaggtaaaatgttggattcagtttataaaaaacggttaggggtttaaatttaataataaaacaaggttaaatatcgatttggttttataaaagaggaatatagtttagattttgtagttaaacgagattatatgtcagtttggagtcattaaaaattgtttaggattgaaatttttgacaattaaatgtgattaaattattgttttgtttggataaaagaatgattagagattagaaattagatttacaattaaattagtttttcttataattaaatttaagtgtttgattctgatgggtaagaataaaaagggtgaagaaaatgtttagtataaatatttatgtatagtcctaattatgaatttatgtatttggggagtaaaaacataagttgtaacctttaaagtgtaacaaatattattaagatatcattagaaaattgtaatagtgtaacgatagaaattcactaaataaatacacaggtcatgggtcataattcaggtttataaagatctacaaagattacatacagtaaaacatctataaattaatagtcgataaataaataacctctataaattaataaattattccgatctcgagttgagaccagtgtaaaaagtgatacaaatcgatacattaataagataataattttcctgaaaatcctatgtaaatatatggtctcatcaatatcataaattaataattatataaatgtatcaactacatatatatatatatatatatatatatatatatataagaaatttctttgaaattatatttctaatatttgtttgcttaaatttgtatttgttcttatttgaatttagttctaatattttacagtatcaaaaaattttggtgttgttttctaaacagaataattattttttactctaagctacctaaagtatttataataagtagggtctatacagtgtataatatttgaaatgtataagaataaaattatatatagtatgggtactatttcaaaatcaaagtattaaattgacctaaattatgtgtattttaaataaaagtatcattaacaaaaacaacaaaatgatgtttaaattcatgagacggatatatagggtgggacaggttttgatctatatttattcttcttcactaaacaaaacaaacaacaaatacttctagattaaaaatttgaaatttaatcaaattatatataatttaaataaatatattagttgaaagaaagaaaaaaatgatgtttagttatgacgagacgagtttatatggcgggacgagtttggataagacggatttatattgcaagatgagtttggatggaacatgtttggatgaatattaatatgagacaatatactacaagtggaatcctataattaacaatcaaattacaactatacaatcttaaacactattttttgtaatcttttaaaaatcaacattatatcaaaataagtgttaatcttctttgacacatctaaatgtgtaattgtaatacaaacttactaaattacaataattctacaagttaaatctataaacactgaaagttttagttatatatttttgatacaaaaatgtgaatataacataacagattaatattattttgtcttttaagatttgacccgtgatacaccaaaagataaacttattaatattgtaaacttatttctcactaaaaataataaacaaaattatcgagaatcattaatcaacacaaataacaacaaacattatacataaaaattcattttataaaaatcaaacataaataaaatatttgaccacgatatattgcggatcctatcctaatctctctctataaactcctaattcttgtgagaattcacaacccaaatgtgaaatcaatttattgtaaaaccataacataaaaatagaatacatttcaagatccaagtataaatagtcttttttttttttgtcgtactactacgtatggggtgtgttgaatttttggtgttgataatccgagatttgggggatgttaaaagccaggtcgaccacgtgagaactgaatacgacagcgtttcaatcagcgccgaataaaaacacacataacggtgcttattgctgcgagaacggcggaacatttttttttatatttttatttttattacttaataaacaaacaataaaaaaaaacaaattaaaaagagacagagagaagaaagagaacctcctcaccttcctcctctctttgcgcgttttctctcttctctctctcctacggctgttgaaaccaatggcatttctccacttcgccggaatttcgatcggaagatgaatcgtctccttcgtctctcttcgcttaatcgtcgatcttcttctgtcgccgtctaattgcaaatccaaatcgtaaacgcttcttctcttattcttccttcccccattgttatcgtttcttcgctcgatgtgatcatattcgattcttagagttttatcgcttctttcgatgagataatctgcgtttcacatttccagatcatttgattgcgtttgttttttgtgttcattcccgattttgaactttttatatgttttcactggatttatccgcgagcgacggagaattctcgaggacgcattctgattttgaatttgtgttgctcaaagaatttgaagatctaattcatgttttcttcgacgagatcgtttttttttcagagtttttttagtttgattctgcaatgtagatcggaatgttattgtaatttcacgagtatagattggatttatacattgaatttgactaacttggatttcaagtttcagattgttcaaatttagaggttctgattcttgaatgtttttttttcttttaattgtgtatcaggttttttgtatggtatagagatttggtgaagaactagacgcagcttagaggaagcttttatatttattgaagcttagggggaaacaatg

SEQ ID NO: 29768 - DNA, 337 bp, Unknown; identical to SEQ ID NO: 7049
  misc_feature (1)..( 337): 2750-1469P.txt file - cDNA_ID_3022237; gDNA_ID_1621124; Annot_ID_56349

SEQ ID NO: 29769 - DNA, 3000 bp, Unknown; identical to SEQ ID NO: 14214
  misc_feature (1)..( 3000): 2750-1469P.txt file - cDNA_ID_3022237; gDNA_ID_2214708; Annot_ID_189858

SEQ ID NO: 29770 - DNA, 3003 bp, Unknown
  misc_feature (1)..( 3003): 2750-1469P.txt file - cDNA_ID_3022241; gDNA_ID_1621124; Annot_ID_56348
cgtttctttcgaattaaaaacgtttcggtgatggtcatttctccctttccatagcccgatatcagtctcatcattttgttgtgcaggtttctggcttttgatagcgttttcaaccgtatttaagaggtcctgcctatgtttctttcttcgattcatggacattacctcccccacagttgcagtaactcagattcccaagtcaatacatcctcttatcccaagtttttcatatagacagcctatattactccattcatcaaaccaaaatgaggtcgtttctccatttttgacctctactctatagaactgttgtgctatccctctatattccatatccaagaaccgcaagttgtagtgtcttttactgccgagaaggagccttttcttatgaaatatttctttacccattcaacccacaaagatcctttagccgacagtatacgccatatcaactttaatacacttactttgtttgcttcttcaatcgaccgcagccctagtccaccttcattctttggtgtgcagacctcagtccatgccacttttacctttcaagggttcatcgatggtcttgaccacagagaacttgaacacagtttatctatttcttgaaagcatgctttgggcagccggaaagcagctatccaaaaatttgtaagactgaagatcaacaaaaatttcttcacatgttgattttcaaatttggaaaactctatacaattgtttctagcagacaagataaatgtaaattttccacgttctatgacttttcagtacctcattgattcacttcaacagactactgtcatcattagtcgataacgtcaccatgtgaaattaatttgctcgtgcaacataacatatgttgttcaacaagtatatttattcatccatgatcctcgtcccaagaaagtcatgctatggcacttgtaaatgcatccaacgttacgttcgatgtattttaatctcctcgatcatggccgtgctatctttttttattatttgttttggccatgcaaaaatattgctacttcatttttgtaattttatcacatatataaatgtttgaactatgaaattctattaatttataaaagtattaatttatcgataaattaataattattaatttgtagagattttagactaattttgtaatttaaaaaaaaatattatgtctgaattttttcttcttctttataatcattatatttttaactttacgatggtaacgttaaacctcaaataataataaattattaactttagaaaataaaaaaaagaacgttttcgatgtagtaaaaagatattaaataaactttaccaagaattaatataaataaaaataaaaatattagcaaattcatatttcactatttttcttccgtataacatatatatatttaaaaaaacttttacaattattaatttatgatattaatgagaccatatatttacataaaattttcaaaaatttattatttaattaatatatcgatttgtgttattttttacattgatcttaactcttatacgataatctgaaaacaatttaggctcttattggtaacacacataatgcagaaaatttgccaataaaaaaaatctgcataattgtattagaaaacgcaaaaacgtaagatttgtatttttgttttaagtaaaaattcattatgccaaaaagtgtgtatataattatttatttgcataatataatcttattattctatgcatacaaatattagcaattgtaaaaaaaaaagtatcatagtttacacaaaattatatcattagtaatacaaaaaaacattttcataactttttaataaattttaattatcttacatttttagtatcgaaaattactcaaatatactaatttgttttaaacattattttttattaagtttatatatatatatatatatctacatatatattgttaatataatattttttttttaacaacttcaactttattaaattgtataaggttgatacaaataagaaagtaagaaacgaggagggacaataaagaactgatacagagtagtagtagacagaacgtattgagccatcttatctgcagcactatttcgttcacgattgacatggagtagagatacgttggatagtttggccatccaatgacgaatatcgtaaagaagagcccctatcagagaatgatcatcaccattattgatagttgctataagttcttggttgtctccatcaaaacaaacattttttattccacaagcccaaactacttgaaggacatgtaacaacccggtagcttccgcctgtaaaggtgaattagtcgatggtagttttcaacagcctgtaattaaaacctttccttcatcgtcccttatcaaccatcccgtatttgtaaaggatcgtcccagcataaagccactgtcaaaattacacttcacccatcctcttggtggtggtcgccattgagaacctctgtcatgaaccgtattcttgtttgtttgactacctcttgtgccttcagtataactgtttgcttccagccattcatttgcctcgtgtcgtcctatgtgttcttcggtttgtggcagtctcatgatcttcttgaaatatttatttgtcattttgcaaaatatatccaattaatatattttaaaattagtttcattcgacgattttttagtttgcaaattttcattctgcgaaatttttattctacaatttatgtcattatgctattatgcaattttagcaatcggaaccttaaggaaaaaaaccgacaagcgaaccgttctgtatgtatttcggttattttcagccagccctatttatttggttaagcttagattaaaaagtttcggtttggttcaatttgatatggtttggaggtcaacaacaaaatcaacgaactgaataaagcgatcgcgttggttctcttcttcaaaacaagctctctctgtccctctctgtctctctctttgggtaatcggaaaaatcagaaaaatg

SEQ ID NO: 29771 - DNA, 3003 bp, Unknown; identical to SEQ ID NO: 29770
  misc_feature (1)..( 3003): 2750-1469P.txt file - cDNA_ID_3022241; gDNA_ID_2214708; Annot_ID_189857

SEQ ID NO: 29772 - DNA, 3003 bp, Unknown; identical to SEQ ID NO: 29770
  misc_feature (1)..( 3003): 2750-1469P.txt file - cDNA_ID_3022241; gDNA_ID_1621124; Annot_ID_172219

SEQ ID NO: 29773 - DNA, 3000 bp, Unknown; identical to SEQ ID NO: 26160
  misc_feature (1)..( 3000): 2750-1469P.txt file - cDNA_ID_3022292; gDNA_ID_2214712; Annot_ID_189922

SEQ ID NO: 29774 - DNA, 3000 bp, Unknown; identical to SEQ ID NO: 14224
  misc_feature (1)..( 3000): 2750-1469P.txt file - cDNA_ID_3022296; gDNA_ID_2214712; Annot_ID_189920

SEQ ID NO: 29775 - DNA, 1487 bp, Unknown; identical to SEQ ID NO: 411
  misc_feature (1)..( 1487): 2750-1469P.txt file - cDNA_ID_3022296; gDNA_ID_1590839; Annot_ID_150135
  misc_feature (9)..(9): n is a, c, g, or t

SEQ ID NO: 29776 - DNA, 3000 bp, Unknown; identical to SEQ ID NO: 14231
  misc_feature (1)..( 3000): 2750-1469P.txt file - cDNA_ID_3022325; gDNA_ID_2214712; Annot_ID_189898

SEQ ID NO: 29777 - DNA, 3003 bp, Unknown; identical to SEQ ID NO: 25598
  misc_feature (1)..( 3003): 2750-1469P.txt file - cDNA_ID_3022338; gDNA_ID_2214507; Annot_ID_184163

SEQ ID NO: 29778 - DNA, 3000 bp, Unknown; identical to SEQ ID NO: 11648
  misc_feature (1)..( 3000): 2750-1469P.txt file - cDNA_ID_3022350; gDNA_ID_2214507; Annot_ID_184160

SEQ ID NO: 29779 - DNA, 876 bp, Unknown; identical to SEQ ID NO: 11654
  misc_feature (1)..( 876): 2750-1469P.txt file - cDNA_ID_3022366; gDNA_ID_2214507; Annot_ID_184153

SEQ ID NO: 29780 - DNA, 3003 bp, Unknown
  misc_feature (1)..( 3003): 2750-1469P.txt file - cDNA_ID_3022386; gDNA_ID_2214508; Annot_ID_133789
caacaaaccacaaacgctaccattctaacaaatccatgataatctctaaaattctctaatcgcgagtggaaaacaccgatgaatctaagctaataggataaatcaaaatggtgcgatggtggtggtacctgaatcttatcggaaaggtaagaaggatctgggaatccagaatcgctgtcgctgctgcaccaggaaccagcaccaccgctaccacctcccgtttccagaaaatctgtaaccattaggcctaggtcatgttcaccgtcgtgactcgaatctatccctcgattcaaccattcctccgccggaacaactctcaagtccatacccatcgttcccaaatctcggtcaattgttcaaatttcaaacccagaacttatgaataaaattgaattgaattgaatttgagtctgtacaaaataaaaaacgcgtatcgtcccctttcacgagtcttgtgtgtgattgattttattatattatatagcgatgagagagacagagcttgaaggttctttttagcgaaagagaaaaatccaggaagataggcgaaaaggaagatgaagcgaagatgaggttaatataatactcatgttaaatgacaaaaatgcccttatatgattaatgatattaccatttgagcttgctgtggaagctgtaacgaaccgaaaattaaaaacagaataacgaacatagacggagaatatgatattattcgttttaccaaagaaactaacaaatagttttaactttatctaacaaaggggtaaaacgggtaatttgtttgggatgaggtggagcgtagcggacaatcgagaaattaaaagtttggcttggggacgaagttaaaggtgggctttaacgttttaaattggctgactcggacgatatttcttgtatttaataccaaaaatgaatgactttataattcatttgtagattgaaagttacgtattgattcgaaaatcaacacattgtgttttcaagtgggcataaactataacaccttgttgattgattaatagattacctaaagacattatggtttattactggtctttcaatatatttttatcgcattgtcaatgatattgtttttgtatcccaagtccactgttttggtctctacattcattttgattgggatttatctttttaaaatttcttctaatgttttttcgatatggttattacttgctttgattttcttttcagtatgtgtattgctttgcaaattgtttttttcttaagatgaaaaacaactcattaaattgtttgagaaatactactaaaacaaataaacaatgaggagaattatggaaaacaaagtgtaataggctttaattcattgctagtgggctttttgggcctatgggcatattacttaccactatccaacccaaaatgccaaataaccgacatgtctcacacaatccaattttgggccatacggccgaaattatttaaacctgtgctcataatttactttacaaattattacttttccataaattgtggaaaagttatctgtaacatccgattcaactggagtctagactactatagacattgatacgttttgagtttttagatacttggaagatatatgcatttatgaatacagattacagacacatactagtactactgtatgtctgtatatggatacaaaaaaaatcatgtatgaatactaaaattttattagaaatctatttttcaattgttgcaacaatcaagttgtcaaatttatttttgtaaccgttaaacaaacaaatatcgatttaggtttctaatctgaattgacatctcaaacaaaaaaggctgaatactttctgaaaatagtgtatggaatgaaggtggcttttagagccattataaccggaagaaaattcaggtgacttttagaaccattataaccggaagaaaaggtgaattttaatttttagctgtgtggaagacacggcaagtccaagtagtaccttcgtacgtcaatattgtccaaccggccgtgtcgaaaatcttcttgagaaaaattggattttcatctataaaaaaaaaaagtccaagtaataccaaacaaagacagcgacgtgtaaaacaatacaagactcataatcacaaacctaccacccaagtcaaacctatattccatttagtgaattcttgattatgacttcttgaaatcatttgtattcatatgtataattatttaagtcatttttctgtaagtaaaatttttatatatctagaataacgagttccctacgacaagatacagttgaacgtaaatgtgacatctcaattttcattggtgtctagtactctagtgattaggttttcgacatttattgtactgattaagtaaaaattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttgatg

SEQ ID NO: 29781 - DNA, 3003 bp, Unknown
  misc_feature (1)..( 3003): 2750-1469P.txt file - cDNA_ID_3022386; gDNA_ID_2214508; Annot_ID_184174
ctagcgatctcaaaatgacttctgaaatcaatatcaacaatcaaacgatcatcttgaccaacttcagtatcactcaatatgatatctatatactcattatctcctgcaaacaaacaaaacatatcattctctcagaattctatgtccagaaacacttgtataagacggttcttagaagcgaaaacataccaccaggaactttgccaccaccttgccatctagctgaacatacagctgcatcatatccagaaagtctcaaaagcttagcgagataaaacctgatgcaactagcgttacatgtaccggatttcacagagtgtagatctttctccttaatagtaagcatcaatgtacgaaccaccgagagaacctcggtttcgtgttgagccatagagtacttgagatactgcagatacaaacacatactcttaattcaacaaaatgttcttcaccattcctagaaacctatgtactaaaacatgccttccttcaaattacaacaaaccacaaacgctaccattctaacaaatccatgataatctctaaaattctctaatcgcgagtggaaaacaccgatgaatctaagctaataggataaatcaaaatggtgcgatggtggtggtacctgaatcttatcggaaaggtaagaaggatctgggaatccagaatcgctgtcgctgctgcaccaggaaccagcaccaccgctaccacctcccgtttccagaaaatctgtaaccattaggcctaggtcatgttcaccgtcgtgactcgaatctatccctcgattcaaccattcctccgccggaacaactctcaagtccatacccatcgttcccaaatctcggtcaattgttcaaatttcaaacccagaacttatgaataaaattgaattgaattgaatttgagtctgtacaaaataaaaaacgcgtatcgtcccctttcacgagtcttgtgtgtgattgattttattatattatatagcgatgagagagacagagcttgaaggttctttttagcgaaagagaaaaatccaggaagataggcgaaaaggaagatgaagcgaagatgaggttaatataatactcatgttaaatgacaaaaatgcccttatatgattaatgatattaccatttgagcttgctgtggaagctgtaacgaaccgaaaattaaaaacagaataacgaacatagacggagaatatgatattattcgttttaccaaagaaactaacaaatagttttaactttatctaacaaaggggtaaaacgggtaatttgtttgggatgaggtggagcgtagcggacaatcgagaaattaaaagtttggcttggggacgaagttaaaggtgggctttaacgttttaaattggctgactcggacgatatttcttgtatttaataccaaaaatgaatgactttataattcatttgtagattgaaagttacgtattgattcgaaaatcaacacattgtgttttcaagtgggcataaactataacaccttgttgattgattaatagattacctaaagacattatggtttattactggtctttcaatatatttttatcgcattgtcaatgatattgtttttgtatcccaagtccactgttttggtctctacattcattttgattgggatttatctttttaaaatttcttctaatgttttttcgatatggttattacttgctttgattttcttttcagtatgtgtattgctttgcaaattgtttttttcttaagatgaaaaacaactcattaaattgtttgagaaatactactaaaacaaataaacaatgaggagaattatggaaaacaaagtgtaataggctttaattcattgctagtgggctttttgggcctatgggcatattacttaccactatccaacccaaaatgccaaataaccgacatgtctcacacaatccaattttgggccatacggccgaaattatttaaacctgtgctcataatttactttacaaattattacttttccataaattgtggaaaagttatctgtaacatccgattcaactggagtctagactactatagacattgatacgttttgagtttttagatacttggaagatatatgcatttatgaatacagattacagacacatactagtactactgtatgtctgtatatggatacaaaaaaaatcatgtatgaatactaaaattttattagaaatctatttttcaattgttgcaacaatcaagttgtcaaatttatttttgtaaccgttaaacaaacaaatatcgatttaggtttctaatctgaattgacatctcaaacaaaaaaggctgaatactttctgaaaatagtgtatggaatgaaggtggcttttagagccattataaccggaagaaaattcaggtgacttttagaaccattataaccggaagaaaaggtgaattttaatttttagctgtgtggaagacacggcaagtccaagtagtaccttcgtacgtcaatattgtccaaccggccgtgtcgaaaatcttcttgagaaaaattggattttcatctataaaaaaaaaaagtccaagtaataccaaacaaagacagcgacgtgtaaaacaatacaagactcataatcacaaacctaccacccaagtcaaacctatattccatttagtgaattcttgattatgacttcttgaaatcatttgtattcatatgtataattatttaagtcatttttctgtaagtaaaatttttatatatctagaataacgagttccctacgacaagatacagttgaacgtaaatgtgacatctcaattttcattggtgtctagtactctagtgattaggttttcgacatttattgtactgattaagtaaaaattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgttaatg

SEQ ID NO: 29782 - DNA, 3003 bp, Unknown; identical to SEQ ID NO: 25602
  misc_feature (1)..( 3003): 2750-1469P.txt file - cDNA_ID_3022412; gDNA_ID_2214509; Annot_ID_184201

SEQ ID NO: 29783 - DNA, 3000 bp, Unknown; identical to SEQ ID NO: 11679
  misc_feature (1)..( 3000): 2750-1469P.txt file - cDNA_ID_3022416; gDNA_ID_2214509; Annot_ID_133804

SEQ ID NO: 29784 - DNA, 3000 bp, Unknown; identical to SEQ ID NO: 11668
  misc_feature (1)..( 3000): 2750-1469P.txt file - cDNA_ID_3022416; gDNA_ID_2214509; Annot_ID_184197

SEQ ID NO: 29785 - DNA, 3000 bp, Unknown; identical to SEQ ID NO: 11664
  misc_feature (1)..( 3000): 2750-1469P.txt file - cDNA_ID_3022420; gDNA_ID_2214509; Annot_ID_184193

SEQ ID NO: 29786 - DNA, 3003 bp, Unknown
  misc_feature (1)..( 3003): 2750-1469P.txt file - cDNA_ID_3022460; gDNA_ID_2214510; Annot_ID_184221
cttatttatcaaaagacaacaagacgatacaaacaaacaggaccaatgagtctgttttgcttcatcaggcagccttactaggcttttttttgtgaagctgcagatctaatggcggtttttgcaagcgtcgaaggcttgagtacactcttcgggttaatagcctttcttattttgaaagcaacccaggctgtgccaagcgcatatcctgctgcatcgagcccttcgtttgtcgcctcagccgctttaccaccatacctatattcatcaaaccaaaatttacatccttctcttaaaacactttccatatccaaataaccaggagtttcaattccaaatactcgattttacttacttgtgatcaacgagttcggttgtaacagtggaagaggttgacattacattcctcccagctacttcaacagcgtcacagaccttatctatcaaaacaggaatcaacagtttcaatgatcatgattacctaaagatagccgcatgaagtcgagttaagtatattgtagacttactgaatccgtcaagagatgcaaggatgacttctccaggaagaaggctgaagaatttctttcctactttggtgtttgccactgaacttgtgaagaatccagaaactttaaggactccagacagtatgctgtttgctacactctctgtcattttggtcatcctcttcactctgcataggcaacaacacaattagacaccaatacacgtaactatatgtcattttgctagagacgatgaacacatatcgtctcagctctcaaattacactcttcaggacacaccagaacaaatcaagatcatcaatcaaaacttatgtctcacaaaaaggattatcaaagacgttcacacaagtttctgtccagacaatttcctaaaatataaaccatattccaccaatttactgcaaacattccatgacacagctataacaaacacaaagatttcacctttcgagaaacatcacaaacctctaaatcaaaatcaaaatcaaattcattcataccttctgattcttttcaaggtgtcagggtgaacttcactctccttctcagcctttgacaacctccttttcatgaaaccatttccccaaataagcctatccatagtcacatctccacaccaaagaatcccttttatcaaatgtcctgagccagttgcaatcagcttcgccgccttcccgctataatcctccacattcggagccaaagtagtccaataagcagaacattgcctctccacaatctctttcctttccccagtaagctccaccggagacgtctctctcgccaccgtcacatccaaaaccttttcacctgcttccttcgcttcctctgacacctcctgcacagagaaactactataatcctccaagatcttctcaagctccaccagtaaatgctcttgacctttagaagcaattgtaagtccgtagttcaacatctcgttagtgtttttccctccatctccgtcttcttcgtcgcttgaatcatgtgagatctctttggtaggacgaagcgtgaagaagtaatgagactcatcgaccttgacagagttctcatccttagtcaacggccattgaatctcatcggagacactagcgagaacagcgacaacattctctccttgaacaatacggatgatctcaagatcaccgcaagcgagctcgacgctgtaagatttgtcgattaaatgaagaatcgcgccggagattttcaaaattacttcctccgtcgcagcgggaggagctgaaaccggaatagaactcgtctctggttgttcagggaagagattacgagcgagatcattcatatcgagagaaggatagagattgttagtagaagatgatgagctagggtttataggagcttcgggattggatgtgtcaacagtagggtaaagagaagaagtttgcttgtcgccggaggattccattttcgccggcgatttcaaatcggagaagatcaatgaagaatgattgacttggtttggttctgaattgattaaagatatttatatttgaagaagaagaaggaaagggaccaagttaagtatctctgtatctgtcagatttgggaagacgtggatgttacgcgtaaatgacgcgtgtaaaacggtataaaccggttcggttataactcaccttgtcgacatctttcccgcgctgttacacggttaattgttctcatgtcggtcggtcgcttttttcgtctcggaaattgcattaaactcaaaaaaagagtgtacttaaagataatttattatgcagttgcgtatcactaaaactttatattatttaactgaaataaagaaatgatagtttcttttgtttgtttttgagtaaaaaaaaaaagaaggtagtaacgttttttcttttctgataaaaggtactaattatttactctacataacatgctattacatttgtaaaacagtatttagtttgaactattaacatgtcattgcttaacttataacttaaattgttttgcatacaataattaacgattaaaaaaaaaaaaaacgattttagatttagttaacaaaataaattttaaacatgcttatatttggataatcttaatcagcaatataaccaccaaacatgtttgatgtttctaagttctagcagtcttgaagttctctttacatgataaaaaaaagaaaagacaaaatcccattaattctcattaaaaaacttagattggttcaaggaaaaaacattaagaccaatatcctctgtttttattaaggttttaaaaaacacacacacaaaactagtaacgaacattaaagagtttctctgataacatgccctttctcaacttcatcaaacagttctgtattaatagctctcaaattccagaaatcaccagacagtatctaactaacaataaagactcccctgcctctaaaaggttttaaagtttggttgatagacaaatcagttacagacttacagatttagattgccacgttaaaatg

SEQ ID NO: 29787 - DNA, 3000 bp, Unknown; identical to SEQ ID NO: 11685
  misc_feature (1)..( 3000): 2750-1469P.txt file - cDNA_ID_3022468; gDNA_ID_2214510; Annot_ID_133815

SEQ ID NO: 29788 - DNA, 3000 bp, Unknown; identical to SEQ ID NO: 11687
  misc_feature (1)..( 3000): 2750-1469P.txt file - cDNA_ID_3022468; gDNA_ID_2214510; Annot_ID_184218

SEQ ID NO: 29789 - DNA, 330 bp, Unknown; identical to SEQ ID NO: 11695
  misc_feature (1)..( 330): 2750-1469P.txt file - cDNA_ID_3022482; gDNA_ID_2214511; Annot_ID_184259

SEQ ID NO: 29790 - DNA, 3003 bp, Unknown
  misc_feature (1)..( 3003): 2750-1469P.txt file - cDNA_ID_3022494; gDNA_ID_2214511; Annot_ID_184253
gtaccaatcatcatctccaggtgatcggtttattaaaaattagggtttttgattgttctaatccgatctctcggttcctttaagattgatgatgaatttcgaagcgtgatatgaaaagatctgaagacttgatgtcagaacttgcgttgcgtgggttccgagataattgttgatggaaagagtatcagagcgaagtttgtcagaaaatttgagaagaagcgatcgagaagatgggaagattatagaatgggaagaattcgaccatgagcttacgaggttatggagtctttcttctgctatgaaattagccacagagaggaaacaaatcctgcaaccgaaacttgagtctcttattcaggtttttctcttactcatgtgttttcttttgggcatgtctgaatttgattcatttctgagtgtaaagcatagatttttattagtggcattgtcttaagggtggatgaagatagctagaagaagaaactctattcaaagaaaatttatgctttcttattgtgttggttaggaatgtgttgtttagtcttattattcttgcttatctcttactttatctactcgatgagctttaattgattagcccgcggattagcgggcggcaaaatttcgggcaggttagtactgaatcattgagacgcactaatgaacttgaagaaatgcgtcagaggcttgaagcaagaaaattgttggtggacaagacatcagttgcttgcaaagttactgagcaggatgttaaaaagaaagaggagaatcttagtacagaagtgaggtctttgctagtaggcggaacaactctttcgatcgctaaaagcaaattgcaggtattacctcattcagtgcagaattatcttattaggaagcaaggtgcatcagttttgcatatcctggtgtttggctatttcaaattagttgtttccccatgttctcttggcctcttctttggcaggagtacagtttattttacgacttactttttcttcttctaactgtattttagttctagtatgaattatttgatagctgtttctttaaagaaggaaagctaattttcttcagtatattctccattctatgaacaatttgtgaatgattgaatcatagatacactgttttaacttatttttctcttttcataggaatcaaactgccaactagaaggagaaagtggttatgcacatttaaagattgtaacgaataagctgagaaagaggcagcagttcatggtatctcaagtttcatttatctatcccttgaagattgaagctggaccttcacaagaccaagaactggaatcatttcctggtggcagtagattaggtcagttaagtctaaaatcttataagaattaagaatgtagcctttgatgagaacgagacctaactccttaacatctttcagtgcatgcctttatctttacttcattcagtctgatattgatatcaggactaactttgcctttgttgtcgtaagtgtttacagaaagtttttaattgcagcatctaccttcttgacatgtttatatctatggcttttgtaggaactaagcctctgagtcaaggatctgtgagaattctggggttgccttttagtatggccccgtttacaaagatgagcttcttcaccgacaagaaagaagttcagaagtctgcaactgccctaggatatgtagcccatgtatgttccgtcctctttttccttactgatttatgcattaaaacttgctttatacttccatatctattgtgcggccttaaatctcttggcttggatttcaggaatcactgctaatgaattcaaacaaacgaattttgtttggtttaaattcttgatagaaagtattaatggcttcctgcttggcttttgcaggccgtgtcactaatagctccttacttgagagtgccaattcgttatcctttgtgcctggggggttccaaaacatacattcgagactatgcaccttacattgagccttcaccatcagacatgtctccgattaccacgctttcccaaaatattaactttgtagagtttcctctgtttctggatggtcaagatacaacacgagctgcctatgctgtcttcttactaaacaaggttagttagagattttttttggttttgctcttctccctgatacttgaaacagtagcttgcctctcctctcatctaatcatagtcatcgtatcacagaacatcgagcaactcttgaactttgtgggggaaaatagtctaggaccacgtcaggttctagcaaacctgaaggagctaattcgaatcatccaatctccagattatatcgattatttatgacgatgatgatgatgacgacgaaaataatgacgatgatgaagatatcaatccattccttctcacacatcttccagagttccagtgtctcttcttgtttattgaatcatctcaagtcagacactttgtggaggtaaaaaagtacaaataattgattttgttagagaaattttagacatggaaattctctttaggatgagactcctcctctctagatgtgatgtttttggtttggagagaccgacgataaacgaaagcttagtctattatacagttctttcttaagttctaacagctgtattagtttttttgtttccctttatctttttgtgctagttgtaccatttgaaatatgtttgaatttgtaacaatgagcctgttgttgagtcagtacaattttcaacgtactgttggaatacgaaacgtgtgaactgtggagtgatgatgattcaaaggcgagaaaacaaaagaccaccaccaagggtaaaatgggaaactcaataagtaaaaatggaccaataggagtgtttgacgaggattgtactttaatgttcgttcaaagctcttttaacttttcccatcatctctttctcacctcctcctctctctttctctctctttctctctctgaacccagaagaaacctcaaaaaaaaaaaggtttctcaaaacaacaatg

SEQ ID NO: 29791 - DNA, 3003 bp, Unknown; identical to SEQ ID NO: 25612
  misc_feature (1)..( 3003): 2750-1469P.txt file - cDNA_ID_3022512; gDNA_ID_2214511; Annot_ID_184244

SEQ ID NO: 29792 - DNA, 3000 bp, Unknown
  misc_feature (1)..( 3000): 2750-1469P.txt file - cDNA_ID_3022516; gDNA_ID_2214511; Annot_ID_184242
atctatgtgggtgatgcatgtataatgtataagcctatctgtttttctttatttgttagtttggaaaatgaaaggtttaatatgtgtttggtttgagccattaatgacataataaatgagatcacttttttttcactaaatgagatcacatttagggcttgaataatgcaaaagagccctcatattattaatggctttgtagtagacatgtccttcaactataaaaggaaaaataaaacagccacgattataaacttttgtttttttgataacgacacaatttattcatttatggtacgtcttttatgaaaatacactaaaagagaaacacactgttctttttgctataaatccatggaaggttgatttatgaggaatcatatacatatggtgaactgatgattgcattctacgaatatgatcagtctggtttttagaacatgaaccaattattattatttgacaaagtacatgaaccaattgtagtatatattttcatcaatttcaggttttttcaccatcggcgcccactagaatcgtttgctcattttcttaatcggaaataagatatacatttcatttcatgtgcatatatatatacatcgatattatttatttattgaattcatcaaatgtacattgatttcatttttattgttatgttggatgagatcaactgggcagttggcagacataaataaattgtcctatgacaggtgaacctcatttaatttagtttactcaaccaatttatttttttcgccttcttacaagttaatacgtccggtttaatcaattccggtttcccacttttcctcacggttacgccttaaccaagcatttcaacctctgaaatagaataatttgagtatatatgaacaaatcaacaaactaaactaaaccggaattgataagaaacctagaaaaagaagaagcaaaaccggttatgtatgtaacgtactcacgagtggacgatatgtctatatatagaggtcaagactaagcttcactgacacaactactgtcttcgatctctctttcatatacaccatataaaacgaaccagttaattatgggtttaatttccgggaaggtgtgtgtgtttatctttgtattcgctctagtcgctgaattttcgttcggaaatgttgaggttaacgacgacaaacactttttccacaaacctcgtccatttttacacaaacctcgtccattcctccacaagcatggcatttacaagaaaggtttcggtaagggtttgggcggtggaggcggtctaggcggcggaggtggtctaggaggcggtggtggcctaggaggcggtggaggtttaggcggtggtggaggtttaggcggcggtggtggtctaggaggcggtagcggtttgggaggaggagggggtctaggaggcggtagcggtttgggaggaggagggggtctaggaggtggtggtggtggtggtttaggaggaggaggtggattgggtggtggagctggaggaggatacggtggtggtgctggaggaggacttggaggcggaggtggaattggaggaggaggaggctttggcggtggagggggaggaggattcgggggcggagccggtggtggatttggtaaaggcattggtggtggaggaggtcttggaggaggttatgttggtggtggccatcactgatgagtggtgaggctcatgctcatgcattcgtaacgttgttatattatttaattaaatggaaaatgataaattaattattgcaataaaatgatacattagcaattgtgtatgtcgttatttttattttgagtcgcattgtatgctgattccatatgttcggctttggtcggtttcaagtgtggttaataaaatggttattttacttttgccaacagttattgagtggttgtgtttatgttttatatacatgttcactcatctttccatatgatcttacaacacttgctaaaatgaattcggttaggtgaattttatgagtagatacactatgtaaataattagtaaagtaatatgatatttatttatcttttggaaacttttaaaacaccaaacttaatattacatgcattgatagtgatcactgtaaaattttgtactaatctaagttcaaaaagtattacatgagtatgtcttatcccaaatttagtctcaacaattgcaaacttttgagacatatatacagcaaactcttatctcacataaaaaaactttaaagttatgagtaatctaagttatagacttgtagtgctactctagctaaattaaattcattaattctggagcataaagaaatctgaaaaataaccatcttctcgatcatgtcctttgcttagcataatatttcttgttcggtttagcgatctcctaaaatgcaacgtggtcactttgccacatcactttgaagatgaacaatctacaagctgacaaacgtatctaatgtgtttgtccgtatgttaagtttatttctgtaattttgaacacatgtgagaattttcaaactgatttaattccgattccaagctatacgtaagaaatttcaactaacgtggattacatacttttctttgagtccgaatacaaagacttcacattctattttgttttcttctttcgaaaccactaagggctactaacctctcgaatcgacaaacgtatccaatgtgtctgtcgttatgctacgtttatatctgtaattctgaacatatgtgagaagagaaattatcaacggatgcatgtgattccaatcccaagttatacgttaagggattttaagtaacgtagaaatcacttcatgatttgagtggcccttagctgcttgaccatacttttgttctagcccgaatacaaaagacttcacgtatagctttaacattttctgagtcaaattgtgcaaaaccacatatctgtatttatacccttcttctctctcacatttcttaatccaaaatcattcttctaaaagatatttcaagacaaccatg

SEQ ID NO: 29793 - DNA, 3003 bp, Unknown; identical to SEQ ID NO: 25620
  misc_feature (1)..( 3003): 2750-1469P.txt file - cDNA_ID_3022587; gDNA_ID_2214512; Annot_ID_184303

SEQ ID NO: 29794 - DNA, 3000 bp, Unknown; identical to SEQ ID NO: 11710
  misc_feature (1)..( 3000): 2750-1469P.txt file - cDNA_ID_3022599; gDNA_ID_2214512; Annot_ID_184300

SEQ ID NO: 29795 - DNA, 3000 bp, Unknown
  misc_feature (1)..( 3000): 2750-1469P.txt file - cDNA_ID_3022611; gDNA_ID_2214512; Annot_ID_133864
ttcctatgtaaacaaatagataatatgtaggtaaataacattgcttataccaatctaaatgtcagttaagaatatattgatacatatgtttataatgccttacagatttatagaaaacccatatttgattatagtgatatatataagaacgtatacagagagcgcaatctcttatccaaatcagaaaaagatttcaattcgtagccaaaaccaagaaagatataagatataggtgaactataggagggtgttttttttactcgtaattccttggattctattggttaatccatcatccatagtgtgtgtatatttaatttttagaaaattagaaagaaaaaaattgtagaaagggaaagctatatagaaatggcaacccatgcatgattgccttgaacatcgcaaaccctcccttagattgcatgtctagtggaacatagtggacctgcaacaatattcaacaaaaaattcatattatatacattgcataatgcatagtaggacataataagatgaattattatgctcaataacaagtttatatgatatgcccacagtttcatcacatatacttgagtttattaaaacgaatgattctatttctctattaagattagcctttattaattgttagtggtatgagatatattgaagaaaataagtataagcaaaaaaaatgttgatagaagaattaaataagcaataatttcaaaaggtatgtaatgtggatgaaacggcacatgtcgttgtcacgtggctcgttcccatcgattcaatgcatatctcgaccaacttgacttattaatattcctcgtacaactctccaatctaaagccacctttcttctacgttatacattttctttttctgttttcttttaaatactttctcctcacaaattattgttttctattatctaaaatcaataccgttaggaaatggtgtctttataacactttagaaaaatataattaatcattttctaatgtattatttttgtaattgagtaatttgatttaaaaatataaactaatataataatattggtatttaatcatttcaaatattcttaattatattctttttgaatacacgcatattgttctaaactattaatttcttacaaaaattctatattatttattgtgtctacaaacaaaagagtcgtctaatcatttttggtttcattttttttttgctagaaatcaaaaacaaattcctcattttttttgaggtaagctaatgttattttctaataacaatcataagtaatacccgtggtttaaagtttacacggtattaattaggtactacagccatggtggacggtggatcttcatcacctaatccgtacaattaagagacaattaattacattaaatcatgtgcattagttgatttaggaactaattgataaatcaactctaaagactaaagtagtgcgatagataaagctaaagtatatattttcttcagtataaagataggaatatatggggacatatacttttgtcgattttgtatccagctttgcatcagtgaagtctgagcgaagatatgaccagacttaaaaagcaactaaaaagatgcataacagaaacacaaaaataaaattcatgcatctgctagtcatagaggttattggattcattgcacgtatcttaatgattcgttttcgtttcacctcccttgctacaaaagatttgaaagagaaaatgttaaattctttaggtcagaatcaattaagataatttcattttcttcttgtgttttgtacgtcacttgtttcttttttcgttggttatgtaccaaaacatgaaaagttcaaaaattgttaattagaagattaaagagaagagtaagaataaagatgaaatgaggaattgatatggaggagtaggacccaagtttgcaaggatggtggctggctggctgctctgttgtttgttacatctcattctcaatcttaattccaattctatgtgcttctttcactatttccctatagaataccattcttgtttttttttttcaattttcaaaaaccactataaggaactttttcaatagttgcttgtttgtttagaccaaggaagatgtcaaatagatttcttcacttttcaagtggaagcaaaattatgcggtcaagtgtattatactagtgtgtgtttttttttggtttaataccgactaatttctaactctaatctatcagtgaacgtcttaaaactaatattgctgaagaatatattgttctctgctacagcctacagcattcaaagtttcatcaaaaagataaaatgtatatataactaaaagttttgggttaatagataatagtcaaagaagacattcgtgttgaatgtttcttttttttttttttttttatcgtggggattgattcaatgcattgttccaaccttttgactctttctcgtgtttccttttttattcgttttctgaattatactttttagaccctttcctcgaatttttacttgagccctactctagtaatacataagcatatatataaaaatctctcaaatttgattaggacagttttagtatataaaaaaaggaaaaaacgcattgtttaaaacgtggtcatgacgaaaacgtttgatttcgatcgatgatatttaaataaaggaaacacctaaccatatttattcttaactgatcaaagatcctccaatttcacgaagcctaaaactctcaaaaacagattcaataacgtcaccaaaccttgaggctttttaaaggaagaagcatttgagaaaatcgtaacttcttgaccctatgcattctgctgtgtacaaggtatggttagtgcttgtaatatacaattatataatctctttgttttaataagtggttgctcattaagatgaatgttacttgtctagtgaatgagtatgacgttgttgtggttatcaggttggtcttcattatctttcttgggatatttctggtggcaatgccagatgtattgcgatg

SEQ ID NO: 29796 - DNA, 3000 bp, Unknown
  misc_feature (1)..( 3000): 2750-1469P.txt file - cDNA_ID_3022611; gDNA_ID_2214512; Annot_ID_184293
gaacaaagtttaacaactatatataactgatcagttatataaatagcatatacaccatagtgatatcttcccgatcttaaaagatattcaaattatcttgtggatatgtacttgattcgatatctttgattttttgtattcatgatcttatggttaggatcgatgccaccagttcctatgtaaacaaatagataatatgtaggtaaataacattgcttataccaatctaaatgtcagttaagaatatattgatacatatgtttataatgccttacagatttatagaaaacccatatttgattatagtgatatatataagaacgtatacagagagcgcaatctcttatccaaatcagaaaaagatttcaattcgtagccaaaaccaagaaagatataagatataggtgaactataggagggtgttttttttactcgtaattccttggattctattggttaatccatcatccatagtgtgtgtatatttaatttttagaaaattagaaagaaaaaaattgtagaaagggaaagctatatagaaatggcaacccatgcatgattgccttgaacatcgcaaaccctcccttagattgcatgtctagtggaacatagtggacctgcaacaatattcaacaaaaaattcatattatatacattgcataatgcatagtaggacataataagatgaattattatgctcaataacaagtttatatgatatgcccacagtttcatcacatatacttgagtttattaaaacgaatgattctatttctctattaagattagcctttattaattgttagtggtatgagatatattgaagaaaataagtataagcaaaaaaaatgttgatagaagaattaaataagcaataatttcaaaaggtatgtaatgtggatgaaacggcacatgtcgttgtcacgtggctcgttcccatcgattcaatgcatatctcgaccaacttgacttattaatattcctcgtacaactctccaatctaaagccacctttcttctacgttatacattttctttttctgttttcttttaaatactttctcctcacaaattattgttttctattatctaaaatcaataccgttaggaaatggtgtctttataacactttagaaaaatataattaatcattttctaatgtattatttttgtaattgagtaatttgatttaaaaatataaactaatataataatattggtatttaatcatttcaaatattcttaattatattctttttgaatacacgcatattgttctaaactattaatttcttacaaaaattctatattatttattgtgtctacaaacaaaagagtcgtctaatcatttttggtttcattttttttttgctagaaatcaaaaacaaattcctcattttttttgaggtaagctaatgttattttctaataacaatcataagtaatacccgtggtttaaagtttacacggtattaattaggtactacagccatggtggacggtggatcttcatcacctaatccgtacaattaagagacaattaattacattaaatcatgtgcattagttgatttaggaactaattgataaatcaactctaaagactaaagtagtgcgatagataaagctaaagtatatattttcttcagtataaagataggaatatatggggacatatacttttgtcgattttgtatccagctttgcatcagtgaagtctgagcgaagatatgaccagacttaaaaagcaactaaaaagatgcataacagaaacacaaaaataaaattcatgcatctgctagtcatagaggttattggattcattgcacgtatcttaatgattcgttttcgtttcacctcccttgctacaaaagatttgaaagagaaaatgttaaattctttaggtcagaatcaattaagataatttcattttcttcttgtgttttgtacgtcacttgtttcttttttcgttggttatgtaccaaaacatgaaaagttcaaaaattgttaattagaagattaaagagaagagtaagaataaagatgaaatgaggaattgatatggaggagtaggacccaagtttgcaaggatggtggctggctggctgctctgttgtttgttacatctcattctcaatcttaattccaattctatgtgcttctttcactatttccctatagaataccattcttgtttttttttttcaattttcaaaaaccactataaggaactttttcaatagttgcttgtttgtttagaccaaggaagatgtcaaatagatttcttcacttttcaagtggaagcaaaattatgcggtcaagtgtattatactagtgtgtgtttttttttggtttaataccgactaatttctaactctaatctatcagtgaacgtcttaaaactaatattgctgaagaatatattgttctctgctacagcctacagcattcaaagtttcatcaaaaagataaaatgtatatataactaaaagttttgggttaatagataatagtcaaagaagacattcgtgttgaatgtttcttttttttttttttttttatcgtggggattgattcaatgcattgttccaaccttttgactctttctcgtgtttccttttttattcgttttctgaattatactttttagaccctttcctcgaatttttacttgagccctactctagtaatacataagcatatatataaaaatctctcaaatttgattaggacagttttagtatataaaaaaaggaaaaaacgcattgtttaaaacgtggtcatgacgaaaacgtttgatttcgatcgatgatatttaaataaaggaaacacctaaccatatttattcttaactgatcaaagatcctccaatttcacgaagcctaaaactctcaaaaacagattcaataacgtcaccaaaccttgaggctttttaaaggaagaagcatttgagaaaatcgtaacttcttgaccctatgcattctgctgtgtacaaggtatg

SEQ ID NO: 29797 - DNA, 3000 bp, Unknown; identical to SEQ ID NO: 26175
  misc_feature (1)..( 3000): 2750-1469P.txt file - cDNA_ID_3022619; gDNA_ID_2214512; Annot_ID_184289

SEQ ID NO: 29798 - DNA, 3000 bp, Unknown; identical to SEQ ID NO: 11704
  misc_feature (1)..( 3000): 2750-1469P.txt file - cDNA_ID_3022631; gDNA_ID_2214512; Annot_ID_184282

SEQ ID NO: 29799 - DNA, 3000 bp, Unknown; identical to SEQ ID NO: 11703
  misc_feature (1)..( 3000): 2750-1469P.txt file - cDNA_ID_3022638; gDNA_ID_2214512; Annot_ID_184279

SEQ ID NO: 29800 - DNA, 3000 bp, Unknown; identical to SEQ ID NO: 11702
  misc_feature (1)..( 3000): 2750-1469P.txt file - cDNA_ID_3022651; gDNA_ID_2214512; Annot_ID_184273

SEQ ID NO: 29801 - DNA, 3000 bp, Unknown; identical to SEQ ID NO: 11628
  misc_feature (1)..( 3000): 2750-1469P.txt file - cDNA_ID_3022692; gDNA_ID_2214506; Annot_ID_184135

SEQ ID NO: 29802 - DNA, 3003 bp, Unknown
  misc_feature (1)..( 3003): 2750-1469P.txt file - cDNA_ID_3022706; gDNA_ID_2214506; Annot_ID_184129
gtgaaaaccctagatgtagaaggtgaagatttcttaagatgtttgtctaaagcatcattgattcgtttccgatcaatagctccaccaaggatctccgatctcgatgatccaccaccacccattattcctcctccactccgatccttgtacataactcgattcgattccctcaatgaaaaaaaacaaaatttttcagctttagattctcaaagtcttcgactttcttatcatcagaggaagaagaggggcggataaatctagggtttgttttttcttcgatagtttgatcacagagtagaagaaagagagaagaagagataaagagtgctctgcttttccctgtggttttttctcattctctactgttttgttttcttctctttgtttttttttttttttttaatcattgtttaattttttaaaattctagtatttagaaatgggcttttcggatgggccttatgacactgacagttgtaatacaaagattcacgtagaaggaaacatttttttgtacttaaactatgattccaaattatatcttaggaagaaagaaatcataaaattcatttttttttgtatcaacacggtagtaataatggacttgcctttccatctttgttaatgatgatgtgtttggtggtcgatccattgtccaaacttaaatcgaaaaaaaaaacaaatgatctagagataattaaaattacacatcttgtaaaattagtcatgtaaatgtaactgaatttacaaaatttgatttgatataaccaccacttattttcattttgctgaaacatttggacctttgcatttgcattgattggtgaaaaaaacaaagcactataatttgtacaactttcatttctaccaattataattttttttatcaaaagcgttactaaaagatttttctctcagcttttttatacattttttttaatataactgttttttagtaattttatactatttcaaaaaaagttaacagataaaagttatgtacagctatgtgttaccaattagagtttttttggaaagaagtaaaatatggcaaaatctatctaaattcaaaaaataggaaagaaatcaaacccaccgaataaaaaattatttttaaggcgttttggctctctgacagctcaaattaaagttgactccttttttaccactcaagtctcattctcattcttcacttgaaccagaataaaaccacagaaagagagagaacagggtaagtaaaatcagagaattttctcaatcaatgtcagcttcaatggctgcaacatcaacatcatcagcaacagctacaacgtttataaagtgtgtcactgttggcgatggagctgtgggcaaaacttgtcttcttatttcctacaccagcaacacgttccccactgtatataaatccatctctccctctctctcttttggattgcttttcttgatagcttttggtgactgttgagatcttgttattacaggattatgttccaacagtgttcgacaatttcaatgctaatgttttagtcgatggtaaaactgtcaatctgggtctctgggatactgctggtaaatgcttttacctaatgtcaaagttgttcttgtctttagctttatatctacaacaatatgtcaaggtctaatcttttggtccttttaaaagaagtcagttgaaaaatttgaatctttgatgcaacattgttttggttcttgaattcactatcagattttgctcatgtttcttcaaaacttaaatgagaccaattatgattcttgtgttatatatcttttgggtgattcacattatattacaggtcaagaagactacaatagggttagaccattgagttacagaggagcagatgttttcattcttgccttctcacttattagcaggcctagctttgagaacattgctaaaaaggttgagacttgagattatctttccttttacttttaatttcactgtaatttaactttacaacactgatctcatgtgcatatggatcggttttctttcgcagtgggtacccgagctgagacattatgccccgactgtgcctattgttcttgtgggaaccaaatcaggttgaagataatgaaccactctgttatgtcttgaatgttaggaatctaacatcaatgtgtaagtgatgttatgtagtatataagatgaatttcttgatattgcagatctaagagacaacatgcagttcccaaagaattatccaggtgcttgcacaatcttcccagaacaggtatgtttttttaaagattcttcttcaatgtatatgatcaagaaccatgttaagaatcaaactcttttataactcaaagattgcttcttttatagggtcaagaactaagaaaggaaataggagcattagcatacatagagtgcagctcaaaagcacaaatggtaaagtaaccattaatgcttgagttacattttacaattagaccaaatattttggacctcaatctgataaagaaagacttatgatgatgctaaatttgcagaacgtaaaagccgtgtttgatgaagcgatcaaagtagttttacatcctccttcaaagactaagaagcgaaagagaaagatcggtttatgccatgttctttgactagtgtactcaagtctctggctttggtttgttttacatcttttttagtgtgtttcttctatgaaggactcttgcagattttagtatgattagctatcttcgttataaaagtttgatcttgtagtagagattcttgtaacagaattataagcgaattctcgtctatcagtctatgtaaaagaacaatgtttgtcttctttgagttcaagagacaacaacaaagaaccgttttagcgcaaaaagaaacaaaataaaccgattgaaacagaatcgaagaataaataaaccgggttttgttttttggctaataaccgaaaccgaaatagaataaatcaataaaatctcaattctctagtcttctcctttaaactagagtcgatg

SEQ ID NO: 29803 - DNA, 3000 bp, Unknown; identical to SEQ ID NO: 11623
  misc_feature (1)..( 3000): 2750-1469P.txt file - cDNA_ID_3022712; gDNA_ID_2214506; Annot_ID_184125

SEQ ID NO: 29804 - DNA, 3000 bp, Unknown; identical to SEQ ID NO: 11622
  misc_feature (1)..( 3000): 2750-1469P.txt file - cDNA_ID_3022714; gDNA_ID_2214506; Annot_ID_184124

SEQ ID NO: 29805 - DNA, 2941 bp, Unknown
  misc_feature (1)..( 2941): 2750-1469P.txt file - cDNA_ID_3022728; gDNA_ID_2214506; Annot_ID_184109
ttcagcttaataccttttgaacaaatgtgtacaaaaccagtttaattttgacgagaaccggtcgaatatttaaccgatttggcttgattttcaaaaccatgaaaactttacaattaaaatttgagcggtctaaaccattagaccgtttagagatccctccaacccaaaatagtcgattttcacgtcttgaacatatattgggccttaatctgtgtggttagtaaagacttttattggtcaaagaaaaacaaccatggcccaacatgttgatacttttatttaattatacaagtacccctgaattctctgaaatatatttgattgacccagatattaattttaattatcatttcctgtaaaagtgaaggagtcaccgtgactcgtcgtaatctgaaaccaatctgttcatatgatgaagaagtttctctcgttctcctccaacgcgtagaaaattctgacggcttaacgatgtggcgaagatctgttgtttatcgtttctcttcaagaatctctgtttcttcttcgttaccaaaccctagactgattccttggtcccgcgaattatgtgccgttaatagcttctcccagcctccggtctcgacggaatcaactgctaagttagggatcactggtgttagatctgatgccaatcgagtttttgccactgctactgccgccgctacagctacagctaccaccggtgagatttcgtctagagttgcggctttggctggattagggcatcactacgctcgttgttattgggagctttctaaagctaaacttaggtatgtgtttacttttcttttctcatgaaaaatctgaaaatttccaattgttggattcttaaattctcatttgttttatggttgtagtatgcttgtggttgcaacttctggaactgggtatattctgggtacgggaaatgctgcaattagcttcccggggctttgttacacatgtgcaggaaccatgatgattgctgcatctgctaattccttgaatcaggtcattgaaatgttgagaagttcataaatttcgaatccttgttgtgtttatgtagttgatcttgcttgcttatgtttatgtagttgaaaagtttaaaaatttctaatccttggtagttgatctcgcttgtttgttttttcattttctagatttttgagataagcaatgattctaagatgaaaagaacgatgctaaggccattgccttcaggacgtattagtgttccacacgctgttgcatgggctactattgctggtgcttctggtgcttgtttgttggccagcaaggtgaatgtttgtttttttatatgtgatttctttgttttatgaatgggtgattgagagattatggatctaaacttttgcttccacgacaaggttattgcagactaatatgttggctgctggacttgcatctgccaatcttgtactttatgcgtttgtttatactccgttgaagcaacttcaccctatcaatacatgggttggcgctgttgttggtgctatcccacccttgcttgggtaaatttttgttccttttcttctttattttagcagattctgttttgttggatactgcttttaattcaaaatgtagtcatggttcaccaattctatgcttatctattttgtgtgttgtcaggtgggcggcagcgtctggtcagatttcatacaattcgatgattcttccagctgctctttacttttggcagatacctcattttatggcccttgcacatctctgccgcaatgattatgcagctggagggtaagaccatatggtgtcatatgagattagaatgtctccttccatgtagtgttgatcttgaactagttcaatttcgtggaatgatcagagtgtcctagatagtgtcacagcagtcgacattttagtggctagataatgagttctttccgttagagataaacattcgcgaacattgtttccagcttccgcgacccaacttctgattttgtttcttggtaccttgttttcagttacaagatgttgtcactctttgatccgtcagggaagagaatagcagcagtggctctaaggaactgcttttacatgatccctctcggtttcatcgcctatgactgtgagtcttgtagattcatcttttttttgtagtttattgactgcattgctgtatctgatttttgctgttccttccaatttttgtgacaggggggttaacctcaagttggttttgcctcgaatcaacacttctcacactagcaatcgctgcaacagcattttcattctaccgagaccggaccatgcataaagcaaggaaaatgttccatgccagtcttctcttccttcctgttttcatgtctggtcttcttctacaccgtgtctctaatgataatcagcaacaactcgtagaagaagccggattaacaaattctgtatctggtgaagtcaaaactcagaggcgaaagaaacgtgtggctcaacctccggtggcttatgcctctgctgcaccgtttcctttcctcccagctccttccttctactctccatgataacctttaagcaagctattgaatttttggaaacagaaattaaaaaaaaaatctgaaaagttcttaagtttaatctttggttaataatgaagtggagaacgcatacaagtttatgtattttttctcatctccacataattgtattttttctctaagtatgtttcaaatgatacaaaatacatactttatcaattatctgatcaaattgatgaatttttgagctttgacgtgttaggtctatctaataaacgtagtaacgaatttggttttggaaatgaaatccgataaccgatgatggtgtagagttaaacgattaaaccgggttggttaaaggtctcgagtctcgacggctgcggaaatcggaaaatcacgattgaggactttgagctgccacgaagatg

SEQ ID NO: 29806 - DNA, 471 bp, Unknown; identical to SEQ ID NO: 11613
  misc_feature (1)..( 471): 2750-1469P.txt file - cDNA_ID_3022732; gDNA_ID_2214506; Annot_ID_184108

SEQ ID NO: 29807 - DNA, 3000 bp, Unknown; identical to SEQ ID NO: 11735
  misc_feature (1)..( 3000): 2750-1469P.txt file - cDNA_ID_3022740; gDNA_ID_2214513; Annot_ID_184342

SEQ ID NO: 29808 - DNA, 3000 bp, Unknown; identical to SEQ ID NO: 11736
  misc_feature (1)..( 3000): 2750-1469P.txt file - cDNA_ID_3022748; gDNA_ID_2214513; Annot_ID_184339

SEQ ID NO: 29809 - DNA, 3003 bp, Unknown
  misc_feature (1)..( 3003): 2750-1469P.txt file - cDNA_ID_3022757; gDNA_ID_2214513; Annot_ID_184334
attgtagaatccatgaagaaatcctgtattcacgatacgttctattattgtaatatgttcttttgatttattttcttcaggtgtcccaccgacttttcgagcttacaaacacgttaaagtctgttttcataccaacaaaagacgacaagaggctgctccacaatgttctcgctggagctgccatctcgttctgtttatatttaacatctctcattcttctccagatcccacactaaccatgtaaggccttttactttgcatggtccattgcagccattgttgatcttggtgtgtactcgcttaggaagagatacaattctcgattaacacgctataaccattttattttgacaggagggactagaaacatgttgaaaaacatgaatctaaagctgcacagaggtttctatgtgaaacttgctaaaatagatacaacacacatctcatatcgacaataaaaatttgttttcaaagatcagtattttttgaagcttgccaagtgaagcatcttttgggtaattagaaccagagaagcttcaaaaaatggcttagagtgaagcatcttgtggcatttcgacggcatcatcttaggacgacttatcttgttcgttttctttctcgtctctgttgtaattttgctataagtttctcatatatagtttcattttgtcttttgttcgtccgtatttggtagtttgtccaaatacagaacatatgaattttacaagagtggatatttcaattcaattgagtcttcagataaaacgccaacacagttagagaaaaagaggttcgatttctatacaaagataccacaaaggaaagttcacaaatttacatagaatagaccacaaacaaactctctttctctgctctcattcacataataagcagccgctcactttccggggacgaagttggtggcgaaggcccaagcgttgttgttgactgggtcggccaaatggtcggcgaggttctccaaaggtccctttccggtgacgatggcttgaacgaagaatccaaacatagagaacatagccaaccttccgttcttgagctccttcaccttcaactctgcgaaagcctcggggtcagtagcgaggcccaatgggtcgaagctgccacctgggtaaagcaagtcctctgcttctcccaatggaccatctccggcgactctgtagccttcaacagctcccatgaggataacttgagtagcccaaatggctaagatgctctgagcgtggaccaagctcgggttgcccaagtagtccaatcctccgtcgctgaagatctgtgaaccggccttgaaccaaaccgcttctccgaacttcactccgttcctagccaatagctcagggaaaacgcagcctagggctccgagcatggcccatctgctgtggataacttctagctcacggttcctggcgaaggtctctgggtcggcggatagaccagcggtgtcccatccgtagtcaccggggaactcaccggtaaggtagctcgggggctcgccggagaatggacccaagtacttgactcggtcagatccgtaccatgggctgcctgatggaccctttggcttggcgacagtcttcctcatggtcacacggccgcttccgaggacatctgatgcggcaggcttcacagcctttccggcgaaggcaggggaggacaaagccatggttgaggaagccattataatctttgtttttgtgttttcttttttttggttgtgactggtgagagtgattgaaaatggttggggtatacgtccactttatagcaatgttaagagtaaggtttgttatctgtgaagtatctgtatctgtttagtgattggcttatgagattttgggattgtcgttatcttgtcctatgtgtcactctctagtccataagcttttgctagattctttagctgcaacgaaaacacttgtcatttgtacacaaagaaactttggggaaattttcaaagataaatgcttgaattattggaaagaaatatttgaaattattccaatctatttttttctttttccttgttttctttaattccaatccacttcatgctctcaataatattttcttttttttcttatcaagtttgtttcgaacgccaaactacaaagtttttaagtgaaactagaaacacttaccaaacaaatatatatcaatgttatgtaaaacaatgcagttagatgaaacaaaaagtgatacgaagttcttacgatcataagttaataatataaaaccgtcgacaatgatattaactgatacctttgattgattttgttgaatgttttcggcaacaaatatgactggtaagtttttcttgccaatacgaattagaaaacatgtctttgaagatgaactgtattttttttttttactttgttgtcattttaatgtactttcttatcaggattaaatcttctgtaatttagagtagtttttttaacaagataattaacaaacttagagtaatgaaaattgagatgttcagttttcactcatatttcacattttggtgaaagagtgggtagtatgcaacgttctaagtatgtttggactttgtatcatgttgttttgattctttgacgacatgtctatttgggaaacaccaatgacgtgtaccttgagactgatacgattcaaagggatagaaacacgtcagatttacaagtggcacgtcttcaatggacaatgggtattccaatatgctaagatgctacgagatatctaatttatctaacacaactcaattccaaaccaaaaatctgatgccagctcgacaagacaaaaaatctaagctcaaaaatgtcaacaaccaatagaaatcaaggcattgacgatatcacgagataagcaaattaaatcttcaagttttgcaattcatatgtacgttataaatacccaaaaacctcaccgtaacctagctatccaatttcatcacatcttattaactaaagagccttttacttgcgccacactctcaccgcaatg

SEQ ID NO: 29810 - DNA, 3003 bp, Unknown
  misc_feature (1)..( 3003): 2750-1469P.txt file - cDNA_ID_3022761; gDNA_ID_2214513; Annot_ID_184332
atatacttcgacggattggtctttgacgagtctagtgatcaggtcaattgaatttcaagttagtttgatgattacctttataaggtttcctccatggttaattagtaaatgtttgagctttgtttttgatccgtatcgaacaatgaggcgtggtagacgctatttagtatcgtggattgttgggttatgtgattcagggttaaaagatgataagcctgtgttggagcttgtgcgtagagtaacatggggtttgttttgtgctgtttatgtggggatcatgttgtttgccttgttggtttctgcgtttatgattagtggttttgtgattacctatttggctcatgaaccacttgttatcaaagagagcttgaattttgattacaccaagagtagtcctgaagcttatgtgcccataagttcatgtgctggtgttgcctttggtttgagtggcaaggagagtattgaaactgggaaggtcaaagggttgaaagacaggacagagataactgtgtcaatgacattgcctgagtccgagtacaatagaaatctcgggatgtttcaggttcgggtggacttcttatccgcgagtggtcatgtgcttgctagttcaaggcggccgtgtatggtaaaatttagtagcgagcctatacgtcttgtccagactttgctaaagattgctccgcttgtcacgggctatgtctctgaaatccaaaccttgaacttgaagcttaaaggcttggtcgaaaaggacattattcctactgcttgcttgaagatcatgatcgaacaacgtgcagagtttcgtcctggagcaggtattcctgagatttacgatgcatctctgttccttgaatccaaacttcctttcttgaaaaggatcatatggaactggaggaaaactttgtttgtctggatcagcatgagtttgttcattatggaattacttttcgccttagttttcttcagacctctgatcatcccaagaacaggtcagagaacacaacaaagagatggaacacattctatcaacaacaacttatatcttgacggtcaggcgggaagtagatgaatcagtggttgactagttgttgtaacggtacttacacttactgtaactttaatatctttcttcaaccgaaattgtaatatcctgtctgctaattaaagtcgcattgtccaaatagacttataagttacgttcttgaatcgttttcataagtcggaatgatacagacttttaatttgatttacagtgtactttacacagtaacatatacatatgttctactttacaaccattttgtgttgataatgattagttacaatgagagcagcgaacagatttgaagatgcttgaccttaaagattgatctacatcatcacagaggaagatcggtaactcgtttatgagaagatcctgtcttggagaactcaggctctgcgttctgtattgacggtaacattttatgaatcaaggccccagagacggcaccaagtgttggagccagcaagtatatccaaatccctttgtaacatccccacacaagtgcaggtcctatgcttctggctggattcatcgatgctcctgatacctctctgtaaaatgaaagtttggattgttcccattggttagccaaaaagattcttaccattgaagaattttaacttgcagagattgagggggaaatgtgaaacttacccagcaaatataacattcagtgtgacggttgccccaatgattagcccctctagttcctctgtctgcaagattgataaatgttaagattgaaatttatatatatcatctgatcatgaagtgtttttggttgttgatcgcttacagttctcttggtggttgtgacggcacagacgactaacatgaggaagccggtaatgatgaactccatcacgaatgcttgaagatcagacccagaaggagatgacccgaggaagacatcatgtttcttgctgcacacatcattgttcagatcaaacagaagacgcagagtcgcagatgccaaggttgatccgatgacttgaacagttatgtaggccgggacttgattcagagggaatctttgggaagatgctaaggcaagagtgacagcaggattgaaatgtgcagagaggtggccgagacagtaaacaagaaccattatcactataccccaaaccacagcaatccccacaagagtcactacatggttgtgttgagcattcacggcaatggcggcacagccagcaaatatcagatagtaagttccaacgagctccgctaagagctgcagatcaaaagtgctcatcgtaagtatcagttaacacaaaaacttgaaaagcctatgggttaaaaagaagctttgaagagtgaataaagcagtgcttcctcaatttggactgagataaacttaccttttgcaagaaatggacagagagcaaaggcggggacgatgactcgtgtttgttggaaggaagagaagtgtctgcaagagaagacgctttgatgttgagcacaacaacatttccgtggttgcttttgctcactgatatgtcatccatttttctttttgtccgagaaatagaaagaaaaaaaagttctgtataagctttgattgatgtttgaagttatgtgtttgagagattttttttttttttttccttcttgtgtgtttgagagattgtaatgaggtttcttccttttatagttactttaccaaaaccaaataagcagactgagaacaaagtgaacaaaaagtcaaattttgcttttcagcaacttgctaaaccaaaatcatagtttatttagtgtatatttgttttaagctgaatactgctgaattgcagcagatggttttggagagcaaaagacacaggtcgacccgaaatagataatgtttagaaagagtcaaatccaattcttgtttctggtttaacctaaaccgaggctgacttgtgcaccatttttaattcctgtttgtactctttgactttatgagtttgcaaatg

SEQ ID NO: 29811 - DNA, 2610 bp, Unknown; identical to SEQ ID NO: 11739
  misc_feature (1)..( 2610): 2750-1469P.txt file - cDNA_ID_3022765; gDNA_ID_2214513; Annot_ID_184330

SEQ ID NO: 29812 - DNA, 3000 bp, Unknown; identical to SEQ ID NO: 11732
  misc_feature (1)..( 3000): 2750-1469P.txt file - cDNA_ID_3022801; gDNA_ID_2214513; Annot_ID_184354

SEQ ID NO: 29813 - DNA, 3000 bp, Unknown; identical to SEQ ID NO: 25629
  misc_feature (1)..( 3000): 2750-1469P.txt file - cDNA_ID_3022817; gDNA_ID_2214513; Annot_ID_184347

SEQ ID NO: 29814 - DNA, 3003 bp, Unknown; identical to SEQ ID NO: 26181
  misc_feature (1)..( 3003): 2750-1469P.txt file - cDNA_ID_3022819; gDNA_ID_2214513; Annot_ID_184346

SEQ ID NO: 29815 - DNA, 3003 bp, Unknown
  misc_feature (1)..( 3003): 2750-1469P.txt file - cDNA_ID_3022832; gDNA_ID_2214514; Annot_ID_184393
ttatttagtataaataaatacaaatatatctatatctatgtatatattgttaatataatatttattttgttattctgtaaaatatatccaatcaacctattttaataataatttcattctatggttttttattgcgtaagttttcattctacgaatttttatctgcaacttatgttattatgatattatgcaatgttatcgatcggaatcatgtaaataataataaaaacgactgttgagactttgtaaaaaaaaagaccattgagatatttagtggccgatatataaagattttttttaaaatggagtacattaaatatatcaacaaccaaagctgtatttttattattttaattgggcttatttgttttcgtcaaccatcttagctgcatcttgtatacagaataaaaaacaatgactctctacattgatgtaatatatttaatttttgcttaacgttatcgtaataataatatgaaaatagaatttagcccatagtttatttgccactaacacttaaggactcaataaacaattacgactagatcacatcattatgaattaaatccattaattatttacacaaattgcagatgagagttatttaactaaaagccttattgggaagctgaaaaattaaaacgaagagtgcacatttcagtctgtatgtgtatgtttatatatacacatatgtagggtcccatacccatctctgtaacgtttattgtgaaactcactgcactaattaaatggacatgtttgagagattgtataagcaacttagctaaaacgcaaatccacatatcctcaaaataaacttgttcagtaaaagcttcaatcaaatcaccaaaactcatcctcagagcaatctctatatatgttccatctcaaacaaatcacagaactccttctttttattttaccaaatttatatataaatttgtgggatcattggtttcttaaaaccccttaccaagaaaagatgactgaaataagtgttgaaagcactcacaaaagttagttcactcgtttaagaatttagaagattacatttcttactaataaaagaagttcattgaggcttctcaggctagccacatcagctttctaatcttttccattaagctgccacatcagcctaattttgctcgcaatgtttctaaacccagccacattagcctaatttattactaataatcaaggctttgggcctcttaataatgtaatcaacgttttggtttccctcttagataatatacatctcatacctctctaagggttttacgttccaattcatctcccccaaatcgactctctaatagtcgcctctccttcaaaaatacgatcaccttcccgttcatcgttcacttcatcctaatatttctaaactctgcatttaataatgatagactgacaaaggtgagacaaattgttctttacgtcttattattaaatcgagatatatagcatgactcatgttatctctgtataaggccttttaacaaaaaaaaaaatgtgatttctgtatatgcatgaaatatggccacaactctctaacttcttcacttaaggtatatgtcttcttttcgcccgtctaaatatttctgtggttcatggttgggaattgacgttgcaatcataatatgttccttcatgttatatgaatatattatgacttgcaggcttacaatggaaaccagagactaccttggcagcagtttggaggaggtaaactctagaaggttgtctcgacatgtgcacgttttggttttcatctattgattctcccatgtgttatacttaggtgttatcaattctagattctcattatagtagaaacagagtaaaatttaggtttctgaggtcttaaacttggtgaatgcatgatatgtgatggtcaaggatttcactatgtaagtgaacaaagtaaattaattgtcattaaaggtcttttttatatgtttaacttttgacgagatgcatctattatatggatcatattcatatttctcctgcaaatcttcaaaaatgataaatgttgtttcttaaagcacaaaaagattatatatgaatatatatcagaagaggagggttccgtttggttatatatatgcacttccaagcatgttgtgaccaataatatactgtggtttaagggagatcttacatatggcgttcattatcaaggtttcaggcttcaaacgttcattgatccaccattatacacatcagctgcttaagataagcatgcaactctcattctcttcagctttttcttattaagattcttacattctttagtttagtttcattttatatatagaaattgttgtattactattattctaaaaagtaaaacaatatgtgcgtataaaaccatagttctttacgttaccataaccacacatattcttctcatttttttctggttaaccatattggaaaaataaaataaaataatgtactgtaatcaccgttatttttacttgctaatctattgcttgaaaaaagtacatcatgtaatttcaaaaacaaaaaaaactaaaacaaaatcacatgaattatagtaccagtatatagatgtcaagactatactttgttcacatattcaatgatagtattaaatatattaaaacttgcttataaaaagtaaccggcgcgtagagccgaccaatccctagtgaaaaaataaaatttgtaatatttattcatctaaataactaaaatatcaaccagctgtattattagcttagttgtgttttggctttttcaacctagctgtatatgaatgtagagagttaatttaattaatttgtacattaagatgtattagaatatttattaacgaaattcaaaaacacaaattgcaaatgaaaagctggaaagtaaaacgtcatgtctgtgactactatgtgtatgcatctgtatatatcggaatgaaggagaataacaatatatatcctaaaccaaagaaaaaaaagaatctccgattgagcagccatg

SEQ ID NO: 29816 - DNA, 3003 bp, Unknown
  misc_feature (1)..( 3003): 2750-1469P.txt file - cDNA_ID_3022837; gDNA_ID_2214514; Annot_ID_184391
tggaaacttgagtttctatcgtgtttccaaaaataaatttttaaaaaatatgttttcgtgacgattttcgtatttccgaaaagtttctgtttccgaaatgtttcgaaatataaaacagatctaagagcgaattttcatgcaacctagatatacactgcccttttaatttgctaagttgtaaatttcctcaaccgatatatggaacaaaattaaaattagatttctgttattttaggtataatctccgggtatacgtgatgagttagtacttttacgcagtagtgatatacaacaaagatctctgataccgaacgtgaaaagtaaaagtccttttacatcatcgttttatatcttgaattaatataacacacaatgactattttttttttagaaacacaaaaagactgttgagaaaattaaataactaaagtctatcaaccatcttagctgtacttaatcgtatatatgaaagttggccaactctcttcatatggatgacacatcatcacacaagaaaatgacatgtgtcctttaacattaattaaattaaaaatcagcaaaattaattgagagaaaatcaaaagtttcatattctgttaaatcgtccattaattcatttctttaactattttttcaaaataaaaataaaattataaaattatttatttaaataaatcaattactacttttattttacttttattatttctatttttttttaaattaatggtcaatggtcatcactctataatgactaaatagttatttgtgttgtagtttagttgtttgctaccttatattagtttagttattttaccttgatttttttatttttacgttatggttcatatcttatcatatgaaattctgtcttttcatttttgtatctttaggtaagttcgtaacattgacattcaacattttcaagtaatagacttttgagacttttggtaagtttataaattcaccttagttgtatatcaggctactatagttaattaattatgtaccacattaagatgattagtttgtttccgtctttattgtacattgtgatttgtgaagatagcatttaatcatttagttagctagctaacccataagttatttatttgccactgaagctatatgccccaattaacaatcacgattagatcatttcataaaattattacagaacatgaattatatataatgtcctatgacacatattttatttattaaagaacttaatcatctatgtgtaacactacctttcattgtttcaagtaaaacttttggtgtatattttcgtttttctttggcaatgttaattgaaacatttgcgattaatcgggtggcgtcacgaaatccgattgtgaaccgggtaatagccggataagacgttaatttggtgacgctatcacacgtaaaaagccaacaaacagtcgaattttaaccggtccaactagttctacttgattagatcatttgaagtccaccttttgcaagattttcttcgtgtaatttacttatctttaaatcgaacatatatatatatatatatatattatatatttttgagtactaatatattgcctttataatttgataaatatacttgtatgtaattaaatcttcctcctcactatataaattcatgacttttaaaactgtttctgtttatatatatatatatactaggatttaacccgtggtataccacgggacaaatattttatttatatataataatattaaattttacggttttaaatttagtattaaaattatataattttatattaatattgtaaataaaaaaattggtgatgataaaataataaataaggatttaactcgtgttatatcaatcaaatccgtcccgctatacaactcgtctcatgatagttttaatatttttttataaggataaatattaataaattgtaggtatgtaacctagctgtaggtatgtaaagagttagtttaatgaatttgtacgttaagattagactatttattaaagaaatttaaaaacacaaattgcaaagaaagctggaaaaattaaaacgtcatctctgtgaacgtgtatatatcggaaagaaggagaagaccagtatcaatcctaaaccaaccaaaaaaaaacaccaaaatctccgattgagcagtcatggacttattcggagaatttcataaggtggaaatcaatgggaaactatttctcgtataccacaacgttataaaaccattaccaaacataaacaatccattgattccgtctacgatctccctcctcagcctcttttcttatgccctcaactccgaaccgaaatattatcaattgatatcgataatgcgagggttggtgagagggtatctaaacaaattcttttcaagcacaatacttcccctctctttgatgacactagtgacggtcatcatgtactccctctgttttggtgcaacaacaaagaagtcgatccagaagcagtagacggcgatgagtgctattcttgctctttccaatccatcggtacagactattatttctgtgacaagtgtgataaaaggttccataaagaatgcgtcgagtgtccacttgagattagttatcctacccacaccaaacattctctccaactcttctattctaaatatagatctgacctctgcatctactgtagagaaagagcaacctatctgatttatttttgtgctctttgcgatagttatatgcatgtcttttgtgctcagatgaaaatacctttttttatagaccaaccaaaaagacatgaccataccctcaccctttttcctagacaagcttccttaacctgcaatatttgtggtttggtaaataaacttcatctcacctacatttgccctatatgcgatttcgtagcccatagtgattgtatctatatcccacaaaccataagaatatctcgtcaccaccatcgtgtgtcttttatttcttcccttccttttgaagaaaagtcttgcggagtttgtcgtcaaatg

SEQ ID NO: 29817 - DNA, 3003 bp, Unknown
  misc_feature (1)..( 3003): 2750-1469P.txt file - cDNA_ID_3022841; gDNA_ID_2214514; Annot_ID_184389
taacacatccttgagttaaaaaaagtataaacaaattttggttcatttattagtctaattggcctcatcgctcaatgaagctatactatcgcaatccaaaatgtctcaatgaagatatcctactatcaatgaagctatactctctataaactataccgaaagttttttactagagatttcttaatgaaatctctatcccttcgattcatatatgtaggatatcatgtaaattataatacaaaaagaccgttgagctaaatattaatactcaatctgtatcattttaaatgatgtttacaagagagaaaaattgtttcatttaaataatgtaatacagtaaaaaccttaaacattccttgaaatgaagagagtatattattatgggctatattaatgtatatgcctgaaagacttgaaaattagatatttactataaatagtttaatattaggtaagaataaaagagaaaaaaattaaaactataaatatcttttctatttatttaatttaccaaatttgccattgtctcacaacattatttattaccggatactttaggcatgatactgttcatcatatacctgacaactctattcatccaaaatttacaacactattcatcattggattgcataaaatatttatggtttatgtagataactatttgattaacatgttaactagtatgatatcgtgctagatacagataaatgtttgattaacatgttaactagtatagtatcacgataaatttatatataacgtattaaaccatttaccatattatacaaattaatatgaaagaatcaaattcggttgacaaaaaaaaaaaaaaaaatcaaattcaaattagaataacatattatactgaatataacgtgctaacatattaaatatttgaataatatttttatataaatgtggtaaaatatttgatatatagtgaaattataacaatagtttatacacgacatatttggtaaattaaacaaagtaaaaaagacagttatgactttaattttttttctcttacatacttacccaatattgaattatcaatggtaaaatctagttttcacattttctgggcatatccattaatactagatgagtacccacgctacgcgtggatttattttgaaaattgttaaaaaaaatatttacattgattgttatttttgctaatttttgtttattctttgtttattcttgtattgttaataaaattagatccataatatgtacttataatttttatggttagattcatttgtgactaatttatttataaagctgattatttataaaattttaatattttcacttcatgaatacatataacaacaatatctgatattctgatagaattatgtataattatgttacttgtgtggtttaaaatttgcttaactcgattataaataaatcaattccttgttttatgtacttcaacgatattgtgataggttcatgattaaagtttggattgacatcaactgaataagatctgaaaaatattcatatgtaaaaataagaagatggcaaaaattgaatatcatttaagtcaacaattttagattttctatcattgcatatatcaatattagaaaaatgatcatgtcttggatgatttgaaaattgtctaacttgattacaaataaactatttctggtcttatatattctcttgatataataatcaacaacattgttataagctcatgattaaatatataaaattgatataaactaaacaagatttcaagcgtattcatatgaaaaaataaaaagaaagcaaaaattaaaatatcatttaagtcaatacttttagatcttctctcattgcatatatccatataagagaaataatcatgtattaaattatttggtaggtctaatgtttcaaaggtttattatttgaaaaaatttgaatgttaatgttatcaaagactcaaaataaaattactaaactaataagaggttaggtagcaaacatcttcaatgcaaaacattttagtcattaaaatagtgattattgataataaaaaattagtaaaataaaaataatataatgtaagtagtgcttaatttattaacataatttttattttttatttttattttgaagaaatcaattaaaattagtattgatgatacatttaatttacttattaaattttattaaattttaatttaaaaaatataaaatgacacatgtcatttcttgtgtaatgacgtgtcattcatatggagagagttggtcaacttttatatatatgatttttctattatatattacattaaatactttttgaaacagagtcaaaactattacagtaaatattataaactaacgttagttggatttaattatttttaatttcagcttagctgtattttttgtcaaccaacgtcaacgtggtaacgtagctgtaatatataacaaaaatgacttctacattaatataacttaattcgtaataataatgtgaaaattagctagcatttagcgcccatagtttatttgctactatatgagtcattaaacaattacgactagatcatatcattctaaaataatatcaaacaaattgcaaactggagttgtttaatccttgggaagctaaaagtgaaatcttaacgaggacaacacctttcagtctttatatatacacatatgtaggggcaagaaggataacaacatcccaaaaccctaaaaaatactctaatcgagcaaccatggacttcttcggagaatttcagaagagagaaatcgaggggaaaccatatctcgtatactaaaacgttataaagccacaaatacaaaccccaaactcctctgatgaaaaaaccaccatcgataatccattatcaatccaaaatttaaactccatagccattgattccggcgacaatctccctcttgcacctcttttcatatgccctgatttacgatatcgattaacagcgactgtcgataatattacagtctcgggtgaagatg

SEQ ID NO: 29818 - DNA, 3000 bp, Unknown; identical to SEQ ID NO: 27379
  misc_feature (1)..( 3000): 2750-1469P.txt file - cDNA_ID_3022848; gDNA_ID_2214514; Annot_ID_184385

SEQ ID NO: 29819 - DNA, 3003 bp, Unknown; identical to SEQ ID NO: 25634
  misc_feature (1)..( 3003): 2750-1469P.txt file - cDNA_ID_3022851; gDNA_ID_2214514; Annot_ID_184384

SEQ ID NO: 29820 - DNA, 3003 bp, Unknown; identical to SEQ ID NO: 25633
  misc_feature (1)..( 3003): 2750-1469P.txt file - cDNA_ID_3022872; gDNA_ID_2214514; Annot_ID_184374

SEQ ID NO: 29821 - DNA, 1197 bp, Unknown
  misc_feature (1)..( 1197): 2750-1469P.txt file - cDNA_ID_3022877; gDNA_ID_2214514; Annot_ID_133906
ttagattattttaaataatatatgtctatcacctatattagtaagtatatattcatagattatagttgattttgcccaaagaaaaaagaagattatagttgattataccacatcattgatattctgtgacgaattagattacagttgcggtaaacgtattcgctagctagtacgacgtgcttaacgcaaaaatattcaaagataacgaatccgattaatattggttcgtttcttaattcttacatctagaatcacacataaaaacaataaaataattaaaaatttgatgaattttttatttttttgagtgataaaaggcaaaatgttttccgttttttagtagctttctctttcaaaatatctatttctggtgtatatcgtgaaaaaaactttcaaaatacgtgaatgtgatgatcgttgaaaacttcaaatctcatttcccctaggttactataaaagcccactatcctttaatgggccaggcatgctatttctgtacaatacaagatggacctgaatgttttaacttttaacttttatctttaaggtcaagttaattgaaaacaaaaaccaaatttgtggatcaatttggatgcctcagcctacgtataaaaacatgtttttttttcgtaatattaatggaaatgaatatgttaaaaaaaaaaaatacatgtttttttcgtcgacacttttaaaaataaaataaaatttaaataaatgtctttgaccaaaataaaaataatgtaaaatttgggagtggggaatgtagctcggaaaaaaatagggtatgtagatcggaattaataaatagattttatattattacataaacaataataaaatacacaatgttgtctttatttaattaatacaaaaataataaaatagacaatgttgtctttattaatattacttctcagccccaaaattaatctttgatcggtcccttttgttttatcgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaaatg

SEQ ID NO: 29822 - DNA, 1197 bp, Unknown; identical to SEQ ID NO: 29821
  misc_feature (1)..( 1197): 2750-1469P.txt file - cDNA_ID_3022877; gDNA_ID_2214514; Annot_ID_184372

SEQ ID NO: 29823 - DNA, 3000 bp, Unknown; identical to SEQ ID NO: 11766
  misc_feature (1)..( 3000): 2750-1469P.txt file - cDNA_ID_3022899; gDNA_ID_2214515; Annot_ID_133948

SEQ ID NO: 29824 - DNA, 3000 bp, Unknown; identical to SEQ ID NO: 11766
  misc_feature (1)..( 3000): 2750-1469P.txt file - cDNA_ID_3022899; gDNA_ID_2214515; Annot_ID_184432

SEQ ID NO: 29825 - DNA, 3003 bp, Unknown
  misc_feature (1)..( 3003): 2750-1469P.txt file - cDNA_ID_3022903; gDNA_ID_2214515; Annot_ID_184431
ataaatattcaatgcataattttctttaaattaattttatataaaataaatattttactatatattatatgaaataaatgctttattatagggaaaaaacccaaaacaaacctcaacttgttatgaataaagatggatgctcattataacgcccatcatctaaactcatcatctagatgtttctaaggttttaccctttccttgtaatcctatataaagaaccctttacctcaatggaataacacactcattttcttctatctctttctctgtttataacacgttatcaggacgctctaaaaggtagatatagagattcttacatttttttaagaaccatgtttacttatcgactcatggttcatagtatttattttctattattgaaacaaaacaatatgagccgatcgatgattatagtatagatcggtaaaagcatgttttcaatgattcaataaagaagagaatcatgcttatcatttgtttctataattactatcgcatgattcaatgattctacaaagaaaatcgttaaagaagataatcatgcttattaattgttaatttttgtgatttattattacaataatgaatatataaattaccaattttataattatataactaattttgtaactattcataacccggtggtaggtgatgcaaacatgtattaatgttttagcattccagttttgaatagttgcatctatattcaatatcattttataaatattatattgtctaaaatccatttatgattgatatgatatcccttatttaactcctttgattaaaacgttatacatatcttatcacttttagatattgacttttccatattaaatatttgatttccatatatttgattgtgttattattatttttactaaaaatgttgcaagataatttttctttttataagattccatatatctaaatctttgtgttattattatctaaaaatttttataagatttccatatatttgattgtgttattattatttttactaaaaacgttgcaagataatttttttttttataagattcttttctctaaatctttgtggtatctaaaaaaaaaaaaaaaaaaaaaacaaaaaaaattgttcatggttttgccctaattttgcacgaaatcattttacccaaatcttgcacgaattcatattagcctaaataaaagttttgtcaagatatatgtaaaatccagattttgcacaaaatagttttattctgattggttttacaatattgcattaaaattgtattagtatatcatacttgattattttatgaaataaattgattgataaataacttaatttaaaggtataatcacttatagaaattttcatgaatgactagtttaatgtatcttaagaagatatcatatttttgatggtcaaaattttttcaagaacttaaattatcaccaaaagttgagaaaataaatatggtaaaaaaaaataagaaattttgaaagaactattataaacttaaatcgagtgtttttcaaaggctaagaaaacagatgagttatcgatgataagtagtactcatattctgaagtgaatataagatcttacatagttagtcaaatttaatatcgtttatactagaatataaaaatttaattattatctcgttattgttttattagcatatgattgattattaaaatacatggaagtaattttgattataagatcttattaagggagtaactgataagcaatgaaaagtaaattaaaagttttgaaagaactagaagtttcaaaagaattaaaagtttcaagagtatatttggcttaaccggattggtcatcctggtttaatgatgatgtgaaagtattgagaattatgtggacattaggtgaaaaactagaagattctccctaatgatttatcaaatgttacttgctcagaaagcaatatgataatgtgatttttaccagtgtaagtaatttggactttatctattcgtaagtatatatacaaggagatgattatgggttgatcacccactatatgacatttagatacctaatggttataaaagatgcatcgattcaatggacgcattgactcgattgttgcatcgactagaaggtcatatttatccttgttataaacccgcaacatagagtttgcgagattactttcttgattaaagtacaagagtatttcagtgtttatttataataaccattattagatatccgttgggataagtgtttaacattttgaaattcatgttcatacacaaaatggtttagtaacatcgatacacatcaagccaatgaataattaatacttttccccattattattggttttgggtcagaaacctaatagttttcatctaaaagctttgaatgtgaaaagtgctccaccacagcacgcagagatgaaccctcaaaggaggataagaatacatgttggatatgaatgataactaagccatcctagaaggatttatataccgctcgttttgaagactatcatattatatagtcagctattccaacataagggggagaatgtatacagctggtgaaaaagataaatagaaatgaattatcaatgatcctcggagtaaagaatgtatattaagagtccaaaagataattcaattacagaatttagcgttgtaattgccagacgcatttgctgacccaaataaagtgatgaagtcacttataccagttgtaaattaaatgccccagaatataatgaatgtcctgtaaggaccaatttcaaactgctattgagtcttaagattgcatgaagcgtaatagaccttggttccaaatataaatatcctcgtaaaagtgaaggagcacaaaattaaaaatgaccaaattgaggaaataaatattttgataatctcttgaagagagtgaatgatctctaaaagagacatagacatgacaaatgaaacattcaagtacttgacaatgaagagatctagctagctatgtcatgtcaaaatataatg

SEQ ID NO: 29826 - DNA, 3003 bp, Unknown; identical to SEQ ID NO: 25646
  misc_feature (1)..( 3003): 2750-1469P.txt file - cDNA_ID_3022912; gDNA_ID_2214515; Annot_ID_184428

SEQ ID NO: 29827 - DNA, 3003 bp, Unknown; identical to SEQ ID NO: 25641
  misc_feature (1)..( 3003): 2750-1469P.txt file - cDNA_ID_3022931; gDNA_ID_2214515; Annot_ID_184419

SEQ ID NO: 29828 - DNA, 3000 bp, Unknown; identical to SEQ ID NO: 11755
  misc_feature (1)..( 3000): 2750-1469P.txt file - cDNA_ID_3022934; gDNA_ID_2214515; Annot_ID_184417

SEQ ID NO: 29829 - DNA, 3003 bp, Unknown
  misc_feature (1)..( 3003): 2750-1469P.txt file - cDNA_ID_3022938; gDNA_ID_2214515; Annot_ID_184415
agctaaaagtgttatgatctgatcaatgtgagtgggttccagtttgagtcattggccagttgttgtgtgtgtgaactgatttatttatatatttggataatgaatctttgccaatcaatggagaataatcgaaaaataatgttacccccgtgaccacaaaagaaaggaattataatgatatggtcttaattcgattaggacttattaatacaacagtactagtatactactcacattgcaactggatctcttaaataattttctaacctgcagatttcagaaagtgtttttttttatacgttcaatattcgtattttgtacgtagacgtttagcactactatacgtttttaagattccgatttaaaacacatttgctactatatttgtagcaactaaaaccaactccaaccgtagttttttagtagaaactcatacaattacaaaaaaaaattataaattaaaaaagagatgagagagaatctctaaaattgggaggatcgtttctattattcatataggttgtttttttttgttttttggatataaaaataaaatattaatactttttgtttttttagaaactatatgaatcctatacattggaggtgctctaatgtacaatccgttcggacacgttaattacagatgggggtgtatggctatatacttcacattcatacgattgttgaaccttgtgagataattgagatgattagctttagcaagaagagatgattttgttggattgtgtgcaggtttaaaacaatctgatttgcattgaggactctctgttataaaccaacatttttttattattcttaaaggactctctgttataaaccaacatttttttattattcttaaaggactctcttaattacttaaactaaaattttgattagcattgtatgttaaaataaaataatacattggataaataaattaaacaaaaacatacattggataaacttattaaccatcatacaattaacaaattaatgacatcgtcaataagatcggaagataaatgattggattttaccaatggtgtcaaagagttttacatgagaaaaaaagtagatttaatgtattgtttttcttaattacttcaaattaaagtattgtttcacatacttaataatgggctgacaagttttcggacacacattttcaaagacatgttaggattgagctgacaagtgaatctggatttacttgtattttaacttctaacttttttcaactagaaaagtagtggatatggatttcacttgaggaacaaaaatacaaaaatagaaacttagaaagcacgagggatgtacgtattttgttgcatggggagatattgacaaagaccatcgagttgggttttgttaaatatagtaatattttatgttatgatttgacgtacgctctataatttatgtgtaatgtatattagaaaattcatggaatcgtatcttgtcatataatacatatcaaataatgtgtattgtttttgttaaatataacataacgaaagattaattaattcaaacataaaatctatgtatctgtcaatcaagaatattgtgtaatgtagttaataaaatatgcttattagttgctatagtcgacgtatcacgtatgaatggttcgaattgatcccacagcatacgtgtttgtttctcaaccacaacctttattcgtccaactaaaacaaaaatgatcattatgagatttaccacaaaccacaagcatgactacaaatatcaaaactaataaaaattgattatataccaaaacggtatcaccaatttatgatgtactacgtatactttctagtaccgttatctgatttttaattatcattatataggatttttttttaaatgtctcttttacaatatttatataaaatcatattgtaatttacaaaagctgaggtgattggtaatcctaaaggcttccatatgcatataaaatcataatttacaaaattcttagatatctcgagagttttgaagattgcaaaccggaatgtgttccaaaaagttgtaatcaagcggcaattaaaaaactctaattaacttaactttaactatttttgatattgttcaaagttatggatttaaggattgataatttcggtttgagtcaactctcccagtaaacaaatgctagcaatataggggcgtttcaagttgcagaaaaacacactaattgtctctaaagtctacagccagaaacacaatctgataggtcccaaaagcaacaaacacacacaaaatccctttttaatggtagtttaaactacctatttgttttgattttctgatcaatatatggaaacaaatgaacgatggaaatggaatcaatcatgattcttacaacttaggggagacggagagatggtgaattgcataaacaactaaaagaaaagcactcattcaaaatcaacgtgaaccaactcaaccttcatgtccgcgttatcccttttggtctcacaatctattccatgttatgcccattattgtctatggataatgtttggcatataccagtgaaatttgttggacgaaatggtttaacatcccgtatattgacaaagaggtcgtgggttcggaacctttgttttgcaaaaaaatacgttttcttaaatttaagtataaaattcatataaaaatacggtttaggtatgaaaaatgccctataaatttatttgggtatgcaaatgcactcagaatgggtattaactcttttcaccagtcgagagactagagatagaacaaaatagaacaataaaacaatttaggggcttttttgcaaatatcaaaacccctcctaatttaactcttccgccgccaaatgctaaacccccaaaggccaaagcttctcctcctccttcacttcctcttcgtctacatcaatctgatttgagggatcatctcctgacgaagtttagggtttagggtttcatttatccctcccaaagtttctttctagtctcttcaattacgatg

SEQ ID NO: 29830 - DNA, 3003 bp, Unknown
  misc_feature (1)..( 3003): 2750-1469P.txt file - cDNA_ID_3022976; gDNA_ID_2214516; Annot_ID_133960
tttgggcagtacgtgtaggcacaaaaaggaatattccggtggcttctttctggactacgtcagccacgattctctccctcttcattaactccgatcttctcgcaagtcacggccattttccgatcgaaccatcaggtagttacaaagttcccatttttactgatcaaaaccgtaaagttcaatactttcatccataattagtgatttctgaatccgggtttgtttccagaatcaaaactagacgagattgttgattacatccccggtttatctccgacaagactcagtgacttacagatcttacacggctatagtcatcaagtcttcaatatattcaaaaagtctttcggtgagctttataaagctaagtatcttctcttcccttctgcttatgagctcgaaccaaaagccattgactttttcacttccaagtttgatttcccggtttactccactggtccgttaatacccttggaagaactatccgttggaaatgagaatagagaacttgattactttaagtggcttgatgagcaacctgaaagctctgttctttacatatctcaagggagttttctttcagtctccgaagctcagatggaggagattgttgtaggagttagagaggctggagttaagttcttttgggtggctcgtgggggtgagttaaagcttaaggaggctcttgaaggtagcttgggtgttgtggtgagctggtgtgatcagctacgtgttttgtgtcatgcggctataggcgggttttggacgcattgcgggtataactcgacattggaagggatatgttcgggagtaccgttgcttacatttcctgttttttgggatcagtttctgaatgctaagatgattgttgaggagtggagagttggaatggggatcgagaggaagaagcagatggagttgttgatagtgagtgatgagatcaaggaattggtaaaaaggtttatggatggagagagtgaagaagggaaagagatgagaagaaggacttgtgatctcagtgagatatgtcgtggagcggttgcgaaaggtggttcttctgatgctaacatcgatgctttcattaaagatattactaagatcgtgtgagttctattgttgttaatgattcaagtctatattagtatttgtataagtttgttaaagattcaaactttgtagagatttaagattgtttgtaaaactgttatttataagttcatttgttagactctttggtagagcttaatctcgtgtgtgcctaatttttgtttgactttggaaatgaattgtgaggagacaaatatagaaaataatttatgaaatgaattgattttggtaaagcttactggctgattggttacactatagctgtagattatttgctgtagaatattggatgtaagtgtaagctgtagctgtagatttgtaaagattttattcagtttgttagagaaaatactccaattctgcataaaattctaaaatctgatcttaataggaatgattttcacacatctcatgttttatctaccaatattttaacatattttgcagtaaatttaatattttacttgatatctaatgctttaggacaattttttttttactttatttttgatttgagttcttcgtttttaagaattatcggtttataaataactagattctgacccgcacgtatacgtgcggggtttcatatttttaaaaatgtattggaatatatttttagtgaaagatattatagtgtataaattataatatgcataaaaagtgtaaagtgttatttatgataaaatagctattttttgtaatttatattatttatattttatttgtattttgcatagtaaatagattgttagatttgtttcgatttgtagaataatatagagatatttagaaaatttgtgtatttttgttagtttgatgtatatataaattgattgtttttgtttgaaatttgatcaattagatgatataatgtaaaattttctccgtggtacacctttggtcgatttttttgtaactaaaaattcaaattttaagatatagttattttgtaaatattgtttattttgtttaatgtttaagaatatataattatgttataattattaattctaaaatttcactcgtagattatcgtcctttattaatatcaactcaaactcatcccaccatataatttcattccgtaaaatgaaaaattattttgttattttaaatattgttattgtaatataataaaaaaatcgagggattgacatgtggtacatcttggattaatatatttaaaaataatttgtatatttaaaaatcgagggattgggtaattatgaatatattgattttaaagtcgattttttaaaagaacaaaatccaagatatttattttgttgtagtgattgttaatttactaaactacccatgcaaaaattcatttacttaattttaaactacccttacaatgttgtagttcatacaatacttctcaattaataatatagataacacttattagttttcaagggataaatttttttccacttgtgtacatttaaattctaccaaagttttaaaaatttacgatgacaaaaaaataatattcgtattcataatataaacataatctaataagtttttttggttaggttcatatcgcttaaattaaagtacgatttaaaaaaaaaaaaaaagtaaaaaagtacgtttttgttttggtaaaaaacactaaagaggcaaaaacgtaaaaaggcaaaaaatatatttttacttggggaaaaagatgttaaagcccacaagacaaggcagaggtttctcccatgctttgtctttagtttaaccgccgcatcctctctctctggtcggagaaatctccagatttggtcatttctccaatcttctcggaaccctaatttaaccaaacctctcctccttcagattcatcttcctcctaatctccctaaaagctcaaacctttctctcaatcaattctaaacaatg

SEQ ID NO: 29831 - DNA, 3003 bp, Unknown; identical to SEQ ID NO: 29830
  misc_feature (1)..( 3003): 2750-1469P.txt file - cDNA_ID_3022976; gDNA_ID_2214516; Annot_ID_184455

SEQ ID NO: 29832 - DNA, 3000 bp, Unknown; identical to SEQ ID NO: 11786
  misc_feature (1)..( 3000): 2750-1469P.txt file - cDNA_ID_3022984; gDNA_ID_2214516; Annot_ID_184451

SEQ ID NO: 29833 - DNA, 3003 bp, Unknown
  misc_feature (1)..( 3003): 2750-1469P.txt file - cDNA_ID_3022990; gDNA_ID_2214516; Annot_ID_184448
tatgcaatgtattttcttaacattgttgagttttaggagtgatggtccacaacagactttacatggagcacaagtttagagtggagaacaatattctcggatatgaaatatacacatataggagatttgattaacatatctaattgtctggattttgagtaattgtcacataattttcagtgcgactgcagatttttttttttttatcacaactgcagatttagtcttttaacaggttttctttataaattacaaattaatatagtatgttatttcttaattaattaataaattacaaattaataaatatataaataagttcaattgtagtctagtttgggtcacaggatacttaagctttctcacctgagagtccatgaaaggccttgaaagacattaataaagcccaacgtagcccagatagacccataaataaatctgtcacgtttaccacgctttaacggtcaacagccactagttattaaatttatttattttttaaaaaaactcatcaaaacaaagtccactagttatattcgaggttataaacgtaattcaaggttattgtgctgttgggagctttgaagcggcacgatgataaataagttgacgccatgacacgtaagccgcttagtagcctctttcttcaaaccaaagactattcaccgttggattaagaaagctcactcaatcttaacccttcattttattaaataaatcctacgaccagaaaataaaataaataatttggttctgttatcctttcattgtcttcttcattcctggtaaaggcttttaatttcatggattatcttagcttctactctcatggtggctatcgagaaatcactcacaccaaaatctttgaagttctgagtttcaaagtttttcgaatttgaaactttcccgaagcaattttaaaccttttctcttcctttcgattttttctcttctggaattagaaaacttagttatggcttatgctcatgttttcgcttcgttgactatctcgacgatttctctccgacgattcctcccccgacttcatcgaaaccacagcgtaaaacccaattcccgaatcatatgcaatctgaaactaaactactctgctggaaaatttcgcgagatgggactatcacgttccgtggagctagaccaattcatcacaagcgaggaggaagaaggagaagcagaggagataggagaaggatttttcgaagcgattgaggaactagagaggatgactagagaaccatcagatatactcgaagagatgaatcatcgattatcttctagagaattgcaattgatgcttgtttacttcgcacaagaaggtagagattcatggtgtactttagaagtgtttgaatggttgaaaaaggagaatagagttgatgaagagataatggagttaatggtttcgattatgtgtggttgggttaagaaattgattgaagatgaatgtaatgcacaccaagtgttcgacttattgattgagatggattgtgttggtttaaaacctggttttagtatgatggacaaagttattgctttgtattgtgagatggggaagaaagaaagtgcggttttgtttgtcaaggaggttttaagaaggagagatggttttggttatagtgttgttggtggtggtggttctgaaggtagaaaaggtggacctgttgggtatcttgcttggaaatttatggtaaagttttgaacttttttcatagtttttatttttttttataattttggtggatttgagatcaaaaagatgtgatatgaagtggttaagatgactatagttgttataccttcttgttagttatcggtttcttggtctagctttgttgatgtggatatgtgtcttttgtttcttctaataggttgatggagattataggaaggcagttgatatggttatggagttaagactttcagggctgaaaccagaagcgtacagctatcttattgcgatgacagctatagtgaaagagctgaatagtcttggaaagacattacgcgagttgaaacgctttgcacgggctggttttgttgctgagattgatgatcacgatagggtactcattgagaagtatcaatcagaaacattatctcgtggactgcagttagcaacttgggcggttgaggaaggccaagaaaatgattccattattggggtggtccatgagaggctactcgctatgtatatatgtgcgggacgtggaccagaagcagagaaacagctctggaagatgaaacttgcagggagagaacctgaagctgacctccacgacattgttatggcgatctgcgcttcacagaaagaggttaatgcagtttctcggctactgacacgagttgagttcatgggatctcagagaaagaagaagactctgtcatggttgctcagagggtatgtgaaaggagggcacttcgaagaggctgcagagacattggtatcgatgatcgactctgggttgcatccggagtatattgatcgagtggctgtgatgcaaggaatgacaaggaagatccaacggccgagagatgttgaagcatatatgagtctgtgcaagaggctctttgacgctggtttggtagggccttgtcttgtgtatatgtacatagataaatataagttgtggatagtgaagatgatgtgataaaaaaagaggaaagagtatgaaatagctgagaaacaagtctaaagacaccgtctaagatggagggatcggaagtttctatttttgtgtatataaatctgtatgtagtaaacaataatatttgtctcaaatatgctgaagttccaacggcccacgtttttaaatgggcctatatattaaatattgtgagcccaaaacaaaccttaatgacttgaggacatctgtttcctcgtacgtatttctgaaattaagtgaatctgaaggtgaaagcaaagccggaggaagaaataagaatcacagaggtaaaattgtgatggagctcgaagatccaacaatg

SEQ ID NO: 29834 - DNA, 3003 bp, Unknown; identical to SEQ ID NO: 21014
  misc_feature (1)..( 3003): 2750-1469P.txt file - cDNA_ID_3022994; gDNA_ID_2214516; Annot_ID_184447

SEQ ID NO: 29835 - DNA, 3003 bp, Unknown
  misc_feature (1)..( 3003): 2750-1469P.txt file - cDNA_ID_3023015; gDNA_ID_2214517; Annot_ID_184488
attttatatcgtgcatcacaatttgtgattattcattgtattaacgagcccacacataaaagatcttaattatccatctacaccttaaaatctacggaccgtcttacattaatacagctagttcaccttgtgaaatctcggtaataccctcagctgcaaaagatagaagtttcatagaacggtacgtgttcattacccaacccagctttaaattttcttcttacgtgtgtatgactagacacgtaggtcccactcagcaccacgacaacccaataataaacatataaaaacaaaaagaaattaattaattttttttctttcttcatatatataattcgtttcttcttcctttttccccgagatttttttcctctgttcggtcggccattgaattgttgttgattcattggctctaaaacgaaaatgggaattctcaacgacgacgccgttttaatcgaaccgggaaaaatctccggagatcccaccgtcgttaccgtcaattgtcctgatgaatccggtctcggttcaactctgtgtagaatcatcctcgaatttggtctctccattacccgagcaggtcaatattcaattttacttcgtatctgtttaggggaatattctctgtttgtcgtttagcttcacggaatattcttctttatgattcgaaaaattcaattctgtttttcttattttgagggtaattaatatgtttgtaaaaatggtgtttgcagatttttcaacagatggaagatggtgttatatagtgttttgggttactccagatattagctctcctaaaattgattgggacagcttaaagaatcgtcttttatcagcttgtccttcttgcttaggctctttctacttctgccttcaatccaatgtctctaagcctccttccctttatcttctcaagttcttttgccgtgataggaaaggattgcttcatggtatgtgtaaagttattgtcttttgtcttgtgcttggtgttttctttatatggttgattaaaagtttgtgtttttttggtgattcgtagatgttactaaagttttgacagagctagagtttacaatacaaagagtcaaagtcatgacaacaccagatggaagagttttggatatgtttttcatcactgacgcaatgtgagttttcttcttctttctaattctgatgtttcatttgagagaagaaccaacattaacgttgtggtttgtgactttgtgtaacagggatctattgcacacgaaacagagacaaaccaaaacgtgtgaccatctaacggctgtgcttggtgagcatggtgtgagttgtgagcttgaactagctgggcctgagttagagagtgtgcaacgattctcttcacttccacctttggctgctgatgagctgtttggcccagatgggtttgatattagcggctctagctctaacaaagcggttcttaccgttgataatcagttgagccctgcacatacgttgcttcagattcgttgtgttgatcaaaagggacttttctatgatatcctcaggacttccaaagactgcgatgtccacgtacgttaaaactgatctctctaacattaagagaacctaaccttacctctgctaagagaagttgggacttctatggttgaaagatttgtataactcaagtagttcttgtttctttatccagattgcatacggtaggttctcctccaaggttaaaggttataggaatttggagttgtttgttagaggcacagacgggaataaaataatggacccaaaacatcaagccaacttctgtgctcgacttaaggaggaaatggtgtgtcctttgcgagtgattatcgtgaaccgaggaccagatactgagctattagtagccaaccctgtggaactatccggaaaaggaagaccacgagttttctacgatgtcacacttgcgttgaaatcactaggaatctgcatcttctccgtaagtactgtataataatacattgtgttctctaagctttttgaacggttattttcggtttgttttaagattggcattgcgttttcttgtaggctgagattgggagacattcgactttagatcgacaatgggaagtttatagatttcttttggatgagagtcgtgaattcccattggctagcctccgtgcgagaaatcaagtagtagatagagtcacaaagacacttatgggttggtgaagcggatgagagtgagctttcatgaacgttatgctacactcaaggggacaaagaaacaaagtcttcttcgcttgcggcttcgggtcgatgaaaagagtgatgcaagggggttgtgattgctgttgtgtggagctaatagcgttgtaaagctttggaaattgtaaaaggattatataaccgcaattgcaatgaatgcttgtaaactcactttgcaaaggtaacatttccgttgactaggtggtcactacaagagagcgacagagttgacccgagccagaatcgcaaacatgttacatttagccatgtagtggcctttgggggataatatggtaattagacaaattgtatcgaaatatatttagagtgttgccatcaaagatctctgtgtttttgaattctttttaatcatatactgaaatttgttttagttgtcatcaatatattcatctactactgtactaatccctttataattgagtttatataacgaagaaaaaggagatatagatgcattgacaagtccataattatgtttagttgtttaccattggatctgaaatagattcgaaaaattaaacggttaagaaaaaggaaacgcgttaattaaaaataaaaaaacgaagcggtagggttaatttcgtcgtttcgttatccgttgtcgctcgctcgtgcttcatcggcggctagtaatccagtgcagcagaggtcctcctatcttaacgaaagctgtgattctccttcgtctttcaatatcattcttaggtttttgaaattcatgtgtcgtaagaaccgaggaagatg

SEQ ID NO: 29836 - DNA, 3000 bp, Unknown; identical to SEQ ID NO: 11806
  misc_feature (1)..( 3000): 2750-1469P.txt file - cDNA_ID_3023019; gDNA_ID_2214517; Annot_ID_184483

SEQ ID NO: 29837 - DNA, 3000 bp, Unknown; identical to SEQ ID NO: 11807
  misc_feature (1)..( 3000): 2750-1469P.txt file - cDNA_ID_3023022; gDNA_ID_2214517; Annot_ID_184482

SEQ ID NO: 29838 - DNA, 3000 bp, Unknown; identical to SEQ ID NO: 11809
  misc_feature (1)..( 3000): 2750-1469P.txt file - cDNA_ID_3023025; gDNA_ID_2214517; Annot_ID_184479

SEQ ID NO: 29839 - DNA, 3000 bp, Unknown; identical to SEQ ID NO: 11794
  misc_feature (1)..( 3000): 2750-1469P.txt file - cDNA_ID_3023029; gDNA_ID_2214517; Annot_ID_184475

SEQ ID NO: 29840 - DNA, 3003 bp, Unknown
  misc_feature (1)..( 3003): 2750-1469P.txt file - cDNA_ID_3023037; gDNA_ID_2214517; Annot_ID_184472
gttatttcgatattaacaaagcttatttcgattatacccaaatggaaaatcattcctagtcaagatatcatcgagatttcatataaagagccagaaattagaaaacaggtatgtttctatataacatttagtaatcaaaaatgattagtttatcaaaaatctgtgtaagaaactgatcaatatgcttgatttaatttttgtacattttgctatatacgactaattaaggttagagaaaatcctttatgctcgaaaggacgaccacgcttgaaaactgcgtatgagctcttaaggatcagcaacgacttggagaagagacttcaagaggtaaattataagtgattacatatatatatatatatccaagatttccataaatgcatatgatattcagattggactcaaatagtggtaattaagattctaacgttagattttttttgtctctgtaaaatataaatcatccgatcgagaactaatgcacataatgatgataataggtttcattgccgtttttggtattacacggagatgatgataaagtaacagataaagcagtgagccaagaactgtacaaggttgcgttgagcgctgacaagaccttaaagttgtaccctgggatgtggcacggtttgctcaccggcgagacaccagagaacatcgaaattgtctttgccgacgtcatcagttggttggaaaaaagaagtgattatggaaatgataggtttgagtcagagcttaaacagcgtaatgatcgtttaaatttcaagaaatagtcgtttgacttattttttacacataaaagtgttttaatgaaattctggtgttttgcattttgatgtttaacgttgctattgtgaattgtactatatattttaagaaaacttatactatagtccaataatatttcctaaatagtccaacaaaataaagaaaaagttttcatcatctagtatgattttaaaatgagatttgatataacatagccaataagactccagaggaaactctctgattcggcttggtttggctaatgtttttagacgcaacgatttacttagatctagaaccatcagattaacaacataaaacaactttaagctttcgagaaacggaaaaccacaaagattcttagcaaagaattcatcaatgtaaagaacattgtctaaaatattttggtatagaggtgaaaactcataatcttgggaagcttgtatcgagctagggttttgtttatcgtatcagccttcagtcccctatacaaagttcctggtccatcaaagtatatgtaaggtgtgtcagaccatacatgcctccatcgtgtggacaagactgaagttctgatagctaaattggtcggaagagaggagaggatttgttggaggatcacatcaggaagcgagctgattgagtctatattttcacttgcatctcttgctagtttgacatctctgtagtgatgatgagcgtagcagtcaccggcggtggcaccgtctccgtttccgccgtcgtctgcctctgccattacgttatcaaccaccgattgtaaacctagatatttgtttgcaatgacatagctttttgagtttttgggtttatcacaaagcccagctatatatatccaaaatattttaaaaagcccattactaaacacgcacaacttttttcttgtccggaactcaaaatatgtatgtacttaacaacttaatctgtgaaaaaaaaaaaaaaaaaatgtactaccaacttagtcatgttgatgtgatcatcttcttcttggattgatattactagttgcagaaagtgacaatttgatctattagaaaataattgcttatactacacatttgttttctttcgtaacagattggtgggatctttaagaatgtatcgtcatgattctgattttatagaagaacaactttatttaagatgtgcttacatattctgcgaaaaaaccggcatgttgaatggttttagtctctctgaaccgacaacaagttttgtaatttttaattttatcttacagtcgtcacttgaatcttgatcgccaatttttacatacttgagaagaaaaatatttaaaaagccaaccgatttattcgtcaaagcctcaaaggctacagatttttttagccaacgagcaaatgatatgcacacgcggatatgggggatccaaaaattaaaatatttgttggtgtaactttgaagcattgacttaaaaaatagtggttttatcatatgaaattaaacacttaaaaatttttgtggaagttgatacgggatcacaattttacaaaaacaaatagttagtcaacggagtataacttagttttacgtctaatattgttagagttgacattttataacatgttaagtagtagaaattgtagatttgactttctagattcttcatttgatggttcttatgatcgttcgtttataaatttgtactacagaaacgattaatctaacattattttacgatgaagaactaaaatttgaacatatagtgtcactaggaaaaaagattgattttcaccttaacatctccaaacgtagtaagtagatgtgagtttgatttgctaaatcctaaatgaaaaaaaactaacaaaacacagtcaaacgtgaaagaatttttgagggggtgtttctgataaatttacgacttaaggtactagtttaatgttattttgaaagtttagggggtggttttgaaacgtcgccaaacttgaattgccacttgtcagggaatattttatcattttaaaaagaagtaacaaaaaaaacgtgttgccgtgtagaggggtgcgaggagaatctgttaaatcgtcgctatcaaacaagaaacggtgtcgcattatcgtatagtcctcttcctcaaaatcctacccaatataaacagagccgtacaacaaaaaactcgatatcttatcaaaaactcgctctccatccaacaaaacccgaagaaagagagattcagactcaaatctctcagtaggaatg

SEQ ID NO: 29841 - DNA, 3003 bp, Unknown
  misc_feature (1)..( 3003): 2750-1469P.txt file - cDNA_ID_3023047; gDNA_ID_2214517; Annot_ID_184468
tcttaagtaggatatgatgtagatgattgacggttagagtgttactaaattatgtggtgttgaacaattcaaatgttttttttacttggaaatattgaaaccatcattatatataactattaagctattgtttgaccaacaagatcaaagatacgcactacctcagatattatgtattttacacatgaatatatataatgacatgatgacaaggtttgaaaatgaaatctacgcataaatatatatacaaatattttgcagacacgagttcattgaaaaagaaaactgtttcttgcttaccaaagtcaattgtgtatcgatgtaagcaagttctgcaataacgctgaccagcaataagctattctacgtatagcaacgaccacacacttcataaccaaaccttaccaaactaagtgcatagaaaaagttgttatgtttgaaaaatgcaaaggtttggtcacttggatttcggctcatatgctttatctgtgtgacgaatttgaagaatattcatcctacagaaccaaaagaactaaaaggaacattcaaaagaatagagaatgtgtgaaaacaatttggcacaagagattatgcgaaagtcaactcttgccctataagacaagtaatcacaaagtcaaatttctcaaaatttgtctttttctcagaaataaattataaacaactgatgtttacatatgttcaacttcaaatttcaaacacgattacttaacaaaactacgatagtctctgatatattgcggatatatatcgccagcccccacctcttcatcttggtctaacaaatcttagtgaccaacaaagtgattcacacaagaggacatattttggtgtatcaattcttcttcttcttctttttggtcaaaatggtattatcaattcttcaaaatctcagattttttacctaatgattctctattggtgtgtaggtttcatatctgtcaacttatcttgcaaatcaccgcatcactttcgtttcttttaatatgattttttctcgggtcaaacatatgtacgcaattaaaagttttctaagaaagaatcacattgcctagagtttaccactggttgagtaatatgctagagagagtcatgtcgctgcgcgatcgagttgggtttagttgataagcaatgaactgctcaaggcaagatcgagttggagtgaagagtaatgtatagagatcactaccctaacaagctaaccctcaactgagtaatataaaagatgctatgatccaataatataacaatactgtttttctgaatcaatctttcattaagatgagcttttaatatctttaacaaggaaggaaaacaaagcaaaaactcacacgagctcaaattcaaacacaaaaattgatgtgatcaagataaaagcttacaccttaatagcatacttccttattggaaagtacatttctttcttcttctccctctctgtcttcaacgatgcctattcaaatcagccagcaattattccattcagtacaataaaacacaggatttgttcatcacttctcaatatcaatctgaatcacactaaagaatatacaaatacctgatgcttagtgagtctcctcctgatggctctagtcttcttgggacgaagatcaagaggcaaaagcttcttgttcttgtatgcctctctcaaagcagacttttgtttctgtgagatcactgtcaacacctgagcaatcgacttcctcaccaccttgctgaaatcaacataaaacataacccatttgagatcaatgtgattaaaaaccagtgaccgaacaatccaacagtgatataactaagcaagtaagctactttatctatctatagaggataatgataggacctaggatacaaaaattacactaaacaacttgcaaaacataagcagaacttaggtaataatatatgtccataacaacacataaacataattaaacctagctaaatatgattactacataaccctgactaaccactaacaccagcaagatcataaacaaagctatgaagaattcagaatccaaaaaaaaaaagagttaaccaaaatcagaaaaatgtaacatttgatcacacaaagtgtgtatagaggaaacacatacatcttagagagcttattaggagcacctccagtgaccttagcgacacgaaggagagcaagctctgccttaaattccttcaactgacccgaaagatcagcttttgatttctccctcagctcatgaaccttgattctcgctgttcagattccatttcacaatataaaatcaaatctcataacctaaacgtacgaaattgtgtgttaacagaggaaaaagtttgagaatttaggcttacccattgcgtcttcgagctctctctagcgtccctttactcttttgcggtgttgttataagagattagaaaccctagagaaaaatgaagaagaagacggctaagagttaataatcagattttaggttatatttgggctttgactgtgagtataaaacccaacacacatctaatgggctgagttttatatcttatgggccagggattataaaatcctagtagtgaaatcttgtaccaaaatcatttattaatgcaagaaaatactaaaaaagtgaatagagagttgtataattagacacgcgccgattgaactgttattttttgtttttgaaggagaattatttgatttcaaatataataataacataatttagcttttcagaataaatttcttctcttttctttttctttttgacatgtctaattagattgtgaatgaaggagtaatcttagaagaagttttggttaaagacgttatcgtaatcaataatgtgatggaaaagtgtaattatgagtcgcgtaatgaaccaaccatacatttgtcaacaagttgatacaaagacataaatgcatgtttatccatccccaagttcaatattcaaagactaaattatgagcatttcataatgactcagtatgccatttggtcaaatg

SEQ ID NO: 29842 - DNA, 3000 bp, Unknown
  misc_feature (1)..( 3000): 2750-1469P.txt file - cDNA_ID_3023072; gDNA_ID_2214518; Annot_ID_184528
actattaaatcactaggcatagaagaaacaggatactcattgacccttggggttgaggattctctcctcatctttggctcctttgctgaaagattgctctcgacagtagatataggatgatcatttaccttctgaaatgagtcatctcttctcattttggcctcttttgatgaagtttctggatcttgtacatgaaagatctgctcctcacgcaaaaatccttgctcaggtttttgtggatagtggggcaccaggctttcaagaggtgtttcaggattcacagaatacgggatataatgaggttgtggttgaacatgtaaaggagcagacctcttctcatctatatagcctatgcttgccatgtgacctgacgtgtaaatttggtggttaccaagtccggggaactgcaattgttgtcctagataaggctgtgaaaatggctcatttccagtagaaaatcctgttacaggttgagaagtttggctcgctggtaaagattcattacctgctaagggagtaagcgaagccactgctggttctgtagcagcccgatcgatcttcctatcaaaattcccatgaagtagttcatccaaattgttcccgggaggacttaatccaagggaacttctccgtgaacttagatccatcccattgacagcaacaacatactgaacctcagaatcaccctctgcatgttccataacaaactgagcctcctctatatcactgcttgaaaacaagaacatcctgggcttctcagatcctccattaccaaacacgatacattcttccatcatgttttgtaaatcctcgtcagaagatacagagactagggcatcaagatcctctcctggcagctgatattttatggtgcgtgcttcaggaaatatttctttcattttatgcatgagttcttggaaagaaatagtcttgctaatccgtatgatacgcgtttcaccacctacatacctaagtttctgatctctggggcggggtataactttaccaccaaaactacacaagaacttcgcacggttcaaagagctatcagaagctctagaagaaaccaaactatgacgcctttgaccagtatcatttttcgaagagataactggggctgactggaccagttcatgataggtcttatcttcaattctagaagggggtttcctctcgtgctcaaagctctgacgtttttcttctatgttaagcactgtagcgttagggccactctctgacattggatgaaccattcccagagcacttaagttaacagaaacaggcataccactgtgctcaccatacacatttgggatgaactgcggtttcataataaccctatctctcataaactcaaaagcaaattcttcaccggtctgtattgagtagtttagcactggccgagcaggggttgaaacaccataatctggaggtcgtacataagtgttaacattagttgaagagtcgtgggaaaacctttgattaatggagccaagtccctcatctctagggtcaggggcagtataccgaacatgttcataaccttttgcttgatccatgttttctttctcaaggtgtctatctatctagttcataagctccctcacaaacgcttgtaggcgacatatcatgatcatgacccaagtaaaatctttgcataagcatccttcgcaaatttctaacgttttggctgcagaacaggacgacttctatcatgaacaactcaaactctcattgaggtgcctgaaataggagaagagtaactttactcaagtagtcaaacatattcaagaacaaaaaaaccaaaatagcatacggctaaaactcagaaaaccatactatttaaggaacattttcggtatacaaaccaataaaactctttactctagcagggacagatcatccagtacaaatatctgactgtgcatactttccaacatgaaactagctaaaatgactactttctagtctcttcaagtttaaactaacaggaatcgctgaaactaaaatcgatcaacttcaccaaactattagcaaacccatcgtaactttgagagagtgtaaatcaacagatcaaaacatagaactaaatccaaaattcaatcaagtccgtgaaacaattccaaacctcaaaaaggaaacaaataagcgtcatttcgaaccaaaaactgagctaaaaacctctacccaaccaaaaaacaaaagccgatcaagccatcaaaaccactgaaactctagaaaatgcaagatctgagtatcattacccgaaattcaggtggaaacacatcggatccagagattttcgataataatgatcaaaattcaaaaacagcatacacctaaaaggaagacgagtaagcaaagaaggagagaagtagagaaaaaggtttataccaggaaaggcggcaccagagactgtgaagcgtcctcggtttgacgatcgatgagtaggagaagaagccaagtccttccttaaaatctctcttctaattttgacaattcgaaaaacaaaactatattctcgagaaaaaaactattatgcctaccaataaaataattgttatctacttacattatttaaaattctgaaaagcaaataaaatatcatataaaacataagaagctttcgtcatctccatagttagtcttttgtaatattaccactctgatccaataaagttttatttcttactaattagtttacacttgagaattttggtttctactaaattttttaaaatttggagttaaaatagtttagttttatttttgggggaaataaaaagagaagctttattccaattttccaaatattccaggtgtaatctaactgtcaaggccataataataaatacataattccacctgacgccaataataaattacatattttccttttttttttatttttttttctaatttatttccaaaattagccgcaaaatcacaaaacctaacagagctcaacactacacactgtttcaaaatcagactactatg

SEQ ID NO: 29843 - DNA, 3003 bp, Unknown
  misc_feature (1)..( 3003): 2750-1469P.txt file - cDNA_ID_3023080; gDNA_ID_2214518; Annot_ID_184521
aatgaagattgttgaatcttgttatatgggtcctttttgtaaagaatcaaaattttgaggcgtttatttaaggatttgaaagatttatgcaaaaagtttaaaattacgtaagttaaaaactaaaaaagagattattgctttcattgagagttgaactcaagacctcccgcttactaaacgggtgctctaaccaactgagctatgaaagcttttgcttacctgtcctgtttttaaataaatatcctttcaaacatatgaatacaagtaccatctctctgctcagtgttcgtcctcctctgatccttcaagttcaatttgttttttctgaccctaaacgctaatattcccttgagttttgacctatatttggaccaatgacgtggattagttcattctttagagttcatcgtcaacgtactggtaagtctttgtcttcttatgtttctgaatgctgtgatgctgttgctatcttaatgccacttgcgttgtacattttgatcaatgtaactaatttagtaacagatttgagataactggatgaagtcaatttaggttgcagaggatttcgaaactggttgatttgaactctaaatgacgagaatggagcctgagagaacaattttgcaacatagtttggattcagtgtacttaactctatttcatgttttgataaagagtccttgtgaaaaagacttttcttatatatacaaactttactttttgcagattacagagaatacagaacgaagcagttcatgaagaaagcagaataacactagggtggaaggaagagaccttttcagaggttacatttcttctctgttttccatagttgttatgttcttggcacaatttgctgatgagccatatcgaatgttgcatgaagaccaagcaggaaatagtatagtaacatggctaaagtgcaaacaccaaaccttacaaaagccattgctcccaaagatcccatgagaaagatgtttgttgctattgataagcacgggagccatggcactaacggtacgccccacactttcggtgttcgttgctgaggaacaaagaatacgatccccaaagttcccaagaaccagaaaggaactgttactgtgtaaccgatccatgatcccttgcgctgcattccccaatacgccgaagtacccattgaagaaacaacgacgaataagagacaagtgatgagcttaatgagatgaactcttggagtatcttgtctcacgtagtatctcctcacgagtagtgcgataggcatcattgtgaagatgaagagagtacttatcgataagaggcttgccaaaacatctaaaccagaaaagaaagcaatgagagcacttggaattgctactaggaggttagcgtttatcggtgttcctgttttgggatggacaagggcaaatataggcggaatcatgtgggtccgtgcgatgtgagtaacgtatctcgcttgtcccaatgctcctactaaaagaactgtggtcatccctttgagagcaccaagtgccaccaagtactttccccatttcattccaacgctctgaaacgctactgagtaagctgcatttggatctatatctgtatacttctgcatcatactcaaggataatgccatcaagcagtatatcactgttattatcgacattgaaccgagtaacccgattggtatgtctcttgatggattcttggtttcttcagccattgttgctatgctatcaaatcctccatatgcaaagtacacaactgcagctgctcggaacactccctcaggtccaaaaggcaagaatggagtcaaatttgatgtgtcggcgtggataaaaccagcgattataacaaaaaatatcactaaagtgttgatagcagaagctatccagttgagcaatgaagtctttcttgtgctgatcgatgcaattgtagctgaagcggctataacaacaacagctattgggtccaagagattaaaaccggaactgagatctgttttgatccgtagagcgttcgggctacgattcagaagagttgcaaaatatgaagtccaggctctagcaacagctgcagttccaacaatactctcaagaagtatattccctgcagtgatgaacgccgcaaaatccccaagctcaatccgtagataggcgaaagaaccaccagccacagggatttccacagcgaattccgtgtagcagaagacagagagcatagcagaaagacctgaaacaacataagacaagacaatagctggtcctgcttgctcatgagcttcttgacctgtcaagacaaagattccagctccaatcaccgacccgaatccaaaccatactaaatcccaccatgtcaaacaccgtttcatctcgtgctcactctgtttcttgagctcaaaccgctcgttctcatcatcagacctactaaccaacctgttcttgaacctggaacatgtctgagacagagcagctctgtaactaccaaagctctggaaagattcctcaggaaagaaatctctcttgctccatctccagtatcctctctcttcaccttccattctctctgcttcaaagatttgttaatgaagaagagctaaagagacaccatctaattttgttccattgtttgactagtagaagtttcagacagtttttttgtatttttgcagcttccctgactttcctcaactttgtgtactgtccattcataaacctccccacttgttagatttgctacgtcaccttcataactctcattgtctttattggcgtcttcttaccgtttcgtttagtacttcaaccatgaaaattcatgatgataacatacataattcagtgcttttttactcttagggggctgtaaaatgataaattgtcatattagtccttcagatttttaaaagatgtacatttaatcctcttttctcaattcgtcataaattaacttcagtttatactcagggttttagattttcccgtgagatcgaatttgatcagtgagagaggaggagatatg

SEQ ID NO: 29844 - DNA, 3000 bp, Unknown
  misc_feature (1)..( 3000): 2750-1469P.txt file - cDNA_ID_3023108; gDNA_ID_2214518; Annot_ID_133994
aactcatatacatctttcgcacgttttcggttgagagctttccattttcctgtaccaccacacatatcacctatatcataacaaaatccaattaaaccaaatgggtatcagtagtaagctcatgaggcattttgcatcatatcaaatggaaacagagaatcattacgaacttttcacataggaaggtgtctacgaaaactattatcaagagttccatatgtttgttgttaaaagtcacaatcaggtcttatatctttcaatcttaagctataagaccctacagattctaaagaaacacaaggcaaatatactatacaatatacgtttaaggatatgtttctatatcagagttccagataagaaactaaaacaaaagaacttgtcactcacaaagaacagcaccactgccctggcagttacgacatgaacctcctggtttcttgtctaaagcggctgcgctttgtacagagacaaaggtataagaattgctaattaaagctgcagatgcgcacacacatgccgtcatccactgtctccgtgacactgatttctgatctccctgcagccaagaacacaagccacataagttgacagcagaaattaagactaagaactaatgaaagcagttgcatagatagctatacactgagaactacaactagatcattgaagagtaacaaagacatactagtgttgatgtaccaatttttgtagcagaagaactaaagactaagactttaaaaaatttcttagcatagctacttaactagagaacataaccaatcaactagctgatttcaaggtaaactattagtagtcaaaacgatcaattagaaaccttttgcagctgatacaaatgcttggaataagaaaaaagatacggactttaacacacagaaccaacaagaatgtaaggcatcttgtattattaacctgggctttgtgggtagtctctgaggaagaatccgaatcgttggagtcgaagctctgattctccgggcatgatttcgcaagaacacgaactcgattccggtttggtgcagctaacagaaacgatgcgggtaagaaagaggataatataaacaatgtcggaaaggaacagatagagagatagagatgttacatagaaacggagaagcaggcgaagggagtgcgaagagatgagatgatgatgccgccatttttttcagtctgcggtcataattttactggcgaaccagaggacccgaaccatctataggatgtttctgatatttacgttttggtacacatagtttgattagtttattagattggtacattttctcttcaatttcaatttttgatccattataacttgacctctaaatgtagtagagtaagtcttaaaaggccgctagcctgttaggcctgctccaagacggccccgaaaagacttaaaaagggttaggctttgactttgattatgactttttcatgatgaattattctctcacatttttaatacaaagaacatgtgcttgttcaggttagtggtgttttattagtcttctgacttgtggtgatctttgtacgattcaaattttatgatatatgaaattagtttaatcaatgaatgtatatttgataaacaaatatatagtatgcaggaggtcttgagttcaactctcaatgaaagcaatttctcttcttttttttctaacattaaattcaaaaaagataaacaaatctatacaactgaggaataaatggtctcgagatctagtaaagtcaatgtgcatggaactgtcggttgctttaattttcttgatcaagatgtagtcatgtttttgtttttaagaagacgtagtaatgttatgaagtcaacatagtttatagccaattatttttattactatatacaaaaaggtctactctttataactctattcgaaatttttctaattataactagcaaattatcgaactatctaaaaatcatttacaaatattacaaccaaaaacaatagattttgttttgcttatcattcattatactaatattttccgtaaatttttgttgtactataatatgttggtcaagaggtagtcaagttttggccataaagtaaaagccacgtagagacttttgccgacatgtgcagcagagagttcgtcggtacgcacaggtgccggagctccctcgttccaatcaccgcgtcccttataatacttgttgcaatttcattcgttacttgtgtctaaaaatctcaataaagtaatcatttaattcaactttatagctcttctcttgtctcgtgtctcgtgttcccttcgctcgctttcaccgtcaagaccactctctttactttcctcctttgtacgtaagtcgttctaaccttttccacttagaattgagatcgaatctttcttactatagaagagagattcttggtcaagtccagattatacaacatttttgctttctacagttttcttctgtttcctcatgtacaggctgaactttggcctttttgttgttgtgaaattctgtgtcggtgtgaattctgcattttcatttttatttgaaagacctacatgttcccacccaaactggagttactgaggtttttgcaggtgcgagttttctaaatatttcgagttgttaatctcttacagctgaaactggactacgccgtgtactttcagaatcaaaatgctgaatttaggcagagctagaaccgggaggcaaaacagatctatgtcttttgaaggtacacacaggaatatcttttagacttttatgataaaacctgatttttctactgtttttttttatttgtctgaaatattttgcttacttgtttagaagtggttggtaagttgatagagattttagattttctgggggcttattagttagctccaaagtcataagcttttcttgtgtttcttatttggattcaaaatttcacacatgttgatgatttttggagtgtaggattggattttgcagacccaaagaagaacaacaattacatg

SEQ ID NO: 29845 - DNA, 3000 bp, Unknown
  misc_feature (1)..( 3000): 2750-1469P.txt file - cDNA_ID_3023108; gDNA_ID_2214518; Annot_ID_184506
gtcctcaccaagcttttaattcgtgaacccaataatctcaaatgtgaagttgtagtaaaaaggacctatacctaccttctcatgaatcaggaagaagccgaccattgtacatcttttcgagtagctcacgagcaccaggccttctaagaaggcctttgttgtttggtaaacctgtacctaaacagaccggacaaacaagcttacctcgacctgtttgcaatagaagccaccaactaatcaggaaatttcaagtgttacgaaaccaaacaagactaaagagatatcgggaaggaaacaaaccgtaacagtttggacattccgtaaactcatatacatctttcgcacgttttcggttgagagctttccattttcctgtaccaccacacatatcacctatatcataacaaaatccaattaaaccaaatgggtatcagtagtaagctcatgaggcattttgcatcatatcaaatggaaacagagaatcattacgaacttttcacataggaaggtgtctacgaaaactattatcaagagttccatatgtttgttgttaaaagtcacaatcaggtcttatatctttcaatcttaagctataagaccctacagattctaaagaaacacaaggcaaatatactatacaatatacgtttaaggatatgtttctatatcagagttccagataagaaactaaaacaaaagaacttgtcactcacaaagaacagcaccactgccctggcagttacgacatgaacctcctggtttcttgtctaaagcggctgcgctttgtacagagacaaaggtataagaattgctaattaaagctgcagatgcgcacacacatgccgtcatccactgtctccgtgacactgatttctgatctccctgcagccaagaacacaagccacataagttgacagcagaaattaagactaagaactaatgaaagcagttgcatagatagctatacactgagaactacaactagatcattgaagagtaacaaagacatactagtgttgatgtaccaatttttgtagcagaagaactaaagactaagactttaaaaaatttcttagcatagctacttaactagagaacataaccaatcaactagctgatttcaaggtaaactattagtagtcaaaacgatcaattagaaaccttttgcagctgatacaaatgcttggaataagaaaaaagatacggactttaacacacagaaccaacaagaatgtaaggcatcttgtattattaacctgggctttgtgggtagtctctgaggaagaatccgaatcgttggagtcgaagctctgattctccgggcatgatttcgcaagaacacgaactcgattccggtttggtgcagctaacagaaacgatgcgggtaagaaagaggataatataaacaatgtcggaaaggaacagatagagagatagagatgttacatagaaacggagaagcaggcgaagggagtgcgaagagatgagatgatgatgccgccatttttttcagtctgcggtcataattttactggcgaaccagaggacccgaaccatctataggatgtttctgatatttacgttttggtacacatagtttgattagtttattagattggtacattttctcttcaatttcaatttttgatccattataacttgacctctaaatgtagtagagtaagtcttaaaaggccgctagcctgttaggcctgctccaagacggccccgaaaagacttaaaaagggttaggctttgactttgattatgactttttcatgatgaattattctctcacatttttaatacaaagaacatgtgcttgttcaggttagtggtgttttattagtcttctgacttgtggtgatctttgtacgattcaaattttatgatatatgaaattagtttaatcaatgaatgtatatttgataaacaaatatatagtatgcaggaggtcttgagttcaactctcaatgaaagcaatttctcttcttttttttctaacattaaattcaaaaaagataaacaaatctatacaactgaggaataaatggtctcgagatctagtaaagtcaatgtgcatggaactgtcggttgctttaattttcttgatcaagatgtagtcatgtttttgtttttaagaagacgtagtaatgttatgaagtcaacatagtttatagccaattatttttattactatatacaaaaaggtctactctttataactctattcgaaatttttctaattataactagcaaattatcgaactatctaaaaatcatttacaaatattacaaccaaaaacaatagattttgttttgcttatcattcattatactaatattttccgtaaatttttgttgtactataatatgttggtcaagaggtagtcaagttttggccataaagtaaaagccacgtagagacttttgccgacatgtgcagcagagagttcgtcggtacgcacaggtgccggagctccctcgttccaatcaccgcgtcccttataatacttgttgcaatttcattcgttacttgtgtctaaaaatctcaataaagtaatcatttaattcaactttatagctcttctcttgtctcgtgtctcgtgttcccttcgctcgctttcaccgtcaagaccactctctttactttcctcctttgtacgtaagtcgttctaaccttttccacttagaattgagatcgaatctttcttactatagaagagagattcttggtcaagtccagattatacaacatttttgctttctacagttttcttctgtttcctcatgtacaggctgaactttggcctttttgttgttgtgaaattctgtgtcggtgtgaattctgcattttcatttttatttgaaagacctacatgttcccacccaaactggagttactgaggtttttgcaggtgcgagttttctaaatatttcgagttgttaatctcttacagctgaaactggactacgccgtgtactttcagaatcaaaatg

SEQ ID NO: 29846 - DNA, 3003 bp, Unknown
  misc_feature (1)..( 3003): 2750-1469P.txt file - cDNA_ID_3023118; gDNA_ID_2214518; Annot_ID_184502
acacttttcaagttttcatcattttgtactgattttcttctaccttcgaaagaaagtaaaatgggcttcaaagtgattaattaattggctcttttcatttagcatattccagctcgttttagtgttttacttaggtgggttagtaaacttggcggcaaagtcaaagaatgaagcacgtggaaccactaaaccagctttacccgccaaagtcgccgtcttttaccaagtccaccagagaatagaagaaataaatttttcataattatctttgttaagtaaattatgaaaaatgaaggattaggaaatcgagagaggctattggttaaaaaatgtaaggcctaggcccaaaccaaaagaatcgagagtatgcagttattgagtgagatgagtaacggcaagctgagtaaatatgtgctaattattcaattattatgtctaattaattattcgcattaattctaaaaatagctgccaaataactttaaagtgacggttactcttaaatttgtagctcaattctcagtttctcatatatcgataataacttacaattaaaaaaaaaaaacttacaatctaaatatgttatgaatatatatattataaataacatatatgttaacataagaatatttcttaattgatttttcttatctctaatttttactcagctaattatgcacgttcttatacaatacacacttcttcctactaaaaaaaaatatatttgattatgtttatgttggcgaggaaactgattaataagaaatatttatttaagctagatattttattaaaataaataaattatgtcctaataattcggaggtggttaccaaaaaaagatgtaaaacccgaagtaactcctcctttatcttcgctaaaaccctaacctctctcagtccgactctttctctctcatatataacgcgtaagagacagttaactagtaaatcaacttacaacgttgaagtctacttgaaacaaaaaagacacaacattatcgtctaaaatcaatctacaggtctttcattgattctctcatatatcctctcctgtctttacttttttttttcttaacttgttttatacgtctatctatatatgtaagctcgttactagtaattaaagcttagttaagcttaataataatgtattaaaatagtctgtaactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaactaatacttcatctgtattagtctatgtattagcttttgtctgacattgttcttgttagttaatgtatgtccgcatgttgaagctttcttacatttaaaagagatctttgtgtaaaatcaagcttttatccataagaattttggggctttattattttctgggttttacaaattcaaagcccgaacattttctccgatttacccgatcgataaggggacttgattttccggacttctgatttactatatacattttttttttttacaacttcatataaaaaaatatgttttctgtaaatttgaattatttatggattgaacatcaaaactttagattaaacaacaataacaactttagattaaattttggtttaaattctttaaatctagttaatcacaacttgttgtcaaaacattttcttatgatttgtttcgatcatttgtttgatgatttgttttgatcatttctttcactggcagttaaaatttccatcattttcactattttacacaaaattaataagtatggttcaccaaacagtgcgcatgacctcataaaatattcaatggttacaaataactaaacccatcccaaacattctttatttagcaacaaacccacactatataatagttgtaaattcaatggtaaaaaagtaaaaaaaagctatccaataaaataaaaatg

SEQ ID NO: 29847 - DNA, 3000 bp, Unknown; identical to SEQ ID NO: 11818
  misc_feature (1)..( 3000): 2750-1469P.txt file - cDNA_ID_3023127; gDNA_ID_2214518; Annot_ID_184498

SEQ ID NO: 29848 - DNA, 1771 bp, Unknown; identical to SEQ ID NO: 11817
  misc_feature (1)..( 1771): 2750-1469P.txt file - cDNA_ID_3023131; gDNA_ID_2214518; Annot_ID_133987

SEQ ID NO: 29849 - DNA, 7 bp, Unknown
  misc_feature (1)..( 7): 2750-1469P.txt file - cDNA_ID_3023131; gDNA_ID_2214518; Annot_ID_184497
ccagatg

SEQ ID NO: 29850 - DNA, 3003 bp, Unknown
  misc_feature (1)..( 3003): 2750-1469P.txt file - cDNA_ID_3023131; gDNA_ID_2214504; Annot_ID_184080
aacctggcacagccgttgttttttttgaatatattgacgattcgttggcctccgagatctaaggcatctctcacaatcaacggtccagattccatctagaagatatattacaccgaccttgttttctctatctaattctcacacacacaccaacgcaaacctccaaaacagggccggggcgattcattcacaatctcggcgattctctcttccgtctcgagtcgctgagatccatcaggttcgtttctattcgaatctattctcttgaatccgtatttgtttcctttcctctctagatagatttcatttttctggaaacattgagatttccattgatttgatgtttagtggtttagatcggataatttttgttattgactctcaaaaaacgaatcataactatcttaaaactttgtttacgcattgttattgaaggctaaataaaaaatgctcaattgttgctagaaaggaaggtgtctcgaaaacatgtgaatttattttttgagcctcattgtttctcactgcaacaatagtgaatgattcaattgaaaagaacttttggttaagccatttttctctttaatagattatgtgtctcaactcaattaggaactgtgtgtttttttgtttccttgatgttaacttgtgagttgatttatttgggtagtttacttgtatatatatttggtggtgggtcctggagggaaatgagtgagagggagctctgttcatacattctatgtttttaaatgattagtatttttctttcatctaatacttgctttttgtgctaggaatttcgatttttgggactaatttatcgagtatatataattggataagtgagtttggtattaatattaagagcaattaggttggttatcttgccaaacagtagacccctgtcgttttcttagtcatttaagaagtaatgcttaagattcaggcctctaatctggttatgatagtgaagaggatctgtaaatttacctatacgacctgttgaaaaggacctctggtgtttgttactatgcgtttctgatcaatatagacatagttggatcatattcttctcttgatcgtctgtttcattttttttcaaaatcagtaaaaggtctgcaaaatggttgctcagggattcactgtggatcttaaaaagccccttgtatttcaggtaattactgtttcccagggttttaaatagtttatgtcaacattttccttgagaccatagtcacccaagattgtcttcgtttctttcttagagctaatcaaagtaacgctctctctttaacccctcctgccattgctttggatgttttacaggttggtcatcttggagaagattatgaggaatgggttcaccaacctatcgcgaccaaggaaggccctcggttttttcagagtgacttttgggaggtatatattttattttcatcttttctcattctcaatttccaatatcaataataagcaatgtcaatgagactctgatctccattctctgacgtatttgcaatgaaacagttcttgacacttacagtttggtgggcagttcctgtcatttggttgccagttgtagtctggtgcatatcaaggtcagtaagtatgggatgttcacttccagaaatcgtcccaattgttgtcatgggaatattcatctggacattttttgaatacgttcttcaccggttcgttttccacataaaaacgaagagttactggttagtcactttctccctctctctgtgttacatttcatagagacagtactctcctatgaatcctcctcaaacagacaaattcctggaaacatgacttcggtcagatgctaatgattttgtgaaaccactccaggggaaacactgcacactatcttattcacggatgccatcataagcacccgatggaccaccttcggctcgtctttcctcctactgcaacagcgattttatgctttccggtatttatctacattaacccaccattctacatgttttcagcgccaaccctaaaccgttttcttttcttgtgtcctagttctggaacattgcgaaggctatctcaactccttcaaccgcacctgcattgtttggtggaggcatgctcggatatgtgatgtacgatgtcactcattattaccttcaccatgcccaacctactagaccagtgaccaaaaatctcaaggtaaaacaatgtcaagtctcaaaacctgggactttcttttcttttgtatccggattgcataaagagagcttatttgttatgttttttcttatgattctgcagaagtaccatttgaatcatcacttcaggattcaggacaaaggatttggtataacttcgtcgttatgggacatagtctttgggacacttcccaccacaaaagcccccagaaaagagcaatagtagtaaaaggcaaaaactaaaaagatgtttgtaatacatttaatttaatcttaagttattaatcatccttctgaattttgagatgtttaatctgaggtttcatttggatcactgtcttttgtagtttgtaaatcaatacttcacaatcctaatataatatttttctgcgaaagcaataaaaaatctactaacatgaacatctgtgtcttgactttggccatatatatatttcttgaattgacagacattttgcaataaatatccgaagtttaaaaaagacaaccaaatatgggaagagaaactaaaaattaaaaaaaatcgttattgggctgggcctgggtaaagaaataaaatcaacactcactcaccgacccgcccggaaatccaaatcgctcgaggtctaatctgactcctcctcgattccttcttctcaaactgactgcactcttccttctttcttctgctcactgaaaattagggtttagggtttttgattttcgttctctattagtttctccccctcactctcatggcgatgaattttcaatttatgtgagattttattccacaatcggaataattttcctggcaatg

SEQ ID NO: 29851 - DNA, 3000 bp, Unknown; identical to SEQ ID NO: 11838
  misc_feature (1)..( 3000): 2750-1469P.txt file - cDNA_ID_3023149; gDNA_ID_2214519; Annot_ID_184562

SEQ ID NO: 29852 - DNA, 3000 bp, Unknown; identical to SEQ ID NO: 11839
  misc_feature (1)..( 3000): 2750-1469P.txt file - cDNA_ID_3023156; gDNA_ID_2214519; Annot_ID_184559

SEQ ID NO: 29853 - DNA, 3003 bp, Unknown
  misc_feature (1)..( 3003): 2750-1469P.txt file - cDNA_ID_3023170; gDNA_ID_2214519; Annot_ID_184548
aacaaaaagaccccacaaagtgaatattcccccaaaacccaaatcacaccctcaggattcagattcttccattaaaagcaacaaaatcgaaaacgttacacaaaatctggtttcgacattcacatatcaacaccattgttaaaataatctattcgcagcctgaaatatccggtttcataaaaagcaagagaaatcgattccctaatacattaagagaaacgaattcgtattcgactattcgtttacacatcaatggaagagaaagttgtcaccttttattataaaaaaaaaacagaaaaaagttgtcaccttttccagaagaaagaaacgaaacccgtgaatgaatgagtcgacgggtttatacttggaagaattatccgggagattttaaaggagaggcctttaagcgttaaagaggtagctctggtgactgctattcgtttgtctctttgctgttttatggcgatttatatatcatcatcatgtgttccttctggaaaacacaaatcaccatctgaacgaaataaagagttaaaagagttttctactccaatattccttcaaactacaaataaatattttatatctttttttccgtggtcttatttttattagagttttatttctttagcattattgtcgctaaagagtagtggatttggtatcatcgattttagtcctattctgtttgttttgaaattgtttttctttatgtcacgtcgccggaaatttgttggccataatttagtaggatatattgggtgcatgtctaccaaaataatgagataaataataattgatggaataattagaaattaattatattttatatcttttattggaaacttttctcattattctttttttatttattttatatttcattgtaaatggtaaaatttgtgaggaatctattattttaccatataataatgagataaatggataataattgatggaataattagaaataattaatattagtatatctttttgggctaagctaatgcaagactggtcaattggagatgaacccaaaagtcatggtacattctatatgggcctcaaaagtccatgtgacataataattcaaggcccaataggcgtcttcttgttatatatttttttttgtttctcaataagacaagaattgtcttcacgcttccgcgaatcgttaagcttcacaatttcaagcgaagaggatcaaaaaatcaatttttttggagaagaaccagaaatcacaaaaccctagagggctctcttcaaatcaaccattaaaaccgccaattccgttatgacaaagaagagaaagctcgaatctgaatccaacgaaacgtcagagccgacggagaagcagcagcagcaatgtgaaaaagaggatccggaaatcagaaatgttgataatcaaagagacgacgacgaacaagtagtagagcaagacacactaaaggagatgcacgaagaggaagctaaaggtgaagataacatagaagcggagacgtcgtccggatctgggaatcaaggaaatgaggatgatgacgaagaagaacctattgaggatctattggaaccgttttcaaaggatcaacttttgattcttctcaaggaagctgcagagagacatcgcgatgtagctaatcgaatccggattgtggcggatgaagatcttgttcatcgtaagatcttcgttcacgggcttggatgggatactaaagctgattcacttatcgacgcttttaaacagtacggagagattgaagattgcaaatgtgtggttgataaggtatctgggcaatctaaaggttatggctttatcctctttaagtcaaggtctggtgctcgtaacgctcttaagcagcctcagaagaagattggaactcgtatgactgcgtgccagctggcgtctataggacctgttcaggggaaccctgttgtggctcctgctcagcatttcaatcctgagaatgttcagaggaagatttatgtcagtaacgttagtgcagacattgatccgcagaagttgctggagtttttctcaaggtttggggagatagaagaaggtcctttggggcttgataaagctactgggagacctaaaggtttcgctttgtttgtctatagatccctagaaagtgccaagaaggcattggaggagccacacaagacttttgaaggccatgtcttgcattgccacaaagcaaatgatgggccaaaacaggttaagcaacatcaacataaccataactctcacaatcaaaattcccgttaccaaaggaacgacaacaatggttatggtgcccctggaggccatggacatttcatagctggtaataaccaagctgtgcaggcgtttaatccggccattggccaggccctcacagctttgctggcatctcagggtgctgggttgggtttaaaccaagcatttgggcaggctttgttggggacattagggacagctagcccaggagctgtaggtggaatgccaagtggctatggtactcaagcaaatatctcacctggggtctatcctgggtacggtgctcaagccgggtaccagggcggttatcagactcagcaacctggtcagggcggtgcgggaagagggcagcatggtgctgggtatggtggtccttacatgggtcgttagattagccactcaggtaattattttcagcttcttttcatctatttcattgatgttctgtatcagaagactttttttgtagttcgcttggttcccttgtgtatttcaagacatggacttgctgtattttgaccttttcatggttactccattatgttaaactttttgcgttgcaagatcattttgttttcaaagttcctgtgactttgttgtgtttctgaagggtgttaggttttgcatcagtttataaaagtcttctcttaatttcttaattcattgtgcagatattccaatacagtactttttaaaattggcctggtgaatcttctgaagttattaaggagctgatgcaaatg

SEQ ID NO: 29854 - DNA, 3003 bp, Unknown
  misc_feature (1)..( 3003): 2750-1469P.txt file - cDNA_ID_3023182; gDNA_ID_2214519; Annot_ID_184544
cggctttaccgtcggtaagaaggcagttacgtttccgtttagctcctccgccgatgatttctggatcagaagcaccggagacggtagaggagagtgtgttagtggaagaagggtgagaaacagcggaggaatcgaagaaagcagaggaaggagtgagagtatgaggggctgtgacggtggtatggagagctcttgcgagcaaatcgttgtcgtgagagaaggtatcagaaagcaaccatgaatcaacgttgaaaccttggcgatataaccaagaatcaacgcttgctaatccctccgaagtcaccataaccggtgaagaagatggtcgctgggtttctgaaaggagaagaagaagaagttagagaaagaaagagagaggtgagaaatgaaaaatggggccgaggaagtttatataaggacggcgagaagcgatggaaaccgcgttgagcggagattgaaagggacacgtgtcacagcttactcgtacggaacttttattcagctaacgagtgagagattatcataaaacaaattagattattgaattatgtcacagattttttttttttttgttaaagatgaattatgtcagacttatacaaaatcgaatggataacatgtggatagtatgtatgtactctgtaacaagcgaaagaaatttttttttattgcgtatatccaatattcagacaatctcctttgcaatattgattgatccaataagaatatcttcaacttttagatacatcctttctacgcggtgagacatgcaaattagccccaaaaagaaaaagaaaaatgaggaaggtcaatatccaacggctgatgtttacttacttaaacgcttgttgctctcagtgggaccaaaagagttagagaaatagaatcggtcgttttcagcttcggtctttcttttgtaccctcctatatctttctgtatatcatactcatagtggctttaacaaatattttaaacaatatatgaaggtgatttgcgtattctattttttttttcatttagataagacgcttactctaagttttacatggtgttaagtaagtacaagtttgagctataatttttaatacaaaccaaaattaataactatgtttaggagttcaaaacttcaaattatatgcaatgaattggcttatgtgaagggtcaaacaaaacaaatgtcaaaattgattataactttattttaaagacaacaaaaatgcgtttatatgtatattttatccttttatgacaatgatattttcatcctttttatggagaaaagtaaaagaaaattttgaatattgtttatttttgtttgcttgtttaaataacacgaatatatatatatatattcaaaattccaggtaagcccaaaagaactaactgtgttaaatgagtttttttcaacgcgttaatatgattatacagttatagagtgaagatgaacgccattcaaagtaatcataaagactgttgaaatagttttttttacaagttgtttcaccactctcaactgcatacaagaaaaatgttttcaataaaatggatttctagtttaatcgacaagtaaaactagataaatgtagtgcacacaatagttttctatatattacaatgatttaattatttttcttatgaagatgatattttaacagtttacgtctttataatgccacgataatagcaaaataagtctgctatggtcgaacgacgcttaagtagcacatcaaaaacatagtttttacaagcccatatatactttcttcaagttgcaaaacatccaactgaataaatgtaccagcataccaaaaaaatgattcttgaatttcacctgtcatataacattttaaaaagttcacaacgcatacatgtaccactcgcactcagcacacaagatctaagatgtcaactgttgactcacacggtcacaccgtttattacgattactgatttgtacgagtcgtcgtcgtttacaaaatgcaaaaaaacaataccaattcttatatatatataaaagattcaaaaatataaaagacaggtgaaataattaatcagattggtttccgcgacgtttcttttgcattttagtattttcgtgatatcaactttagcacattaacattatacattgacgagacgactctcatgagcttcacttgttcattctttaaaaagacatatctggtacgtatataagaatttgttggaaatttctataatttgtggtcttaaagactcagattagtcagaaaaaataaataaagaaaatgtctttattcttatagaagaagaacaaagtcaaaagccgccaacggtgacgtgagcatttttatacgatgtaatgatgatggtatgatgacgagaccgaacggaagcatgtgatgaaggaagaagcggtcgtgtgtgtgtgtcttcttctttcttcttttcaccgaaagcttttctctcattactttatttccaatacattactgactctgacactcctctcttgtctcccatgtttcttcctactgccttgcttcggctctatagcttcttcatttgatctcttaatccgaaaagtaaaaatacattgttttatcatttagtttacatataattaagtaaagatcacaacttgacgtttgttaacaatccattacttcaaactttccacaatagtcttgtaaatttatccccacatgatgtctgttaacaatccattatttcaaactttccacaataatcttataaaccaagatagagccaaactttagcttccatttttatttcttcggtttatgatctctacttgaccagccagttaatatatgggcttgggccttatgggcctaattgcttatcgcagaaattatctagggctcggattccgattctctctgtgactcacatcgacatcgtactggtttgttgattttgattggtaatcggaagtaaattacgacgttgaagctccctcagtctaaaggattcggaggttgacgctgaactaaataatg

SEQ ID NO: 29855 - DNA, 1898 bp, Unknown; identical to SEQ ID NO: 11871
  misc_feature (1)..( 1898): 2750-1469P.txt file - cDNA_ID_3023214; gDNA_ID_2214520; Annot_ID_184591

SEQ ID NO: 29856 - DNA, 3000 bp, Unknown; identical to SEQ ID NO: 11864
  misc_feature (1)..( 3000): 2750-1469P.txt file - cDNA_ID_3023222; gDNA_ID_2214520; Annot_ID_184587

SEQ ID NO: 29857 - DNA, 3000 bp, Unknown; identical to SEQ ID NO: 11868
  misc_feature (1)..( 3000): 2750-1469P.txt file - cDNA_ID_3023226; gDNA_ID_2214520; Annot_ID_184583

SEQ ID NO: 29858 - DNA, 3003 bp, Unknown; identical to SEQ ID NO: 24880
  misc_feature (1)..( 3003): 2750-1469P.txt file - cDNA_ID_3023230; gDNA_ID_2214520; Annot_ID_184580

SEQ ID NO: 29859 - DNA, 3000 bp, Unknown; identical to SEQ ID NO: 11894
  misc_feature (1)..( 3000): 2750-1469P.txt file - cDNA_ID_3023266; gDNA_ID_2214521; Annot_ID_184634

SEQ ID NO: 29860 - DNA, 3000 bp, Unknown; identical to SEQ ID NO: 11896
  misc_feature (1)..( 3000): 2750-1469P.txt file - cDNA_ID_3023273; gDNA_ID_2214521; Annot_ID_184631

SEQ ID NO: 29861 - DNA, 3000 bp, Unknown; identical to SEQ ID NO: 11910
  misc_feature (1)..( 3000): 2750-1469P.txt file - cDNA_ID_3023277; gDNA_ID_2214521; Annot_ID_184629

SEQ ID NO: 29862 - DNA, 3003 bp, Unknown
  misc_feature (1)..( 3003): 2750-1469P.txt file - cDNA_ID_3023281; gDNA_ID_2214521; Annot_ID_184628
aagaaagtatccgtgaattcccatcaacacagtagccaagaagttgaacaaagttatcatgtttaagcctagaaaccatggaaacctacaagcagtgtcaaaatttcccaagttcttaaacacaaaaaaagtgagacatttatgtgaccataacacagtagtaacagaaaaccacacaaaacctgagcaaggaattcattgtcaggctgtttgttagaatccaactttttaatcgctgaaggcagatcattgtttaataccccgtagtatactcttccataagagccttcaccgatgagagaattcgatccaaaatcatcagttgcttctttgagttcactaaaagggataataggtacttcaataggctgcaacttcacaactggaggacccttctgtgcagtttcagaggcttggtggtgccttgcatcatttccttcacaccaaaaccaaaactccaatgaggaaacaggaaacaagtaaagtcttgattttttggatagcaagatccaactttgatacctggaggaaagtgtttggcttggttatgacgacctccataatcagcagttttatgcatatcatcatcctccccacaacacccaaagcaactcattttctttaaagaatcaaaattggagttcaaaatggaaaagagaagagcataaaaacggaaaatcagtcgaaatcgagaagagaggaacgaaatagaaataatctggggaaaaaggttttacctttgggggatccaacaacacggagtgaaacggaatgtgcaaaatgttctggagaattattagagagagtgaagaagaacaaatgacaatcaatgtcttgagcttaattagagagaaattataggtacgagtgattagctctcccaagtttgactggattttcaacgccagcgtgtcgacattaacaccgttggattatttgacaatgacccaaaatccaacgaccagattgccacatcgttttatttcattttgtttttgtcttacatgatataataattacaatcataataattttcttaaatgacgctttctatatggagtattttcctttgtttgttaattagtgccatatcttttagatataaaactattaactatgacttggtaattaatacgtatagtcaaatactaggcatcctacgttacgtttctatgcatttttttatataaaagtgtaagaaccaatactagcttaaaaggaaacgagtagaatttcgtaatgaaaaaagacttcaaatgttaccttttaaattcagtttatgtttccgcgttaccttttgaaatctcgttgctttcgtacgaaaaagacaagaaaatagaaataaattagaaagggtggtttggtgagtaatgggtcgtatatgtgggagtcgttatcgtgcatgtgaacaaaatatggccatgttcgagacgaatcatggtgtcttttaatttggtgactacattattttaacactaatcaatatctttctcgaaccatatgatcatgattagccgtttctatattttctcttttaaatagattatatatgggaattattagccggaactttgccgctgcggttggtaataccttttaatacacttatgatttgtctctttattcggttcctaattcagtatacatattggggcttgagtttgaacggaaggtatatcaatgtcataccaccaataataatcagcatcatgcatggtttttaaaatgtggaataatatatacttttaaggacgataatgagattatataattgaaaggaattagatccattgagattctaaagctaccaagacgaggaacatggaagacgtggcgcattggattcttcgttcgagtttatcatcatatcatgtgactggtctctctttctttgtactcacactaacaaaacaaaatgttaatatcccacgttaaattaaatgattagaggccatcaaaggataaaaacaagaaaccaaatctaatatactattttataataaaaaattaaaagcgggtttatgtaagtgggccaaataaaaagagtgggccaagaaagcccagaccataatgaccacatggagaccgaaaggttgacccaattagaaaacttgttatatctttaggagtcaaagtcaaagcgcgtttacaaacaccgacactttctttgtcaactagcggttaccgcggttgttcactaggcacggaacactcgatttcttcccaagaagtcgcaaccaacacttactatgtatggtacatcacaacatagacaataaaaactcttggaatgttccgcgaaacaggtgattattgactaccatgagtggggaaatgtggggtaagttaacaagtacactgcttcacatgggaaaaagaaaaatgagatacacataattcacaaaatataatttttatcttagacaatttttttaaaataatattaaaatcagtgtagaagtggtccccaccactattttgtttttccttaaaattaattattatttttgctggactaaataaaattggtttttttttttctctctctgtcctaactctttttctttctctgttttgtatctctctctctctctcactctttgtctctcccctaacctttattgtactagcataaccattaccatacatactcttctctatcacgccacaaacgcagattcatcacatcttcttcttgttcatagcatctccatcactattgggctctcttcaaaggtgtatttctggggttacttattccttctttgtattgattagtgttgaaaaggtgtctctgttgcgttcaagagctagctttagggctatatattaagaggtttccagaggttttttttggattataggcatctgtgtttggcttacatggatcctttttttaaggttttctgggcaagactaattgattaggaccaaagtttgtgtttttatttgtttggatctacaaagatcaattaggctgttgttgaattggatcgagtgatg

SEQ ID NO: 29863 - DNA, 3000 bp, Unknown; identical to SEQ ID NO: 11887
  misc_feature (1)..( 3000): 2750-1469P.txt file - cDNA_ID_3023285; gDNA_ID_2214521; Annot_ID_134071

SEQ ID NO: 29864 - DNA, 3000 bp, Unknown; identical to SEQ ID NO: 11887
  misc_feature (1)..( 3000): 2750-1469P.txt file - cDNA_ID_3023285; gDNA_ID_2214521; Annot_ID_184624

SEQ ID NO: 29865 - DNA, 3000 bp, Unknown; identical to SEQ ID NO: 11888
  misc_feature (1)..( 3000): 2750-1469P.txt file - cDNA_ID_3023289; gDNA_ID_2214521; Annot_ID_184623

SEQ ID NO: 29866 - DNA, 3000 bp, Unknown; identical to SEQ ID NO: 11890
  misc_feature (1)..( 3000): 2750-1469P.txt file - cDNA_ID_3023293; gDNA_ID_2214521; Annot_ID_184621

SEQ ID NO: 29867 - DNA, 3000 bp, Unknown; identical to SEQ ID NO: 11891
  misc_feature (1)..( 3000): 2750-1469P.txt file - cDNA_ID_3023297; gDNA_ID_2214521; Annot_ID_184619

SEQ ID NO: 29868 - DNA, 3000 bp, Unknown; identical to SEQ ID NO: 11892
  misc_feature (1)..( 3000): 2750-1469P.txt file - cDNA_ID_3023300; gDNA_ID_2214521; Annot_ID_184617

SEQ ID NO: 29869 - DNA, 3000 bp, Unknown; identical to SEQ ID NO: 11893
  misc_feature (1)..( 3000): 2750-1469P.txt file - cDNA_ID_3023308; gDNA_ID_2214521; Annot_ID_184615

SEQ ID NO: 29870 - DNA, 3000 bp, Unknown; identical to SEQ ID NO: 11878
  misc_feature (1)..( 3000): 2750-1469P.txt file - cDNA_ID_3023312; gDNA_ID_2214521; Annot_ID_184614

SEQ ID NO: 29871 - DNA, 3000 bp, Unknown; identical to SEQ ID NO: 11877
  misc_feature (1)..( 3000): 2750-1469P.txt file - cDNA_ID_3023320; gDNA_ID_2214521; Annot_ID_184611

SEQ ID NO: 29872 - DNA, 3000 bp, Unknown; identical to SEQ ID NO: 11876
  misc_feature (1)..( 3000): 2750-1469P.txt file - cDNA_ID_3023324; gDNA_ID_2214521; Annot_ID_184610

SEQ ID NO: 29873 - DNA, 3003 bp, Unknown
  misc_feature (1)..( 3003): 2750-1469P.txt file - cDNA_ID_3023328; gDNA_ID_2214521; Annot_ID_184609
acgccgtcgttctttctcccgcatctcggttgttttctctctctcccggaataacaatctacagttctaccggtttaaatgtaccggttaagtaaaaaccggaaagataccttgttctcctaaaaaggttgagagaagcgagggattagcgtgtatcgacgagataatcatctagtcgtcggtgtcgccgcctttctccgccgtctgaaatcgtccttgttcgattttccgaagacgaagcaggagaagatatgtctgggaggttgctgaagaaggttctccaggaacatgaagattcgaaacttcagaaacatcacgaagaagaagaagaagaggacgaagaagaatcaggagcccgttcttcgattaatccattcgatctcttgaacgatggtgatgaagatcctgaggtcagtctctcagattttgacgattagattgttcggtagatttagtatctagaattttatcctcctccgtgttctaaaatagctaatgtgttgataagtttgaatgtagatagtttcaatggtttgatcttcagattcttatggttttttattctgatgtctagagctgattcatattttgttggtcgtaggagtaatgattacaaagtgtttctgtaacaattgggtttgattgcaggagattgatgatgagactatagctgagaagaagaacgaagatgcggatcatcagtcaagtgtcgctgatcatgtgcagccggtgtcaaagaataagtcgaagaaaaagaaaaagaagaagaacaaagagagtggctctaatgtgcctaaagctgaaatgactttggatgaaactttggaagcacttggtctcaatgctaactctaagcaagataaggttcaggagacaaaaccaaatgctgattcttccaaaaaggcttcttcacgatttgtgttggaaatagattccaagtatctgaatcttgagaacgagttgaggagaacgtatggttcaaaggctatgcgatcatttgagagtgagagtggctctcaaggtggtagtagctctagacgagggggaaggcgtggagtccatcatatcacaaagacggttctggtatctccaaaagagaattggtctcgatgggatagatctttctcaatggagtttctagagactaaagatggtaacaactacttcaggtaacaatttttacagctttttgttttttcgttgggtgtgtgtatagaaaatacagacattgtaaatttgtacatctgatgaaatacttttcttttgatgtgtagatatacccattcatcctcatatgagcaggctcagagagcatttcaggctgcacaagctatccatgatttgaatggtgtagcaagtgtccttatacacaatccttaccatattgagtcgctcataactatggcggattactttaagtttgtaggtgagaatgatatggctgcagattccattggaaaatgcttgtacggtttggagcgtgcgtggcatcctatgttcactccgttccagggtaactgccggttggagtttaaccacgatgaaaacaagctgttcttcaagacgcttttcactcacatgagaaacatggacaggcgtggctgtcataggtcagcgttggaggtctgcaaactcttgctttccttggacacgagtaatcctgtgggcgctttgttttgtgtggactactttgctttgagagcagaggagtatgcgtggctggagcaattctcggaggagtaccgaaatgataactcattatggctctttccgaatttctcttattcgcttgcaatagcacgagtttatcttgaaaagatggagcctacctcttcctcagaagccactcccagagatacttcgaagcaaagctctttggatctcatgacgcaagctttgaagcttcatccaacagtactcaacaaactagtggaaaaagtacctttaaaagatcaggcatggacaaagatactcaagcattcttacttccgatcagatgaatcaaagatcccgtctttagatcacctcatcaaaatatatgttgagaggaattatcttatatggaggcttccagatgtacagaaattgcttcggagcgctgctgatttagtcattgaatctctggaacaagatggaaccgaagctgagagctggctttgtgtaagattagaagctttctcttctgagaataaccagtaagcgttttgaactctcactcacttgtcaatttctttttttttggctagagctgatcacgtatggttctaacccattgcaggtactctcatttatcaacccatgatttctctgattcgatgccaactctcccaccagacaatttgcagaactttgtggctgatccaagaatggtgggaggagagcaaatggctgaaggtggcgggagaggtcaacaccaagcaccaccaccacgtccacgtgatttggcaaatcggagtccattagctgtgttgattgagtcaatacttccatgggctaattttggagatggagaggatgagattgcacatgatgctcaccaccaaccagacaacaatggctaatcaatggctctaactgaagaaagaagaaaactgctttaaagtttacaaaatgtggccttccttttgttgtacagtgccattttgatggtttagtctatggatcatttgttacttgggtaaatcggacttggtcattttcgattcatgttctggtggaataattgacagctttcattgctcaaaggctcggttaaggtttgagccggttcacgatgtcaggtcaaaatactgccacgtattaaaataaaaaaatgaagagtaattatagaaaataaagctgtctcatcttcctcagttctcagtttgtcaccatcctcgagcagcttttgagctttgaaggtatcgactaaattattattattatttttttctcctagacattgttactctttggggataaattttttatcttgtataagcttatccatcaggttcgaaaatg

SEQ ID NO: 29874 - DNA, 3000 bp, Unknown; identical to SEQ ID NO: 11923
  misc_feature (1)..( 3000): 2750-1469P.txt file - cDNA_ID_3023351; gDNA_ID_2214522; Annot_ID_184662

SEQ ID NO: 29875 - DNA, 3003 bp, Unknown
  misc_feature (1)..( 3003): 2750-1469P.txt file - cDNA_ID_3023355; gDNA_ID_2214522; Annot_ID_134099
ggcgttcactgacagcttcttgttctcctagcggtttcccttgtgctcatcctcacaccttccaaaatattatcaactcggataacaaaacatatatatgtgatcaaccagacaattttttaatatatatttctatagtcaacgatgagtacgcattttaataatccggtgaaagattagtcggactaactaaataatttttttgacatataataaacacttggaccccccaaattgagccttaagaaaagactaaaccagttctattagttgcgtacaactaacgatgatcaacttgagtgatttatatcggagatcgtgggtagtgatacgggtcaacaatataaggatttagagatcaattaggaattgaagttaaaccttttcaattttcttaaagttccctgatccttattcattcatcgtatccacaaccattcttaacattgcccatggctaagacgctggacctcttttggcacgaacatcctttatatgaaaaatatcgtatgttcacttgccaagagtgccataggagtgctatacccttctttgaagttttttatggatgcttcagatgcaatataaaatggcatccctattgcgtgccaaggtcaacgaagaatattaaccacccttgtcacccgaaccatcccctagaggttctcctccaagggccacctagttactctgacgagaagtgcagcctctgtcaacggaaactctccaacttcgtttaccattgtaagttatgcaatttcagcatagatatggaatgcggaaacaggcccccgccccacaaagtggatcatccaaagtgccacgagcatgcactcaccctcatgggaagggaagtatccttcacttgcaatgcttgtggtacgcatggtgaacggaacccttatgtatgcctaccatgctctgtcatgtttcattatgattgtattgatctaccacacgtcatcaacatcaatcgtcatgatcatcgcatttcacattcatatcctctcaaacgtgggaattgggtatgtgaaatctgtcgtcaagatatcaacaccacgtacggaggctattcatgcaacaaatgtccagatttttttgttcattcaaaatgtgcaactagaaaagacgtgtgggatgggaccgaactcgaagggatacctgaggaagtagtagacgttgcgccatttgaagtgatcgaggaaggggtaatttatcatttctcccacgagaaacataacttattccttattgaggatgtttttatagatggtgctgaagacatgcattgtgaagcttgcgcccgtccagtctcttctgagaagcactacaagtgcgtggaatgcaagtttattcttcacgaagagtgtgcgaatcttcctcttacgaaacgacatggactttccacaggtatattttatcttcgcttcgggaaggattttagcgaacaaaatttcagttgtgatgcttgcaatagagatggaaggggttttagctacaaggatgaagagggtgtggtactcgatgtgttgtgtgcgtctctctctttcttcaagcaccccaaacttcatcctcacacgttatttctaaccacaatagatcgtggtacttgcttagcttgcggtgagaataaactcaatgtgctgcgttgtgttgattgtgattattctttggattacaaatgcgccactctaccattagtcataaagcataggtgtgatacacattatttagttttgcgctctggggaggaggcgcctgaaggtaaatattggtgtgaaatctgtgaagccgaaaccaatcctgaaagatggttctatacatgcgatgattgtggggtcgtgtgccatattgaatgcgtaaccggggactttttgaacataaaacctggaataataatgaagaacagggagaataagtttgaagtgggtttcaacgatcacgattctagaccaaaatgcactgattgtggctctcgttgtaggttccctaggtttttcaaggttactagaaaaaatattgagtactactattgctcaaaagcttgttttcagaatgcgaaattctgaatgcctgaaggaaggcgaaaggaaggatttggaaacataaaaagaatatgggtttttacagatggaggctgtgtaatgtttttcaattattttcagataaacttgttttctatatttggatttattgttggtttgctcattcagttcataaaactatttatgagaaagagagaaagagagagagagagactttgaaggtaattattcttcacaccttttattataattcaccaaaattgggatgtttgttctattcttgatcacacgcctctctgtcgcttccttttgacgttttctttcttttcttagctttttcttttatcttttgtgttttctgtcttttcttttccgtagttatttgggattccaaatttttttcattcctaaatttctccacgagctcatcacctcctttcgtctctgcctctcatttgtctacaaacattttttccttttgattcgtctctctggtttattgctcgttgatcgtttgtttctaaattgcattctgatttctgatggatcgtgattttcatcgtcgtggtcaagtggtaagcattacacgcaaacacagctttgatcattaaaaatgtcatcttatttaaatcatgtcttgagatcacgtaatggtcttaggtcaatcaagatcaacgcgcaacaaattctaatgtttttacaaaatttgaaaatacttatctacaaatgtatttataaagaaacctaatttgcctttgtgttgatcatgatagacaattgttgttattagcctgttgatttgaaggcagagtcctctgttttcctgcaacatgttagaacagctcatttatgtgttttggtgaaaacgcaggcgaatgatcgtacacaaagcaactttgttcgattggataaaccgagagctgtagacgatcttgatataggcaagagagggaagatg

SEQ ID NO: 29876 - DNA, 3003 bp, Unknown
  misc_feature (1)..( 3003): 2750-1469P.txt file - cDNA_ID_3023355; gDNA_ID_2214522; Annot_ID_184661
cagtttctagacccatattcatctgttccttgtatagctgccattggattcagtggtacacaagtttggagaaccggtaagaccatatgtactttagattttaagtatttacacgttatagtcaagcaaacgtactcaagtttgttttctatccctttctatctttcagaaggatttatcactgctgaagaccttgcatccagtttagagaaagcgtggttaggacttcatatccaggtacgtgatagctgctttctcacttatggtggtgttcgtccttctatacattttcagttgacttttctcattttcaggaaacaactgcaagtatcttttcagcagcacttgcatcacagaactcagagacacctgtttctagtgcttcgagtgttgtcttgcctcccggaagtgttcctttagatgcagcggttgcatctccatcgacggcttctagtgttcaaccctcagagacaaagtcaacggtaacatctgcatcaacaacagaaaacaatgatggcacagttgcagttaaggttgtccctggagctgaaatcatttccacattactttagtttgttgttttgcttacatgatgcagcctttttttaaaacagggcaaagaatctgctgaacccagtaatttgtgtgatactactaaaaaccagccagcaccctctgttgatggaactaaggccaatgttgaacatgaagcgacagagacccctttgcgtgttcaggcagaaaaggagccaattcgtcctacagccccaggaacaaatgataatacatccagggttcgatcttctgttgatagaaaaaggaaacagggaactgtgataaatgaagaggatagtggtgtaggtgttagtggaagggacattaatctaacaaaatctgtcgatacaaaagagaccatgaagccaaaggatgaaggaggagaggaagaggatggagaaaaatccaaaaaagcatctgacgttcatttaaacattcgattacctgatggtagtagccttcaggagaagttttctgtgacaagtatattgagaatggtcaaggattatgtgaacagtaatcaaacaatcggactgggtgcttatgatcttgcggttccttacccacgtaaggtgtatactgaccaaggtacgtaaaatctacaatgcatccaatagatttttatttttatttggtaaagaacattttaccttaaaaccagcttcatcttgatcgaagatgatgttttctgccatttaggttttttttttttttttttctggtcagtttggactagtgtagtagatacataactccattactcttaatctctgcagatctggataagtctctatccgagttgagattgttcgatagacaagcacttgtagtagttccgcgaaaaagagcaaccgtctatcaaagaggaacatcttactcggagtctaacaacaacacagaccctaatagtggcggttactttgcttatgttagaagagtactgtcttatgcaaacccgttttcatattttggcggtggtactgccaacgcatcaagctctgttccagaacgtcaaacaagtatgcgggaatatgatgagtttataaaatccattctaatgcagaaagtcgtgtaattgctaatctgattctctctttttctatctataggaccaaatacggaggtgagaaacaatctggggcaagtagggacgtcctttcaagatccatcagaaggtaggagcaacgttaggaataggagaccaaccacttctcggattggaagtaacatccatacgttgaatcacaatgaagatgaggctccgtttggtgatggaaacgctttttggaacggaaactccacacagtacggtggtggaagcggtggagacagtaatgatagacgatgaaataagagaagttgaaatctgtgtggatagatacagaaacagctcgggtgtttactttttatacttgactctttatgaaccatttaagagaccagctgcaaaatgtatcctgatgcgtttccgttttttcggttgctcgtattaaatttaaatctaaaaaaactagcaatttctgtttgattaaattcggttctagaaattaattagtgtcgtttgattaacttcggttccaatcataacaaaaatattagagttaaatggttgcttaaatataagaatctgtatattcttttctatgcaagtgaagacttcattgaactgtgaaaaggcgttcactgacagcttcttgttctcctagcggtttcccttgtgctcatcctcacaccttccaaaatattatcaactcggataacaaaacatatatatgtgatcaaccagacaattttttaatatatatttctatagtcaacgatgagtacgcattttaataatccggtgaaagattagtcggactaactaaataatttttttgacatataataaacacttggaccccccaaattgagccttaagaaaagactaaaccagttctattagttgcgtacaactaacgatgatcaacttgagtgatttatatcggagatcgtgggtagtgatacgggtcaacaatataaggatttagagatcaattaggaattgaagttaaaccttttcaattttcttaaagttccctgatccttattcattcatcgtatccacaaccattcttaacattgcccatggctaagacgctggacctcttttggcacgaacatcctttatatgaaaaatatcgtatgttcacttgccaagagtgccataggagtgctatacccttctttgaagttttttatggatgcttcagatgcaatataaaatggcatccctattgcgtgccaaggtcaacgaagaatattaaccacccttgtcacccgaaccatcccctagaggttctcctccaagggccacctagttactctgacgagaagtgcagcctctgtcaacggaaactctccaacttcgtttaccattgtaagttatgcaatttcagcatagatatg

SEQ ID NO: 29877 - DNA, 3003 bp, Unknown
  misc_feature (1)..( 3003): 2750-1469P.txt file - cDNA_ID_3023363; gDNA_ID_2214522; Annot_ID_134093
cttccttgagattgttttagggtgaatctgaacaaagacaaattcgatcattgctgattgctttgttgccgttcctcaattccatgtatctggctcttacgattgtgtaattgaaatgagattatgatgaagaatgattcgtttgtttctttttgttctatctatacatttgtggtgatatatatatatatctttgtttgaaacgttaatagataagctgctcatactagttatacaacagactccatagaaggtgacatttgtttaagatactcttgttcctggaacacatacgaagatgaagaaagtcttcggacaaactgttagagacctgtaagtattttcgtacccgaaatttaatgatattctcaatctgtgtgtggtttatttcttttttcattgacgggatgcttcattttatgttccatttattcagtaagagagaggtcaacaagaaagtgctcaaagttcctggagtagaacagaaggtaatggatgctcttagcttcttctctctttttcttcttatcagaaattcttccgcagcagagatttagatactgttttccatttttatgcttgagtttatcaatttctttatttgtttctaaaaggcttttataaatagagagcttatcttggttgcattcatcgtcttgctaaacaatgtaaagcgagatatccaactttctcttatcttgttttgtctgtgctttctcttattcaggttctagatgctactagtaatgagccatggggtccacatggatcacttcttgctgatcttgcgcaagcttccagaaattagtaactacgaccaccttccaacttgctatattttgctgcgattttggacattgcacaggaattataaaaacatgttacttctatttcagtcatgaatatcagctgatcatggtggtcatatggaaacgccttagcgacaccggaaaaaactggcggcatgtctataaggtaaacaatattattgtcttgctggcttaatttgtgttgaatttctgtagcagtgactaaagtatttcatgctgtttacctcttctctctccccttcaggctttgacagttttggagtacatggtaggccatggatcagaacgtgttatagacgagattagagaacgtgcatatcaaatttcggtaatgactaccttgagtacattattttggaagtattcaacatcaagagaatcctttagtgctatatctcagtagttgactatcttacttgtatatatgtctattttccttgtggcagacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtaagtttgcttgtcattgtatctttctggaactggtggatagttttctctctgtgtgagtctcggtggacactcgtttgatttcttgttgctagtggcttacaattgttattatgcttctcggtagtctattaattggtagtactggcactttaactgtattagcttctgaattttgaaagtttttatctcgagaaaaaaaaatgacatgtcttttggttcattcaaaatatgctgaacatatcaacctacattattttacaacaggtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcgtcattccagggactctgaagaccggtatgggagagatggtaatagggatgatgattacaggggaaggagcagaagtgttgataactatgggtcacgaggtaggagttcggaaagagagcgggaggatgatggccattcttcatcacggtatgttaaatttcaagtcgcctaaatcctgaaataaaaaaggaaggggaaaattttgaagattatcaactccatttggatagaatatttttattttgaatactagcgtagatgtccttgattttaaaaatcatttcgaaccgcaatcttcttagtctagttccattttcaaattttaaatggatacactcctttttgtcctgtaggggcagtggtgctcgagctgatgataattctcaggatgggaggtaatttctgataaatttctactgaagtttaggcattcttttattgtatgacaactcatctcaccttctttcgggattataatggtagaggggggctccagaggaagttttctgaacaaaatattggcgctccacccagttatgaagaagctgtcagtgattcacgcagccctgtatatagtgaaaggtgatcattttctgctttgaaaattgaaagctaccttggtttttattggtgctgatgaatctttctatgccagggatggtggggagaccccacaagttaccgctccaggagctgcttctcctcctcccccacaagttgctgctccagaggctgcttctcctccaactggaaccaacacagccaatacaactgctacttttgttaatgaatcaccttctcagaaagttgagactttcgatgaatttgatccacgcagtgcgttttcaggtacagaatactcaaactcttgcaattctttagttgtatcttgagatattttcttagtttttcaaactcctcggcagcatagagattacatgaaaatctttaatcaataactataactaattcagtaaatgtttcaaggcttagttggagggtgtatgattgtattctcatgtctgtatggtatatttctatcccattaaactctgcttgttctgagtgtggccgttgtgttcctttacttttccagctggccctccagcatatgcatctacagatggtgttacagctcctccaactgtgacttctatg

SEQ ID NO: 29878 - DNA, 3003 bp, Unknown
  misc_feature (1)..( 3003): 2750-1469P.txt file - cDNA_ID_3023363; gDNA_ID_2214522; Annot_ID_184656
cggtgaagaatggcgactccggcatggagtcatgccaaggctcaatgggtagtcgccatgttggcgttactcgttggctcggctatggctaccgaaccttattactatagctctcctccaccaccgtatgagtataaatctccacctcctccggttaaatctcctccaccgccttatgaatataaatcaccaccacctccggttaagtctcctccaccaccgtattactatcattcaccgccgccgccagtgaaatcccctccccctccttatgtttacagctctcctcctcctccggtgaagtcccctcctcccccatactactaccattcaccgcctcctccggtgaagtctcctcctcctccatactactaccattcaccacctcctccggtgaaatccccaccaccaccatattactaccattcaccacctcctccggtgaaatccccaccaccaccatactactaccattcacctcctcctcctgtgaaatctcctcctcctccatattattaccactccccacctcctccggtgaaatccccaccaccaccatacctttacagctctccaccaccaccggtaaaatctcccccacctcctgtctacatctacgcttctcccccacctcccacacattactaggctcatcaaattcaacaaaatttccccattattcaagtaagtcctatacttatacctttacctcataatccgttttaataattgtgccctaaataaaatcggaatttcttctttcacaggttttcttttaaaaaatgaaataaaggaagggtcaaagtcaaagagaagaagaagtgaaccaaataaggatcgtggcgtggaaatcagaaacaaaacatctctaacaacgatccacatcacttcctcttcttcaatgtcgctcatcttccacttgtgcatcattatctttgcgtcttcgtcaagtcaaattgtttccaagacccttttagatcgtatcatactcctctttgttcccttttgttgttaagtgaaaaaatgggttttggtaatttaattgttgtgcatacattttctattttgttattcttccgttaatgtaatgaaagagttgttagcatataaaacaaagttcagtttcttctttctttggattatgcgatatacagtcataacattttctatcttaaaacatagttccaacgacaaaagtagttccaatgacaaagttaaaagacatattcttttaggttgggcacgacattgtttcgatctgttcgtccagagaaagttatcattgcttcaaaaggtgggaaagtggaagtaacacatcactttgatctcattggatcattaataattgtgtttatgtaatacgtcagagactcactttcattcaactaatttccacctactctttttgtttcaaccttaaaaaaaaaaaatattgagcaatactatatgcttaatacaaaaccattgactaaaattaaagaatgttgaaatgaattaatatcaaagttatagtttatattcttctatttaatcgaaacatggaaccaaacaaaagcaaatgaaaagcagcaagtgctgaagaattggttcgaaataagtggagtggttgtactttgggctttgggatagcattagctgattttgaggcccattggctaaacgtatttggtaatttgcctccaatttttttgtcaccgtcattttgtttgttgtttggcaacgacaccttccaaactttatcgttatgcttaagttgattttgataaattaatttgataatgatgaagtgaaattcaatgaagctaataaacacaattttgataaattaatttgatttcaacagtactgaaatatatagtattaggtctagtagcttccaactccactagacataaagcaattttgtcccaacaaaagttttggaataaagcatattgtatcttctcatttccaaactgtatatgagaatagaaactttataaaactggttagaccaaagtaataattatgttgttctcaattaaacagctgtgatttttcaaatccaaacattatattgatttggagcgccttaataatattctccgtgtttagttgcgctgtcttatttgtattattctttttttttttcactatttcatttttatttatttattttatctgttgaattttctcttctggctgctgttttcctctctctctctctctaaactcgagaatttttgtagagagaggaggcaaagtgcgaaagctaaacgcagatccacgatcaatctcctccaccttcaaaagccttcaaaagtgtttcttcttcgtcttcttccttttattatctgtgccttgacagatccacgatccgattctggtcaaattttacatttctgcaggtacgatcttagctctttttgttctttcatgttcattattctttttctggatctattgtttccatttttaaatttccggttgatttttttatcttgttcgatgtgattctattttgtggagggatgttattagctttaagatctgtgtgagctgcgtttttgaatgtgaatcttcctttttattcgattttgattgttaccgtttgaatttttagtctgcttaggagtcggattttgttgattttgacttcttctttatatcctttaattgttgcaaaattcggaaattttgttacgagctggggattttttccacttccttgagattgttttagggtgaatctgaacaaagacaaattcgatcattgctgattgctttgttgccgttcctcaattccatgtatctggctcttacgattgtgtaattgaaatgagattatgatgaagaatgattcgtttgtttctttttgttctatctatacatttgtggtgatatatatatatatctttgtttgaaacgttaatagataagctgctcatactagttatacaacagactccatagaaggtgacatttgtttaagatactcttgttcctggaacacatacgaagatg

SEQ ID NO: 29879 - DNA, 3000 bp, Unknown; identical to SEQ ID NO: 11918
  misc_feature (1)..( 3000): 2750-1469P.txt file - cDNA_ID_3023371; gDNA_ID_2214522; Annot_ID_184654

SEQ ID NO: 29880 - DNA, 3000 bp, Unknown; identical to SEQ ID NO: 11917
  misc_feature (1)..( 3000): 2750-1469P.txt file - cDNA_ID_3023374; gDNA_ID_2214522; Annot_ID_134089

SEQ ID NO: 29881 - DNA, 3000 bp, Unknown; identical to SEQ ID NO: 11917
  misc_feature (1)..( 3000): 2750-1469P.txt file - cDNA_ID_3023374; gDNA_ID_2214522; Annot_ID_184653

SEQ ID NO: 29882 - DNA, 3000 bp, Unknown; identical to SEQ ID NO: 11913
  misc_feature (1)..( 3000): 2750-1469P.txt file - cDNA_ID_3023382; gDNA_ID_2214522; Annot_ID_184647

SEQ ID NO: 29883 - DNA, 3003 bp, Unknown; identical to SEQ ID NO: 26195
  misc_feature (1)..( 3003): 2750-1469P.txt file - cDNA_ID_3023398; gDNA_ID_2214523; Annot_ID_184687

SEQ ID NO: 29884 - DNA, 3003 bp, Unknown; identical to SEQ ID NO: 25728
  misc_feature (1)..( 3003): 2750-1469P.txt file - cDNA_ID_3023417; gDNA_ID_2214523; Annot_ID_184675

SEQ ID NO: 29885 - DNA, 3003 bp, Unknown
  misc_feature (1)..( 3003): 2750-1469P.txt file - cDNA_ID_3023421; gDNA_ID_2214523; Annot_ID_184674
actgatccaattctctttgatactgcatatgtttctttttaactgattttataatctgtgctcttgtgcagtatctgaagaactttcagttcaggcaattcccagtagtggagagatttgctcttattatagcgcttatcatcgtgtgggcttacgcgcatgtcttgaccgccagtggggcttacaaacaccgaccacaccagacacaattaaactgcagaacggatatgtctaacctcatttcatctgctccttggttagttagttcatattctctagatataataaaaaaacattcaatagttgatagtgttttcatatatttatgcttctcttgacttattttaggatcaagattccttatccacttcaatggggagcacctagctttgatgctggtcatgcttttgctatgatggccgctgttttagtctcactcattgaggtaataatgtctctctgtatcagattattactcttgtctcagcatagaatgttctaaaagaattgaaatgtgattagtcaactggagctttcaaagctgctgcacgactggctagcgctacgcctcctccacctcatgttcttagccgtggaataggctggcaaggcattgggatcctcttaaacggtttatttggaacactaagcggttcaagtgtctctgtgtaagtgtaattgtgaatgttttcaaagcattttctccattagttggacaagttagtctcattgatttcttgattgttacaaattctgcagagagaacattggattactaggaagcaccagagttggaagccgcagagttatccaaatctcagcaggatttatgatattcttctcaatgctaggcaaattcggggcattgttcgcttcaatacctttcacgatatttgcagctgtgtactgcgtcttgtttggtcttgttgcttcagttggactctcttttctgcaattcacaaacatgaactctctgagaaatctcttcatcgtcggtgtgtctctcttcttaggattatcgatccccgaatacttcagagatttcagcatgaaagcattacacggcccagctcacaccaatgctggttggttcaatgatttcttgaacacaatcttcttatcttcaccaatggtcgcactgatggtggcagtgttcttggacaacactctggactataaagagaccgcgagagacagaggattgccttggtgggctaagttcagaactttcaaaggagatagcaggaatgaggaattctacactctccctttcaacctcaaccgtttcttccctccttcatagaaagttttactctctttttttttactcagaattgtgttgtttgtgtgtgatttatataatcaccccaagtattatttaatctataagaatcattcttttttctttatctaatggataaccaccacccattaggatcaccataaagatcatattttggagcattccaatatcataacactttactcttaagggtctaatttgagttggtggcaacatgtcatatagacttcagagctgcttccaaaatgggtttccaatctacaccatttattacagattcatttttgcttttcgtatttggttagtttaggagtttagtttttactttttttagattcaggaagtctttaatgggtttcaccggtttagtaggttcacctttatcggccaacaagaattacatttctctctatttatgacgactgccaccaataattcaaaacaagtttacatattaagttttcttaaactactcctatatattaagtctaagattatattaatcttatttatataatttaattcaactaaatttttagtttgtttatttacatgatataccatggtcctgttattttagctaaagtatatattaaatttattacttttttatttcaaagattttttctattgttttttattttgttttcttttcatttaagcttatattattattattatacacacacatttaaggtttatatttatatttcttgcaatgcaaacatgtgtcaatattagttgatttaagatacaaaaatattaaggactaaatggttgagataatactactttgatatatatatatatatatatataactatattctataaacttaatttatttgagagggtaaggattagatgaccaagaaattggtaaaaattggaaaaataattatagacattattattttacaagatattctcaaatggctagagatttgtgaagttctgttttttttttcctcaaagttcaagtgtaatatttttcgatgacaatgattattccaaatttatttttttgttaatcgtaaacagtgaattttgcataattggtttgaattagagttgataatagttgttctcatcatcaccaaacattcttctgcttaccaaaagtaagggactttcattagcaaaaacaaaaatcatacacaaatgggttttggttgtactgtccaaaatggaacacacagttttatagaaagacaaaactgaaacggcaagtgagagttaaagtaaaaggaaattgcaatcgagagccagctgagatttttagatattttgcaggtaactcttaacgccgagcatacatacgtttctcaaagacataaagctgattgtgtttctccatttgctgaaagatctgagccataaagctgaaatagaaaccttttttgtgttttgttgttccccagattctctgacgctgcttaaaccttaaagttcgtagctttttcttgctagtgggtcttttgaggtggatctggattctgggtaaggttttgttttttatatctttaccagtaaattgaagttcttatggtttcaagaaattttacagggttttcaattattggaatgttgtttctgttggctctttatctgaatacaatcttactaagaggttacggatcttggactttgtaggaacttgagcaaaagccatcctcttttgttgtatatatgaattaaatg

SEQ ID NO: 29886 - DNA, 3000 bp, Unknown; identical to SEQ ID NO: 11958
  misc_feature (1)..( 3000): 2750-1469P.txt file - cDNA_ID_3023447; gDNA_ID_2214524; Annot_ID_184712

SEQ ID NO: 29887 - DNA, 3000 bp, Unknown; identical to SEQ ID NO: 11966
  misc_feature (1)..( 3000): 2750-1469P.txt file - cDNA_ID_3023451; gDNA_ID_2214524; Annot_ID_184708

SEQ ID NO: 29888 - DNA, 3003 bp, Unknown
  misc_feature (1)..( 3003): 2750-1469P.txt file - cDNA_ID_3023459; gDNA_ID_2214524; Annot_ID_184706
tcattagcaaaaccaaactcatttacatacaaacatagaagattgaaacgtatacatttttgccttccctatattatctttttatcttataatcccatttataaccacacaataacagttacccctaacatagaaatttattttcccttttttgacattgtggctatggtacattcaccaaataccgatgccttagcccctagacctataaattatcacaatccagaagagaagaatcgtatccaaaaaagcaaagtatagatctgaaattcgtagattcaacctcctgtagtcacttgcatccatcacatatcataaggtatgaccttccatacccaaactccaatctttagggtaaaatcatttgcttttgcttcgatctcttatgtctcaaacaacgatgtgtttcttaataaatttcttctatatatttaatccaatatcgtttggttcctctttggtgacctagcctttgattccgacattcctgttaccactcaccatatgtatcctaacaagttattgttgtgttatgtggcctttagtgttgactgttgagaaataagatctctatgtgaaagcagaaagatggtttgtgcattttaacatttttttattcacttgacccagtaacttttccaaaattcagtatagtccttttaagtctaatgataaaacaccaaaaattttaagttttctttttaactccgttattcataaattgtcagcaacttttaaactttggacacaaattccaagttactaaagctatagatctcaaaactctatctaattagttttaattttgatgctgattaaaattttataatttttttgtcaacaaattcaataaaaaagatttcttaaatctttaatgcgacaaccactattaacaaaaaaaaaatacttcaatatttgtttgattcaaatatttccaataaaaatatatatggtcagccattaattaggcgtttactcctaaaagttttaggatttttctaaaaagtattttgtaatatatttggaaaaacatttttttctgtattttacatggaaatagactgttttcttttagtgacatgttttatactatactgaatttgttggtaaaaatatatatatatttaagatatttttggtgaaatgatatattgccattcaacccaagttaaagtttaaccaaccaatatataatttcaatgaattttaagtattaaaaataattgttactgtgtgtaaccttgaatttgctttaagaagaaaccaaaacagtgttaaaaaaagcttctcctttactactatgttaggtaacttttttttcttcgtaacaaattttcgctgacatttaaattactttgtttttttctcacaattatttttcttaatataaaagtactttattttgaaaaaaacgaaagaataaaaatgccaaactgatccatttttaaaaattgtaactattttttattttatttttttaatcacatcgctaacataacctgcacataattttcctttcttatagtattatatttttttttatcttataagtcaatttataaaccacacataaaaataattatccctattccctagcatagaaacaattgttactgtgttaaaaccttgaatttgcttttaaaagaaaccaaaacagtattcaaaaatgcttctgatcctttactatgtcaagtaacttttttttttttcaagtaactttttttcttccgaataatttttttctcataattatttattattaatataaaagtattttattttgaaaaaaaagagagagaataatactgccaaactgacccaatttttaaaatccaaactaaatttatgtgtaactatttgtttgtttgctttttattttggaaagctaacataaccatatatacatacatagataaatatacctaatcatatttttccaatcctatagtattatttttatcttataattcaatttataaaccacacataaaaataattatccctattccctagcatagaaaatattttatcttccatattttcgacattttggccatggtacatgcccaaataccgatgccatcgaccaataaaatcttcattcataatccagaagaagataagaatcacacatatagtaattcttttctccttttataatacaaatctcaaaattcatagattcaaaaaccaaatcctctcttaatttgcatcgcaccaccacagatcaaatcacaaaggtgtgtgacccttccatgcccaaaatccaaatctttaggtttaaaaaaaaaacatttgcttcttattatatgtcacatacatgatgtgtttcgtgttcccactttataactctctttttttttttcgttggttcttcttccgtgacctagcctttgattccgccatgtctgtttccatatcctaagtcctaacaagttattgtgttacctgaccttctctcatagttattaaaaacccaaatgttaaagtttttgttttgtggcagcattttaacatttttggtcacctccacctgggtttgttgattggtcatgttattgatcttcaatttggtatctttggaccaacttttttttttcttatatatatctgtataattcaatattgggttctttctaatgtagggtttagatcaattcttcatttcttggtgttgattttgttttgtggaattcagggttttagctaattgttcttccccagttaggagttttacttcttaagatctgaattgtttagattagtaattctgattagtaccaacaatgtcatgtaatataattgacttcgtatgtctgaaaatgccttattagaaatttcttatggtgaatgttagaaatttgattaggataggaaagcaatttatattgactattgtttttgtattcccctgttcttattgcagaattgtgtgtttgtatcaaatcctgggtttaaagaagtgaaatatcttctaagtggtgatttatggaagttaaaatg

SEQ ID NO: 29889 - DNA, 3000 bp, Unknown; identical to SEQ ID NO: 11957
  misc_feature (1)..( 3000): 2750-1469P.txt file - cDNA_ID_3023463; gDNA_ID_2214524; Annot_ID_184705

SEQ ID NO: 29890 - DNA, 3000 bp, Unknown; identical to SEQ ID NO: 11956
  misc_feature (1)..( 3000): 2750-1469P.txt file - cDNA_ID_3023474; gDNA_ID_2214524; Annot_ID_184702

SEQ ID NO: 29891 - DNA, 3003 bp, Unknown; identical to SEQ ID NO: 25742
  misc_feature (1)..( 3003): 2750-1469P.txt file - cDNA_ID_3023547; gDNA_ID_2214526; Annot_ID_184760

SEQ ID NO: 29892 - DNA, 3003 bp, Unknown; identical to SEQ ID NO: 17247
  misc_feature (1)..( 3003): 2750-1469P.txt file - cDNA_ID_3023557; gDNA_ID_2214526; Annot_ID_184748

SEQ ID NO: 29893 - DNA, 3003 bp, Unknown
  misc_feature (1)..( 3003): 2750-1469P.txt file - cDNA_ID_3023565; gDNA_ID_2214526; Annot_ID_184761
gtttatcatgatgccgattgcgcatctggttgaactgacatataaagtgttgggaccatatgggatgacagtaccacaactaacaccttcaagagttaggcttctctcatgcagcagaactttcgattccacgaaagcaaaggatcgactaggctatgctcctgtggtcccacttcaggttatacaatatttgatttgaaagagagagatatttgaagcctttattgttctttatatattgcatgcatgccttgatgatcctgcaggaaggtatacggaggacgatagactcattctctcacctaacagctggaagtcaatccaaaagagagggcccatccaaggcttctaggattcttggaggcggaaagggtatgaccatatatttcaattagcatgcttgtcctctcagctgatcgtctctcacatgataagcacccaatgtttatttttaaaattcactggatatttttctttttattaaaatcttgagtcagcgtcaacatctgcacgctctcctgagaatgattgtgttcagtggctagctaccatattaatgtgaagaggcataggatgttagtagaactagacatattttcaaatctaccctggtcttgattcacttgttctgacatgattttgcagttgctgatacacttctctggaaggatttaaagcagactcttattgccatattcattctaattagtatctattataactttgttgcaactgggtctaccgtcgtaactgctctttcgaaggctctattggtagcatctgtatttttgttcctccatggcattctaccagagaaaatgtaagattcctgagatgccaacttttgatagattttcatttatgtgcaatatgaactaccttaacctagttctctaataatggaaaccagaaggtatatgccaaacatttttgaaacactgtgtatcgtactcttcaatcaggaacaagtaatataagcaattgctgtctatttcagtttacgaacaactgaatatagatgcttattttgcagatttggttatacagttgaaaagattcctgcatcgcaatttcacctctcaaaagactcatcacatgacctctcattgtcagtgatctcttcatggaacaccactgtaaaagctttaagatctctttgccaggggaatgattggagcttctttttcaaggtatttttccttgaactagttattgctggcaagttccagtcgtacgatatcttatcccaacctgaaacagaaatagggacaaaattcgattgctgaagttctctttggtaataatattgtaacaccgctttggtgtttttaatgtcataggtggtcttcgttttgttagcattgagtttggctggagccatatctcttcacagcatatttgttataggtacacactcactctctatctagttttactacatgccaacgctacggttgtatgaattatagttcttcaacaataactggttttgttgttctgtttttgttcaacaggactgcccattgccttccttgcttttctcgtgtacgaaaagaaagagcaagagatcgactcaatagtggtgagttttaaatctttcgcatgcaagcacaaatccgatgtgtatgagaaattgttcggaagcaagaaacatgactaaaaaccctttttttgcccagcatttgtaattttcttttgtttccaacgacctctaactctggtttgagcttttttcaagttttattatttgtgaatctcttttttactcatttctattggtctttgtttacatgcttggagaaaaatggatgttgagagatgccctattaagccacaacttttgtcctctaacatgaaagtaagcattgaaaaatcgaatgaatttgtgaaaaaaagaaaggagagaagaaagattcgcaaggttgattcctaaagcacatgtccttagtcccgtgcctttgaatatagaatcaattgatagattatcaaaccacaaaacaactctaatattgaatttaatgacaaaatattagtaaagaccaactttatgaagtggcagcctttttatctacttgttgtaagtctatttctcgaattttcctttccaaatatccaaaatgtaattaatgtaaattgagttaactatattccaatatcattaaaatcatagagacgaatttcataacgaataaagaaaaaattttaagcttcaattttattgttaatattttgttgtacacatgttaaagcgaataatttagcatatgaaattcttacagaaccacgttatattacatatgtaaacaacatatctccgaagtagttcttttgagtttaatttaaagttgttaaaaaataaagattatctgaaaataaataataatacaaaaaattataaaaataaatagaaatgtttaactggatcccatccatctaaaaacagaagcttacaaattaaaatttgtattatcactccacttttattaaaaagccaaaattacaagacttgttataattacaagagttttggtgtaagtaattaataaaaagaagtcgggtcgggtcgggtcaagcccaactatttttgaatcacaagagttatctctcagtctcactagtcacttgcaaagaagcgttgtgtgagagttttgaatagaaagagtagttgtctctcattccccaaatttggaatcacgccgataaagccaaaattagccccacgaaaaagctccgacaaccaaagtaaccatctttttccgaggattcatcacttaaagcaccattttgtccacaatcactcaaccctaaaatctttttctcctttgaatccttttcatgcttcttcttacattccccgatttctttttcctctgagaaagtgatttccttttgattttgattcttttttagtctttctgcaatgattccgtattttgaattaaggatttataaaaaagcagagattggagcttggtttgttgtctatcatcaactatcacaatg

SEQ ID NO: 29894 - DNA, 3003 bp, Unknown
  misc_feature (1)..( 3003): 2750-1469P.txt file - cDNA_ID_3023585; gDNA_ID_2214526; Annot_ID_184766
tctatattgttgaacagttattgcatgatggaacaaaggagtttgctcaaaatgaaacagattctgctaaatatatgttatcttctgaaagtattgtaagtggttagattcataggtcacttgagctgtctttgttagagttttgagtcttgtgagtaccttgtcttatggtagtcaacttattatcgtaatatcaggcaattggggagaaactatctgagattggtggtaggttagactatccacgtcttaccaaggacatcgctgagggaatagaaacactatggaaggatcctgcaattcaggtgtgtttgtgtgtgtgtgtgcacgttttatttactattgcactcaaagttgaatacatgatttaaacgtttcattttgtaggaaacttgtgctcgtggtaatgagcttcaggttcctgattgtacgaaatatctgatggagaacttgaagagactatcagatataaattatattccaactaaggtataaccaaagtatcattctttgttgaaaacatttcaagtaatgatcttaaaatggttgaataaaactcattggatcagcctcggaggatcaatgtattaacaaacagaagccttttgctttccatattagcctagttgagctagcattttcagagaccagagtcaatatgcaatttctgtgacatgtgtcttccggaatgtgttgtcattggtgcattttttctatgttggtgtttcaggaggatgtactttatgcaagagttcgcacaactggtgtcgtggaaatacagttcaggtaccaactactttttgttttaccctttttcctgtttgattgttagtctttcatagatgagtaattgtttgataagctctaagtgttagtctggttcactaggcaatatgattagctaggcggtttgtagtagctgtgttaacagctcagcaacaatcttgttaatgtagtctctctgcgatgtgtaagttatttggtgaaatgaataaaagtgtttacggattcgattcctatgattgccactaagatgtactaatagaacatatgaattccataccaatatcaaacttgttgttgtggtgaatctacttgtaatgatccgttaccaaagatgaattcacaaatggtatatgagataaagcttcgtttatgcagccctgtgggagagaataaaaaaagtggtgaagtgtaccgattgtttgacgtgggtggacagagaaatgagaggaggaaatggattcatctgtttgaaggtgtaacagctgtgatattttgtgctgccatcagcgagtaagctcacttcattataaattataagatatcctcgtactgtccacatattgccaaaacattaactgagttttgatcataggtacgaccaaacgctctttgaggacgagcagaaaaacaggatgatggagaccaaggaattattcgactgggtcctgaaacaaccctgttttgaggtttttagttacatttttatctcatcttttaaaaatttaaagacactcttgagatgggtttggttacaaaaacttggttctctttacgcagaaaacatccttcatgctgttcttgaacaagttcgacatatttgagaagaaagttcttgacgtaagaagaactaaagcatatttatttgttttgataggcaagcaagtctttttgttcaataacgctttcttattcaatgtgcataggttccgttgaacgtttgcgagtggttcagagattaccaaccagtttcaagtgggaaacaagagattgagcatgcatacgagtaagcttgtctccaaactttactgattcccgccaaactgttaccgttatatgaccttatttttaatttggattcaggtttgtgaagaagaagtttgaggagttatattaccagaacacggcgccggatagagtggacagggtattcaaaatctacaggacgacggctttggaccagaagcttgtaaagaaaacgttcaagctcgtagatgagacactaagaaggagaaatttactggaggctggccttttatgaccttattattacatatctctagtaaattacctctccttattattataagaaaaactcgaaaactgaatgaccgtgtaatttatctttcgggacaaaagacttagcgattcaaaatctaatgtgtctcgatggctacgactagtttctattttatcattgtttttgttaacattcctctgtctttgacttcttatttttttttctcatcaaaaacatctcattttgatcttgtttttggggttatattattattaaaatgaggcatccacatcccgaaatctagaaagtgaaacacaacacaaaacgtaactttatcagtactaaaaagttttggaatgttcctaacatgaaaaagttcttacattaaaaaaaagtatgggggtgaaactgaacaaatacaaaatatgatgtaaaaactgaaataaaagtaaaacacatggggtctaccgtgatttcagaacattcgaaaaagcgactttaaaaataattgcaccgaagaaagaagaaccctgaaagcaaaaaactcttcgccgttgttgtttcttacgtcaaagaatattccttcttctctttcgttaatagatcccaaaaaaaaaaaaaagcttcattgattcttcttcctctgtttttgattccgttttcgagcaatcctctgaaacatgtatgttgttgttctctctttcttccaatggtgttctgattttgctttttctgttatacgataatgataacaatcgcttcttagtttgattaatacgaaactctcaaagatcacgaaattggttttgttagggaaccatttagatcaaggcttgtttgtgattgttgttgttgattcagctttgatttgattcgttagccattgattttgatttgagaatttgtctttgtttgatttttcttgcagaatctttggtacaattggagttatattcaaaagcttataaatgtcaaatatg

SEQ ID NO: 29895 - DNA, 3003 bp, Unknown; identical to SEQ ID NO: 25754
  misc_feature (1)..( 3003): 2750-1469P.txt file - cDNA_ID_3023613; gDNA_ID_2214527; Annot_ID_184802

SEQ ID NO: 29896 - DNA, 3003 bp, Unknown; identical to SEQ ID NO: 25755
  misc_feature (1)..( 3003): 2750-1469P.txt file - cDNA_ID_3023617; gDNA_ID_2214527; Annot_ID_184801

SEQ ID NO: 29897 - DNA, 3003 bp, Unknown; identical to SEQ ID NO: 26202
  misc_feature (1)..( 3003): 2750-1469P.txt file - cDNA_ID_3023632; gDNA_ID_2214527; Annot_ID_184790

SEQ ID NO: 29898 - DNA, 3000 bp, Unknown; identical to SEQ ID NO: 12004
  misc_feature (1)..( 3000): 2750-1469P.txt file - cDNA_ID_3023636; gDNA_ID_2214527; Annot_ID_184784

SEQ ID NO: 29899 - DNA, 3000 bp, Unknown; identical to SEQ ID NO: 11995
  misc_feature (1)..( 3000): 2750-1469P.txt file - cDNA_ID_3023640; gDNA_ID_2214527; Annot_ID_184783

SEQ ID NO: 29900 - DNA, 3003 bp, Unknown
  misc_feature (1)..( 3003): 2750-1469P.txt file - cDNA_ID_3023644; gDNA_ID_2214527; Annot_ID_184782
agacttaaattgaatattatatttctaaatagattatttctgtaaaaataaaccctaaaatatatttatcaaatcttttaagattttaaactttcttatattttctatttgatcatttcatattaacgcgattaattaaaatatgttttgtgacttcaaatattttggttttatttaaattcttgctttgtatttatgtgattaacttagtagtctctttaaatagataaaataatcctcagaactataatatttaaaatctagtgacaaaagttttctttattaatactatacttttccaatttttagatttttaaagatatttttaaaaaatttgaaagaaaaaaggttgaatgttctatttcttacaagttacaaattaaatatacacaacacaatatataccaatgtcccagttatcttcccaacaattatttcaaaagtataacgttatacactaatactaacaatgatgcttaatcagacagtgatcttcttccttctttgggtgatcatagcacttgtagtcgaaattactttggccggaaagatcacagtttctgatatccatgagcagaaaatcgaacaacggttgaaccaactcaacaaacccgccgttaaatctatccatgtattcgcaacgacttttaattacccgtggtttgctattcccactattttcttggctaaatgcttttatgttttcctttaatatttatattgaatagagtccagatggagatataatcgattgtgtatggatctatcaccaaccagcttttgatcatcctttactcaaaaaccacaccattcaggtttttttgtaatacttttttttattcactcttcaaaatcatattacctctacgttttgccctaacgcttcttgtttttttcgaggaagatgaggccgaaaagtgactcgacaagggacaaaactggaggtaacaagacagacattatccatcaattgtggcgcacgaaaggtgaatgtcctaagaacactattcccatcagaagaagaacaagagatgatcttctaagatcagattccatcaaaactcatggaagaaagaacccaccaaccatttctccaactacttatcacctccccgatgatcagacagaagttcatgaggtatctatatccccggctcaaagttttttttttaaaagtgattaaatatttttgacgctttaatttttataattttgagttaaactattaagagctacccttaactattataccttactttaattgtagcatgcgagtgtgtacctggactatggtgaataccatggcagcaagagccgtataagtatatggagaccagacgttaatatgaccgagtttagtttggctcaaacatgggtcgtcggtggagattgggacactgttttgaacactgtggagtctggttggcaggtcagtgctatttttttttttttaggctaacacttctctttttgtgtgtggggcttttttttgtaaaaaaaaatggatctcaattaggatatatgtgttgcattgttgcaaaatttactgattttataaactcaatttgaatcgataataattggatactcagatataccacattatgcattcagaagttctactatttctaacttcagtttttttttaactctttatgatagatcctacattctatgtacggtgacaataatacaagacttttcgccttttggacggcaagtttcccttttttattaatcttaactaagattgtcatgcattgactaagggttaattactaatattttctgacaaaacatatagagcgattcatatggagacaacagctgctacaatcttgactgtccaggctttgttcaagtgaataaagatattgcccttggtgcagccctcaacactatctcgacctacaatggtaaccaatatgatttccttctaactattgagaaggtataatttatctacaagtactgaacaaacacaacttatagcagtttcaaaaagagtgtcatcactaaattgagctactatacctattttaggaacaagataccggactttggtggcttaagtttgatactcatctagtcggatactggccaagctttctagtcccgaagctagcagactcagcacggatgatcgcttggggaggtgaaattgtgtatgatgctagtggccaaaatgaacatacgcttacgcaaatggggagtggccatttcgcggaagaagggtttaagaaggcggcttatatcaataacatagagtacatcgataaatctaatcatccgatcaaaccctttcctcaaaatcttgaagcttctgttactcggcctgaatgctataacctcaaggttggctctagccgaagatggggaacttacattttctatggtggacctggacgtaaccctcaatgcctatgaaaagtgacatgatttttcgaaatttatttagaaaatgtttgggacaacccttgtgattgaactgaatagcgttctaaagatgtaaactttttaagactaataaatggttttgcatttgagataaaacaaaaaagatcatatcaatattttaataagcaacacatttttcttgttaggtcataaaacgtaacaagtcggtgtcactaatttacttatcaagtgataccttgcacgatttgtaacttgcagaaaaaaagaagatagaaggatatgataaaattttatgcatatgtagaaaaaaaccttgcacgacaccttccgttagatcgatcagctttgacttatacgtttaaatttgcgtttttgtcattcacagagaagaatatgctttacacttatcctctctttcttatttctatattcttgatgagtaaagtaattgacaccaagatactgcatttctatataacccatgactacaagtttcctctgttttaacaaaaaacgaaaaaaacaaacaagtttcctctgtttaaatatcaatcttcctgtttatgttccgctatcccaaaaatg

SEQ ID NO: 29901 - DNA, 3000 bp, Unknown; identical to SEQ ID NO: 12038
  misc_feature (1)..( 3000): 2750-1469P.txt file - cDNA_ID_3023706; gDNA_ID_2214528; Annot_ID_184849

SEQ ID NO: 29902 - DNA, 3003 bp, Unknown
  misc_feature (1)..( 3003): 2750-1469P.txt file - cDNA_ID_3023710; gDNA_ID_2214528; Annot_ID_184848
tgaagacaagagtgttaaagctggtggtgttattggttcacaggagctaaggaatatgcaagggattgataaactgatggataagcatacgaggtcttccttgtctaatacaagtacatcgtcttctctctggactgatgagtcatcgactgattccagtagaggtctttgtgcttctccttttcgtaaaaagatcaatcaccctcctttgcagtattatctcatgtcttctaagcctggagataattttcaagatttggagccacctcaagataacggtgatacttctcacagtcatagaagagatgggcagtttcatcagacccctcgtgcaactgcggtccaacagaatgagaagaaagatactgatgttaagattgttccaaagacaagaactctctttagtccatcgaagccagatagtccttcttgcacaaggataatatcaaagaatctagccgaggattttaagaagaaaggagagaagttggaagagagaatccgaaatcctcgtgttcatgatctctttggaaaagaaaagcctgctgctgtatttgtaccagggattgtttctcagaaacagtttattggtttgtccaagttctatgattcgaaagtgttactagctgagcgattggcggaaagtaaccgaaaggggttcacagagaggttagcgcatgggaaaactgcagttcttgactctgatgtaggtcctttccgacgtgaagctgatggaggaagtaagccattcttaaaacgtatcagcttcttatcagaaagatcatgttcagctccacgatcaagaaaggctgaatctagtccctctagaagcaggactctagatagaaggtcaacagaaacattacctaaacagtcagatcagaaaccagctaaagtcttatcagaaagagctaggagcatttcaccatttcgccgactcagcttcagcattggaaagtccagtaaaaactccaacaccgaagatgctaagactcctccacacttaagcacagcacttatttcatcacgagctggtttagacaatccatctgcctcttctttcagtgacagctcttcttttgataaaaccagtgcagcaaacagaggcaggtctagtccattgagaaggttactcgatcctttaataaaaccaaaatcaagccactcatgtagatctcctgagccatcactaaaggaagcaccttcaagtcaaccatcttcgtcatcctttctgtcgagaaatggaaaatcttcaactgttcaggctctatttcgtgtgacatctaagaatgatcaaccactcttcacttttgcggttgaaaaggaacaaagtattacagcagctacaataagaaaacagactctcccagagaaggaagactatggacacaagtatacttttttcactgttcaagaagtacagaagaaaaatgcaaaatggatgaacaacagcaggaaagtccaaagccaagagtacacatccaacattgtcgctcagatgagagtctcagatcctaagcctctatttctcgctggagaaagatctgcggaaaacctcttaactagagagtttgtacttgttgcatctgaatcgcagcggactaacgagctagctgccatggtgatcaagataccaaaacttacagacacaacaagctcaaccactcttggagattactttgcagaggttaacgcaacagtggtacttccaagtggagttcacagtctcccgcacaaaggagggccgtcatcactgatccaacgatggaaatcagatggatcatgtgactgtggaggctgggacacgggatgtaaccttagaatcctcacaaatcagcataataaacccataaacccttctccaaccacttcagatgccttcaagcttttctttcaggtttgttatataacatctcaaaactctgaatactaagaccaacctttggcttaaattatgaatctcactaatgtgagttttgttgcagggaggagtacaggagaataacaaccaaccatacttgagtttcactacatacagagaaggtgtttacgcggttgagtacaatacatcgctctcactcttgcaagcattctccatttgtatagcggttaacgagggacgaaatccgttaataaagaccaccgtggaacccaacacttcacgtgtagagaagaaagcttatggaggagagatgtcatcgattcaaaacgagaatttgaagtcattttcaggtcctattgaagctgaggctccggctaggtatctctcacaccacccacctttgtctcctgttgggagggtttagttgcttcttcaaataatcttgttatatatatttttttcttttcttttctcttctgatggggttcgtattttctgtgtaattacggcgtggaagtagattacgttaaatagagaaatttgtgaaacttgttgtaatcgaatatccacatttaagctaataaaaactcttatgttcttgacttctttcttcttcaattacaattaccatgatcatgtaacataaactctgtcgtgttagttgttactttagtagtttagttagcattgttaaaaccataaaatgcaaacattaagcaaaaaaaaaaaagaggaaaaagatggtgctgcccaggatcgaactggagaccttttgcgtgtaaggcaaacgtgataaccactacaccacagcaccttgctgttcaagattatcatttaattctatataaagtttagaatacagaattggctttggtttgcgtagattgcacaaaaaggtgagtcctttctccgacaacgcaaagactcatttgaatcggttccttcaaaattattgatttgggaatatattcttgtcaattcaggtgaatcaaactggtcggtgcaattcaagattgccctcgtatttgtgtcggggaatgaaactgttctgtctttcttacaaaagcagttgcatttgatcttgctgcagagattaatgttcattctcaatcttaaccatg

SEQ ID NO: 29903 - DNA, 3000 bp, Unknown; identical to SEQ ID NO: 12030
  misc_feature (1)..( 3000): 2750-1469P.txt file - cDNA_ID_3023716; gDNA_ID_2214528; Annot_ID_184836

SEQ ID NO: 29904 - DNA, 3003 bp, Unknown; identical to SEQ ID NO: 16046
  misc_feature (1)..( 3003): 2750-1469P.txt file - cDNA_ID_3023719; gDNA_ID_2214528; Annot_ID_184832

SEQ ID NO: 29905 - DNA, 3003 bp, Unknown; identical to SEQ ID NO: 26209
  misc_feature (1)..( 3003): 2750-1469P.txt file - cDNA_ID_3023723; gDNA_ID_2214528; Annot_ID_184831

SEQ ID NO: 29906 - DNA, 3003 bp, Unknown
  misc_feature (1)..( 3003): 2750-1469P.txt file - cDNA_ID_3023727; gDNA_ID_2214528; Annot_ID_184830
agcagaagttcacacttgcgctcggaatgagtacgagctggagaattgtttgagtgattggaaccgttctggttttcgagttgctggatccgtttgcgatgtctctgatcgatctcagagagaggctttgatggagaccgtgtcatctgtgtttgaagggaagcttcatatccttgtaaggtttaatgccattgcttagagataatgcacataaagtgtttgttaatttgtctgtgagaacaattgtaaataaataactttactttcttgtgtaattatgatgcttttaggtaaacaatgttgggacgaacattaggaaaccaatggtagagtttactgctggagaattttcgactctgatgtctacgaatttcgaatcggttttccatttatgtcaacttgcttatccattgcttagagaatctaaagctggaagtgttgtgttcatctcttctgtttctggttttgtttccctcaagaatatgtcggtccaatcttcaaccaaaggtaggtatttgttcttatgcagcattcattcatttattcaggttttaccaagatgtattagattctttaacgagcaggcgatggataaactttggttcttttcgttggcctttgtgttttaggagcaattaatcaacttacgagaagtctggcttgcgagtgggccaaagacaatataaggatcaatgctgttgccccgtggtatatcaaaacatctatggtggagcaagtatgggtttaaaagccttattatctattatgcggttaaatataagctcttgaggctgaaaatcaaaatgagaaagactaagctaatttgtgtgttccttgtttaagatggggttgtttaatggttctcgtcttttggtctcaggtccttagcaacaaagagtacctagaagaagtctactcagtaactcctcttggtcgacttggcgaaccgagagaggtgtcttctgcagtggcttttttatgcctacctgcatcatcatatattacagggcagattctttgtgttgatggtggaatgtcaataaacggtttcttcccacgacatgattaggccactctattgttttactagtttccttgggatcctttttgttttatctttagcatgtctcctttctcccgtgaaagacagttcatcgatatgagatgagaattgaagttgtgctactaagtctactgttaatgaaaaggataatttagcatcagacagcgtgattcagtttcccttgtcttttactgattatcttgattgtgcatgtgggggaaaattgctgaggaaccttttcatgttatgacttttatgaaaacaaaaactttatgtttcttgagttagtattcattagcttgtattctgtgtcatcctttctcggttttggctttcattgtgtcttgaacctgcactcatatccaacaaacaatggttgaggaagagagaagctgcatagaataaacgaggaacctttaatgaattaccgccacctgtgtctcgggtcactcttcttctgcccttgtatttacagcacattaagctctgcttttggttaatatcgctttgtctctgtgtttaataatgtttttggttcgatgtatatatacaggtaagcaatgcaggaaagtgtatagccaaaccgaccacaaaatatgcagtagaagatttctcgttgctgatggctacaaatctggagtcagctttccatctctcacagctcgccaatcctttgttgaaagcttcaggttcagggagcattgtccttacgtcctctgttgatggggttgtccatctgagagtcggatccatctatggagcaaccgaagctaccgtatatatgtctacatccttaaaacaatgttcccttgcgttatgatgctttcgtaacatatagatgcgtttcaggagccatgaatcaactggctagaaacttagcttgcaaatgggcgagtgacaacataagggcgctctgtttgtccttggttcattaaaactcctttaactaataatgtacggcgaaaagtaaaaagtctccttattattatgaaaatatatctatatcataacttcccaattttgatttgtatgaaatgtttcagtttctcaatgataaagatgcaaaagaaaaggtggagagtaggccaccgatgggtcgtgttggaggtgccattgtcaacgttttttccttcaagactctgccttaaaatacatatatgcatgtgtttggattatattttcctgcgtaataattaagaaatgtactttagataagttcctatctaaagtcgcttgtgatgccaaagggattgggtcccccttcttcttcttgttattctctatgttttgtttcctgaaatatttatgcttgtggtgaacgagagttcaatatctgaattcattatctactttggccaacgcctaatggtatcatttggtgtctcaacatgtgatggagtgtctaatttggtttgaaatcccaaaattcaatatccatgggtattctctagtaatttataaaagaactttggtccaaatcctacaagtggtcatatactgacataccacatagtggaagaactagctagctgggtttgaaataaactcaagataagacaagtggtcagaattgatgttgagagatttttttcctcagcatgggtgtcaaatgagggtccatcaaagtatgcagatgtcactaagggtttccatttagagtaatgagacatgaaatagtgggttttgggttttgagtatttgggttttgagtaagtattccaatataatatatgttcggataattttgatagctaaaatcattgtccacggtcccaaacgcccactagtttaggtaagatggacagccctagatgtaactatcaggagttgcccaatgtctatcatgtaattgtatcttttcttatttacaaagttgttagtaatctatctttatatacaatttaaagaagctcttgttagttatgtgatagataaagatg

SEQ ID NO: 29907 - DNA, 3003 bp, Unknown
  misc_feature (1)..( 3003): 2750-1469P.txt file - cDNA_ID_3023743; gDNA_ID_2214528; Annot_ID_184823
taatgattttatgaatgaagaatcctaatttgtatataccaagaggttttaaaaagttttaagtttttatttctaatggcatacctatgtaattacttacaaaaaataaggttacatttaaaatgcttatttataatttttgataagtgtgtatgtgagaaggtacggacatcgtgatggtaatctgcttatttataattttaacttgcagtataccacatgtaggcttatattttatttaaactaaaaatttttattgtaaagatgattataaatatatgatattattttatttgattttaaatgtatagtaaactgcgagttgtatatgttttgttgatattatttatattgtttagtgtttaaaattatacacttgtattttgattgttaattttagagtttcacatgtagtataccatcttgtattaatatcgatttaaacccgtcaattctaggattttctatcttgtattaaaaattgaatcacatcatacacataaaaaaatctaatatgttattaattattgtagtatataagattataaatttttaaaataatatgtatgaaattgaatataaatattcaaattatgacccagtattcagtagaaaattttcttaaatctatttttgacccgttataatattttttcatgtattgaacagtttatattagtttttaaaaattcaaattatggcatatgcgaaaaaactctaattatttttttataacgatgatattattttttcgccaaaatagaatcatataaagatgagaggtgaactataataattaataaaaaattaatatgataatttagatatcaaatctaatttgttgattttaattggttacttttttggaaattaataatgtattttgttttttaattaaatttaattaattaaattagtatttgacttaattattaaagagatgaattaatgtactctttaaattttatttctaatggcatacttatgtaattacttacaaaaaataaggttatatttaaaatgtacttcctaaataatatagtaggatttcttaattaggaaaatgacaaaaaaatattatatttacctcttaacttttgagattttatttaaatttatgaaagttttgcttttttttcagcggagatgttaggcgaaacttacattattttcttgtcagcaaagatttggtgaattcgttaattcgatgatgataacgttagtgacggttgcaaaaatgtttctgtttttacggttttttgattcatgtagaggcaaagtttgtttgtaattggaaagaaaaaataaattaaataacgaatcttaaaaagtcttccaagttgatttttttctttactgacataaattttgctttatatatcatacaaatacgtcaaagtccataatttcgatgatggtgatgacaaaagaaaatatgttattatcttttgcatgacatgccctcatatatgaaactgaaacacagagttatgagctcatctatatatacatttttgctgctactttgtgaaataaatactggagttgggatttatttacaacggctgccactggcatttaataattgtttttgataattagaaagaaaatcttctaattaaatatttgacatttaacaatcttcccaaaatctctcaaccttaactacacgattaattactaaaataaaacttctaaaatatttaatatcatttaattactacaaaattatcatttttgatattgcttttctgcatgattataatcatcaaaccgtagagatatttgatagcatttaattactacaaaattacaaaatatttagacaataattcataaacatatcataaataaaatcaacattaataaaataaatgagttttttttagaggacgggttggcgggacgagtttggcaggacgttatttaataacaattgtaaactatacaataaaaatattttatagatagataaaatttacaaacttttatatatattaattaaaaaaataaattgtttccgcggtgtactgcgggttaaaatctagtctaatacaatattagagataactatagtcattgctctcatttttccatttgcatacttatatgttctcaattctcatacctaccttatattgtgtgcccatacaccttccatgcgcacttgttgtccacacaaattacgatcaaacaactgttatatagtttccacccacactttcacctatggtttaagaaacataagttactctaatgtagtaggacgagttgaccaaacctaactccttcattttgttgcaccaacccatatttttaccgagtaatgcacaccccaaaacttataatcatagtcatcttcctttcacgtcccataaggttcacattgattactctaatctatttcactttcaagattaccaccacatgtaacttttccattccttttccacatttatctcttaaacctcaaacactttcaagtttcatcttctctctctcttattaacttcatctaccaaccctacttaacctaaaaccattttcaattgcttaatcagtccacacaatgcacataaatttccgtgaccacactgttcgttttagaagaaaaaaaccacttccaaaattgcatatgtaccaataagataaaatgttttactcattcaaatagacctacgagattaattaagactaggtttgctttgggctaaaactggcccataagctatggcaattgaaaccaatcagattacaaaaaaggcttgtcaagaagatgagaccgaacatgttccaataaatggcaataacgtaattctcaaaacctctgagggtaacaatggaaaaacaaaatgaagtgagtccgatatagctagggctcgttaaaaactcttcaaaatctctgtggaagccccattttcacatctaaatctcacaaatctctctcaagcttcgatctttcttctagagacgagctagtgcttccacaaaccctaaactatg

SEQ ID NO: 29908 - DNA, 3000 bp, Unknown; identical to SEQ ID NO: 12046
  misc_feature (1)..( 3000): 2750-1469P.txt file - cDNA_ID_3023747; gDNA_ID_2214528; Annot_ID_184822

SEQ ID NO: 29909 - DNA, 3003 bp, Unknown
  misc_feature (1)..( 3003): 2750-1469P.txt file - cDNA_ID_3023761; gDNA_ID_2214528; Annot_ID_134197
tcaaatttaatttagttacttgaattttttttttgttaaagagttacttgaaaaattttcggatatcaaaacttcgaaagagaagtaaactttatatcaaatattattttatataaatatgtggcgataccaaagtaagataagtaaataacgagtacagtgatatattatagtaagcagggatgatgtagaggattgggacgtgtacgttggttgtttgaaaacatatgttccaacaaaagagagtcttgagtgaatctaagctttaaggatcttcacagtctcttggaagactctctctttgacactttacccaattattccattcctttcaagcaacataagacaacgatcgttggattcagcttcacttggcaaatctactgttaatctgtctcatctcctttttctctagatatttggtaactttagaattaagatggtgcattcaatgtttaaatttggtgagattactcacttcatttccatttatctcatctgactataagaaaacatcgaacttaattaggaatgtttgaaatgtaagttaagattggtgtcttgctcatagtaggaaaagaatgtaaaaagtaaaaaaaactatatgatttggaaaaatatctaattaataggtggcaagaaggttcttgcgaatttagcttcgagtaaattgttagacgatacttaaaaatcgattacttcaaatgaataacttgcacatagtttgtgatgaaatgaatctaagctataaaaaaaaaattgtgtgttcacgatgagaaaagtatagtaagtacaaataaacaaggcaccaaattcttgaggagtttcgatttctttaaaatatacttttttttggggtttttttacacgtctcgtgaatgtttactaaatttgctaacaaccaaatttagaaattaaaatataagttcagaaagtaactagtaaacaagagatggtattagttaaggctaaagtgatactggtaaatgatgaggaattagaaatttagaaacatggttttactaaaagtaagaaagaacataataatgttggtcgttagttgtagccttgtaggtttaccaacttcaaccctttcctttacttattacatatttttaacatttatgtttgtatccaataaacattaacaagttgtaactacataactttttgttttctgaaagaataaattactttactgtgcttttgtaaatcctcttgagattttttttgagagaaaattatcattactttatttggaaattggttttacgaaaaattgatcatacacaatttactaaccaactcatgattcgatcaataggtatatcacccaaaaaatatattctcttctagtgtttcagcgtgtaagtttagccattataataacgcttgactttgaatttataaaataatgtgattattagtcggtgacaagaataattcaactaatcataagaatggtggcttccaaaaggaccaaaaccatgaataccatacgtatacaaacgaataaattcgatttataaggccgaattcattgggccttataactaatcaaatttacaaaatggataaaataaaattgaaactaaagcccattatatgaatttaaagcctaacaaaatttcattttgccgtccttagaccaacaccgattcgcacgccgactcgtggacttcggagggcaatcatgaccaagcacgatcggagactcaaagatacctttcttaatttaatcgcattactctcattctaaccgttatggacaacattttaaccggaatagttacaaataatgccattaaattgatacatttaaagagagaggtttgactaatgaccaacttttaacctccaaattaggaaataaatacattaaaagatgaacagtgatagtaggtggtaaccaagtaaaaaaaaaacttccattttctgaaaactcacaatgtttaccttttggtatttgattttacttcaaaaaggagcatttataacaaagaaactatactattgcagagagaacatgcaaatcaaatggactttttgtttcagagtttcacaccttttatttatttctgtttttggtgaatcaatctgaatcatatcaaaaacagaaaaacagaaatagtatgattccattaatatctagtcagaaaaaaacacagctggactaaatagcttacattctaaagtttgaatgaaaacagtttgtaacaattcatgttttaagtattaaataccgaaattatgtcatttttaatccaatttaaatgatgaaaaattagattacaattttttttaaaaaaatttcaacaggaagatctttgagtatattttcttataaagaatattaacatttacgtatatatcttctctcgcgaaataagcatatatccaaaattataagtatatataaatagaaaaaataatcatagaatcttgaagtgttgtactttgttaaagctgtgtccttaaacccaaaactgaaacacacacagaagacagaagaactcgaaacagctccaaacgtgtgagtctgagattcctcagctctctctgaaacacaaaagacaatattaaagttttgctctgtttttttttttttaattaatgctttttataatttttcaattccttatgcaatcactaggtcagatcaacaacaacaaccctaataatgattcacagtaaattttttttttaaaattttttttcacaaaaaccctaagggtttcttacatcgccgtcgatttttttcttctaactctctataaaacccagtttcttcttaaagtttcgatttttctatttctcatcatctgatcattgtgtttagggttttttttttttttaattgaaaacgacagtaatacatggagattggattttgagtactagcttaaagttttgatctttgggtttagttttggggtataaaggtgtcatctttaggatttttagcgtaattgattttgggggtttcttgttgtttaggtgatg

SEQ ID NO: 29910 - DNA, 2981 bp, Unknown; identical to SEQ ID NO: 12066
  misc_feature (1)..( 2981): 2750-1469P.txt file - cDNA_ID_3023777; gDNA_ID_2214529; Annot_ID_184882

SEQ ID NO: 29911 - DNA, 3000 bp, Unknown; identical to SEQ ID NO: 12070
  misc_feature (1)..( 3000): 2750-1469P.txt file - cDNA_ID_3023793; gDNA_ID_2214529; Annot_ID_184876

SEQ ID NO: 29912 - DNA, 3000 bp, Unknown; identical to SEQ ID NO: 12088
  misc_feature (1)..( 3000): 2750-1469P.txt file - cDNA_ID_3023822; gDNA_ID_2214530; Annot_ID_184915

SEQ ID NO: 29913 - DNA, 3003 bp, Unknown
  misc_feature (1)..( 3003): 2750-1469P.txt file - cDNA_ID_3023834; gDNA_ID_2214530; Annot_ID_184912
taaaatattatagtatactgatattataggtaattattataggctaaacaatcagaaagtgcctattctgaggaattgaagcgaaggaaagatacggagatagcagtagcgaaagagaaagagagatttataacaataaaaaacgagcaagaggtgatcatggaagaacttcaaagtgcaatggctcagaaagcgatgcttgagagccagatagcaaaatctgatggtacaatggaaaagctaaaccagaagcttgatatagctgtgaagttgttgcaaaagttgagggatgaacgagaggagttgcagacagaacgtgacagagcactcagagaagctgaggagttaaggagtcacgcagaaacctcaaccctacagttgcctcagtacttcacggatttctcattctccgagattgaggaagcaactaatcactttgattcgaccctgaagattggggaaggtggatatggaagcatctacgttggtttactgcgtcatactcaggtggctataaaaatgttgaatcctaacagttcgcaaggccctgtagaatatcaacaggaggtattttcttgacatattattagtgaaatttcttgtttagtttcatcatcattgtttactggtttattgtgcacaaactgctgcctctacgaaaaaggggactttgaaacacagttctactgtagttttgattttatagtgttcgctgtggaggagctttgacttattcttgcggcattgcaggttgatgtcctaagtaaaatgaggcatccaaatatcattacgctaattggagcatgtccagaggggtggagtcttgtctatgagtatcttccgggtggaagccttgaagacaggcttacttgcaaagacaactctccacccttgtcgtggcaaaatcgtgtgcgcattgccactgagatatgtgcagcacttgtctttcttcattctaataaagctcatagcttagtacatggtgatttgaagccggcaaatatcctactcgattccaatctcgttagcaagttaagtgactttgggacctgctcactacttcatcctaacggaagcaaaagtgtgagaactgacgttacaggcacagttgcctatttggatccagaagcttccagtagtggagagctaactcctaagtcagatgtttactcgtttgggattatcttattgcgcttgttgaccgggagacctgccttacggatatcaaatgaagtgaaatatgccctcgataatggaacattgaacgacctcttggaccctttagcaggggactggccctttgttcaggctgagcagcttgctcgcttagcattgagatgctgcgagactgtcagcgagaatcgtccagatcttggaactgaagtgtggagggtacttgaacctatgagggcttctagtggaggatcttcatctttccatcttggccgtaacgagcaccggatagcccctccatacttcatttgccccattttccaggtaactaatctgtatatttgagtatggatttccagtattattatcaatctgagaagacttcgatcacaaagtcattaaaatttgcttatctgaggtctcaaaccgttatgttgcagtctaatggtactcaacccgttcttcctctgctttgttttcaaatatttcaggaagtcatgcaggatccacacgtggctgcagacggtttcacatacgaagcagaggctataagagcgtggctggacagtgagcatgatacttcaccaatgaccaatgtcaagctttctcacaccagcctaatagctaaccatgctcttcgttctgcgattcaagagtggcttcaacatcatttgtgaaaataaaatccttcaaaccctcaatccctgttctcttatgaaaaaacgtttttgccttttctgcgggaggcaacagagtaagtgagtaagattagtgttttcagtcttccttatacatatacatacgatctaatcatggatagcagcatatttgtttactttttcaagcatagtgtaagtcctccatatcagtcatatatgaaaagaagaagctggtgagatttgtatgtggatatgtatatatatatatatatatatatatatatatatatgttctgtatgaaaaaaaaagttatatgcttattcggtttgtgtgagaagaactgccactattttgttcttccattatgttcggctctcttaagaacaaagattagcctctaattattggacatgatctcactgatgatgcctttgcttagctaaaattaggatgagtcttacatttttagtcaagactatcgtgtaagacttgttttccacctggaagaagttaccttggattgcctatagtgatttttaatgaactcttaaaattcttgtgattaatcttacttaattagcagtggggtcaggtcgttttggcggctagtggcataactgtataaaaattcaggattgcactgaggtaagccaacctaacgcagcctttaaagacaccaacctggaaaatgctgagagtattcttcaggattttctcaaaagtcttgtgaaattcgtgtatttgtgtcaatatgtcgacatttctcttcatacacagatactgtcgcttttgattcctggtttggcttgttgaaagtcaaaaagccttcattattttaatacatgattcagcttctgcgttaaggctaggtttcgtcattggtaccgtggttgacttcgtgtgcatgttataacataagaaaatgttcttgcttgttgattgctccctctgttagataagtcatctcttttctcgtattgcaaattttaagtttgttcttgtttattctcttgagtgaattagaggtatgttttgagtgttctcatatggagtgtgttggagataggagcttcgatccaagcaaaggggaaaagtgttggcttcatgaggcttcgatgcagccttaaacgctaaaatccaggccaagcaagatggagatagagagagatg

SEQ ID NO: 29914 - DNA, 3003 bp, Unknown; identical to SEQ ID NO: 26213
  misc_feature (1)..( 3003): 2750-1469P.txt file - cDNA_ID_3023838; gDNA_ID_2214530; Annot_ID_184911

SEQ ID NO: 29915 - DNA, 3000 bp, Unknown; identical to SEQ ID NO: 12087
  misc_feature (1)..( 3000): 2750-1469P.txt file - cDNA_ID_3023846; gDNA_ID_2214530; Annot_ID_184908

SEQ ID NO: 29916 - DNA, 3003 bp, Unknown; identical to SEQ ID NO: 26215
  misc_feature (1)..( 3003): 2750-1469P.txt file - cDNA_ID_3023850; gDNA_ID_2214530; Annot_ID_184907

SEQ ID NO: 29917 - DNA, 3003 bp, Unknown
  misc_feature (1)..( 3003): 2750-1469P.txt file - cDNA_ID_3023854; gDNA_ID_2214530; Annot_ID_184904
tgtatcacatatcaatgtccatatgtgatttgagcataggaataccaaatatggatgaccaaatgtctcctactaattaataaaatattatctatttaatatttaaaaacattttaactcttcgaaaaactaaaaagtaaacaagattcacacaaaaatatgaacgtcattaacacaaaagatgtgaactctggttagtgttgaagataacgtgaaacaagattcaaatcctcgtggaagagcaccaatcgatcaccagaatcaaacctttgagcttcctcctagcttcggtaacgtttaatctcacctgattctcgtttttcttctcttcctgttgaatgtttgtgaacatagatatatataaagctgagatagatatagattcatgcttcaacggaaaagcatgaagaggaacaacaacaatcttctaacgaacaagaataagtatgtctatcttaaaacggcgtcgcatccagcaaaaagcatcgctaaagctactctgttcctcgtcacctctctcttcatatctgctggtctcttagacttattgggttgtttcgatttcgtgagttcgaatctgaagtaacttcttttttagaaactttttattcaatcaagtgaatcttgaacttgaagagttaataaattcatatctctctgtacttcagacaacttttacaggtctgaagcaggtaacaactagtatcagaaaatcaccaatcacaagccaaagattccctaaccaatgcggcgtcgttcagaaccaaactcaattatttccccaaaatggctcctcgagaaacaacgacaaacccagaagcagccattcaagaatatccacgtgtccttcttacttccgttggatccacgaagatctacggccatggaaagagacaggtgtaacgagagggatgcttgagaaagccaggaggacggcgcatttcagagtagtaatcctcgacgggagagtgtacgttaagaaatatagaaagtcaatccaaacaagagacgtttttactctgtggggcatcgtacagttactacggtggtacccaggtaggttaccggatcttgagctcatgtttgacccagatgatagaccaaccgtccgatctaaagactttcaaggtcaacaacacccggccccgcctcctttgttccgttattgctctgatgacgccagcttggatattgtcttccctgattggtccttctggggctggtaagggcttaacacacatgttaattctattctgttctctatttaatgggcttgttattggacctagctaattatattattattgggctagggctgaggttaatataaagccttgggataaatcgctagtggcgatagaagaagggaataagatgactcaatggaaagaccgcgtggcgtatgcttattggagaggaaaccctaatgtggctccaactagaagagatcttctcagatgtaatgtctcagctcaagaagattggaacacacgtctctacattcaggttaggatttctcaaaatatgtataatttttatatattgcaatttttaaataatctaaatgatcaaaaatgtttattattgtgaaggattgggatagagagtcaagagaaggattcaagaactctaacctagagaaccaatgcacccacaggtttaacttaagccacactttttgtacttaggaaatatttgcaaagattcgattttaaatgtgtgataatgatggaataggtacaagatttatatagaaggatgggcatggtcagtgagtgagaaatatataatggcatgtgattcaatgacattgtacgtgagacctatgttctatgatttttacgtacgaggaatgatgccattacaacattactggccaatcagagacacctctaagtgtacttccctcaaattcgccgtacattgggggaatactcatttggaccaggtttgtatttttttttttacattaagacccaaaaagttttgttttgtaacaaattaacacattgagtgtggttttttttttttatataggcgagtaagataggagaagaagggagtaggtttattagagaggaagtgaaaatggaatatgtgtatgactacatgttccatttgatgaacgagtatgcaaaacttttgaagtttaaaccagagattccgtggggagccacggagattacgccggatattatgggctgctcggcgacgggacggtggagagatttcatggaggagtctatggttatgtttcctagtgaagagtctccttgtgagatgccttctccttttaaccctcatgatttaaaagagattcttgagagaaaaactaatttgactcgtcaagttgagtggtgggaagatcaatattttcatgatttagccaatatcaagaagccttgaccaaaaaggctcttgtgtttgtttagatgattgagttgtattcatatattgaaattagtgaaaagtaaacgagtaattttttttccgactagtatgtgtctctatctccactagcgatcttttttccgactagtatgttaattgagttgtatattctaatgttttagtaaatgttataagtttagttctattttttttaaaaactttactaagatatttatttaggttggaattttttaaaattaaattcattaaaattataagaacaaaaataaaatagtatgttctaaaagtataatgatgtttttatagtatcagaccttgttaattttcaaatcatataaaatgtaaagatttatattctaatttaacttgcattaaaaaatctatagcattgaatatataggcaactgaaatagttcattttggtaataataaggtaaattaagaacatcaaaatttggtatctgtagatattagaaagaaaaaaatgtgtgtttggtaagtggttcaaagagaatgaaaataagaaaaatatgtgtttgataaatgtgatggtagaattaaataataaaaaatataaagttgagaaaaatg

SEQ ID NO: 29918 - DNA, 3003 bp, Unknown; identical to SEQ ID NO: 25789
  misc_feature (1)..( 3003): 2750-1469P.txt file - cDNA_ID_3023858; gDNA_ID_2214530; Annot_ID_184901

SEQ ID NO: 29919 - DNA, 3003 bp, Unknown; identical to SEQ ID NO: 25788
  misc_feature (1)..( 3003): 2750-1469P.txt file - cDNA_ID_3023862; gDNA_ID_2214530; Annot_ID_184897

SEQ ID NO: 29920 - DNA, 3003 bp, Unknown; identical to SEQ ID NO: 24875
  misc_feature (1)..( 3003): 2750-1469P.txt file - cDNA_ID_3023870; gDNA_ID_2214530; Annot_ID_184892

SEQ ID NO: 29921 - DNA, 3000 bp, Unknown; identical to SEQ ID NO: 12075
  misc_feature (1)..( 3000): 2750-1469P.txt file - cDNA_ID_3023874; gDNA_ID_2214530; Annot_ID_184891

SEQ ID NO: 29922 - DNA, 3000 bp, Unknown; identical to SEQ ID NO: 12108
  misc_feature (1)..( 3000): 2750-1469P.txt file - cDNA_ID_3023903; gDNA_ID_2214531; Annot_ID_134290

SEQ ID NO: 29923 - DNA, 3000 bp, Unknown; identical to SEQ ID NO: 12108
  misc_feature (1)..( 3000): 2750-1469P.txt file - cDNA_ID_3023903; gDNA_ID_2214531; Annot_ID_184943

SEQ ID NO: 29924 - DNA, 3000 bp, Unknown; identical to SEQ ID NO: 12111
  misc_feature (1)..( 3000): 2750-1469P.txt file - cDNA_ID_3023916; gDNA_ID_2214531; Annot_ID_134283

SEQ ID NO: 29925 - DNA, 3000 bp, Unknown; identical to SEQ ID NO: 12111
  misc_feature (1)..( 3000): 2750-1469P.txt file - cDNA_ID_3023916; gDNA_ID_2214531; Annot_ID_184934

SEQ ID NO: 29926 - DNA, 3000 bp, Unknown; identical to SEQ ID NO: 12103
  misc_feature (1)..( 3000): 2750-1469P.txt file - cDNA_ID_3023924; gDNA_ID_2214531; Annot_ID_184930

SEQ ID NO: 29927 - DNA, 3003 bp, Unknown
  misc_feature (1)..( 3003): 2750-1469P.txt file - cDNA_ID_3023974; gDNA_ID_2214532; Annot_ID_184981
aaatcaaactaatcatatatacaatttgaattcaagttataaattatagaccaaaatattactatccttttttaaatccaaatatggttgtgtgtgtactgttgaaaatcaagctagcatagcactggaatcctataaaacttaagtggactaagcatccacggataagcaataactacacatagaaataaatgagatgacgacaataatatacgtcacattctttggcctgtctctcttatataatccttcttctcattttgtttttctattctcctaatgttttttcagtggaatgccaacgttattatgtagtaatatagtaggagaactgagcaagcagaaccgtaaaacgattctattgttgaccggtttctcttatcttttaattgattaaataatgaattatcttaacgtgtatgttgcttcatatatagtagcttatagtaaaggataccatatcatggtaccccaaaatcaaataaaatgttctactacatggagaattttaaatgtttgaaataataattaatctaaattatactgtagttgcttatatagaatcacaattagttttttacggactaaaattaaataaagattgatgaaaaaaactatatcacatgtgtttgagaatcaccttacaaatgggccataggcttagaactgaagctctttggcccaaactaaaactatatttacttcatagttttattttcattaccaataagttgtatgaaaatatattttccagaatttctgatatttattttgttaagagtttctgtaaactttagttagtttgaagaaaataggtacaagttcaaaattttctaacaaaaaacagagcttttcaaaaatttacaaagctttcgatatatattttttttttttaggtttcgatattttgttttgttgttgttgttgtaagttgtagataattttggataataataaacatgttatcggagacttgaatgttaattacgatagtatgagaaacactacttcttttttttttggccaaaacatgagaaacattacttaaaaaagtatttccattcaacatcttttcaaaaaaatatgagaaacattacttaaaaaagtattgggaaccaccgaaaaatttaacatttcctcgtcagaaactgtcggttgtgccaaatagctagtgaaaataagaatatacaattcgactactggacaatgaatcataaggtcgagttttacgcaggcagataagatatgcttcttggtagtaactagctaggaaatcgactatggttttctttcagcggtaataacatgaccaaactatctggtcgtatggtttataggtttatgtttggtcgacatggtgtgtgctttacgtgctaaagtgctgacatgactttgtacctatgcaacaagccaacaaatatcttagtggctcaacagtccaagtcttaaaaggagttcacgaaaatggttttctaaaatgcgattccgctggtcaaaagcttgctacggtctgatattttcagaatgctgaatatgtcaccgactcgctttattacattttcgacatgcttatcacgattgtattgggcctattggctgacgaaaaattatttgtaacagtgcaacaaaccactgttatttgatacttttttaaaaaagatacttaggtaggatctatgattctcagctacatttgtgacagattaattaattatcgtataaattactatgtatccaccaaattagtgaagatgaaagaagatatttgtaaaagacgcgtgacgaggtctcatctatatatcacgtgcatcattttgttttatgtcctttgccgacagtgtctgtgtggtccgtcttagtcgtacactcgtacagagacctgtacctttcattttttcactttgtttatttttaggaatctctaactcctactactactactcttatactattattattatccacacatatctatttcataactggtaataacataaatattttagatcttttttttcgatttcactaagaaaagagtacaaacattatgtataaataaaaattaaatatatttaaaagaaactagtaacgtatgaataaataaagtagggtccaataggaggagccattgacttggaagcatatgagacagttgagaggcccaacagcccatcgccagctggatttcccctaaaagtcacgtgacctctctccccatctttcttcactatctccttccttcccacgtgaccttcctctctctctgtccctcgtccttcttcttcttcttcttcttcttcttcttcctcctccttcctcgatagagccttctccgattatgctctgtgtcctcattgttatctccggtacaatcatttctcttccccgatccttttctattccacgaatttcacatctttcgcatttgatcgtctttatattttatcttgttgattcaatcatacggatctgccggagtaaatgccgttgctctcggtcattgaatttgatatctgtaatgtgggtttttattggttttggtgattatgaggtttcattagtgctctcttgttaaagtttgcattttggagatttgagtttggctctttgatgtgagaatgtacattgaactttttgtgttgttgaatgatgaattgtaccttttgtgcggattttttgaggttactctcttgatattaaattctgtgggccaataacgaattgatgacataaagttgtttttactacagagaacagaacagagtcttcttattttgctcattttaaccaatgtcaaacaaaaacctcgttttaatccatgttacactttcagctaacttctctgtctaacaaaggttaacatgtctttctctcatttagtgcagaaacaagagcagatgggtctaattctacaccaatcaaagctttgttctcgatttagaaagcctcttttggggtaaagagatggtgagaaaataagttatacaaattatctggaagatg

SEQ ID NO: 29928 - DNA, 3003 bp, Unknown
  misc_feature (1)..( 3003): 2750-1469P.txt file - cDNA_ID_3023988; gDNA_ID_2214532; Annot_ID_134313
gattctttggggatttgaacttaggttgtgtgttaagtatgctcagaagaaacatttgaaatcactttcttgataagcctcttgcgttgttatgcactgcttaattatgttaaatccttcttattccacaggcatctttcatgaaaccaggtcataatcatcacgccatggaatcgtgaaacccacatggttatctgagacttgcgccaacaaactcctatgttctgctttgcttgcacctccttctttgccacgattcctgatcatgtaaactgttcatagatcatttattcctatggttattttggaatggacatcctttgttcgattctatttcctccacttcaaatttttgacacagggccaaaccatattacttgcatcttttgatgtttagagtccataacctcaaagtttccaggtgttttctcggtactgttagtaagagaccatgtccatcagtgtttctaatgggtttctaatctaaaatcctaaagaataaaagtccaaaaataaaggaaaacccaataaaattgttaggatcgttcctattttaggatttttaggattttctgaagtgtttagaaacagtgacgtggctagaaatgataggatgaaaatttagacaaaaaaaacaaaaaagaaaaaagcgtgtttctctttcctcttgtcctttctcttttcttttggttctccgacgaaaattaggtgattccaatcgatccctttcgattacaaacttcggcgtatcgaccatgaaatcgggagacaagagccacatgtactcaattttcaaccgctatgtactcaattttcaaccgccgggatgatgatcgacgacgaggttgttcactaaattgattcttcgaaccaaatcgaaaggagtggcaaaaagcttcagaaaagagtagggtggaggctgcttggattaaagagaagtatccagatagaattccggtgagtgtctctcttgtcattgatcgatcatacaataacttgcttaactttcacaacaattatagccttttctctacgcattgtttggaattgtggtgttctctacgcattgttttaaacttctgttgtttaagaaattatagaatatctgcataaagtatgttaaggtttatacgtttattcacatgaacatgaccatgcttctgctatcgaagaagaattgcaattctcatggaaaagcctctgttttttatagtgcttagtaagtatagagactagtaactagaatattattagattggtttatgcatttcttttatggcttttgatgaacaattggtccatatgccattattttcggttatatggtccttatgtgacacattactgttaagtgtttctttctcatctaaacgttgaagagtagtttgattgttgtattgaccgttaagcatttgtactcttactgaaatcttgagagctgtcattttcaggtgtatgtagaattgcagactacattctttaagttcttgagcttggaacaatacttttctcactctacttgtttctgcaattaaatggtaataacaatttctaatgtcagttaaaaatctttcaagttgatttttgtttagctttttctattgaggttcaaacttgtaagcacgcgattgaaaccaactgtagaatgacagatcttgtttgttattctgtctttatgttactttgtgtcatcttctatatacttttacataccttacagggccgcttagtgatcttgaaatggctttaaagaacaaacttatcactgacatgttgtcaaatgcttgaatggtgccttttatgtcttgaaagttagtctttttgtgtcggttaatgcttcttcacttgtttttgttctgttcggttatgaatcttattatcttaagttgtttgtgttctgttctaaattggtttcattgtgctctgttctaattggtttgtgttcgtgttcaaacttcaatagattggtttgtgttctgttctaaatgaatttcaacttcgttttaaggatgatgtccctgtcgagatgcaagagttcaaggaagcataaatagcaagcacatgcaagtgttgttctgttctgtgtataagtgtataggctatggtcgtgtgaagatgcacttgagtttgtgtgtcgaattttgtgagtgtatcaagttttgagagcgtagagtctgtgtcaagttttgagagtcaaatgtatcccaaacactttcacatttttttcaaaatttttttttagttttattagaaactcacttaaggatttttttaatggaccaaaaatttttcaaaaactctacaaaatctctaaactacaaaaatatcaaaattaattaataaaaaatacatagaaaccttacttagaaactaaccaatgtggttgctctgagagtactacaaaaataaaataaaatgtgtaatatacaaattgcaagagaatacataacataacagagaaattcatatgtacagtaattgaaaatcgtcgagtaaaccaattttggtttggataccaattcagtttttggttagattcgggtaattaaattaaaccactcaatgaaggacacgtaagttcttcacgaaccacatctgttcccttaaaaaaaaatctccaagtcccttgcactattctcctctctttctctccatcctccatatttgcagagctcgagattctccttccctatacaactctcatctgtaatcgatacaggtttgtcttctacctcttctctttggttagattcttttataatctccgtcgctgcataactctgactgggttttcttcggcaaattctgatttcgtcgctttgtgttagttttagttccttgatttctaattcactgaattaagaactcgaagtatgtttactgttcctttgatctgagggttaggttcttgtacttgtaagaaacttgcttgttctgtctcatcgttcatgggatttgatatatcatctaattaatttttcttctttgatgaattttcagatg

SEQ ID NO: 29929 - DNA, 3003 bp, Unknown
  misc_feature (1)..( 3003): 2750-1469P.txt file - cDNA_ID_3023988; gDNA_ID_2214532; Annot_ID_184974
caatatttaaaaatattttagaccttcattattaaagtttgtatatttatttgcagtggatgcggaattaccttgttgaaaagttgcggtaataattgcattattataaggtaaaaatgtgcatttagaaaaggataaagtaaccaaagatacaactttcggtgtcgcaaagtaatgataagaaaagaataaaattggttcactgtttcttctctttatttgagtattaataaggtacggaatgaggaacacatgattatgagagcaagtgggggcacatatttgttagcaacaacataggaaatgaaaaatagattcatgtctataaatcttcaattattttcaattttatcttagtaaataataagtcaagagtactgatttaagatccctattatccaatactaacaaaatgtgttaaatcgtaagccctaaaaactctatgatatttgttatagacagagtcaaaacaaaagttcttaacctcttatgctacatctttggattctaccaaatcttcttgcactctttaaaaacgtattacaaaaaaaaaaaaaaaaaaaaaaaaactcaaatgagaatgcaggagtggctagagattttactgattcacactcttattgattcatcatctttatcaccacaaagactcagagtaatgaatagaatcatatcatcacaaggatcagatttgatcaaacaaaaactctctcaacacacttccttcttcggcatcaagctatggatcctcatcacagcttctgcctccatagccttcctcttagttctgataatttctgtcctcctctgtttcatatttcacaggagaagatgtagccaagaaccattcagactaagatcaaagctttgtctacctttatcacacattcccttaactaacaaacaacagattccttataaccgttgcggcgacgatatagagagccagagaatctctcaggttggttggtcctctgctcgtctttcctactacacacgcagcttctcctctaccggcagctttggaagcttcaatgtgtttacgttcatggagatcaagaacgtgacagatagttttgcagatgataatgtgattactaaaggagattcttcaacggtgtatcgcggaatcttgatgggtacagtcactgttgctgtcaaacgattccttccaaggtttttacatttttgcttgatgtcctcgtatatcttagaatcttaatattttgatctgagataaagagtaatagcaggtatgaagataaagatttcattacaaaagctgagatgattgcaaatgttagacacaagaatgttgtgagactccttggatactgcatagaaggagatgagaggtatatagatatataacctatgatgtgtgacttacgttaaaattaatttagactcatacttaagtctgtataaattttagggttcttgtatatgaatacgctgagaaaggcgatttgcacgaatggcttcatggatctgcaggaagaaatcggcctctgacttggagaaagaggatgaagatcattcaaggagtagcaaaagggtttgatgatcaaaccacattttggttttcttgtcttcttttatgcatgaatcattctgatggttaattattaagtttatgttctgatcagccttgcgtatattcacgaggacatcgaaccaaagatcactcatcaagacataagaccaagcaagattcttcttgattatcaatggaaccctaagatacttgatgttggattcattggtcacagtgatattccaactttgattccttcacctggtaatatggatgagaaaatcgacgtttattcctttgggaatatgataatggagcttgtctctgggagagtctctgtagaccaaagttcaccacatgtgagagtgtatacacaatacataatttaccaataaaaaccatttttagctaactagaaacactgttgttcttggcaggtttatctagtggactggatcaaagagatggtggcaaatcatatgatagtagatgttcttgatcctagtcttcccgaatttcctacaataaaggaactcaaacggattgtgttgatttccctgcgttgtgttgatcccgagctaaaagagagacctaaaatgggagatgtgattcacatgctccaaccacatgacttgctgctgaataacaatgtaataaaactttttgacattcagtttcttgttccccaagctaaatagttatccttactttgttctttctctgtttccaggcaatacagaaggctcagaagattacccggtcacatgaggtttctgcaataagtatcagacaatgagtcctaagcaagcaataaaatgattgttaatataggatcttctgctttgtattaactaaattaagggttccttttaatttaggtcacagcaggctcagctgtattgattgtgttttgcatcctttccaactttgttatatgacttccctatatatcacatgtgttgctattgatgcaggatagtaatcaggaagataaatttcttgaaccaaatctgtataggaacactgataaaatagaaacaacgattttcacaatcttggtttccaaggaacttgaataacaataaaaactagggatagtataatgaagttacaaatttattactttgacccttcttttacttaaatttccactgttgtttttctttttggaaaattatcttttacaagtttttttgcgtttcattaattctatgttacgaacacaactttttgaccaatttataaaatcggtgagttacaataaccggtagacgagtaaaccgggattttataagtgctctgaagatcaccaaacaatctctcctcacgaagatcttcagcttcaaggacttttaaatcatcgaatctctctgtaagttacgatctccgactgactcttactgggtaaatttcgaaaacttgaaactgggtgtttccgaccgtcgaatcggattcgactagatatg

SEQ ID NO: 29930 - DNA, 3000 bp, Unknown; identical to SEQ ID NO: 12139
  misc_feature (1)..( 3000): 2750-1469P.txt file - cDNA_ID_3024018; gDNA_ID_2214532; Annot_ID_184959

SEQ ID NO: 29931 - DNA, 3003 bp, Unknown
  misc_feature (1)..( 3003): 2750-1469P.txt file - cDNA_ID_3024036; gDNA_ID_2214533; Annot_ID_185011
ataacttttttttgtcaacaaaatatttttggacccttgacctataatctcatgcggtccggaactagtcgggaaaaaccgtttacataacatagtgacaacccatgctgcctcaactatgcttgcaatgcttcgaagttcggacatccagatattgctcgatttgtattgctgccacttttactaccattcggatctctatcttggtgatacgaagatcaagtgtgcatgatcttgaatcaatcctataaaagaaaagctaaagatgatgatgttgttagaggttcttcggagttgcaataacataagcatgttgtattgtcggccaccttaatttcgagttttttctgcttcgtcgttgtcttcttctctcacgacacttatcaacataaacagcaacttatgtctctactatgttttgatccttagtaccccaaaaatattattttaaagcaaatcaacataatcttaatcaaatgtctctcttttcattattcataacattttttttagtctttaaaaccacgcgccttaatgtcaaacagtttcttgattacctttcactttgatttctatagatttttctctctttccgagtaagtatatacttacaacatgtcatacatatatagagtcaaattcgattagaaaagaacattaaagtttagtaccaatgaatgacatgttgcacttgcaatgtctaatatgttttccaagtggattgtttcgatctgtaacttggtaatatggtatgggtcctttaaaatctttaaaataatatcttattttttggattctaatctaaaggatatccatacaagtggtggaccgttaatatagtacttcacgttcacggaagggcagagatcttcccagaagcaaacaaataaaataatttttcgtaacataaatatatatctatctttatatgcgataagctgcggcggatttttttcataaagcgacgtattttttattaagtaaataccataggtaattagatggcaagtgtatcgaagcaggaaaaagtatttaataattttaataaattaattaattactaactagtgttttgtcaactcatgaatttagtatttgaaaatgattattcatgaacttttttgttggtcaacattattgtggaattataagcatttcaaatgaaaactacattttttttcatatcctcaaggatcacgttgagtaaattatctgttttattacccaacaaaagacaagaaaaacaataatatttaaaagtagaggtggaggtggtgagtgcacgtcaatagtgcgatcttctagcaaaacattagtgagttcggacaactggagtctttggttctctgttggagaacgtggaccaacaagctagtgacacataagcttccaaagtagacccctccaaagatctctagttctttaggtgcccaagtgatatacctctctctcaacctctttgaacaactaactcggtcgctacacgttacttactcgcttccaatatttgtttggttcgcttatttttaaaggtcttccccgtgcttcgtgtacaaacaccgatgcaccctcgtcgacatcaattgttgacactttttaagcactaaaagttagttggaggaaattgatccaatgcatattactagagcatctaatatttgtttcgatttcatccgatagaccttctaagttctaaccaacatgttttcaacaccttttgacagaacactagtgtaggccttggaaatttgtagaaagaaagccaaaaaagaaaagaaatttaaggtcattaattattaaaatgttgttaagaacttttaaattaaaaacgggaaaaggactccatctcctcgcatttaacaactcgagatctctaccactattgtacatagacattctataaatctatcggtaacagaccgcaaactcaaacttttgtagtttagggttaggactattttctggtgtaacagacatgtatgtatttagagactgtacgagtgcctcaacttagacatgttcgttttggtaatgttttgagatatataaaagaaaataatgtttacaattatgagatcacaaagtttagaagagtgattgattggattaaattttattctttgaacgtagtccaaaattgacaacaaaaagtgataattgattcgtcttaattaagataaaacaattctcttcatatgattggctactacgtaatttgttatcacgattacaagaataataatacatcattcgtagattacaaccgaatattccatgtctctgatttcctataacacgagtcaacaaagaaaaagaaaaactaaaacgcgcaacaacaacaacaacaacaacaaaagtcaaccgaccaaacaaagggtccgaaaatcaatcgacacgttttgttagtttaccgttcccacgactcgtcgggcagatctctcagcacttgtcggtcctaacttaatgtccttttaacagtaaaattaaaacacaaaccgttttctttgttgaagttaaacgaaccaatttattaaaccgttgacttattccattttatccttttttcgggtaaagaatcaacgagacctgatcaaaccacaacttgaactctttgttgataaggataaaagttaaagtactcaagttttctttcttacaacatcccaagaacttctccaagtgtcgttactgacatcatcaaggtatcaaaacctttcttcctaactatccatttgtctaattaaaaaggttaaaagctaatttaattaaagagttagtactgttttgaatttccccaagtgggaagtctttatttatggcttcacgatttcaaaatccagaaagacaagtagaaaagaaacgtccacgtcggataataaaattaaaattccaactttatttctcgttcacatttgacacttcatcacacgtataaatatcgtcgtgtgtccttagaaatttacacacgaaaagttagttaagcagcaacaaaaaaaaaacatg

SEQ ID NO: 29932 - DNA, 3003 bp, Unknown
  misc_feature (1)..( 3003): 2750-1469P.txt file - cDNA_ID_3024040; gDNA_ID_2214533; Annot_ID_134330
tattttggaattgtgttatatggtggatgtatttgaattaatatttaaaattttttaaaatattattaatatgttgttttaataggggttaaaacttcagttttttaacaattgtctcattgattcgtggtatagcgttacttaacaacaattataaactgtaaaatataaatattttataaaaataaaatttgcaagttttaatatatattacttttacaaaataaatcgtcccgcggtataccgtgggttaaaatctagtactaattttaaactttgattatatttaaataccaaatgtttaatcaatagtgaatcttatgatatttatgagagaaagaaaaaaccatatctgttttgtcaaaaactcttaattacaatcatccacgcaacacaattattgttatatatatatatatatatgtatccttaacccataaacaaattcttcaatacaaaacctgatattcatataatttctgtgctaaatcatggcaagaactgagttgtgtcacgataagccgtttgatccaagccattcattgaacatcctgataaagttgaaagcatcagacacaggtttgagtaatacattaacaatgcctaaagagtttgtagagaaaaacttatttccatggtttagtaaacatcgtcgtgtaaaattgtcacaacacgattcggtacaattgttggatttatacgaatacgattcgaagattacaacaactcttattatgaaaaaagagcaagatggaaatttcaagtttcacggatggagtaacattcttgataaaagaaagttcaagactggtgatattattggattttggtgggataaattttacgatagactcaattttatatcactatcgactgcttgatcgatgaaccggacttcacaacatcatttctcgaatatgaatctcgggtcttgtcatgtttgttcgagtctggttataaatatattcctttggctttgtaagattatgatatatataatttttaagtattaagaaataatcgagagaaacatgtgtaacttaagaaaatcataaaacaaagcataacttaggttttgtatccaatatcttcaggttttattggaatatatgttttatgcaacgggggtcaacaaacaagtttacacatagcataagagatccaaatcaagtaatcaaaggaccgtacaaatcacgaaataccgaactatcatcgttttttgaatccgtatttcttgcgttcatagaagagatcggttttcgcactgccaaggttaacaatcttggggcaaccatctctgtctttctcctgctgtgtacactctttgcagtaataagcatctgagattccaacgccaccgcatataacacaccgaccttggaatgacccgtagttgcattcatcacaaatacgtactagagtacacggacgcacataagaatcacaaatcacgcatttcccatcgcatttctcacacagtcgtccaatagcaattccgggttgtttccggcacatgatcaaatcagggtgatgcttcgccatggcttactggaacagtgtttgatctgcaaaccaaaacaaaagcaaaaagaggtcatttgtctatatactcattcacaaaggaaaaggtgagcaagagatagcttagtaaaagaaaactaataagctccttccaactaaatggagactaggaattaataaaactactgaaaaactaaactctaatcaacagttagagaatcagaaaagaaagtaaaacttcaaaaaagaagcttgtcactaatagtttctcagaggaatttcgtcgaacaccttacatgcatcagttccagccaaaattttctaatttccagttccagaggcctactctactaacccaacaaaatcgtggaagagaaactatcgataagaaatttgaaatttgatcaaactaccgaaagctccatcaataagcatagacattacaaaatacaaaccctaagatttcagagcaacgaaatcagtacacaaaataaacaaaccccagaaaaaggtgaaataaaactcacacaagtaaagggagatctaacttgagccaatagagaagaacgttgcgacgagaaatttccagagcgccaagatcgacgacgaagcaaaaagagcaataaaacgaatcgggtcggattctacacaaataacgaagcatccagattccagtttagtaaagtgggtccaatcagaatctttaaagcccaaagtaaaagcccattattattggaccagattagtttaagttgctccaaaccaaaccggcagtcaaatcaattaaaccatgtcctaatcaatagtacccaatttagacccggtccaaacgttaccgtttatgagtgtgcgcaactagcagctgccactgtcagtgccaaattggtaatttcattgacctagctttgactgagtatcaccacagtgacgtggctttttcacaattataaaaaaaatgatcatattctagacatggaggtaaagtaaagcaaagaatctgcatttttgtattttctctaaggaacaattacaaaatcttgataccttgtgagatcataaagaaggtcgttaactcgttatctattatatttatataccttgaattcttgatacgtttgttttacctttttttctattgataatacgtttgaagtttgttttactgttacacattgattttatatgtgtttcccaaaaccgtttaagtttcagagtccggagcagtaactcgtaattcactaatactggtattaaatgttgttatttatgggtaaagcataaatacttaaattcaattattataagaaaataaattaaaacccgaccccatatttttcgtccttttaaaagatggagtcctcgaaaacattacgtattagtaagttccatgcaaaggacaaacatataataacaacaacttctcttctttactcgtttctctctctctcttttcttttcttttcttcaagcgcttctttaatg

SEQ ID NO: 29933 - DNA, 3003 bp, Unknown
  misc_feature (1)..( 3003): 2750-1469P.txt file - cDNA_ID_3024040; gDNA_ID_2214533; Annot_ID_185008
aagattatgatatatataatttttaagtattaagaaataatcgagagaaacatgtgtaacttaagaaaatcataaaacaaagcataacttaggttttgtatccaatatcttcaggttttattggaatatatgttttatgcaacgggggtcaacaaacaagtttacacatagcataagagatccaaatcaagtaatcaaaggaccgtacaaatcacgaaataccgaactatcatcgttttttgaatccgtatttcttgcgttcatagaagagatcggttttcgcactgccaaggttaacaatcttggggcaaccatctctgtctttctcctgctgtgtacactctttgcagtaataagcatctgagattccaacgccaccgcatataacacaccgaccttggaatgacccgtagttgcattcatcacaaatacgtactagagtacacggacgcacataagaatcacaaatcacgcatttcccatcgcatttctcacacagtcgtccaatagcaattccgggttgtttccggcacatgatcaaatcagggtgatgcttcgccatggcttactggaacagtgtttgatctgcaaaccaaaacaaaagcaaaaagaggtcatttgtctatatactcattcacaaaggaaaaggtgagcaagagatagcttagtaaaagaaaactaataagctccttccaactaaatggagactaggaattaataaaactactgaaaaactaaactctaatcaacagttagagaatcagaaaagaaagtaaaacttcaaaaaagaagcttgtcactaatagtttctcagaggaatttcgtcgaacaccttacatgcatcagttccagccaaaattttctaatttccagttccagaggcctactctactaacccaacaaaatcgtggaagagaaactatcgataagaaatttgaaatttgatcaaactaccgaaagctccatcaataagcatagacattacaaaatacaaaccctaagatttcagagcaacgaaatcagtacacaaaataaacaaaccccagaaaaaggtgaaataaaactcacacaagtaaagggagatctaacttgagccaatagagaagaacgttgcgacgagaaatttccagagcgccaagatcgacgacgaagcaaaaagagcaataaaacgaatcgggtcggattctacacaaataacgaagcatccagattccagtttagtaaagtgggtccaatcagaatctttaaagcccaaagtaaaagcccattattattggaccagattagtttaagttgctccaaaccaaaccggcagtcaaatcaattaaaccatgtcctaatcaatagtacccaatttagacccggtccaaacgttaccgtttatgagtgtgcgcaactagcagctgccactgtcagtgccaaattggtaatttcattgacctagctttgactgagtatcaccacagtgacgtggctttttcacaattataaaaaaaatgatcatattctagacatggaggtaaagtaaagcaaagaatctgcatttttgtattttctctaaggaacaattacaaaatcttgataccttgtgagatcataaagaaggtcgttaactcgttatctattatatttatataccttgaattcttgatacgtttgttttacctttttttctattgataatacgtttgaagtttgttttactgttacacattgattttatatgtgtttcccaaaaccgtttaagtttcagagtccggagcagtaactcgtaattcactaatactggtattaaatgttgttatttatgggtaaagcataaatacttaaattcaattattataagaaaataaattaaaacccgaccccatatttttcgtccttttaaaagatggagtcctcgaaaacattacgtattagtaagttccatgcaaaggacaaacatataataacaacaacttctcttctttactcgtttctctctctctcttttcttttcttttcttcaagcgcttctttaatggcggctgttcaatgtctcactttcctcttcttgtttcttctccaaaacgcgacgtcagcttcacctctccctctcttccggcggccgatccaaagcaaccacagcaacttcgtgaagcatcctcgccgaagtcaggtggttttcccggtgaatcatagtagttgtgatctgttcgccggcgagtgggtgcgggatgagacttacccactttaccggtctaaagaatgcggccgaggaatcatagatccgggattcgactgccagacttacggcagacctgactccgactatctcaagttccggtggaaacctttcaactgcaatgtccctaggttatttaaactcactcacttgtcactagctctactttgttagattaatttggttaatgttaattttagttgtcttgtttttgaggaagaaatattcattttattgataccgaggttataatctgacatccaatagtaaaacttatgctttggcaaatgaatttttggtagggccactataccaaccaagattgtaaatttgattactttatgaaaaagacaaaaacaaattctagctggttataccaagaattgtcatatatatacgatagtatttggatcatacaatgatcccaaattatttgttagtatttaatattttatggttatagacattccttcactacatttttttcataattaggggtattacatacatacaactttataatatatttttctattagttaattatgagagattctccttttctaaatgtgtaataagtacaagtttaacagattcgtttttaacaaaaaacaaattgattttactgttaattaggtggagtttggtacggttaatataataagtacttattattttaaatatgtaatgtcgacgcaatgatttatttatggaacccctttctgattatactccatttgggaaagcagattcaatggagtgaagtttctacaagaaatg

SEQ ID NO: 29934 - DNA, 3003 bp, Unknown; identical to SEQ ID NO: 29932
  misc_feature (1)..( 3003): 2750-1469P.txt file - cDNA_ID_3024044; gDNA_ID_2214533; Annot_ID_185007

SEQ ID NO: 29935 - DNA, 3000 bp, Unknown; identical to SEQ ID NO: 12148
  misc_feature (1)..( 3000): 2750-1469P.txt file - cDNA_ID_3024052; gDNA_ID_2214533; Annot_ID_134328

SEQ ID NO: 29936 - DNA, 3000 bp, Unknown; identical to SEQ ID NO: 12144
  misc_feature (1)..( 3000): 2750-1469P.txt file - cDNA_ID_3024052; gDNA_ID_2214533; Annot_ID_185003

SEQ ID NO: 29937 - DNA, 3000 bp, Unknown; identical to SEQ ID NO: 12143
  misc_feature (1)..( 3000): 2750-1469P.txt file - cDNA_ID_3024056; gDNA_ID_2214533; Annot_ID_185000

SEQ ID NO: 29938 - DNA, 3000 bp, Unknown; identical to SEQ ID NO: 12153
  misc_feature (1)..( 3000): 2750-1469P.txt file - cDNA_ID_3024096; gDNA_ID_2214534; Annot_ID_185035

SEQ ID NO: 29939 - DNA, 3003 bp, Unknown; identical to SEQ ID NO: 25817
  misc_feature (1)..( 3003): 2750-1469P.txt file - cDNA_ID_3024110; gDNA_ID_2214534; Annot_ID_185030

SEQ ID NO: 29940 - DNA, 3003 bp, Unknown
  misc_feature (1)..( 3003): 2750-1469P.txt file - cDNA_ID_3024114; gDNA_ID_2214534; Annot_ID_185029
atgcacattccagtgacaccaacctgtcacaacaattataattcatctgcattttcctcaagaattttatgcgaactgaaagaactttgtttaagtttagcaccttttttgagccattggattttagccaattaacagaagcgcggatatctttgatagcacctggccaatcaaggccatccattagatgctgtgcctctgcagtatccaaaccaacctttcctcgatacaagctacaaaatataatattgtgagacgatactcaatgaaccataatttacaaaactgaatcttgcagttaaagaagcactcactcaggtataagggctttgaatccaggctcaagttgtgagattttaatagcatggttcttgatctcaaagtcaacaccccaccattcttgaatcaccacaatcccaggcgcatcatctttaccgaccacataggcatcaaatgtctaaccaacagaccacagtgtataagttttctttagagtaaaatcaagattatagaagaatcatacacaaaaaaatagctaaatcaaatgcatttttcacaatcctaataatcaagaaactccaatgttcaagagaaaccagtctatccatggagagagttacaagcaaagcataacatcgccgaaaactctgaccaaaacaatacctaaactgtttatcactatactgatcatttgtgaactgaaacctaaactcacaatcttccttcttaaatcaaccagttctataaccaaacctgataaggactatgattatacggagatcttcagaagtagctaagcaataataacatctcttactctcattcccagtttctctaccacagaacaacactacacaatcctgaagcagaaacgccattgaaatgataaatcaaatataatccatacatcatacacaacagattccgagatttgggggatatcaaaagaaatgatgattttcattcaacggaaaggataaccaaaatttttttttacttcaaaatcaggcactacggatacagtcgaagcttatgatacaccaaacacaaccataaaaatggcactaagtagaaaaaaaactcagggagagacaaaaaagagaagctcttacagtgtcatctctttggatctgaattttcctgaaagctgaatccgccattgatcgcactgataagcgagaaaacgaaggaatcgaggatctatagagcgaagaagtttttccgattgaagaagagaagaatctggatgaggatgacactagtgtacttaacattgtttttgtgtcttgtgaggaaagaaattcttcagagtcaaccccaaacgacacaaaaacgacgacgtatctgtgagtgtgaatctgggcccggtatatttttaaaaatatatgggccattaggcccaaataatcaagtccttttttgtatttgtatttgtatttgcgacgacgataatacgtaaatagtagtttggtaatatccaaaaagccagcatcgcctctgctacggcgttgtctcttttctcccaattattagcttatatcaatataagaaattattttttttgtggattttgtaaccatgacaggaccagcttgattttgtttttgtaagattcgtggtttctcgatttcatgaaaatgactcaatgatttcgtcctttctatagtattttgggttttaaagtcaactagttgacttcaaaacccaaacttaacgtccatatatatacacatacacagtactgtattatgtgtatatatatggacgttaagtttttgaaaataagagatatatagggcttacgaagccaatatctagataagtgatatcggaacaaaaatcaatcacaaaatatctaccaagagatgtcatatgtgatacgtattaactttatatacatatgattagttccatgaatttgaatttaaaaggtatagtgcatgtatcaaagggcatatatagccacatctcaattgggataaatgaaagagttcatcacgtttcttttcaattcccaaaatggcgatgcgaggaaataaaggcaagttattgatttcgctttctataataattttaaatttttgttgtataacaatgataaagaaacgttcttcaacaacaacaaaaaaatgttacgtacgtgactttaatttgcgtgacgactactcatcattcaccacaagagcaaacggaataaaaagacaaactttatcgttatcctaatttgaaccaaaccacaaaatagccaccacaaatagacaaagatatacatacagcgagacacatcatgcaaaaatgtatatatgtagcttagtggatcattaataatgtttagagaaacgatcgaatttaatgagacttattttcgttgaaaaagttttgatagggtgtaacttaatatatagtatcagtctagtgctaaacatctataagttcaaattccaatttctgtgtatattttggcctccattctacaaatctatatttatttaccacaatgtataatctagacatacaatacgttttacaaaaaaataatatgtagtacatacaccatttgtgaagtcatgtatctatttgacaaactagtccaatggaatttgactatgactaatttattattgtcctttctcttgtgtatctttttttttcttcctaactaaacactactacacattatgggttgattggtatccaataccgctgtagtatggagtatattgctttgataataatcaatcaaaggatgctactaaaaacgatattttaagttttatgatttttttttctttcgtaccgctactttatatcgtttttaaactatttttgtatctcttaccgttttttctacttgctaaaaaacttatacgattttgtgtggccaatcggtcctatattttatatatacaagcattcatagacgtgacgacgcattattttacttaaccctatataaacatatccaaaaaccgcaagaaagctcacaagaaatctcctcccatg

SEQ ID NO: 29941 - DNA, 3000 bp, Unknown; identical to SEQ ID NO: 12151
  misc_feature (1)..( 3000): 2750-1469P.txt file - cDNA_ID_3024118; gDNA_ID_2214534; Annot_ID_185026

SEQ ID NO: 29942 - DNA, 3003 bp, Unknown
  misc_feature (1)..( 3003): 2750-1469P.txt file - cDNA_ID_3024137; gDNA_ID_2214535; Annot_ID_185067
caagactttcgaagtagcttggttctgtttgttcaacgttaattgcaccaattgttccactgctatcactgaaacttacctttaaccttaatgtatacaaagttgacacatccatcaaacttgactgtgataattgggaatctttcagtgtattgtgtactgcttggattccgattatagcttttaggtaaaagaaaatttcagtatgcaatgagtcattcatacaccatgttcacataaatgaaaggactggtaacaaaacttaacttctgtttttcttgacacacacaagtacaatccttgataaccttaaaacaacattattgtaccaaaacacagtagaaagtaaaagaaattaaaaagaaacttgatagaacaagcaacatcatatggttcttcatcatgtaagataggcatcgcaatgcaagaagtcccatatagttccaagagcatctcgtagcatctccaaaacacaacccctctcagtgttctgctcctgcagaccacaagtattatcaccataagcctcgcacttccattagagtttctaaaatagtacaagagcacaataatttacctgtattttagtgtcgatgtctttaagcgtcaaactcacctccctcttggtttcccctgttccagtcgtctcattgaatctatcagtctctcttaccctaagccttagagttttatttttgtagatagtagctctaacgtgacaaacttcaaattctttgtatccatcttcagataaagctttaccaaacggccaccttaaaccgccttttacatttggatcaacagttgctgattccaatagcgctttaatgtcacctatctctttatcctgccgatcaaagaaagatcacacaacctaagtctaagaagagcatattatttatccatatattgtaaaatatatataccaaacttgaacttacactgagatacgttatttccctcttagcggtgagcgttagtctcatgtcgagattcttatcaatgcatgacacatcaacaaccaaatgccttacaggattaaggtcgacctatataaaagcaaaactcaagattcaaagttagatattaaaggaagaccaagtaaaaatgtgacatctatcaaattcttgtttgtttttcttgctagtccgagaacaataaagaagagattttactattggttgtagtcactacacacataaaactcgagacttgccttgtacatactgagccgtccatcttccttacgggtacatttacagttgatggttgcattaggacgagaataatgcgatacctaaaaatagaagccaaacccaaattagcacattcaaatgacattcgaagtatagatctaaatctaagaaaatgaaacgagtaccttcacagtgtatgtttccttctccttatcaatagagaatccatggcttggtacaacattagattttatgtgttgtaagtaagacattgggagatcagtagagaacatcttattcaagttttttagtgaacattcagccacaggaccagcttgactcctggtttaaagttgtatatgttagaaaaaatataaacccattcctgaaaacagcaaaatgtgagatcagacggtgaatcgcttacccatagaagaaaattttaccaaaccgagcaaccagtctcgatacatgatgatgctccttcatttcagtcttaactcgctcatatgccaacacaagatcctccataaccttctcagctactaatagccactgagttctctcatccttcctctctccaatattcatattcactgaatataaacatataaaaaaccatactcaacatagatacaatgcatcttcttttggcaaaaacgataatagcacaaacaaaatagttaatagtattgtttatttcagcatctagatgatattcattttgtcaaacacatagccaaagtctactaatagtttcttaccattttggacattgttgttcatcagtattgaaggcttttctccttttctacactcgacagaatctgaggacaagggcacaaacttaacatacgaaggaacatcgtcctcaattccatttgaaccaacaagaaaccatttggaaatggaatctcctgaatagataatcttgttgcgtttaacactgctagtgctactcttaaagtcaaggttcttcttgaattttgtaacaagagaatctggaacaggggtaggctttgtcggatccttcgaatgcctcttatgtggtggaatataagacatgtctaaacctgaaactcacaacaacatcaaccaaaaacgatttcaagataaaacaaaaaaatctcaaacttggagctcaaataagaattgctttacaacgagcgaagaagaatataaagacagaaactttaaggtgagaagagagaagtcgaatcatacctgtaggctgtagtcgaaactcaacgtcttttaatattcctgcagagaagtaacagtgacactcaaatagactcttcgctccctttttaatctttcaattaactctcatccgtttctcaaaaatgactttaattagattgtgtttggtttcgatagggatcacaattggacaaacctcaagcctgaaactatcaggttcccgaggggtttggtcttaaatgcaggttttattgcaacaaggttttggttttgtaagaatttttcactaaaagtaacaattttttaagtatttctggctatcgaaaaatagaaaaagaaatgttttcttaaaaagtcttttagcgttgaggttctcagactctctctctctctctttgcccctacctatatccgccgtcttgaatccacagaaagtccgttttagtttccagctaagtgatgtcgtcacatatctaatggtggtcggtcactacttaaatgaagacagagaagcttttctagtcttcttctttctaaagttcttacctttagaatttgaacaaaagtatcagcgagctgatcagacagagaagctcaaacaatg

SEQ ID NO: 29943 - DNA, 3 bp, Unknown
  misc_feature (1)..( 3): 2750-1469P.txt file - cDNA_ID_3024161; gDNA_ID_2214535; Annot_ID_185048
gcc

SEQ ID NO: 29944 - DNA, 3003 bp, Unknown; identical to SEQ ID NO: 26225
  misc_feature (1)..( 3003): 2750-1469P.txt file - cDNA_ID_3024189; gDNA_ID_2214536; Annot_ID_185108

SEQ ID NO: 29945 - DNA, 3003 bp, Unknown; identical to SEQ ID NO: 26226
  misc_feature (1)..( 3003): 2750-1469P.txt file - cDNA_ID_3024192; gDNA_ID_2214536; Annot_ID_185107

SEQ ID NO: 29946 - DNA, 3003 bp, Unknown; identical to SEQ ID NO: 21021
  misc_feature (1)..( 3003): 2750-1469P.txt file - cDNA_ID_3024200; gDNA_ID_2214536; Annot_ID_185098

SEQ ID NO: 29947 - DNA, 3000 bp, Unknown; identical to SEQ ID NO: 12196
  misc_feature (1)..( 3000): 2750-1469P.txt file - cDNA_ID_3024204; gDNA_ID_2214536; Annot_ID_185096

SEQ ID NO: 29948 - DNA, 3000 bp, Unknown; identical to SEQ ID NO: 25825
  misc_feature (1)..( 3000): 2750-1469P.txt file - cDNA_ID_3024208; gDNA_ID_2214536; Annot_ID_185094

SEQ ID NO: 29949 - DNA, 3003 bp, Unknown; identical to SEQ ID NO: 21284
  misc_feature (1)..( 3003): 2750-1469P.txt file - cDNA_ID_3024213; gDNA_ID_2214536; Annot_ID_185089

SEQ ID NO: 29950 - DNA, 3003 bp, Unknown; identical to SEQ ID NO: 26227
  misc_feature (1)..( 3003): 2750-1469P.txt file - cDNA_ID_3024222; gDNA_ID_2214536; Annot_ID_185084

SEQ ID NO: 29951 - DNA, 3000 bp, Unknown; identical to SEQ ID NO: 12186
  misc_feature (1)..( 3000): 2750-1469P.txt file - cDNA_ID_3024225; gDNA_ID_2214536; Annot_ID_185080

SEQ ID NO: 29952 - DNA, 3000 bp, Unknown
  misc_feature (1)..( 3000): 2750-1469P.txt file - cDNA_ID_3024231; gDNA_ID_2214536; Annot_ID_185077
tatatatatttatattataatgattgtccaggtcattttctgttgacgaatctgcttctggacaaaatgaaaagtaccgcaagagaaagtggagtccaaggaaggattgtgaatctgtcatctattgctcatacttatacttactctgaaggtatcaagttccaaggcatcaatgaccctgctgggtaagtttgttattcaattttatgctaatgaaacgagactaaatatttttaactgatgtaaacactaattctctatcctatgcattatctagatattcggagagaagggcttatggacagtccaaactctcaaacttgttgcactccaatgcactctctcgtagactacaggtaatatattatttacacattgatatactttaattaaatcaaagtttgatgccataaaatgatgaatatgattttgggatgtaggaagaaggtgtgaacatcactataaattcggtgcaccctggtcttgtcaccactaatctctttcgctactccggttttagcatgagtacgtataccaattctccaatggtcattcaaacacttaaattttaatattttcttatcttaaaatcgacatttacttgcatattcagaggtcttcagggctatgactttcctcttttggaaaaatatacctcaggtgaatttaaaacccttttcaaataaatgttcttatgagattttagtttttattttacaaatataattcttttgggggcattttcagggagcagcaacaacatgctacgttgcacttcatccagatctcgaaggcgtcaccggaaagtatttcggcgactgtaacatcgttgctccgagcaaatttgctaccaacaattctctcgccgataaactttgggatttcagtgtctttctcatcgattctatctctaaataatctatcatcatcaagacaaattcttagacattcaaaatttatttatccttcttgatattgttacattaatgccatatctttttcaccaccacatatttctttatggaataccataatttagaaatcattatccatattttttcttgaataaaattataaaacacaatttgtttgtgtaagaaaataacttttttcatctagtaatctatttatatctcccaaatgaaataacaaaggttatatcataaccagttcatgggcctaaattaatgggcttcgtcggcctcccaaaggcccatagtccttacgacgacggcggaaagagccacaacaattgctgcaaaaaccggcggcacaacgaggtccatcttcgacctccggaaaagattcgccggtaaacacaagacctccgagggaagatccagcggaaccaatatggctgcataagaaccgcaccgccgcgagaacacctcagaagaagacgggaaaatcgccgacacgaaagcgaattccggtgcaagcgagatgatagccaccgttaacgtcagaaacaacgtccacgttgcgccgtagacgaagtgtggaatccgccatgcgaatctgtgagtcagagaggagaacatatggcgaatcattggttttaagttcttaaaagtgttcttcgttctctttatatatttatagttccatcgatcgtaaagagttccgccataggaattggagtagcttcgatgaaaaagagaagtagaaagagaagataacctaatctcttacctgctcttggtgacgaacgaataaggaaaagtgaaaaatacaaaaattatgttatcaatcctaaaattccaaaatataccaagttactagtaaaatttacaaaattatcttaaatgaatttacaaaccttacttaaaagttaaattaaaccgttttagttattaaaggcttgtataatttgtgttttgggttgtgatatatattgtaggatattttattcaagttaaaaacactaaaaaacatctctaacacaaaaggtcccacatatacatgtggatattcacttaaacagaaactgaaatgatttgttctcttctcgtactttcttccaagttgtcatcactcaccagcaactgccacgattttcttcccctttttctttcgatttacataatcactccaaaggttttaatttattcttaaacagtctccatacttttaattatctcatattttcccctcggttaactacaatatccaattttactctcataatttcgtgtaaccgacttaaactgatatttaatatcataaaattatacatagaaattatcatcgcaaccaaaattaatacttactcgaatcaacatttttttttctaaaagcagattgaaatttaagagataaagtaatccggtcaaaaagttacatttaaaaacaagggccagtttgtattttctcacgattcggatattattttccttctttttatctcctaattactattttttccaaaaatataaaaaaatatctgttttttttttctgttttcttttttctttcttcatctctctctattctttgctttgaaaagtaatctggaccgcgaacaaagctttttcgttttctggttcgttgccgccttgcacgttccttcttcttccttctctcccccccatcttatctctttccccccctttaccctaaccctaattttcttcgccgtcctctcttttctctctatctaatttcgttcccatattcgaaatctcttaccttttatctccagatcttttagatccgtaattccctactattgattatacccaaacttttactcttatcttcctcgtttgattcttatgcttccttttatgaattgatttcttcataaagtcatcatctttggattgaattcgactcattaatcaatccgttaaccaataaccaccttgacagtttcttctccgaggattccagattacaattctagtggagctgtaattggattcagatctaactcaagttagtgttactgttgtgtctattggatgcaatcgtgttgtgatattgaatatatttctgatg

SEQ ID NO: 29953 - DNA, 3003 bp, Unknown
  misc_feature (1)..( 3003): 2750-1469P.txt file - cDNA_ID_3024248; gDNA_ID_2214537; Annot_ID_185142
gtggtgactttctaccctttgaggtcttgaagacgaggtttgtgatcacctctgtggcacatagagccactccgcgatagtttccttccaccgctatgatatgttcgtccggatattgaagtacaaactgtttatgaattaaatatcatttcttcaatcaagaaattaaaatttctaaccaaaaaaatcaagaaactaaaattcacgaaaagaacttataattgatcggagcttgtagtataatagtttgttatagtgttgtagtgtgagttttagatatttgatgtagaaaatttggaatgtgatgagagggtaaatgaagtgaagaacctctttgggttgttgaatgattttcccatattcagttgttacgacttggccgtcttccttcacatactcgaatttgacgtaagtgatacgattgatatcttgtcctacatacacttttcttacaccctcatatacatcatcgtcccattcacgccctccttcaccaccgtagcctgtcaacttccggtagattttcgccattttgtattttttcaaatactgtaaaatgaattttttaactaaattatccaaatccaaataaagtgtatattcaagctttataatgtttactaagccgggatcccggatctgtgattggtgatacactagcctattgaattgcatagcaagacatagagagcaatgatcaactaatgagtacctatttacgaaactaaagttgtaatttgtataaacaaatcagaacttgagagagagagaagagagaacctgtaaattcttgatcttattcagaatgaaattaaggaactatcaactatgtctatttattgatacaatttggaacacgtttttgttgattccaataatttagttatacttgtaagttgtaactaaatcatgattgacctttttctgttccctttacttttccttcaaaaagaatatgagaaggaaaacattttacaaggccaaaccaatccccataatttgtaatttaagtcatattagaagagaaatagccaaactaacccaaaatatattagagatctcaagagcatcctggctgcatgttatcattctggacgatatgtcacgagacgagaggttctaacaaataaagcaatagatgattttgataagagtccaataatactagcatattacaagttgtcagatggagacatccatgattgtaatgaacagaggaacaaaacaattttgtttcacaaagaaattttgttataatatttttcatatactgtttacatcgtcgtcccattcacgtcctccttcatcaccgcaaagtgccaacttccgctagatcctcatccattttgaatcaccaaattaatccttaaaaatgaaaaaaaaacaaactaaactatttgttagtccaagtatgaatgcatagctttataatcatttcctaagctggatatgtgattggtaataaactaatactaccatgacaacattgtaccctattcatatacatcgcaataaaataccaaaattttccactaatcgcagatagaggaatcaactaatgcatggtagggtaaatatttatagtgtgatgttgatagctctattataggtgtactatataaatcaatgacgatataagtatactgtatagtattaaacaagccccacacaacaaactgaaattgcatccacatattcatttctcacgtttatttcatctatatatcctaccctacttgctcataaactttcctctcttgtcttaaacttttaacgttacaaagtcacagccacaatattctatcctcaccgatataataatcaccgcaacagtataatcttaccttgatatctattatatggattaaaacccgatttcttactaaacatttgacactttcgcgtagaacataatctgtacatacgaatttcgaattcatatatatatatatatatatatatatatatgttggataatgattgttttctcgaatattgtgtcgatttatagtgtagtcatattttagatagctactccgttcatcaccaatagcttgtttctatggttaatttctttcacttattagatttatctcaaccaatcactcaattagtttctagagattgttgtgattgctatactacatgttaagcactttttatttttgccggatttcttggccaaaagggttggcgatagaagcaactacattaaattcatgacctaagctaaattacatgtaacgatatacaatacaagatttgtctaaactaaacattgattcaaccaaaacttatatagactatatatttaacccaaatacttatcatataaatgttttcttttttgacgtcaacacaaccgtaaacattcgaaatcttatatatttaattatttactatgcttgttatttcatttgtcgacgttgttttttttttttgcattcttcagatccactaagaaaaggcaagtccgaaagataatgggcccaattagtggctatataaaaacccgacccggaaagactaaacctgatccgcaaccgaaccgacccgacgacgctagtataccgtaaaaatttgacaatcttcgtctccggcacaacaaaattgttcttcttcggcaagattcctcgattttctccgtgttctgtaatttccgatagattttgacaactctctttgattgtttccctttagctttttatttttatctgccttttttttttttgttgttgttccggttctattcgtttccttttgttaccttgtttttggttttgatctcaaatcctgctctgctctactatcttcaattcgattcttcatccgaacgaagaagacacaaattggagcttcactggtacatattcttgacgctttatctctgatttgctatttagggcttttcaatgaatgaatttagtttttctgctatgttcattgggaagtaagttcaatcgtatgtgtgatgatttttcaggacgttgatgataaagcatg

SEQ ID NO: 29954 - DNA, 3000 bp, Unknown; identical to SEQ ID NO: 12216
  misc_feature (1)..( 3000): 2750-1469P.txt file - cDNA_ID_3024252; gDNA_ID_2214537; Annot_ID_185138

SEQ ID NO: 29955 - DNA, 3000 bp, Unknown; identical to SEQ ID NO: 12220
  misc_feature (1)..( 3000): 2750-1469P.txt file - cDNA_ID_3024260; gDNA_ID_2214537; Annot_ID_185134

SEQ ID NO: 29956 - DNA, 3000 bp, Unknown; identical to SEQ ID NO: 12212
  misc_feature (1)..( 3000): 2750-1469P.txt file - cDNA_ID_3024264; gDNA_ID_2214537; Annot_ID_185133

SEQ ID NO: 29957 - DNA, 3000 bp, Unknown; identical to SEQ ID NO: 12208
  misc_feature (1)..( 3000): 2750-1469P.txt file - cDNA_ID_3024272; gDNA_ID_2214537; Annot_ID_185128

SEQ ID NO: 29958 - DNA, 3003 bp, Unknown; identical to SEQ ID NO: 26231
  misc_feature (1)..( 3003): 2750-1469P.txt file - cDNA_ID_3024276; gDNA_ID_2214537; Annot_ID_185127
